United States Patent 7,745,391 (HUMAN THROMBOSPONDIN POLYPEPTIDE) - sequence listing, part 284

SEQ ID NO: 886140 - protein, 391 aa, Homo sapiens
MAPGQLALFSVSDKTGLVEFARNLTALGLNLVASGGTAKALRDAGLAVRDVSELTGFPEMLGGRVKTLHPAVHAGILARNIPEDNADMARLDFNLIRVVACNLYPFVKTVASPGVTVEEAVEQIDIGGVTLLRAAAKNHARVTVVCEPEDYVVVSTEMQSSESKDTSLETRRQLALKAFTHTAQYDEAISDYFRKQYSKGVSQMPLRYGMNPHQTPAQLYTLQPKLPITVLNGAPGFINLCDALNAWQLVKELKEALGIPAAASFKHVSPAGAAVGIPLSEDEAKVCMVYDLYKTLTPISAAYARARGADRMSSFGDFVALSDVCDVPTAKIISREVSDGIIAPGYEEEALTILSKKKNGNYCVLQMDNLTTDEMSSNSLGLIKRKKPGPP

SEQ ID NO: 886141 - protein, 112 aa, Homo sapiens
ASSAAVRLAEPSSQYVTEPGEDEDLIKWKALFEEVPELLTEAEKKEWVEKLTEVSISSDAFFPFRDNVDRAKRSGVAYIAAPSGSAADKVVIEACDELGIILAHTNLRLFHH

SEQ ID NO: 886142 - protein, 1045 aa, Homo sapiens
EQVECVQEGVTMETAYSPGNQNGVLDFFFQKPSGFLTLLDEESQMIWSVESNFPKKLQSLLESSNTNAVYSPMKDGNGNVALKDHGTAFTIMHYAGRVMYDVVGAIEKNKDSLSQNLLFVMKTSENVVINHLFQSKLSQTGSLVSAYPSFKFRGHKSALLSKKMTASSIIGENKNYLELSKLLKKKGTSTFLQRLERGDPVTIASQLRKSLMDIIGKLQKCTPHFIHCIRPNNSKLPDTFDNFYVSAQLQYIGVLEMVKIFRYGYPVRLSFSDFLSRYKPLADTFLREKKEQSAAERCRLVLQQCKLQGWQMGVRKVFLKYWHADQLNDLCLQLQRKIITCQKVIRGFLARQHLLQRISIRQQEVTSINSFLQNTEDMGLKTYDALVIQNASDIARENDRLRSEMNAPYHKEKLEVRNMQEEGSKRTDDKSGPRHFHPSSMSVCAAVDGLGQCLVGPSIWSPSLHSVFSMDDSSSLPSPRKQPPPKPKRDPNTRLSASYEAVSACLSAAREAANEALARPRPHSDDYSTMKKIPPRKPKRSPNTKLSGSYEEISGSRPGDARPAGAPGAAARVLTPGTPQCALPPAAPPGDEDDSEPVYIEMLGHAARPDSPDPGESVYEEMKCCLPDDGGPGAGSFLLHGASPPLLHRAPEDEAAGPPGDACDIPPPFPNLLPHRPPLLVFPPTPVTCSPASDESPLTPLEVKKLPVLETNLKYPVQPEGSSPLSPQYSKSQKGDGDRPASPGLALFNGSGRASPPSTPPPPPPPPGPPPAPYRPCAHLAFPPEPAPVNAGKAGPSAEAPKVHPKPNSAPVAGPCSSFPKIPYSPVKATRADARKAGSSASPPAPYSPPSSRPLSSPLDELASLFNSGRSVLRKSAAGRKIREAEGFETNMNISSRDDPSTSEITSETQDRNANNHGIQLSNSLSSAITAENGNSISNGLPEEDGYSRLSISGTGTSTFQRHRDSHTTQVIHQLRLSENESVALQELLDWRRKLCEEGQDWQQILHHAEPRVPPPPPCKKPSLLKKPEGASCNRLPSELWDTTI

SEQ ID NO: 886143 - protein, 532 aa, Homo sapiens
EQVECVQEGVTMETAYSPGNQNGVLDFFFQKPSGFLTLLDEESQMIWSVESNFPKKLQSLLESSNTNAVYSPMKDGNGNVALKDHGTAFTIMHYAGRVMYDVVGAIEKNKDSLSQNLLFVMKTSENVVINHLFQSKLSQTGSLVSAYPSFKFRGHKSALLSKKMTASSIIGENKNYLELSKLLKKKGTSTFLQRLERGDPVTIASQLRKSLMDIIGKLQKCTPHFIHCIRPNNSKLPDTFDNFYVSAQLQYIGVLEMVKIFRYGYPVRLSFSDFLSRYKPLADTFLREKKEQSAAERCRLVLQQCKLQGWQMGVRKVFLKYWHADQLNDLCLQLQRKIITCQKVIRGFLARQHLLQRISIRQQEVTSINSFLQNTEDMGLKTYDALVIQNASDIARENDRLRSEMNAPYHKEKLEVRNMQEEGSKRTDDKSGPRHFHPSSMSVCAAVDGLGQCLVGPSIWSPSLHSVFSMDDSSSLPSPRKQPPPKPKRDPNTRLSASYEAVSACLSAAREAANEGQPWGGTQPRVPGSRML

SEQ ID NO: 886144 - protein, 213 aa, Homo sapiens
SQRPPLYRITWPESHKNNSFGQDRDFSKGNPGLSQPALLPMEDSFLQSFGRLSLQPQQQQQRQRPPRPPPRGTPPRRHSFRKHLYLLRGLPGSGKTTLARQLQHDFPRALIFSTDDFFFREDGAYEFNPDFLEEAHEWNQKRARKAMRNGISPIIIDNTNLHAWEMKPYAVMVFQTEQKNLFRLEMDMVVFRPEMKKHSWCLKRKNPPNERTV

SEQ ID NO: 886145 - protein, 137 aa, Homo sapiens
MRNGISPIIIDNTNLHAWEMKPYAVMALENNYEVIFREPDTRWKFNVQELARRNIHGVSREKIHRMKERYEHDVTFHSVLHAEKPSRMNRNQDRNNALPSNNARYWNSYTEFPNRRAHGGFTNESSYHRRGGCHHGY

SEQ ID NO: 886146 - protein, 228 aa, Homo sapiens
SQRPPLYRITWPESHKNNSFGQDRDFSKGNPGLSQPALLPMEDSFLQSFGRLSLQPQQQQQRQRPPRPPPRGTPPRRHSFRKHLYLLRGLPGSGKTTLARQLQHDFPRALIFSTDDFFFREDGAYEFNPDFLEEAHEWNQKRARKAMRNGISPIIIDNTNLHAWEMKPYAVMALENNYEVIFREPDTRWKFNVQELARQIVSSKWICGLLHQNCLRWLLKSEFMDPIQ

SEQ ID NO: 886147 - protein, 179 aa, Homo sapiens
SQRPPLYRITWPESHKNNSFGQDRDFSKGNPGLSQPALLPMEDSFLQSFGRLSLQPQQQQQRQRPPRPPPRGTPPRRHSFRKHLYLLRGLPGSGKTTLARQLQHDFPRALIFSTDDFFFREDGAYEFNPDFLEEAHEWNQKRGISDRTKESFQAGNGHGSFQARNEETFMVSQEKKSTE

SEQ ID NO: 886148 - protein, 283 aa, Homo sapiens
SQRPPLYRITWPESHKNNSFGQDRDFSKGNPGLSQPALLPMEDSFLQSFGRLSLQPQQQQQRQRPPRPPPRGTPPRRHSFRKHLYLLRGLPGSGKTTLARQLQHDFPRALIFSTDDFFFREDGAYEFNPDFLEEAHEWNQKRARKAMRNGISPIIIDNTNLHAWEMKPYAVMALENNYEVIFREPDTRWKFNVQELARRNIHGVSREKIHRMKERYEHDVTFHSVLHAEKPSRMNRNQDRNNALPSNNARYWNSYTEFPNRRAHGGFTNESSYHRRGGCHHGY

SEQ ID NO: 886149 - protein, 141 aa, Homo sapiens
SQRPPLYRITWPESHKNNSFGQDRDFSKGNPGLSQPALLPMEDSFLQSFGRLSLQPQQQQQRQRPPRPPPRGTPPRRHSFRKHLYLLRGLPGSGKTTLARDDWSEHWPGSLKIVPSDLLRHLLAGDFGQSSSFSGPYVPYM

SEQ ID NO: 886150 - protein, 283 aa, Homo sapiens; identical to SEQ ID NO: 886148

SEQ ID NO: 886151 - protein, 73 aa, Homo sapiens
SQRPPLYRITWPESHKNNSFGQDRDFSKGNPGLSQPALLPMEDSFLQSFGRLSLQPQQQQQRPWQWPGAGSPL

SEQ ID NO: 886152 - protein, 283 aa, Homo sapiens; identical to SEQ ID NO: 886148

SEQ ID NO: 886153 - protein, 283 aa, Homo sapiens; identical to SEQ ID NO: 886148

SEQ ID NO: 886154 - protein, 73 aa, Homo sapiens; identical to SEQ ID NO: 886151

SEQ ID NO: 886155 - protein, 205 aa, Homo sapiens
SQRPPLYRITWPESHKNNSFGQDRDFSKGNPGLSQPALLPMEDSFLQSFGRLSLQPQQQQQRQRPPRPPPRGTPPRRHSFRKHLYLLRGLPGSGKTTLARQLQHDFPRALIFSTDDFFFREDGAYEFNPDFLEEAHEWNQKRGDKFLPKLLGNPDVHIDCSCCRMNKFYGRSLTESSANFSPKTEHQSITSLDSRERKLLIDSGL

SEQ ID NO: 886156 - protein, 220 aa, Homo sapiens
SQRPPLYRITWPESHKNNSFGQDRDFSKGNPGLSQPALLPMEDSFLQSFGRLSLQPQQQQQRQRPPRPPPRGTPPRRHSFRKHLYLLRGLPGSGKTTLARQLQHDFPRALIFSTDDFFFREDGAYEFNPDFLEEAHEWNQKRARKAMRNGISPIIIDNTNLHAWEMKPYAVMALENNYEVIFREPDTRWKFNVQELARRNIHGVSREKIHRMKERESDLM

SEQ ID NO: 886157 - protein, 73 aa, Homo sapiens
RPSCWHAQMWISKQEYDESGPSIVHRKCTKYGLSRCVAFAAWVNLEWKFAPGKCTHLMLASRNWNKPSKRNCP

SEQ ID NO: 886158 - protein, 73 aa, Homo sapiens; identical to SEQ ID NO: 886157

SEQ ID NO: 886159 - protein, 523 aa, Homo sapiens
ITVDQAECGEVSNCTLTGKDCINGFKRDHNGCRTCQCINTEELCSERKQGCTLNCPFGFLTDAQNCEICECRPRPKKCRPIICDKYCPLGLLKNKHGCDICRCKKCPELSCSKICPLGFQQDSHGCLICKCREASASAGPPILSGTCLTVDGHHHKNEESWHDGCRECYCLNGREMCALITCPVPACGNPTIHPGQCCPSCADDFVVQKPELSTPSICHAPGGEYFVEGETWNIDSCTQCTCHSGRVLCETEVCPPLLCQNPSRTQDSCCPQCTDQPFRPSLSRNNSVPNYCKNDEGDIFLAAESWKPDVCTSCICIDSVISCFSESCPSVSCERPVLRKGQCCPYCIEDTIPKKVVCHFSGKAYADEERWDLDSCTHCYCLQGQTLCSTVSCPPLPCVEPINVEGSCCPMCPEMYVPEPTNIPIEKTNHRGEVDLEVPLWPTPSENDIVHLPRDMGHLQVDYRDNRLHPSEDSSLDSIASVVVPIIICLSIIIAFLFINQKKQWIPLLCWYRTPTKVLSCKS

SEQ ID NO: 886160 - protein, 575 aa, Homo sapiens
ITVDQAECGEVSNCTLTGKDCINGFKRDHNGCRTCQCINTEELCSERKQGCTLNCPFGFLTDAQNCEICECRPRPKKCRPIICDKYCPLGLLKNKHGCDICRCKKCPELSCSKICPLGFQQDSHGCLICKCREASASAGPPILSGTCLTVDGHHHKNEESWHDGCRECYCLNGREMCALITCPVPACGNPTIHPGQCCPSCADDFVVQKPELSTPSICHAPGGEYFVEGETWNIDSCTQCTCHSGRVLCETEVCPPLLCQNPSRTQDSCCPQCTDQPFRPSLSRNNSVPNYCKNDEGDIFLAAESWKPDVCTSCICIDSVISCFSESCPSVSCERPVLRKGQCCPYCIEDTIPKKVVCHFSGKAYADEERWDLDSCTHCYCLQGQTLCSTVSCPPLPCVEPINVEGSCCPMCPEMYVPEPTNIPIEKTNHRGEVDLEVPLWPTPSENDIVHLPRDMGHLQVDYRDNRLHPSEDSSLDSIASVVVPIIICLSIIIAFLFINQKKQWIPLLCWYRTPTKPSSLNNQLVSVDCKKGTRVQVDSSQRMLRIAEPDARFSGFYSMQKQNHLQADNFYQTV

SEQ ID NO: 886161 - protein, 278 aa, Homo sapiens
MTGCALKHTMLHSCWPTASSLLTYMFIFPDQPFRPSLSRNNSVPNYCKNDEGDIFLAAESWKPDVCTSCICIDSVISCFSESCPSVSCERPVLRKGQCCPYCIEDTIPKKVVCHFSGKAYADEERWDLDSCTHCYCLQGQTLCSTVSCPPLPCVEPINVEGSCCPMCPEMYVPEPTNIPIEKTNHRGEVDLEVPLWPTPSENDIVHLPRDMGHLQVDYRDNRLHPSEDSSLDSIASVVVPIIICLSIIIAFLFINQKKQWIPLLCWYRTPTKVLSCKS

SEQ ID NO: 886162 - protein, 510 aa, Homo sapiens
ITVDQAECGEVSNCTLTGKDCINGFKRDHNGCRTCQCINTEELCSERKQGCTLNCPFGFLTDAQNCEICECRPRPKKCRPIICDKYCPLGLLKNKHGCDICRCKKCPELSCSKICPLGFQQDSHGCLICKCREASASAGPPILSGTCLTVDGHHHKNEESWHDGCRECYCLNGREMCALITCPVPACGNPTIHPGQCCPSCADDFVVQKPELSTPSICHAPGGEYFVEGETWNIDSCTQCTCHSGRVLCETEVCPPLLCQNPSRTQDSCCPQCTDQPFRPSLSRNNSVPNYCKNDEGDIFLAAESWKPDVCTSCICIDSVISCFSESCPSVSCERPVLRKGQCCPYCIEMYVPEPTNIPIEKTNHRGEVDLEVPLWPTPSENDIVHLPRDMGHLQVDYRDNRLHPSEDSSLDSIASVVVPIIICLSIIIAFLFINQKKQWIPLLCWYRTPTKPSSLNNQLVSVDCKKGTRVQVDSSQRMLRIAEPDARFSGFYSMQKQNHLQADNFYQTV

SEQ ID NO: 886163 - protein, 555 aa, Homo sapiens
MAAAGAAATHLEVARGKRAALFFAAVAIVLGLPLWWKTTETYRASLPYSQISGLNALQLRLMVPVTVVFTRESVPLDDQEKLPFTVVHEREIPLKYKMKIKCRFQKAYRRALDHEEEALSSGSVQEAEAMLDEPQEQAEGSLTVYVISEHSSLLPQDMMSYIGPKRTAVVRGIMHREAFNIIGRRIVQVAQAMSLTEDVLAAALADHLPEDKWSAEKRRPLKSSLGYEITFSLLNPDPKSHDVYWDIEGAVRRYVQPFLNALGAAGNFSVDSQILYYAMLGVNPRFDSASSSYYLDMHSLPHVINPVESRLGSSAASLYPVLNFLLYVPELAHSPLYIQDKDGAPVATNAFHSPRWGGIMVYNVDSKTYNASVLPVRVEVDMVRVMEVFLAQLRLLFGIAQPQLPPKCLLSGPTSEGLMTWELDRLLWARSVENLATATTTLTSLAQLLGKISNIVIKDDVASEVYKAVAAVQKSAEELASGHLASAFVASQEAVTSSELAFFDPSLLHLLYFPDDQKFAIYIPLFLPMAVPILLSLVKIFLETRKSWRKPEKTD

SEQ ID NO: 886164 - protein, 547 aa, Homo sapiens
MPSEVARGKRAALFFAAVAIVLGLPLWWKTTETYRASLPYSQISGLNALQLRLMVPVTVVFTRESVPLDDQEKLPFTVVHEREIPLKYKMKIKCRFQKAYRRALDHEEEALSSGSVQEAEAMLDEPQEQAEGSLTVYVISEHSSLLPQDMMSYIGPKRTAVVRGIMHREAFNIIGRRIVQVAQAMSLTEDVLAAALADHLPEDKWSAEKRRPLKSSLGYEITFSLLNPDPKSHDVYWDIEGAVRRYVQPFLNALGAAGNFSVDSQILYYAMLGVNPRFDSASSSYYLDMHSLPHVINPVESRLGSSAASLYPVLNFLLYVPELAHSPLYIQDKDGAPVATNAFHSPRWGGIMVYNVDSKTYNASVLPVRVEVDMVRVMEVFLAQLRLLFGIAQPQLPPKCLLSGPTSEGLMTWELDRLLWARSVENLATATTTLTSLAQLLGKISNIVIKDDVASEVYKAVAAVQKSAEELASGHLASAFVASQEAVTSSELAFFDPSLLHLLYFPDDQKFAIYIPLFLPMAVPILLSLVKIFLETRKSWRKPEKTD

SEQ ID NO: 886165 - protein, 535 aa, Homo sapiens
LGTPTATTTLTSLAQLLGKISNIVIKDDVASEVYKAVAAVQKSAEELASGHLASAFVASQEAVTSSELAFFDPSLHHLLYFPDDQKFAIYIPLFLPMVCHPPVPGQDLPGDPQVLEKALRRQTVYVISEHSSLLPQDMMSYIGPKRTAVVRGIMHREAFNIIGRRIVQVAQAMSLTEDVLAAALADHLPEDKWSAEKRRPLKSSLGYEITFSLLNPDPKSHDVYWDIEGAVRRYVQPFLNALGAAGNFSVDSQILYYAMLGVNPRFDSASSSYYLDMHSLPHVINPVESRLGSSAASLYPVLNFLLYVPELAHSPLYIQDKDGAPVATNAFHSPRWGGIMVYNVDSKTYNASVLPVRVEVDMVRVMEVFLAQLRLLFGIAQPQLPPKCLLSGPTSEGLMTWELDRLLWARSVENLATATTTLTSLAQLLGKISNIVIKDDVASEVYKAVAAVQKSAEELASGHLASAFVASQEAVTSSELAFFDPSLLHLLYFPDDQKFAIYIPLFLPMAVPILLSLVKIFLETRKSWRKPEKTD

SEQ ID NO: 886166 - protein, 397 aa, Homo sapiens [sequence omitted]

SEQ ID NO: 886167 - protein, 382 aa, Homo sapiens
QCSSSQFCPPFGSMMESSPIPEEKQVQLSWEYRLPLFFDPQEPLTSLTPVSVGYEITFSLLNPDPKSHDVYWDIEGAVRRYVQPFLNALGAAGNFSVDSQILYYAMLGVNPRFDSASSSYYLDMHSLPHVINPVESRLGSSAASLYPVLNFLLYVPELAHSPLYIQDKDGAPVATNAFHSPRWGGIMVYNVDSKTYNASVLPVRVEVDMVRVMEVFLAQLRLLFGIAQPQLPPKCLLSGPTSEGLMTWELDRLLWARSVENLATATTTLTSLAQLLGKISNIVIKDDVASEVYKAVAAVQKSAEELASGHLASAFVASQEAVTSSELAFFDPSLLHLLYFPDDQKFAIYIPLFLPMAVPILLSLVKIFLETRKSWRKPEKTD

SEQ ID NO: 886168 - protein, 555 aa, Homo sapiens; identical to SEQ ID NO: 886163

SEQ ID NO: 886169 - protein, 555 aa, Homo sapiens; identical to SEQ ID NO: 886163

SEQ ID NO: 886170 - protein, 555 aa, Homo sapiens; identical to SEQ ID NO: 886163

SEQ ID NO: 886171 - protein, 555 aa, Homo sapiens; identical to SEQ ID NO: 886163

SEQ ID NO: 886172 - protein, 277 aa, Homo sapiens
MLGVNPRFDSASSSYYLDMHSLPHVINPVESRLGSSAASLYPVLNFLLYVPELAHSPLYIQDKDGAPVATNAFHSPRWGGIMVYNVDSKTYNASVLPVRVEVDMVRVMEVFLAQLRLLFGIAQPQLPPKCLLSGPTSEGLMTWELDRLLWARSVENLATATTTLTSLAQLLGKISNIVIKDDVASEVYKAVAAVQKSAEELASGHLASAFVASQEAVTSSELAFFDPSLLHLLYFPDDQKFAIYIPLFLPMAVPILLSLVKIFLETRKSWRKPEKTD

SEQ ID NO: 886173 - protein, 555 aa, Homo sapiens; identical to SEQ ID NO: 886163

SEQ ID NO: 886174 - protein, 203 aa, Homo sapiens
MSRWGGIMVYNVDSKTYNASVLPVRVEVDMVRVMEVFLAQLRLLFGIAQPQLPPKCLLSGPTSEGLMTWELDRLLWARSVENLATATTTLTSLAQLLGKISNIVIKDDVASEVYKAVAAVQKSAEELASGHLASAFVASQEAVTSSELAFFDPSLLHLLYFPDDQKFAIYIPLFLPMAVPILLSLVKIFLETRKSWRKPEKTD

SEQ ID NO: 886175 - protein, 479 aa, Homo sapiens
SPAPARQRMKRARREGARSGGWGRAWGSLPGSATAGRTPGRAAAGGARTRAEAAQAMRSLGANMAAALRAAGVLLRDPLASSSWRVCQPWRWKSGAAAAAVTTETAQHAQGAKPQVQPQKRKPKTGILMLNMGGPETLGDVHDFLLRLFLDRDLMTLPIQNKLAPFIAKRRTPKIQEQYRRIGGGSPIKIWTSKQGEGMVKLLDELSPNTAPHKYYIGFRYVHPLTEEAIEEMERDGLERAIAFTQYPQYSCSTTGSSLNAIYRYYNQVGRKPTMKWSTIDRWPTHHLLIQCFADHILKELDHFPLEKRSEVVILFSAHSLPMSVVNRGDPYPQEVSATVQKVMERLEYCNPYRLVWQSKVGPMPWLGPQTDESIKGLCERGRKNILLVPIAFTSDHIETLYELDIEYSQVLAKECGVENIRRAESLNGNPLFSKALADLVHSHIQSNELCSKQLTLSCPLCVNPVCRETKSFFTSQQL

SEQ ID NO: 886176 - protein, 446 aa, Homo sapiens
SPAPARQRMKRARREGARSGGWGRAWGSLPGSATAGRTPGRAAAGGARTRAEAAQAMRSLGANMAAALRAAGVLLRDPLASSSWRVCQPWRWKSGAAAAAVTTETAQHAQGAKPQVQPQKRKPKTGILMLNMGGPETLGDVHDFLLRLFLDRDLMTLPIQNKLAPFIAKRRTPKIQEQYRRIGGGSPIKIWTSKQGEGMVKLLDELSPNTAPHKYYIGFRYVHPLTEEAIEEMERDGLERAIAFTQYPQYSCSTTGSSLNAIYRYYNQVGRKPTMKWSTIDRWPTHHLLIQVVNRGDPYPQEVSATVQKVMERLEYCNPYRLVWQSKVGPMPWLGPQTDESIKGLCERGRKNILLVPIAFTSDHIETLYELDIEYSQVLAKECGVENIRRAESLNGNPLFSKALADLVHSHIQSNELCSKQLTLSCPLCVNPVCRETKSFFTSQQL

SEQ ID NO: 886177 - protein, 371 aa, Homo sapiens
MARYEAGWFLRLFLEQTHDTSYSEGSREHLQEFQAFLLRLFLDRDLMTLPIQNKLAPFIAKRRTPKIQEQYRRIGGGSPIKIWTSKQGEGMVKLLDELSPNTAPHKYYIGFRYVHPLTEEAIEEMERDGLERAIAFTQYPQYSCSTTGSSLNAIYRYYNQVGRKPTMKWSTIDRWPTHHLLIQCFADHILKELDHFPLEKRSEVVILFSAHSLPMSVVNRGDPYPQEVSATVQKVMERLEYCNPYRLVWQSKVGPMPWLGPQTDESIKGLCERGRKNILLVPIAFTSDHIETLYELDIEYSQVLAKECGVENIRRAESLNGNPLFSKALADLVHSHIQSNELCSKQLTLSCPLCVNPVCRETKSFFTSQQL

SEQ ID NO: 886178 - protein, 355 aa, Homo sapiens
SPAPARQRMKRARREGARSGGWGRAWGSLPGSATAGRTPGRAAAGGARTRAEAAQAMRSLGANMAAALRAAGVLLRDPLDELSPNTAPHKYYIGFRYVHPLTEEAIEEMERDGLERAIAFTQYPQYSCSTTGSSLNAIYRYYNQVGRKPTMKWSTIDRWPTHHLLIQCFADHILKELDHFPLEKRSEVVILFSAHSLPMSVVNRGDPYPQEVSATVQKVMERLEYCNPYRLVWQSKVGPMPWLGPQTDESIKGLCERGRKNILLVPIAFTSDHIETLYELDIEYSQVLAKECGVENIRRAESLNGNPLFSKALADLVHSHIQSNELCSKQLTLSCPLCVNPVCRETKSFFTSQQL

SEQ ID NO: 886179 - protein, 435 aa, Homo sapiens
MKRARREGARSGGWGRAWGSLPGSATAGRTPGRAAAGGARTRAEAAQAMRSLGANMAAALRAAGVLLRDPLASSSWRVCQPWRWKSGAAAAAVTTETAQHAQGAKPQVQPQKRKPKTGILMLNMGGPETLGDVHDFLLRLFLDRDLMTLPIQNKLAPFIAKRRTPKIQEQYRRIGGGSPIKIWTSKQGEGMVKLLDELSPNTAPHKYYIGFRYVHPLTEEAIEEMERDGLERAIAFTQYPQYSCSTTGSSLNAIYRYYNQVGRKPTMKWSTIDRWPTHHLLIQCFADHILKELDHFPLEKRSEVVILFSAHSLPMSVVNRGDPYPQEVSATVQKVMERLEYCNPYRLVWQSKVGPMPWLGPQTDESIKGLCERGRKNILLVPIAFTSDHIETLYELDIEYSQVLAKECGVENIRRAESLNGNPLFSKVSTVLQSF

SEQ ID NO: 886180 - protein, 153 aa, Homo sapiens
MKRARREGARSGGWGRAWGSLPGSATAGRTPGRAAAGGARTRAEAAQAMRSLGANMAAALRAAGVLLRDPLASSSWRVCQPWRWKSGAAAAAVTTETAQHAQGAKPQVQPQKRKPKTGILMLNMGGPETLGDVHDFLLRLFLDRDLMTLPIQK

SEQ ID NO: 886181 - protein, 479 aa, Homo sapiens; identical to SEQ ID NO: 886175

SEQ ID NO: 886182 - protein, 492 aa, Homo sapiens
MKRARREGARSGGWGRAWGSLPGSATAGRTPGRAAAGGARTRAEAAQAMRSLGANMAAALRAAGVLLRDPLASSSWRVCQPWRWKSGAAAAAVTTETAQHAQGAKPQVQPQKRKPKTGILMLNMGGPETLGDVHDFLLRLFLDRDLMTLPIQKKHFSGCQAGIKSTYLYVKWFSKLAPFIAKRRTPKIQEQYRRIGGGSPIKIWTSKQGEGMVKLLDELSPNTAPHKYYIGFRYVHPLTEEAIEEMERDGLERAIAFTQYPQYSCSTTGSSLNAIYRYYNQVGRKPTMKWSTIDRWPTHHLLIQCFADHILKELDHFPLEKRSEVVILFSAHSLPMSVVNRGDPYPQEVSATVQKVMERLEYCNPYRLVWQSKVGPMPWLGPQTDESIKGLCERGRKNILLVPIAFTSDHIETLYELDIEYSQVLAKECGVENIRRAESLNGNPLFSKALADLVHSHIQSNELCSKQLTLSCPLCVNPVCRETKSFFTSQQL

SEQ ID NO: 886183 - protein, 393 aa, Homo sapiens
PAETSPADPGGLEASALLPDGGAAGPNLKFNLQKRKPKTGILMLNMGGPETLGDVHDFLLRLFLDRDLMTLPIQNKLAPFIAKRRTPKIQEQYRRIGGGSPIKIWTSKQGEGMVKLLDELSPNTAPHKYYIGFRYVHPLTEEAIEEMERDGLERAIAFTQYPQYSCSTTGSSLNAIYRYYNQVGRKPTMKWSTIDRWPTHHLLIQCFADHILKELDHFPLEKRSEVVILFSAHSLPMSVVNRGDPYPQEVSATVQKVMERLEYCNPYRLVWQSKVGPMPWLGPQTDESIKGLCERGRKNILLVPIAFTSDHIETLYELDIEYSQVLAKECGVENIRRAESLNGNPLFSKALADLVHSHIQSNELCSKQLTLSCPLCVNPVCRETKSFFTSQQL

SEQ ID NO: 886184 - protein, 157 aa, Homo sapiens [sequence omitted]

SEQ ID NO: 886185 - protein, 437 aa, Homo sapiens
SPAPARQRMKRARREGARSGGWGRAWGSLPGSATAGRTPGRAAAGGARTRAEAAQAMRSLGANMAAALRAAGVLLRDPLASSSWRVCQPWRWKSGAAAAAVTTETAQHAQGAKPQVQPQKRKPKTGILMLNMGGPETLGDVHDFLLRLFLDRDLMTLPIQNKLAPFIAKRRTPKIQEQYRRIGGGSPIKIWTSKQGEGMVKLLDELSPNTAPHKYYIGFRYVHPLTEEAIEEMERDGLERAIAFTQYPQYSCSTTGSSLNAIYRYYNQVGRKPTMKWSTIDRWPTHHLLIQCFADHILKELDHFPLEKRSEVVILFSAHSLPMSVVNRGDPYPQEVSATVQKVMERLEYCNPYRLVWQSKVGPMPWLGPQTDESIKGLCERGRKNILLVPIAFTSDHIETLYELDIEYSQVLAKECGVENIRRAESLNGNPLFSKFL

SEQ ID NO: 886186 - protein, 431 aa, Homo sapiens
DLRSAAYLPKLEVGACGNMKRVNSCVKSDEHVLEELETEGERQLKSLLQHQLDTSVSIEECMSKKESFAPGTMYKPFGKEAAGTMTLSQFQTLHEKDQETASLRELGLNETEILIWKSHVSGEKKTKLRATPEAIQNRLQDIEERISERQRILCLPQRFAKSKQLTRREMEIEKSLFQGADRHSFLKALYYQDEPQKKNKGDPMNNLESFYQEMIMKKRLEEFQLMRGEPFASHSLVSATSVGDSGTAESPSLLQDKGKQAAQGKGPSLHVANVIDFSPEQCWTGPKKLTQPIEFVPEDEIQRNRLSEEEIRKIPMFSSYNPGEPNKVLYLKNLSPRVTERDLVSLFARFQEKKGPPIQFRMMTGRMRGQAFITFPNKEIAWQALHLVNGYKLHGKILVIEFGKNKKQRSNLQATSLISCATGSTTEISGS

SEQ ID NO: 886187 - protein, 423 aa, Homo sapiens
DLRSAAYLPKLEVGACGNMKRVNSCVKSDEHVLEELETEGERQLKSLLQHQLDTSVSIEECMSKKESFAPGTMYKPFGKEAAGTMTLSQFQTLHEKDQETASLRELGLNETEILIWKSHVSGEKKTKLRATPEAIQNRLQDIEERISERQRILCLPQRFAKSKQLTRREMEIEKSLFQGADRHSFLKALYYQDEPQKKNKGDPMNNLESFYQEMIMKKRLEEFQLMRGEPFASHSLVSATSVGDSGTAESPSLLQDKGKQAAQGKGPSLHVANVIDFSPEQCWTGPKKLTQPIEFVPEDEIQRNRLSEEEIRKIPMFSSYNPGEPNKVLYLKNLSPRVTERDLVSLFARFQEKKGPPIQFRMMTGRMRGQAFITFPNKEIAWQALHLVNGYKLHGKILVIEFGKNKKQRSNLQATSLISCATG

SEQ ID NO: 886188 - protein, 423 aa, Homo sapiens; identical to SEQ ID NO: 886187

SEQ ID NO: 886189 - protein, 447 aa, Homo sapiens
DLRSAAYLPKLEVGACGNMKRVNSCVKSDEHVLEELETEGERQLKSLLQHQLDTSVSIEECMSKKESFAPGTMYKPFGKEAAGTMTLSQFQTLHEKDQETASLRELGLNETEILIWKSHVSGEKKTKLRATPEAIQNRLQDIEERISERQRILCLPQRFAKSKQLTRREMEIEKSLFQGADRHSFLKALYYQAYHKKTSADKYMTSMKRKIKLGTKDEPQKKNKGDPMNNLESFYQEMIMKKRLEEFQLMRGEPFASHSLVSATSVGDSGTAESPSLLQDKGKQAAQGKGPSLHVANVIDFSPEQCWTGPKKLTQPIEFVPEDEIQRNRLSEEEIRKIPMFSSYNPGEPNKVLYLKNLSPRVTERDLVSLFARFQEKKGPPIQFRMMTGRMRGQAFITFPNKEIAWQALHLVNGYKLHGKILVIEFGKNKKQRSNLQATSLISCATG

SEQ ID NO: 886190 - protein, 1089 aa, Homo sapiens
MQKKSTGKNNYVEEAEWKQNCLVLKNCLQMVRQIHRNKWREREIGNKFNIKNYKHILTLLSASFKDVKLYEVIIIMCVGFVMYRNNIYNNNTTKRGMGLYRNRVVTLELSECLSEAYVCLVKMCMVSPRATTEEITFKKSKILLNVNITFEIMQKKEWRSKKLEAYQKQYNGSHKSSYIKITMCMDYSNTIKGRDVRNKSDSTSCHLFETHFRRKKEIKGKRMENKYITQTTAIRKLEWYSNTRQNRLKKMLLEIRVKCYNDKRVNTSGRCNNYEIYMHLTVEPKIHEAKTERKGETDEVHKKSWNIQYPFFNNRAPRQKINQEIEDLNNIIRQIDLKDIYRTFHPTSEYIFFSSAYENISKIGHKLKHKTSLNKYKRLKSCKACPLTTWDEVRKQGKVGKLTNMWKSDTLVSDLAGCSSSRLKSQHFGRPKWEDSLDPLRPGIQDQPGQHSKTLSLPKKKKNVSKKKIIREITKPFEMSDNEDTTNQNLQDAAKAVFTGKSIGTNACTSEEKRPGTVAYACNPSTLGGRGGWRSWGQEIETILGNMVKTLSLLKIQKISQAWSWAPVVPATREAEAGEWREPGRQSLQCAKIAPLHSSLGSRARLHLKKKKKKKRKTIALTSLYTLRPWKKKSKLNLEPGERRKYKRLDENKGNRVKKSREKSMQPKVDSIKRSVKLTHLLLDCPGKKENQITKIRNEGGNISTELVEIKKIMKAYYEEFYVNKLSMKWTNSKEDTNYQNQLRSRKLEYNLYQVNRLNEFLKRYPQRRAQAEISFLNEFYKTFNEKLIQILHKLFQKVEEWWTLLTHTTTWKNSEYAQCKKPVTKDYILYDTIYMKCPEWQIYRDRKWISGCLGLAQSWGEWEGLGVTVEVYEVSLEVDESVLKLVVVVIYNSEYTKKPGIVHVKWVNCVVYELYLNKTHKSEGCPSIGKWVNNLWYIYLVQYYAAIKIVKCIYEYIMTYTHVQELCIKLINKMRNMYSMNTFLCKSIHLCIVCMYIDISEVNLRKSWEIDIESYKPLEVGLNRLKEDFHFVKFLKWCDFGVIFTFFIFFLTKKFFKKYSANGMASRIFVRPTLGISSDYTQDKLLFL

SEQ ID NO: 886191 - protein, 198 aa, Homo sapiens
DLRSAAYLPKLEVGACGNMKRVNSCVKSDEHVLEELETEGERQLKSLLQHQLDTSVSIEECMSKKESFAPGTMYKPFGKEAAGTMTLSQFQTLHEKDQETASLRELGLNETEILIWKSHVSGEKKTKLRATPEAIQNRLQDIEERISERQRILCLPQRFAKSKQLTRREMEIENIPQKDKCRQVHDLNEEEDKIRHKR

SEQ ID NO: 886192 - protein, 431 aa, Homo sapiens; identical to SEQ ID NO: 886186

SEQ ID NO: 886193 - protein, 269 aa, Homo sapiens
DLRSAAYLPKLEVGACGNMKRVNSCVKSDEHVLEELETEGERQLKSLLQHQLDTSVSIEECMSKKESFAPGTMYKPFGKEAAGTMTLSQFQTLHEKDQETASLRELGLNETEILIWKSHVSGEKKTKLRATPEAIQNRLQDIEERISERQRILCLPQRFAKSKQLTRREMEIEKSLFQGADRHSFLKALYYQESTVSPRLKCRGMISAHCNLHFPGSSNSRASAFRVAGITDVCHHPWLIFIFLVQTRNTKYSPGTVAHAMLAKLVWNS

SEQ ID NO: 886194 - protein, 329 aa, Homo sapiens
DLRSAAYLPKLEVGACGNMKRVNSCVKSDEHVLEELETEGERQLKSLLQHQLDTSVSIEECMSKKESFAPGTMYKPFGKEAAGTMTLSQFQTLHEKDQETASLRELGLNETEILIWKSHVSGEKKTKLRATPEAIQNRLQDIEERISERQRILCLPQRFAKSKQLTRREMEIEKSLFQGADRHSFLKALYYQAYHKKTSADKYMTSMKRKIKLGTKDEPQKKNKGDPMNNLESFYQEMIMKKRLEEFQLMRGLTSFPREDFQNLSYEGTTSVLGAKWQKRTGRTSTFSILLVSLLSETVFTSSAMYGIPHLLTMSLKFSTRIGKLSFTP

SEQ ID NO: 886195 - protein, 423 aa, Homo sapiens; identical to SEQ ID NO: 886187

SEQ ID NO: 886196 - protein, 424 aa, Homo sapiens
DLRSAAYLPKLEVGACGNMKRVNSCVKSDEHVLEELETEGERQLKSLLQHQLDTSVSIEECMSKKESFAPGTMYKPFGKEAAGTMTLSQFQTLHEKDQETASLRELGLNETEILIWKSHVSGEKKTKLRATPEAIQNRLQDIEERISERQRILCLPQRFAKSKQLTRREMEIEKSLFQGADRHSFLKALYYQDEPQKKNKGDPMNNLESFYQEMIMKKRLEEFQLMRGEPFASHSLVSATSVGDSGTAESPSLLQDKGKQAAQGKGPSLHVANVIDFSPEQCWTGPKKLTQPIEFVPEDEIQRNRLSEEEIRKIPMFSSYNPGEPNKVLYLKNLSPRVTERDLVSLFARFQEKKGPPIQFRMMTGRMRGQAFITFPNKEIAWQALHLVNGYKLHGKILVIEFGKNKKQRSNLQATSLISCATGI

SEQ ID NO: 886197 - protein, 1013 aa, Homo sapiens
MKTSHIIKNQENLLLADLTCWKYKRKFFSLKASDHRQKSESTHMQKKSTGKNNYVEEAEWKQNCLVLKNCLQMVRQIHRNKWREREIGNKFNIKNYKHILTLLSASFKDVKLYEVIIIMCVGFVMYRNNIYNNNTTKRGMGLYRNEGCYIGIKLVFIGSLFCLVKMCMVSPRATTEEITFKKSKILLNVNITFEIMQKKEWRSKKLEAYQKQENGSHKSSYIKITMCMDYSNTIKGRDVRNKSDSTSCHLFETHFRRKKEIKGKRMENKYITQTTAIRKLEWYSNTRQNRLKKMLLEIKSKMFNDKRVNTSGRCNNYTIYMHLTVEPKIHEAKTERKGETDEVHKKSWNIQYPFFNNRAPRQKINQEIEDLNNIIRQIDLKDIYRTFHPTSEYIFFSSAYENISKIGHKLKHKTSLNKYKRLKSCKACPLTTWDEVRKQGKVGKLTNMWKSDTLVSDLAGCSSSRLKSQHFGRPKWEDSLDPLRPGIQDQPGQHSKTLSLPKKKKNVSKKKIIREITKPFEMSDNEDTTNQNLQDAAKAVFTGKSIGTNACTEEEKRPGTVAYACNPSTLGGRGGWRSWGQEIETILGNMVKTLSLLKIQKISQAWSWAPVVPATREAEAGEWREPGRQSLQGAKIAPLHSSLGSRARLHLKKKKKKKRKTIALTSLYTLRPWKKKSKLNLEPGERRKYKRLDENKGNRVKKSREKSMQPKVDSIKRSVKLTHLLLDCPGKKENQITKIRNEGGNISTELVEIKKIMKAYYEEFYVNKLSMKWTNSKEDTNYQNQLRSRKLEYNLYQVNRLNEFLKRYPQRRAQAEISFLNEFYKTFNEKLIQILHKLFQKVEEWGTLLTHTTTWKNSEYAQCKKPVTKDYILYDTIYMKCPEWQIYRDRKWISGCLGLAQSWGEWEGLGVTVEVYEVSLEVDESVLKLVVVVIYNSEYTKKPGIVHVKWVNCVVYELYLNKTHKSEGCPSIGKWVNNLWYIYLVQYYAAIKIVKCIYEYIMTYTHVQGCVLS

SEQ ID NO: 886198 - protein, 424 aa, Homo sapiens; identical to SEQ ID NO: 886196

SEQ ID NO: 886199 - protein, 328 aa, Homo sapiens
DLRSAAYLPKLEVGACGNMKRVNSCVKSDEHVLEELETEGERQLKSLLQHQLDTSVSIEECMSKKESFAPGTMYKPFGKEAAGTMTLSQFQTLHEKDQETASLRELGLNETEILIWKSHVSGEKKTKLRATPEAIQNRLQDIEERISERQRILCLPQRFAKSKQLTRREMEIEKSLFQGADRHSFLKALYYQDEPQKKNKGDPMNNLESFYQEMIMKKRLEEFQLMRGEPFASHSLVSATSVGDSGTAESPSLLQDKGKQAAQGKGPSLHVANVIDFSPEQCWTGPKKLTQPIEFVPEDEIQRNRLSEEEIRKIPMFSSYNPGEPNKV

SEQ ID NO: 886200 - protein, 390 aa, Homo sapiens
GSGRWEPVGPRTQPPRRGRRDRVPGMSLIRKKGFYKQDVNKTAWELPKTYVSPTHVGSGAYGSVCSAIDKRSGEKVAIKKLSRPFQSEIFAKRAYRELLLLKHMQHENVIGLLDVFTPASSLRNFYDFYLVMPFMQTDLQKIMGMEFSEEKIQYLVYQMLKGLKYIHSAGVVHRDLKPGNLAVNEDCELKILDFGLARHADAEMTGYVVTRWYRAPEVILSWMHYNQTVDIWSVGCIMAEMLTGKTLFKGKDYLDQLTQILKVTGVPGTEFVQKLNDKAAKSYIQSLPQTPRKDFTQLFPRASPQAADLLEKMLELDVDKRLTAAQALTHPFFEPFRDPEEETEAQQPFDDSLEHEKLTVDEWKQHIYKEIVNFSPIARKDSRRRSGMKL

SEQ ID NO: 886201 - protein, 83 aa, Homo sapiens
FLRASVPSIPSFEEQRVSLLGPESSMKTDSSGVPGQGLPGVDWGGAAPSEGQHKGRQKWRNSPRKGKPSVHQCPELPDGGTAP

SEQ ID NO: 886202 - protein, 385 aa, Homo sapiens
ASFSVKPPWYPDLRRDRVPGMSLIRKKGFYKQDVNKTAWELPKTYVSPTHVGSGAYGSVCSAIDKRSGEKVAIKKLSRPFQSEIFAKRAYRELLLLKHMQHENVIGLLDVFTPASSLRNFYDFYLVMPFMQTDLQKIMGMEFSEEKIQYLVYQMLKGLKYIHSAGVVHRDLKPGNLAVNEDCELKILDFGLARHADAEMTGYVVTRWYRAPEVILSWMHYNQTVDIWSVGCIMAEMLTGKTLFKGKDYLDQLTQILKVTGVPGTEFVQKLNDKAAKSYIQSLPQTPRKDFTQLFPRASPQAADLLEKMLELDVDKRLTAAQALTHPFFEPFRDPEEETEAQQPFDDSLEHEKLTVDEWKQHIYKEIVNFSPIARKDSRRRSGMKL

SEQ ID NO: 886203 - protein, 390 aa, Homo sapiens; identical to SEQ ID NO: 886200

SEQ ID NO: 886204 - protein, 390 aa, Homo sapiens; identical to SEQ ID NO: 886200

SEQ ID NO: 886205 - protein, 356 aa, Homo sapiens
MSEDVNKTAWELPKTYVSPTHVGSGAYGSVCSAIDKRSGEKVAIKKLSRPFQSEIFAKRAYRELLLLKHMQHENVIGLLDVFTPASSLRNFYDFYLVMPFMQTDLQKIMGMEFSEEKIQYLVYQMLKGLKYIHSAGVVHRDLKPGNLAVNEDCELKILDFGLARHADAEMTGYVVTRWYRAPEVILSWMHYNQTVDIWSVGCIMAEMLTGKTLFKGKDYLDQLTQILKVTGVPGTEFVQKLNDKAAKSYIQSLPQTPRKDFTQLFPRASPQAADLLEKMLELDVDKRLTAAQALTHPFFEPFRDPEEETEAQQPFDDSLEHEKLTVDEWKQHIYKEIVNFSPIARKDSRRRSGMKL

SEQ ID NO: 886206 - protein, 357 aa, Homo sapiens
MDVAAPGAVPLSQLLPGFLLPALRPAAPPYSSSAIDKRSGEKVAIKKLSRPFQSEIFAKRAYRELLLLKHMQHENVIGLLDVFTPASSLRNFYDFYLVMPFMQTDLQKIMGMEFSEEKIQYLVYQMLKGLKYIHSAGVVHRDLKPGNLAVNEDCELKILDFGLARHADAEMTGYVVTRWYRAPEVILSWMHYNQTVDIWSVGCIMAEMLTGKTLFKGKDYLDQLTQILKVTGVPGTEFVQKLNDKAAKSYIQSLPQTPRKDFTQLFPRASPQAADLLEKMLELDVDKRLTAAQALTHPFFEPFRDPEEETEAQQPFDDSLEHEKLTVDEWKQHIYKEIVNFSPIARKDSRRRSGMKL

SEQ ID NO: 886207 - protein, 364 aa, Homo sapiens
GSGRWEPVGPRTQPPRRGRRDRVPGMSLIRKKGFYKQDVNKTAWELPKTYVSPTHVGSGAYGSVCSAIDKRSGEKVAIKKLSRPFQSEIFAKRAYRELLLLKHMQHENVIGLLDVFTPASSLRNFYDFYLVMPFMQTDLQKIMGMEFSEEKIQYLVYQMLKGLKILDFGLARHADAEMTGYVVTRWYRAPEVILSWMHYNQTVDIWSVGCIMAEMLTGKTLFKGKDYLDQLTQILKVTGVPGTEFVQKLNDKAAKSYIQSLPQTPRKDFTQLFPRASPQAADLLEKMLELDVDKRLTAAQALTHPFFEPFRDPEEETEAQQPFDDSLEHEKLTVDEWKQHIYKEIVNFSPIARKDSRRRSGMKL

SEQ ID NO: 886208 - protein, 390 aa, Homo sapiens; identical to SEQ ID NO: 886200

SEQ ID NO: 886209 - protein, 329 aa, Homo sapiens
GSGRWEPVGPRTQPPRRGRRDRVPGMSLIRKKGFYKQDVNKTAWELPKTYVSPTHVGSGAYGSVCSAIDKRSGEKVAIKKLSRPFQSEIFAKRAYRELLLLKHMQHENVIGLLDVFTPASSLRNFYDFYLVMPFMQTDLQKIMGMEFSEEKIQYLVYQMLKGLKYIHSAGVVHRDLKPGNLAVNEDCELKILDFGLARHADAEMTGYVVTRWYRAPEVILSWMHYNQTVDIWSVGCIMAEMLTGKTLFKGKDYLDQLTQILKVTGVPGTEFVQKLNDKAAKSYIQSLPQTPRKDFTQLFPRASPQAIPSLNPSGTLRKRRRPSSRLMIP

SEQ ID NO: 886210 - protein, 282 aa, Homo sapiens
GSGRWEPVGPRTQPPRRGRRDRVPGMSLIRKKGFYKQDVNKTAWELPKTYVSPTHVGSGAYGSVCSAIDKRSGEKVAIKKLSRPFQSEIFAKRAYRELLLLKHMQHENVIGLLDVFTPASSLRNFYDFYLVMPFMQTDLQKIMGMEFSEEKIQYLVYQMLKGLKYIHSAGVVHRDLKPGNLAVNEDCELKILDFGLARHADAEMTGYVVTRWYRAPEVILSWMHYNQTGQILHPVPATDPQEGFHSAVPTGQPPGCGPAGEDAGARRGQAPDGRAGPHPSLL

SEQ ID NO: 886211 - protein, 422 aa, Homo sapiens
AEGKQLRAPFFCAGVAPWGRGRAAPRCASATVGGSGIGRLRGITSSGLKMDNKKRLAYAIIQFLHDQLRHGGLSSDAQESLEVAIQCLETAFGVTVEDSDLALPQTLPEIFEAAATGKEMPQDLRSPARTPPSEEDSAEAERLKTEGNEQMKVENFEAAVHFYGKAIELNPANAVYFCNRAAAYSKLGNYAGAVQDCERAICIDPAYSKAYGRMGLALSSLNKHVEAVAYYKKALELDPDNETYKSNLKIAELKAAGGPQPHGRRGQLRHRRPAEQPWLHEHGFEPNEQSPDSAAHVRHDFGWQQPLGNSRHQPLAERPGQPHPGGPAVCPADAAAEPRVDRAAQEPDPESDAQRQQRRPAGVTLPAPGVTASFPGRPEGSLLVVCHFLLLDCLREGKRETSDLHVKMDFPLLSLPSSTPFL

SEQ ID NO: 886212 - protein, 422 aa, Homo sapiens; identical to SEQ ID NO: 886211

SEQ ID NO: 886213 - protein, 208 aa, Homo sapiens
AEGKQLRAPFFCAGVAPWGRGRAAPRCASATVGGSGIGRLRGITSSGLKMDNKKRLAYAIIQFLHDQLRHGGLSSDAQESLEVAIQCLETAFGVTVEDSDLALPQTLPEIFEAAATGKEMPQDLRSPARTPPSEEDSAEAERLKTEGNEQMKVENFEAAVHFYGKAIELNPANAVYFCNRSRSLQQNSGNYFKPPVQGTFKRGPFLVF

SEQ ID NO: 886214 - protein, 105 aa, Homo sapiens
SSPLLTQGELQEAPSPTGGVGSFDIAGLLNNPGFMSMASNLMNNPQIQQLMSGMISGGNNPLGTPGTSPSQNDLASLIQAGQQFAQQMQQLAPELQLAPELAARP

SEQ ID NO: 886215 - protein, 422 aa, Homo sapiens; identical to SEQ ID NO: 886211

SEQ ID NO: 886216 - protein, 422 aa, Homo sapiens; identical to SEQ ID NO: 886211

SEQ ID NO: 886217 - protein, 391 aa, Homo sapiens
DPRVRIGRLRGITSSGLKMDNKKRLAYAIIQFLHDQLRHGGLSSDAQESLEVAIQCLETAFGVTVEDSDLALPQTLPEIFEAAATGKEMPQDLRSPARTPPSEEDSAEAERLKTEGNEQMKVENFEAAVHFYGKAIELNPANAVYFCNRAAAYSKLGNYAGAVQDCERAICIDPAYSKAYGRMGLALSSLNKHVEAVAYYKKALELDPDNETYKSNLKIAELKAAGGPQPHGRRGQLRHRRPAEQPWLHEHGFEPNEQSPDSAAHVRHDFGWQQPLGNSRHQPLAERPGQPHPGGPAVCPADAAAEPRVDRAAQEPDPESDAQRQQRRPAGVTLPAPGVTASFPGRPEGSLLVVCHFLLLDCLREGKRETSDLHVKMDFPLLSLPSSTPFL

SEQ ID NO: 886218 - protein, 391 aa, Homo sapiens
SVGLGIGRLRGITSSGLKMDNKKRLAYAIIQFLHDQLRHGGLSSDAQESLEVAIQCLETAFGVTVEDSDLALPQTLPEIFEAAATGKEMPQDLRSPARTPPSEEDSAEAERLKTEGNEQMKVENFEAAVHFYGKAIELNPANAVYFCNRAAAYSKLGNYAGAVQDCERAICIDPAYSKAYGRMGLALSSLNKHVEAVAYYKKALELDPDNETYKSNLKIAELKAAGGPQPHGRRGQLRHRRPAEQPWLHEHGFEPNEQSPDSAAHVRHDFGWQQPLGNSRHQPLAERPGQPHPGGPAVCPADAAAEPRVDRAAQEPDPESDAQRQQRRPAGVTLPAPGVTASFPGRPEGSLLVVCHFLLLDCLREGKRETSDLHVKMDFPLLSLPSSTPFL

SEQ ID NO: 886219 - protein, 373 aa, Homo sapiens
MDNKKRLAYAIIQFLHDQLRHGGLSSDAQESLEVAIQCLETAFGVTVEDSDLALPQTLPEIFEAAATGKEMPQDLRSPARTPPSEEDSAEAERLKTEGNEQMKVENFEAAVHFYGKAIELNPANAVYFCNRAAAYSKLGNYAGAVQDCERAICIDPAYSKAYGRMGLALSSLNKHVEAVAYYKKALELDPDNETYKSNLKIAELKAAGGPQPHGRRGQLRHRRPAEQPWLHEHGFEPNEQSPDSAAHVRHDFGWQQPLGNSRHQPLAERPGQPHPGGPAVCPADAAAEPRVDRAAQEPDPESDAQRQQRRPAGVTLPAPGVTASFPGRPEGSLLVVCHFLLLDCLREGKRETSDLHVKMDFPLLSLPSSTPFL

SEQ ID NO: 886220 - protein, 373 aa, Homo sapiens; identical to SEQ ID NO: 886219

SEQ ID NO: 886221 - protein, 427 aa, Homo sapiens
AEGKQLRAPFFCAGVAPWGRGRAAPRCASATVGGSGIGRLRGITSSGLKMDNKKRLAYAIIQFLHDQLRHGGLSSDAQESLEVAIQCLETAFGVTVEDSDLALPQTLPEIFEAAATGKEMPQDLRSPARTPPSEEDSAEAERLKTEGNEQMKVENFEAAVHFYGKAIELNPANAVYFCNRAAAYSKLGNYAGAVQDCERAICIDPAYSKAYGRMGLALSSLNKHVEAVAYYKKALELDPDNETYKSNLKIAELKAAGGPQPHGRRGQLRHRRPAEQPWLHEHGFEPNEQSPDSAAHVRHDFGWQQPLGNSRHQPLAERPGQPHPGGPAVCPADAAAEPRVDRAAQEPDPESDAQRQQRRPAGVTLPAPGVTASFPGRPEGSLLVVCHFLLLDCLREGKRETSDLHVKISSLESRLDCRQRLTRSVKT

SEQ ID NO: 886222 - protein, 378 aa, Homo sapiens
AEGKQLRAPFFCAGVAPWGRGRAAPRCASATVGGSGIGRLRGITSSGLKMDNKKRLAYAIIQFLHDQLRHGGLSSDAQESLEVAIQCLETAFGVTVEDSDLALPQTLPEIFEAAATGKEMPQDLRSPARTPPSEEDSAEAERLKTEGNEQMKVENFEAAVHFYGKAIELNPANAVYFCNRAAAYSKLGNYAGAVQDCERAICIDPAYSKAYGRMGLALSSLNKHVEAVAYYKKALELDPDNETYKSNLKIAELKAAGGPQPHGRRGQLRHRRPAEQPWLHEHGFEPNEQSPDSAAHVRHDFGWQQPLGNSRHQPLAERPGQPHPGGPAVCPADAAAEPRVDRAAQEPDPESDAQRQQRRPAGVTLPAPGVTASFPGRL

SEQ ID NO: 886223 - protein, 286 aa, Homo sapiens
AEGKQLRAPFFCAGVAPWGRGRAAPRCASATVGGSGIGRLRGITSSGLKMDNKKRLAYAIIQFLHDQLRHGGLSSDAQESLEVAIQCLETAFGVTVEDSDLALPQTLPEIFEAAATGKEMPQDLRSPARTPPSEEDSAEAERLKTEGNEQMKVENFEAAVHFYGKAIELNPANAVYFCNRAAAYSKLGNYAGAVQDCERAICIDPAYSKAYGRMGLALSSLNKHVEAVAYYKKALELDPDNETYKSNLKIAELKAAGGPQPHGRRGQLRHRRPAEQPWLHEHACPA

SEQ ID NO: 886224 - protein, 322 aa, Homo sapiens
MTSSGTGASRPMLRRAWKEMPQDLRSPARTPPSEEDSAEAERLKTEGNEQMKVENFEAAVHFYGKAIELNPANAVYFCNRAAAYSKLGNYAGAVQDCERAICIDPAYSKAYGRMGLALSSLNKHVEAVAYYKKALELDPDNETYKSNLKIAELKAAGGPQPHGRRGQLRHRRPAEQPWLHEHGFEPNEQSPDSAAHVRHDFGWQQPLGNSRHQPLAERPGQPHPGGPAVCPADAAAEPRVDRAAQEPDPESDAQRQQRRPAGVTLPAPGVTASFPGRPEGSLLVVCHFLLLDCLREGKRETSDLHVKMDFPLLSLPSSTPFL

SEQ ID NO: 886225 - protein, 414 aa, Homo sapiens
MYHAAFVVFIQWTHESIRAMRTSASVQIPCHGPGSGARVTCLDRECVRKMTLGKLSSSMMSMGVTGVYGDVTVRNDMMDALRHRASRLPGRRVILTELGVAYGGHMEDCRPGPLKEAPEQKRPPSEEDSAEAERLKTEGNEQMKVENFEAAVHFYGKAIELNPANAVYFCNRAAAYSKLGNYAGAVQDCERAICIDPAYSKAYGRMGLALSSLNKHVEAVAYYKKALELDPDNETYKSNLKIAELKAAGGPQPHGRRGQLRHRRPAEQPWLHEHGFEPNEQSPDSAAHVRHDFGWQQPLGNSRHQPLAERPGQPHPGGPAVCPADAAAEPRVDRAAQEPDPESDAQRQQRRPAGVTLPAPGVTASFPGRPEGSLLVVCHFLLLDCLREGKRETSDLHVKMDFPLLSLPSSTPFL

SEQ ID NO: 886226 - protein, 362 aa, Homo sapiens
AEGKQLRAPFFCAGVAPWGRGRAAPRCASATVGGSGIGRLRGITSSGLKMDNKKRLAYAIIQFLHDQLRHGGLSSDAQESLEVAIQCLETAFGVTVEDSDLALPQTLPEIFEAAATGKEMPQDLRSPARTPPSEEDSAEAERLKTEGNEQMKVENFEAAVHFYGKAIELNPANAVYFCNRAAAYSKLGNYAGAVQDCERAICIDPAYSKAYGRMGLALSSLNKHVEAVAYYKKALELDPDNETYKSNLKIAELKAAGGPQPHGRRGQLRHRRPAEQPWLHEHGFEPNEQSPDSAAHVRHDFGWQQPLGNSRHQPLAERPGQPHPGGPAVCPADAAAEPRVDRAAQEPDPDILGLPGSWPSVR

SEQ ID NO: 886227 - protein, 338 aa, Homo sapiens
AEGKQLRAPFFCAGVAPWGRGRAAPRCASATVGGSGIGRLRGITSSGLKMDNKKRLAYAIIQFLHDQLRHGGLSSDAQESLEVAIQCLETAFGVTVEDSDLALPQTLPEIFEAAATGKEMPQDLRSPARTPPSEEDSAEAERLKTEGNEQMKVENFEAAVHFYGKAIELNPANAVYFCNRAAAYSKLGNYAGAVQDCERAICIDPAYSKAYGRMGLALSSLNKHVEAVAYYKKALELDPDNETYKSNLKIAELKAAGGPQPHGRRGQLRHRRPAEQPWLHEHGFEPNEQSPDSAAHVRHDFGWQQPLGNSRHQPLAERPGQPHPGGPAVCPADAAARP

SEQ ID NO: 886228 - protein, 115 aa, Homo sapiens
MTFCPGRLSPGHREGSWAVSVCVPSCCPSVLDVSWARGPPGKLTPPVLGGGHGTPQVPPTLALKQPPGKQPESRTAGSLSGFLRPGGGRRAHGAVVPAAGLSVGASWGSLAPGRL

SEQ ID NO: 886229 - protein, 334 aa, Homo sapiens
AEGKQLRAPFFCAGVAPWGRGRAAPRCASATVGGSGIGRLRGITSSGLKMDNKKRLAYAIIQFLHDQLRHGGLSSDAQESLEVAIQCLETAFGVTVEDSDLALPQTLPEIFEAAATGKEMPQDLRSPARTPPSEEDSAEAERLKTEGNEQMKVENFEAAVHFYGKAIELNPANAVYFCNRAAAYSKLGNYAGAVQDCERAICIDPAYSKAYGRMGLALSSLNKHVEAVAYYKKALELDPDNETYKSNLKIAELKAAGGPQPHGRRGQLRHRRPAEQPWLHEHGFEPNEQSPDSAAPVWVPEAWGWQTSPRRRGPSSRVVSRSILGLPGSWPSVR

SEQ ID NO: 886230 - protein, 77 aa, Homo sapiens
MDNKKRLAYAIIQFLHDQLRHGGLSSDAQESLEVAIQCLETAFGVTVEDSDLALPQTLPEIFEAAATGKVSLDASPA

SEQ ID NO: 886231 - protein, 1234 aa, Homo sapiens
CCRRCCRPRPPRGNGRQVAVEGPPLPSVVCGSWGCLPAQPRRPTPTMVPCWNHGNITRSKAEELLSRTGKDGSFLVRASESISRAYALCVLYRNCVYTYRILPNEDDKFTVQASEGVSMRFFTKLDQLIEFYKKENMGLVTHLQYPVPLEEEDTGDDPEEDTESVVSPPELPPRNIPLTASSCEAKEVPFSNENPRATETSRPSLSETLFQRLQSMDTSGLPEEHLKAIQDYLSTQLAQDSEFVKTGSSSLPHLKKLTTLLCKELYGEVIRTLPSLESLQRLFDQQLSPGLRPRPQVPGEANPINMVSKLSQLTSLLSSIEDKVKALLHEGPESPHRPSLIPPVTFEVKAESLGIPQKMQLKVDVESGKLIIKKSKDGSEDKFYSHKKILQLIKSQKFLNKLVILVETEKEKILRKEYVFADSKKREGFCQLLQQMKNKHSEQPEPDMITIFIGTWNMGNAPPPKKITSWFLSKGQGKTRDDSADYIPHDIYVIGTQEDPLSEKEWLEILKHSLQEITSVTFKTVAIHTLWNIRIVVLAKPEHENRISHICTDNVKTGIANTLGNKGAVGVSFMFNGTSLGFVNSHLTSGSEKKLRRNQNYMNILRFLALGDKKLSPFNITHRFTHLFWFGDLNYRVDLPTWEAETIIQKIKQQQYADLLSHDQLLTERREQKVFLHFEEEEITFAPTYRFERLTRDKYAYTKQKATGMKYNLPSWCDRVLWKSYPLVHVVCQSYGSTSDIMTSDHSPVFATFEAGVTSQFVSKNGPGTVDSQGQIEFLRCYATLKTKSQTKFYLEFHSSCLESFVKSQEGENEEGSEGELVVKFGETLPKLKPIISDPEYLLDQHILISIKSSDSDESYGEGCIALRLEATETQLPIYTPLTHHGELTGHFQGEIKLQTSQGKTREKLYDFVKTERDESSGPKTLKSLTSHDPMKQWEVTSRAPPCSGSSITEIINPNYMGVGPFGPPMPLHVKQTLSPDQQPTAWSYDQPPKDSPLGPCRGESPPTPPGQPPISPKKFLPSTANRGLPPRTQESRPSDLGKNAGDTLPQEDLPLTKPEMFENPLYGSLSSFPKPAPRKDQESPKMPRKEPPPCPEPGILSPSIVLTKAQEADRGEGPGKQVPAPRLRSFTCSSSAEGRAAGGDKSQGKPKTPVSSQAPVPAKRPIKPSRSEINQQTPPTPTPRPPLPVKSPAVLHLQHSKGRDYRDNTELPHHGKHRPEEGPPGPLGRTAMQ

SEQ ID NO: 886232 - protein, 1359 aa, Homo sapiens
LGHGIPRGCQHGRRRTTSLAHPCLLGHASSEVATTLLTSPEPVIPPRGTSAATGHFNCTLRPVARKERAGKKAAAAVAGCMGRWTARAPPSLSFSLSLLLGFCNEEVLRSSVSFSLTERLKQEVSQLSWWQQPRPPRGNGRQVAVEGPPLPSVVCGSWGCLPAQPRRPTPTMVPCWNHGNITRSKAEELLSRTGKDGSFLVRASESISRAYALCVLYRNCVYTYRILPNEDDKFTVQASEGVSMRFFTKLDQLIEFYKKENMGLVTHLQYPVPLEEEDTGDDPEEDTESVVSPPELPPRNIPLTASSCEAKEVPFSNENPRATETSRPSLSETLFQRLQSMDTSGLPEEHLKAIQDYLSTQLAQDSEFVKTGSSSLPHLKKLTTLLCKELYGEVIRTLPSLESLQRLFDQQLSPGLRPRPQVPGEANPINMVSKLSQLTSLLSSIEDKVKALLHEGPESPHRPSLIPPVTFEVKAESLGIPQKMQLKVDVESGKLIIKKSKDGSEDKFYSHKKILQLIKSQKFLNKLVILVETEKEKILRKEYVFADSKKREGFCQLLQQMKNKHSEQPEPDMITIFIGTWNMGNAPPPKKITSWFLSKGQGKTRDDSADYIPHDIYVIGTQEDPLSEKEWLEILKHSLQEITSVTFKTVAIHTLWNIRIVVLAKPEHENRISHICTDNVKTGIANTLGNKGAVGVSFMFNGTSLGFVNSHLTSGSEKKLRRNQNYMNILRFLALGDKKLSPFNITHRFTHLFWFGDLNYRVDLPTWEAETIIQKIKQQQYADLLSHDQLLTERREQKVFLHFEEEEITFAPTYRFERLTRDKYAYTKQKATGMKYNLPSWCDRVLWKSYPLVHVVCQSYGSTSDIMTSDHSPVFATFEAGVTSQFVSKNGPGTVDSQGQIEFLRCYATLKTKSQTKFYLEFHSSCLESFVKSQEGENEEGSEGELVVKFGETLPKLKPIISDPEYLLDQHILISIKSSDSDESYGEGCIALRLEATETQLPIYTPLTHHGELTGHFQGEIKLQTSQGKTREKLYDFVKTERDESSGPKTLKSLTSHDPMKQWEVTSRAPPCSGSSITEIINPNYMGVGPFGPPMPLHVKQTLSPDQQPTAWSYDQPPKDSPLGPCRGESPPTPPGQPPISPKKFLPSTANRGLPPRTQESRPSDLGKNAGDTLPQEDLPLTKPEMFENPLYGSLSSFPKPAPRKDQESPKMPRKEPPPCPEPGILSPSIVLTKAQEADRGEGPGKQVPAPRLRSFTCSSSAEGRAAGGDKSQGKPKTPVSSQAPVPAKRPIKPSRSEINQQTPPTPTPRPPLPVKSPAVLHLQHSKGRDYRDNTELPHHGKHRPEEGPPGPLGRTAMQ

SEQ ID NO: 886233 - protein, 976 aa, Homo sapiens
MFTLSPAPREVIRTLPSLESLQRLFDQQLSPGLRPRPQVPGEANPINMVSKLSQLTSLLSSIEDKVKALLHEGPESPHRPSLIPPVTFEVKAESLGIPQKMQLKVDVESGKLIIKKSKDGSEDKFYSHKKILQLIKSQKFLNKLVILVETEKEKILRKEYVFADSKKREGFCQLLQQMKNKHSEQPEPDMITIFIGTWNMGNAPPPKKITSWFLSKGQGKTRDDSADYIPHDIYVIGTQEDPLSEKEWLEILKHSLQEITSVTFKTVAIHTLWNIRIVVLAKPEHENRISHICTDNVKTGIANTLGNKGAVGVSFMFNGTSLGFVNSHLTSGSEKKLRRNQNYMNILRFLALGDKKLSPFNITHRFTHLFWFGDLNYRVDLPTWEAETIIQKIKQQQYADLLSHDQLLTERREQKVFLHFEEEEITFAPTYRFERLTRDKYAYTKQKATGMKYNLPSWCDRVLWKSYPLVHVVCQSYGSTSDIMTSDHSPVFATFEAGVTSQFVSKNGPGTVDSQGQIEFLRCYATLKTKSQTKFYLEFHSSCLESFVKSQEGENEEGSEGELVVKFGETLPKLKPIISDPEYLLDQHILISIKSSDSDESYGEGCIALRLEATETQLPIYTPLTHHGELTGHFQGEIKLQTSQGKTREKLYDFVKTERDESSGPKTLKSLTSHDPMKQWEVTSRAPPCSGSSITEIINPNYMGVGPFGPPMPLHVKQTLSPDQQPTAWSYDQPPKDSPLGPCRGESPPTPPGQPPISPKKFLPSTANRGLPPRTQESRPSDLGKNAGDTLPQEDLPLTKPEMFENPLYGSLSSFPKPAPRKDQESPKMPRKEPPPCPEPGILSPSIVLTKAQEADRGEGPGKQVPAPRLRSFTCSSSAEGRAAGGDKSQGKPKTPVSSQAPVPAKRPIKPSRSEINQQTPPTPTPRPPLPVKSPAVLHLQHSKGRDYRDNTELPHHGKHRPEEGPPGPLGRTAMQ

SEQ ID NO: 886234 - protein, 1007 aa, Homo sapiens
MVPCWNHGNITRSKAEELLSRTGKDGSFLVRASESISRAYALCVLYRNCVYTYRILPNEDDKFTVQASEGVSMRFFTKLDQLIEFYKKENMGLVTHLQYPVPLEEEDTGDDPEEDTESVVSPPELPPRNIPLTASSCEAKEVPFSNENPRATETSRPSLSETLFQRLQSMDTSGLPEEHLKAIQDYLSTQLAQDSEFVKTGSSSLPHLKKLTTLLCKELYGEVIRTLPSLESLQRLFDQQLSPGLRPRPQVPGEANPINMVSKLSQLTSLLSSIEDKVKALLHEGPESPHRPSLIPPVTFEVKAESLGIPQKMQLKVDVESGKLIIKKSKDGSEDKFYSHKKILQLIKSQKFLNKLVILVETEKEKILRKEYVFADSKKREGFCQLLQQMKNKHSEQPEPDMITIFIGTWNMGNAPPPKKITSWFLSKGQGKTRDDSADYIPHDIYVIGTQEDPLSEKEWLEILKHSLQEITSVTFKTVAIHTLWNIRIVVLAKPEHENRISHICTDNVKTGIANTLGNKGAVGVSFMFNGTSLGFVNSHLTSGSEKKLRRNQNYMNILRFLALGDKKLSPFNITHRFTHLFWFGDLNYRVDLPTWEAETIIQKIKQQQYADLLSHDQLLTERREQKVFLHFEEEEITFAPTYRFERLTRDKYAYTKQKATGMKYNLPSWCDRVLWKSYPLVHVVCQSYGSTSDIMTSDHSPVFATFEAGVTSQFVSKNGPGTVDSQGQIEFLRCYATLKTKSQTKFYLEFHSSCLESFVKSQEGENEEGSEGELVVKFGETLPKLKPIISDPEYLLDQHILISIKSSDSDESYGEGCIALRLEATETQLPIYTPLTHHGELTGHFQGEIKLQTSQGKTREKLYDFVKTERDESSGPKTLKSLTSHDPMKQWEVTSRAPPCSGSSITEIINPNYMGVGPFGPPMPLHVKQTLSPDQQPTAWSYDQPPKDSPLGPCRGESPPTPPGQPPISPKKFLPSTANRGLPPRTQESSEALSELPLSREPRGTA

SEQ ID NO: 886235 - protein, 419 aa, Homo sapiens
MVPCWNHGNITRSKAEELLSRTGKDGSFLVRASESISRAYALCVLYRNCVYTYRILPNEDDKFTVQASEGVSMRFFTKLDQLIEFYKKENMGLVTHLQYPVPLEEEDTGDDPEEDTESVVSPPELPPRNIPLTASSCEAKEVPFSNENPRATETSRPSLSETLFQRLQSMDTSGLPEEHLKAIQDYLSTQLAQDSEFVKTGSSSLPHLKKLTTLLCKELYGEVIRTLPSLESLQRLFDQQLSPGLRPRPQVPGEANPINMVSKLSQLTSLLSSIEDKVKALLHEGPESPHRPSLIPPVTFEVKAESLGIPQKMQLKVDVESGKLIIKKSKDGSEDKFYSHKKILQLIKSQKFLNKLVILVETEKEKILRKEYVFADSKKREGFCQLLQQMKNKHSEQPEPDMITIFIGTWRVGLLVPGS

SEQ ID NO: 886236 - protein, 267 aa, Homo sapiens
TGREGKKRRRCPALATVAWRSGETGTENLSLLGLTVVMSFKREGDDWSQLNVLKKRRVGDLLASYIPEDEALMLRDGRFACAICPHRPVLDTLAMLTAHRAGKKHLSSLQLFYGKKQPGKERKQNPKHQNELRREETKAEAPLLTQTRLITQSALHRAPHYNSCCRRKYRPEAPGPSVSLSPMPPSEVKLQSGKISREPEPAAGPQAEESATVSAPAPMSPTRRRALDHYLTLRSSGWIPDGRGRWVKDENVEFDSDEEEPPDLPLD

SEQ ID NO: 886237 - protein, 251 aa, Homo sapiens
TGREGKKRRRCPALATVAWRSGETGTENLSLLGLTVVMSFKREGDDWSQLNVLKKRRVGDLLASYIPEDEALMLRDGRFACAICPHRPVLDTLAMLTAHRAGKKHLSSLQLFYGKKQPGKERKQNPKHQNELRREETKAEAPLLTQTRLITQSALHRAPHYNSCCRRKYREVKLQSGKISREPEPAAGPQAEESATVSAPAPMSPTRRRALDHYLTLRSSGWIPDGRGRWVKDENVEFDSDEEEPPDLPLD

SEQ ID NO: 886238 - protein, 195 aa, Homo sapiens
MLRDGRFACAICPHRPVLDTLAMLTAHRAGKKHLSSLQLFYGKKQPGKERKQNPKHQNELRREETKAEAPLLTQTRLITQSALHRAPHYNSCCRRKYRPEAPGPSVSLSPMPPSEVKLQSGKISREPEPAAGPQAEESATVSAPAPMSPTRRRALDHYLTLRSSGWIPDGRGRWVKDENVEFDSDEEEPPDLPLD

SEQ ID NO: 886239 - protein, 279 aa, Homo sapiens
GLGREWLKDSWCRFGFSGRIPRSQPFPMAALRSGETGTENLSLLGLTVVMSFKREGDDWSQLNVLKKRRVGDLLASYIPEDEALMLRDGRFACAICPHRPVLDTLAMLTAHRAGKKHLSSLQLFYGKKQPGKERKQNPKHQNELRREETKAEAPLLTQTRLITQSALHRAPHYNSCCRRKYRPEAPGPSVSLSPMPPSEVKLQSGKISREPEPAAGPQAEESATVSAPAPMSPTRRRALDHYLTLRSSGWIPDGRGRWVKDENVEFDSDEEEPPDLPLD

SEQ ID NO: 886240 - protein, 195 aa, Homo sapiens; identical to SEQ ID NO: 886238

SEQ ID NO: 886241 - protein, 173 aa, Homo sapiens
MLTAHRAGKKHLSSLQLFYGKKQPGKERKQNPKHQNELRREETKAEAPLLTQTRLITQSALHRAPHYNSCCRRKYRPEAPGPSVSLSPMPPSEVKLQSGKISREPEPAAGPQAEESATVSAPAPMSPTRRRALDHYLTLRSSGWIPDGRGRWVKDENVEFDSDEEEPPDLPLD

SEQ ID NO: 886242 - protein, 267 aa, Homo sapiens; identical to SEQ ID NO: 886236

SEQ ID NO: 886243 - protein, 267 aa, Homo sapiens; identical to SEQ ID NO: 886236

SEQ ID NO: 886244 - protein, 195 aa, Homo sapiens; identical to SEQ ID NO: 886238

SEQ ID NO: 886245 - protein, 199 aa, Homo sapiens
TGREGKKRRRCPALATVAWRSGETGTENLSLLGLTVVMSFKREGDDWSQLNVLKKRRVGDLLASYIPEDEALMLRDGRFACAICPHRPVLDTLAMLTAHRAGKKHLSSLQLFYGKKQPGKERKQNPKHQNELRREETKAEAPLLTQTRLITQSALHRAPHYNSCCRRKYRPEAPGPSVSLSPMPPSRPRSQQLSQPLHP

SEQ ID NO: 886246 - protein, 220 aa, Homo sapiens
TGREGKKRRRCPALATVAWRSGETGTENLSLLGLTVVMSFKREGDDWSQLNVLKKRRVGDLLASYIPEDEALMLRDGRFACAICPHRPVLDTLAMLTAHRAGKKHLSSLQLFYGKKQPGKERKQNPKHQNELRREETKAEAPLLTQTRLITQSALHRAPHYNSCCRRKYRPEAPGPSVSLSPMPPSPCTHEPHKKTSPGPLSHPSKLWMDPRWTRSMGKR

SEQ ID NO: 886247 - protein, 306 aa, Homo sapiens
TGREGKKRRRCPALATVAWRSGETGTENLSLLGLTVVMSFKREGDDWSQLNVLKKRRVGDLLASYIPEDEALMLRDGRFACAICPHRPVLDTLAMLTAHRAGKKHLSSLQLFYGKKQPGKERKQNPKHQNELRREETKAEAPLLTQTRLITQSALHRAPPPQKQCLPARGRYQPSPPPSSSPFSPLMPHPSRRVHNLPKGGGRIQRGNPNPAGPVPPPEPGEVQPNLLQPPLPTPTAPPERTGAPCGPILSTPFPEALLGGDPPGMGTGGVRSGLKKWKKLWRFLLLLMEGRGPPPLLLPPCGDLE

SEQ ID NO: 886248 - protein, 69 aa, Homo sapiens
DRKRRKKEKALSRSCYGGLEEWRNRNREFITSGTHSRDVFQEGRRRLESTQCAQKKKSRGPPSQLHSRG

SEQ ID NO: 886249 - protein, 199 aa, Homo sapiens
TGREGKKRRRCPALATVAWRSGETGTENLSLLGLTVVMSFKREGDDWSQLNVLKKRRVGDLLASYIPEDEALMLRDGRFACAICPHRPVLDTLAMLTAHRAGKKHLSSLQLFYGKKQPGKERKQNPKHQNELRREETKAEAPLLTQTRLITQSALHRAPHYNSCCRRKYRYGTGKPEVGRLRRRQMALKEFSSVYSEEY

SEQ ID NO: 886250 - protein, 183 aa, Homo sapiens
TGREGKKRRRCPALATVAWRSGETGTENLSLLGLTVVMSFKREGDDWSQLNVLKKRRVGDLLASYIPEDEALMLRDGRFACAICPHRPVLDTLAMLTAHRAGKKHLSSLQLFYGKKQPGKERKQNPKHQNELRREETKAEAPLLTQTRLITQSALHRAPHYNSCCRRKYSRPRSQQLSQPLHP

SEQ ID NO: 886251 - protein, 560 aa, Homo sapiens
MNRKWEAKLKQIEERASHYERKPLSSVYRPRLSKPEEPPSIWRLFHRQAQAFNFVKSCKEDVHVFALECKVGDGQRIYLVTTYAEFWFYYKSRKNLLHCYEVIPENAVCKLYFDLEFNKPANPGADGKKMVALLIEYVCKALQELYGVNCSAEDVLNLDSSTDEKFSRHLIFQLHDVAFKDNIHVGNFLRKILQPALDLLGSEDDDSAPETTGHGFPHFSEAPARQGFSFNKMFTEKATEESWTSNSKKLERLGSAEQSSPDLSFLVVKNNMGEKHLFVDLGVYTRNRNFRLYKSSKIGKRVALEVTEDNKFFPIQSKDVSDEYQYFLSSLVSNVRFSDTLRILTCEPSQNKQKGVGYFNSIGTSVETIEGFQCSPYPEVDHFVLSLVNKDGIKGGIRRWNYFFPEELLVYDICKYRWCENIGRAHKSNNIMILVDLKNEVWYQKCHDPVCKAENFKSDCFPLPAEVCLLFLFKEEEEFTTDEADETRSNETQNPHKPSPSRLSTGASADAVWDNGIDDAYFLEATEDAELAEAAENSLLSYNSEVDEIPDELIIEVLQE

SEQ ID NO: 886252 - protein, 517 aa, Homo sapiens
MNRKWEAKLKQIEERASHYERKPLSSVYRPRLSKPEEPPSIWRLFHRQAQAFNFVKSCKEDVHVFALECKVGDGQRIYLVTTYAEFWFYYKSSMCVKHFKSYTVLIAQLKMFVNLDSSTDEKFSRHLIFQLHDVAFKDNIHVGNFLRKILQPALDLLGSEDDDSAPETTGHGFPHFSEAPARQGFSFNKMFTEKATEESWTSNSKKLERLGSAEQSSPDLSFLVVKNNMGEKHLFVDLGVYTRNRNFRLYKSSKIGKRVALEVTEDNKFFPIQSKDVSDEYQYFLSSLVSNVRFSDTLRILTCEPSQNKQKGVGYFNSIGTSVETIEGFQCSPYPEVDHFVLSLVNKDGIKGGIRRWNYFFPEELLVYDICKYRWCENIGRAHKSNNIMILVDLKNEVWYQKCHDPVCKAENFKSDCFPLPAEVCLLFLFKEEEEFTTDEADETRSNETQNPHKPSPSRLSTGASADAVWDNGIDDAYFLEATEDAELAEAAENSLLSYNSEVDEIPDELIIEVLQE

SEQ ID NO: 886253 - protein, 431 aa, Homo sapiens
MVALLIEYVCKALQELYGVNCSAEDVLNLDSSTDEKFSRHLIFQLHDVAFKDNIHVGNFLRKILQPALDLLGSEDDDSAPETTGHGFPHFSEAPARQGFSFNKMFTEKATEESWTSNSKKLERLGSAEQSSPDLSFLVVKNNMGEKHLFVDLGVYTRNRNFRLYKSSKIGKRVALEVTEDNKFFPIQSKDVSDEYQYFLSSLVSNVRFSDTLRILTCEPSQNKQKGVGYFNSIGTSVETIEGFQCSPYPEVDHFVLSLVNKDGIKGGIRRWNYFFPEELLVYDICKYRWCENIGRAHKSNNIMILVDLKNEVWYQKCHDPVCKAENFKSDCFPLPAEVCLLFLFKEEEEFTTDEADETRSNETQNPHKPSPSRLSTGASADAVWDNGIDDAYFLEATEDAELAEAAENSLLSYNSEVDEIPDELIIEVLQE

SEQ ID NO: 886254 - protein, 385 aa, Homo sapiens
MLNFGFTINPGNFLRKILQPALDLLGSEDDDSAPETTGHGFPHFSEAPARQGFSFNKMFTEKATEESWTSNSKKLERLGSAEQSSPDLSFLVVKNNMGEKHLFVDLGVYTRNRNFRLYKSSKIGKRVALEVTEDNKFFPIQSKDVSDEYQYFLSSLVSNVRFSDTLRILTCEPSQNKQKGVGYFNSIGTSVETIEGFQCSPYPEVDHFVLSLVNKDGIKGGIRRWNYFFPEELLVYDICKYRWCENIGRAHKSNNIMILVDLKNEVWYQKCHDPVCKAENFKSDCFPLPAEVCLLFLFKEEEEFTTDEADETRSNETQNPHKPSPSRLSTGASADAVWDNGIDDAYFLEATEDAELAEAAENSLLSYNSEVDEIPDELIIEVLQE

SEQ ID NO: 886255 - protein, 530 aa, Homo sapiens
MNRKWEAKLKQIEERASHYERKPLSSVYRPRLSKPEEPPSIWRLFHRQAQAFNFVKSCKEDVHVFALECKVGDGQRIYLVTTYAEFWFYYKSRKNLLHCYEVIPENAVCKLYFDLEFNKPANPGADGKKMVALLIEYVCKALQELYGVNCSAEDVLNLDSSTDEKFSRHLIFQLHDVAFKDNIHVGNFLRKILQPALDLLGSEDDDSAPETTGHGFPHFSEAPARQGFSFNKMFTEKATEESWTSNSKKLERLGSAEQSSPDLSFLVVKNNMGEKHLFVDLGVYTRNRNFRLYKSSKIGKRVAWRLLKITNFFLYSQKMFLTNINIFSLLWSAMSVETIEGFQCSPYPEVDHFVLSLVNKDGIKGGIRRWNYFFPEELLVYDICKYRWCENIGRAHKSNNIMILVDLKNEVWYQKCHDPVCKAENFKSDCFPLPAEVCLLFLFKEEEEFTTDEADETRSNETQNPHKPSPSRLSTGASADAVWDNGIDDAYFLEATEDAELAEAAENSLLSYNSEVDEIPDELIIEVLQE

SEQ ID NO: 886256 - protein, 121 aa, Homo sapiens
TPKLIFNEIGFTEVKNFKSDCFPLPAEVCLLFLFKEEEEFTTDEADETRSNETQNPHKPSPSRLSTGASADAVWDNGIDDAYFLEATEDAELAEAAENSLLSYNSEVDEIPDELIIEVLQE

SEQ ID NO: 886257 - protein, 502 aa, Homo sapiens
MNRKWEAKLKQIEERASHYERKPLSSVYRPRLSKPEEPPSIWRLFHRQAQAFNFVKSCKEDVHVFALECKVGDGQRIYLVTTYAEFWFYYKSRKNLLHCYEVIPENAVCKLYFDLEFNKPANPGADGKKMVALLIEYVCKALQELYGVNCSAEDVLNLDSSTDEKFSRHLIFQLHDVAFKDNIHVGNFLRKILQPALDLLGSEDDDSAPETTGHGFPHFSEAPARQGFSFNKMFTEKATEESWTSNSKKLERLGSAEQSSPDLSFLVVKNNMGEKHLFVDLGVYTRNRNFRLYKSSKIGKRVALEVTEDNKFFPIQSKDVSDEYQYFLSSLVSNVRFSDTLRILTCEPSQNKQKGVGYFNSIGTSVETIEGFQCSPYPEVDHFVLSLVNKDGIKGGIRRWNYFFPEELLVYDICKYRWCENIGRAHKSNNIMILVDLKNEVWYQKCHDPVCKAENFKSDCFPLPAEVCLLFLFKELDCPLVKKLNPPLLFRRGVLKSMCTEL

SEQ ID NO: 886258 - protein, 712 aa, Homo sapiens
MGDYGFGVLVQSNTGNKSAFPVRFHPHLQPPHHHQNATPSPAAFINNNTAANGSSAGSAWLFPAPATHNIQDEILGSEKAKSQQQEQQDPLEKQQLSPSPGQEAGILPETEKAKSEENQGDNSSENGNGKEKIRIESPVLTGFDYQEATGLGTSTQPLTSSASSLTGFSNWSAAIAPSSSTIINEDASFFHQGGVPAASANNGALLFQNFPHHVSPGFGGSFSPQIGPLSQHHPHHPHFQHHHSQHQQQRRSPASPHPPPFTHRNAAFNQLPHLANNLNKPPSPWSSYQSPSPTPSSSWSPGGGGYGGWGGSQGRDHRRGLNGGITPLNSISPLKKNFASNHIQLQKYARPSSAFAPKSWMEDSLNRADNIFPFPDRPRTFDMHSLESSLIDIMRAENDTIKARTYGRRRGQSSLFPMEDGFLDDGRGDQPLHSGLGSPHCFSHQNGERVERYSRKVFVGGLPPDIDEDEITASFRRFGPLIVDWPHKAESKSYFPPKGYAFLLFQDESSVQALIDACIEEDGKLYLCVSSPTIKDKPVQIRPWNLSDSDFVMDGSQPLDPRKTIFVGGVPRPLRAVELAMIMDRLYGGVCYAGIDTDPELKYPKGAGRVAFSNQQSYIAAISARFVQLQHGEIDKRVEVKPYVLDDQLCDECQGARCGGKFAPFFCANVTCLQYYCEYCWAAIHSRAGREFHKPLVKEGGDRPRHISFRWN

SEQ ID NO: 886259 - protein, 410 aa, Homo sapiens [sequence omitted]

SEQ ID NO: 886260 - protein, 376 aa, Homo sapiens [sequence omitted]

SEQ ID NO: 886261 - protein, 721 aa, Homo sapiens
MGDYGFGVLVQSNTGNKSAFPVRFHPHLQPPHHHQNATPSPAAFINNNTAANGSSAGSAWLFPAPATHNIQDEILGSEKAKSQQQEQQDPLEKQQLSPSPGQEAGILPETEKAKSEENQGDNSSENGNGKEKIRIESPVLTGFDYQEATGLGTSTQPLTSSASSLTGFSNWSAAIAPSSSTIINEDASFFHQGGVPAASANNGALLFQNFPHHVSPGFGGSFSPQIGPLSQHHPHHPHFQHHHSQHQQQRRSPASPHPPPFTHRNAAFNQLPHLANNLNKPPSPWSSYQSPSPTPSSSWSPGGGGYGGWGGSQGRDHRRGLNGGITPLNSISPLKKNFASNHIQLQKYARPSSAFAPKSWMEDSLNRADNIFPFPDRPRTFDMHSLESSLIDIMRAENDTIKGRLNYSYPGSDSSLLINGQSSLFPMEDGFLDDGRGDQPLHSGLGSPHCFSHQNGERVERYSRKVFVGGLPPDIDEDEITASFRRFGPLIVDWPHKAESKSYFPPKGYAFLLFQDESSVQALIDACIEEDGKLYLCVSSPTIKDKPVQIRPWNLSDSDFVMDGSQPLDPRKTIFVGGVPRPLRAVELAMIMDRLYGGVCYAGIDTDPELKYPKGAGRVAFSNQQSYIAAISARFVQLQHGEIDKRVEVKPYVLDDQLCDECQGARCGGKFAPFFCANVTCLQYYCEYCWAAIHSRAGREFHKPLVKEGGDRPRHISFRWN

SEQ ID NO: 886262 - protein, 721 aa, Homo sapiens; identical to SEQ ID NO: 886261

SEQ ID NO: 886263 - protein, 721 aa, Homo sapiens; identical to SEQ ID NO: 886261

SEQ ID NO: 886264 - protein, 609 aa, Homo sapiens
MEGKPMRRCTNIRPGETGMDVTSRCTLGDPNKLPEGVPQPARMPYISDKHPRQTLEVINLLRKHRELCDVVLVVGAKKIYAHRVILSACSPYFRAMFTGELAESRQTEVVIRDIDERAMELLIDFAYTSQITVEEGNVQTLLPAACLLQLAEIQEACCEFLKRQLDPSNCLGIRAFADTHSCRELLRIADKFTQHNFQEVMESEEFMLLPANQLIDIISSDELNVRSEEQVFNAVMAWVKYSIQERRPQLPQVLQHVRLPLLSPKFLVGTVGSDPLIKSDEECRDLVDEAKNYLLLPQERPLMQGPRTRPRKPIRCGEVLFAVGGWCSGDAISSVERYDPQTNEWRMVASMSKRRCGVGVSVLDDLLYAVGGHDGSSYLNSVERYDPKTNQWSSDVAPTSTCRTSVGVAVLGGFLYAVGGQDGVSCLNIVERYDPKENKWTRVASMSTRRLGVAVAVLGGFLYAVGGSDGTSPLNTVERYNPQENRWHTIAPMGTRRKHLGCAVYQDMIYAVGGRDDTTELSSAERYNPRTNQWSPVVAMTSRRSGVGLAVVNGQLMAVGGFDGTTYLKTIEVFDPDANTWRLYGGMNYRRLGGGVGVIKMTHCESHIW

SEQ ID NO: 886265 - protein, 273 aa, Homo sapiens
RRLLLLSLRDKLTIFRFVIKASCTLCDLSGSALECGEGYFSWCMEGKPMRRCTNIRPGETGMDVTSRCTLGDPNKLPEGVPQPARMPYISDKHPRQTLEVINLLRKHRELCDVVLVVGAKKIYAHRVILSACSPYFRAMFTGELAESRQTEVVIRDIDERAMELLIDFAYTSQITVEEGNVQTLLPAACLLQLAEIQEACCEFLKRQLDPSNCLGIRAFADTHSCRELLRIADKFTQHNFQEVSCTWCSNAPICWRAIWVHILLNNTCLGISC

SEQ ID NO: 886266 - protein, 467 aa, Homo sapiens
MEGKPMRRCTNIRPGETGMDVTSRCTLGDPNKLPEGVPQPARMPYISDKHPRQTLEVINLLRKHRELCDVVLVVGAKKIYAHRVILSACSPYFRAMFTGELAESRQTEVVIRDIDERAMELLIDFAYTSQITVEEGNVQTLLPAACLLQLAEIQEACCEFLKRQLDPSNCLGIRAFADTHSCRELLRIADKFTQHNFQEVMESEEFMLLPANQLIDIISSDELNVRSEEQVFNAVMAWVKYSIQERRPQLPQVLQHVRLPLLSPKFLVGTVGSDPLIKSDEECRDLVDEAKNYLLLPQERPLMQGPRTRPRKPIRCGEVLFAVGGWCSGDAISSVERYDPQTNEWRMVASMSKRRCGVGVSVLDDLLYAVGGHDGSSYLNSVERYNPRTNQWSPVVAMTSRRSGVGLAVVNGQLMAVGGFDGTTYLKTIEVFDPDANTWRLYGGMNYRRLGGGVGVIKMTHCESHIW

SEQ ID NO: 886267 - protein, 652 aa, Homo sapiens
RRLLLLSLRDKLTIFRFVIKASCTLCDLSGSALECGEGYFSWCMEGKPMRRCTNIRPGETGMDVTSRCTLGDPNKLPEGVPQPARMPYISDKHPRQTLEVINLLRKHRELCDVVLVVGAKKIYAHRVILSACSPYFRAMFTGELAESRQTEVVIRDIDERAMELLIDFAYTSQITVEEGNVQTLLPAACLLQLAEIQEACCEFLKRQLDPSNCLGIRAFADTHSCRELLRIADKFTQHNFQEVMESEEFMLLPANQLIDIISSDELNVRSEEQVFNAVMAWVKYSIQERRPQLPQVLQHVRLPLLSPKFLVGTVGSDPLIKSDEECRDLVDEAKNYLLLPQERPLMQGPRTRPRKPIRCGEVLFAVGGWCSGDAISSVERYDPQTNEWRMVASMSKRRCGVGVSVLDDLLYAVGGHDGSSYLNSVERYDPKTNQWSSDVAPTSTCRTSVGVAVLGGFLYAVGGQDGVSCLNIVERYDPKENKWTRVASMSTRRLGVAVAVLGGFLYAVGGSDGTSPLNTVERYNPQENRWHTIAPMGTRRKHLGCAVYQDMIYAVGGRDDTTELSSAERYNPRTNQWSPVVAMTSRRSGVGLAVVNGQLMAVGGFDGTTYLKTIEVFDPDANTWRLYGGMNYRRLGGGVGVIKMTHCESHIW

SEQ ID NO: 886268 - protein, 417 aa, Homo sapiens
FLPNFEQVMESEEFMLLPANQLIDIISSDELNVRSEEQVFNAVMAWVKYSIQERRPQLPQVLQHVRLPLLSPKFLVGTVGSDPLIKSDEECRDLVDEAKNYLLLPQERPLMQGPRTRPRKPIRCGEVLFAVGGWCSGDAISSVERYDPQTNEWRMVASMSKRRCGVGVSVLDDLLYAVGGHDGSSYLNSVERYDPKTNQWSSDVAPTSTCRTSVGVAVLGGFLYAVGGQDGVSCLNIVERYDPKENKWTRVASMSTRRLGVAVAVLGGFLYAVGGSDGTSPLNTVERYNPQENRWHTIAPMGTRRKHLGCAVYQDMIYAVGGRDDTTELSSAERYNPRTNQWSPVVAMTSRRSGVGLAVVNGQLMAVGGFDGTTYLKTIEVFDPDANTWRLYGGMNYRRLGGGVGVIKMTHCESHIW

SEQ ID NO: 886269 - protein, 164 aa, Homo sapiens
MSTRRLGVAVAVLGGFLYAVGGSDGTSPLNTVERYNPQENRWHTIAPMGTRRKHLGCAVYQDMIYAVGGRDDTTELSSAERYNPRTNQWSPVVAMTSRRSGVGLAVVNGQLMAVGGFDGTTYLKTIEVFDPDANTWRLYGGMNYRRLGGGVGVIKMTHCESHIW

SEQ ID NO: 886270 - protein, 143 aa, Homo sapiens
MVCLASTLLRVERYNPQENRWHTIAPMGTRRKHLGCAVYQDMIYAVGGRDDTTELSSAERYNPRTNQWSPVVAMTSRRSGVGLAVVNGQLMAVGGFDGTTYLKTIEVFDPDANTWRLYGGMNYRRLGGGVGVIKMTHCESHIW

SEQ ID NO: 886271 - protein, 432 aa, Homo sapiens
MEGKPMRRCTNIRPGETGMDVTSRCTLGDPNKLPEGVPQPARMPYISDKHPRQTLEVINLLRKHRELCDVVLVVGAKKIYAHRVILSACSPYFRAMFTGELAESRQTEVVIRDIDERAMELLIDFAYTSQITVEEGNVQTLLPAACLLQLAEIQEACCEFLKRQLDPSNCLGIRAFADTHSCRELLRIADKFTQHNFQEVMESEEFMLLPANQLIDIISSDELNVRSEEQVFNAVMAWVKYSIQERRPQLPQVLQHVRLPLLSPKFLVGTVGSDPLIKSDEECRDLVDEAKNYLLLPQERPLMQGPRTRPRKPIRCGEVLFAVGGWCSGDAISSVERYDPQTNEWRMVASMSKRRCGVGVSVLDDLLYAVGGHDGSSYLNSVERYDPKTNQWSSDVAPTSTCRTSVGVAVLGGFLYAVGGQDGVSCLNIVER

SEQ ID NO: 886272 - protein, 672 aa, Homo sapiens
AGALSEEIRDSSFPGKRRGLSPARVGRAGAGGPRRPPSPAVTLAAGEGLGRCGAVAAARGGSGEELAQLGGAGWGGSAPPRPPPRPPPSPLPRASSPPASLLPWALLPSSPPPPVPVRAHPCPQPRAPAESLSRGCRTGRDRLGWARPPGPAVGMGALARALLLPLLAQWLLRAAPELAPAPFTLPLRVAAATNRVVAPTPGPGTPAERHADGLALALEPALASPAGAANFLAMVDNLQGDSGRGYYLEMLIGTPPQKLQILVDTGSSNFAVAGTPHSYIDTYFDTERSSTYRSKGFDVTVKYTQGSWTGFVGEDLVTIPKGFNTSFLVNIATIFESENFFLPGIKWNGILGLAYATLAKPSSSLETFFDSLVTQANIPNVFSMQMCGAGLPVAGSGTNGGSLVLGGIEPSLYKGDIWYTPIKEEWYYQIEILKLEIGGQSLNLDCREYNADKAIVDSGTTLLRLPQKVFDAVVEAVARASLIPEFSDGFWTGSQLACWTNSETPWSYFPKISIYLRDENSSRSFRITILPQLYIQPMMGAGLNYECYRFGISPSTNALVIGATVMEGFYVIFDRAQKRVGFAASPCAEIAGAAVSEISGPFSTEDVASNCVPAQSLSEPILWIVSYALMSVCGAILLVLIVLLLLPFRCQRRPRDPEVVNDESSLVRHRWK

SEQ ID NO: 886273 - protein, 622 aa, Homo sapiens
AGALSEEIRDSSFPGKRRGLSPARVGRAGAGGPRRPPSPAVTLAAGEGLGRCGAVAAARGGSGEELAQLGGAGWGGSAPPRPPPRPPPSPLPRASSPPASLLPWALLPSSPPPPVPVRAHPCPQPRAPAESLSRGCRTGRDRLGWARPPGPAVGMGALARALLLPLLAQWLLRAAPELAPAPFTLPLRVAAATNRVVAPTPGPGTPAERHADGLALALEPALASPAGAANFLAMVDNLQGDSGRGYYLEMLIGTPPQKLQILVDTGSSNFAVAGTPHSYIDTYFDTERSSTYRSKGFDVTVKYTQGSWTGFVGEDLVTIPKGFNTSFLVNIATIFESENFFLPGIKWNGILGLAYATLAKPSSSLETFFDSLVTQANIPNVFSMQMCGAGLPVAGSGTNGGSLVLGGIEPSLYKGDIWYTPIKEEWYYQIEILKLEIGGQSLNLDCREYNADKAIVDSGTTLLRLPQKVFDAVVEAVARASLLYIQPMMGAGLNYECYRFGISPSTNALVIGATVMEGFYVIFDRAQKRVGFAASPCAEIAGAAVSEISGPFSTEDVASNCVPAQSLSEPILWIVSYALMSVCGAILLVLIVLLLLPFRCQRRPRDPEVVNDESSLVRHRWK

SEQ ID NO: 886274 - protein, 287 aa, Homo sapiens
MCGAGLPVAGSGTNGGSLVLGGIEPSLYKGDIWYTPIKEEWYYQIEILKLEIGGQSLNLDCREYNADKAIVDSGTTLLRLPQKVFDAVVEAVARASLIPEFSDGFWTGSQLACWTNSETPWSYFPKISIYLRDENSSRSFRITILPQLYIQPMMGAGLNYECYRFGISPSTNALVIGATVMEGFYVIFDRAQKRVGFAASPCAEIAGAAVSEISGPFSTEDVASNCVPAQSLSEPILWIVSYALMSVCGAILLVLIVLLLLPFRCQRRPRDPEVVNDESSLVRHRWK

SEQ ID NO: 886275 - protein, 672 aa, Homo sapiens; identical to SEQ ID NO: 886272

SEQ ID NO: 886276 - protein, 672 aa, Homo sapiens; identical to SEQ ID NO: 886272

SEQ ID NO: 886277 - protein, 415 aa, Homo sapiens
MLQILVDTGSSNFAVAGTPHSYIDTYFDTERSSTYRSKGFDVTVKYTQGSWTGFVGEDLVTIPKGFNTSFLVNIATIFESENFFLPGIKWNGILGLAYATLAKPSSSLETFFDSLVTQANIPNVFSMQMCGAGLPVAGSGTNGGSLVLGGIEPSLYKGDIWYTPIKEEWYYQIEILKLEIGGQSLNLDCREYNADKAIVDSGTTLLRLPQKVFDAVVEAVARASLIPEFSDGFWTGSQLACWTNSETPWSYFPKISIYLRDENSSRSFRITILPQLYIQPMMGAGLNYECYRFGISPSTNALVIGATVMEGFYVIFDRAQKRVGFAASPCAEIAGAAVSEISGPFSTEDVASNCVPAQSLSEPILWIVSYALMSVCGAILLVLIVLLLLPFRCQRRPRDPEVVNDESSLVRHRWK

SEQ ID NO: 886278 - protein, 351 aa, Homo sapiens
MKKLSINTRNVCGAWRLHWVTHVYTVSPKRVPLSVALPQPSSSLETFFDSLVTQANIPNVFSMQMCGAGLPVAGSGTNGGSLVLGGIEPSLYKGDIWYTPIKEEWYYQIEILKLEIGGQSLNLDCREYNADKAIVDSGTTLLRLPQKVFDAVVEAVARASLIPEFSDGFWTGSQLACWTNSETPWSYFPKISIYLRDENSSRSFRITILPQLYIQPMMGAGLNYECYRFGISPSTNALVIGATVMEGFYVIFDRAQKRVGFAASPCAEIAGAAVSEISGPFSTEDVASNCVPAQSLSEPILWIVSYALMSVCGAILLVLIVLLLLPFRCQRRPRDPEVVNDESSLVRHRWK

SEQ ID NO: 886279 - protein, 343 aa, Homo sapiens
CSYRSWRTIAWLLVSGINGMNTWLAYAHLTTPSSSLETFFDSLVTQANIPNVFSMQMCGAGLPVAGSGTNGGSLVLGGIEPSLYKGDIWYTPIKEEWYYQIEILKLEIGGQSLNLDCREYNADKAIVDSGTTLLRLPQKVFDAVVEAVARASLIPEFSDGFWTGSQLACWTNSETPWSYFPKISIYLRDENSSRSFRITILPQLYIQPMMGAGLNYECYRFGISPSTNALVIGATVMEGFYVIFDRAQKRVGFAASPCAEIAGAAVSEISGPFSTEDVASNCVPAQSLSEPILWIVSYALMSVCGAILLVLIVLLLLPFRCQRRPRDPEVVNDESSLVRHRWK

SEQ ID NO: 886280 - protein, 263 aa, Homo sapiens
MPSLLVDIWYTPIKEEWYYQIEILKLEIGGQSLNLDCREYNADKAIVDSGTTLLRLPQKVFDAVVEAVARASLIPEFSDGFWTGSQLACWTNSETPWSYFPKISIYLRDENSSRSFRITILPQLYIQPMMGAGLNYECYRFGISPSTNALVIGATVMEGFYVIFDRAQKRVGFAASPCAEIAGAAVSEISGPFSTEDVASNCVPAQSLSEPILWIVSYALMSVCGAILLVLIVLLLLPFRCQRRPRDPEVVNDESSLVRHRWK

SEQ ID NO: 886281 - protein, 668 aa, Homo sapiens
AGALSEEIRDSSFPGKRRGLSPARVGRAGAGGPRRPPSPAVTLAAGEGLGRCGAVAAARGGSGEELAQLGGAGWGGSAPPRPPPRPPPSPLPRASSPPASLLPWALLPSSPPPPVPVRAHPCPQPRAPAESLSRGCRTGRDRLGWARPPGPAVGMGALARALLLPLLAQWLLRAAPELAPAPFTLPLRVAAATNRVVAPTPGPGTPAERHADGLALALEPALASPAGAANFLAMVDNLQGDSGRGYYLEMLIGTPPQKLQILVDTGSSNFAVAGTPHSYIDTYFDTERSSTYRSKGFDVTVKYTQGSWTGFVGEDLVTIPKGFNTSFLVNIATIFESENFFLPGIKWNGILGLAYATLAKPSSSLETFFDSLVTQANIPNVFSMQMCGAGLPVAGSGTNGGSLVLGGIEPSLYKGDIWYTPIKEEWYYQIEILKLEIGGQSLNLDCREYNADKAIVDSGTTLLRLPQKVFDAVVEAVARASLIPEFSDGFWTGSQLACWTNSETPWSYFPKISIYLRDENSSRSFRITILPQLYIQPMMGAGLNYECYRFGISPSTNALVIGATVMEGFYVIFDRAQKRVGFAASPCAEIAGAAVSEISGPFSTEDVASNCVPAQSLSEPILWIVSYALMSVCGAILLVLIVLLLLPVFPPGGGFGVPPKGPVSASPP

SEQ ID NO: 886282 - protein, 672 aa, Homo sapiens; identical to SEQ ID NO: 886272

SEQ ID NO: 886283 - protein, 550 aa, Homo sapiens
AGALSEEIRDSSFPGKRRGLSPARVGRAGAGGPRRPPSPAVTLAAGEGLGRCGAVAAARGGSGEELAQLGGAGWGGSAPPRPPPRPPPSPLPRASSPPASLLPWALLPSSPPPPVPVRAHPCPQPRAPAESLSRGCRTGRDRLGWARPPGPAVGMGALARALLLPLLAQWLLRAAPELAPAPFTLPLRVAAATNRVVAPTPGPGTPAERHADGLALALEPALASPAGAANFLAMVDNLQGDSGRGYYLEMLIGTPPQKLQILVDTGSSNFAVAGTPHSYIDTYFDTERSSTYRSKGFDVTVKYTQGSWTGFVGEDLVTIPKGFNTSFLVNIATIFESENFFLPGIKWNGILGLAYATLAKPSSSLETFFDSLVTQANIPNVFSMQMCGAGLPVAGSGTNGGSLVLGGIEPSLYKGDIWYTPIKEEWYYQIEILKLEIGGQSLNLDCREYNADKAIVDSGTTLLRLPQKVFDAVVEAVARASLIPEFSDGFWTGSQLACWTNSETPWSYFPKISIYLRDENSSRSFRITILPQKLQVLQCLKFPGLSQQRM

SEQ ID NO: 886284 - protein, 672 aa, Homo sapiens; identical to SEQ ID NO: 886272

SEQ ID NO: 886285 - protein, 533 aa, Homo sapiens
RRRSCAPRHRNGRQLWAALARALLLPLLAQWLLRAAPELAPAPFTLPLRVAAATNRVVAPTPGPGTPAERHADGLALALEPALASPAGAANFLAMVDNLQGDSGRGYYLEMLIGTPPQKLQILVDTGSSNFAVAGTPHSYIDTYFDTERSSTYRSKGFDVTVKYTQGSWTGFVGEDLVTIPKGFNTSFLVNIATIFESENFFLPGIKWNGILGLAYATLAKPSSSLETFFDSLVTQANIPNVFSMQMCGAGLPVAGSGTNGGSLVLGGIEPSLYKGDIWYTPIKEEWYYQIEILKLEIGGQSLNLDCREYNADKAIVDSGTTLLRLPQKVFDAVVEAVARASLIPEFSDGFWTGSQLACWTNSETPWSYFPKISIYLRDENSSRSFRITILPQLYIQPMMGAGLNYECYRFGISPSTNALVIGATVMEGFYVIFDRAQKRVGFAASPCAEIAGAAVSEISGPFSTEDVASNCVPAQSLSEPILWIVSYALMSVCGAILLVLIVLLLLPFRCQRRPRDPEVVNDESSLVRHRWK

SEQ ID NO: 886286 - protein, 385 aa, Homo sapiens
MSSTYRSKGFDVTVKYTQGSWTGFVGEDLVTIPKGFNTSFLVNIATIFESENFFLPGIKWNGILGLAYATLAKPSSSLETFFDSLVTQANIPNVFSMQMCGAGLPVAGSGTNGGSLVLGGIEPSLYKGDIWYTPIKEEWYYQIEILKLEIGGQSLNLDCREYNADKAIVDSGTTLLRLPQKVFDAVVEAVARASLIPEFSDGFWTGSQLACWTNSETPWSYFPKISIYLRDENSSRSFRITILPQLYIQPMMGAGLNYECYRFGISPSTNALVIGATVMEGFYVIFDRAQKRVGFAASPCAEIAGAAVSEISGPFSTEDVASNCVPAQSLSEPILWIVSYALMSVCGAILLVLIVLLLLPFRCQRRPRDPEVVNDESSLVRHRWK

SEQ ID NO: 886287 - protein, 457 aa, Homo sapiens
GIKSRLLPHQESQLQILVDTGSSNFAVAGTPHSYIDTYFDTERSSTYRSKGFDVTVKYTQGSWTGFVGEDLVTIPKGFNTSFLVNIATIFESENFFLPGIKWNGILGLAYATLAKGRKQRNKSLGWQVAEPVSHRVCFALPPLKKPSSSLETFFDSLVTQANIPNVFSMQMCGAGLPVAGSGTNGGSLVLGGIEPSLYKGDIWYTPIKEEWYYQIEILKLEIGGQSLNLDCREYNADKAIVDSGTTLLRLPQKVFDAVVEAVARASLIPEFSDGFWTGSQLACWTNSETPWSYFPKISIYLRDENSSRSFRITILPQLYIQPMMGAGLNYECYRFGISPSTNALVIGATVMEGFYVIFDRAQKRVGFAASPCAEIAGAAVSEISGPFSTEDVASNCVPAQSLSEPILWIVSYALMSVCGAILLVLIVLLLLPFRCQRRPRDPEVVNDESSLVRHRWK

SEQ ID NO: 886288 - protein, 134 aa, Homo sapiens [sequence omitted]

SEQ ID NO: 886289 - protein, 494 aa, Homo sapiens
AGALSEEIRDSSFPGKRRGLSPARVGRAGAGGPRRPPSPAVTLAAGEGLGRCGAVAAARGGSGEELAQLGGAGWGGSAPPRPPPRPPPSPLPRASSPPASLLPWALLPSSPPPPVPVRAHPCPQPRAPAESLSRGCRTGRDRLGWARPPGPAVGMGALARALLLPLLAQWLLRAAPELAPAPFTLPLRVAAATNRVVAPTPGPGTPAERHADGLALALEPALASPAGAANFLAMVDNLQGDSGRGYYLEMLIGTPPQKLQILVDTGSSNFAVAGTPHSYIDTYFDTERSSTYRSKGFDVTVKYTQGSWTGFVGEDLVTIPKGFNTSFLVNIATIFESENFFLPGIKWNGILGLAYATLAKPSSSLETFFDSLVTQANIPNVFSMQMCGAGLPVAGSGTNGGSLVLGGIEPSLYKGDIWYTPIKEEWYYQIEILKLEIGGQSLNLDCREYNADKAIVDSGTTLLRLPQKVFDAVVEAVARASLVSPRDTHGSPSC

SEQ ID NO: 886290 - protein, 87 aa, Homo sapiens
DFGTRDTQRISLEIMTLQPRCEDVETAEGVALTVTGVAQVKIMTEKELLAVACEQFLGKNVQDIKNVVLQTLEGHLRSILGEALFSL

SEQ ID NO: 886291 - protein, 428 aa, Homo sapiens
MGNCHTVGPNEALVVSGGCCGSDYKQYVFGGWAWAWWCISDTQRISLEIMTLQPRCEDVETAEGVALTVTGVAQVKIMTEKELLAVACEQFLGKNVQDIKNVVLQTLEGHLRSILGTLTVEQIYQDRDQFAKLVREVAAPDVGRMGIEILSFTIKDVYDKVDYLSSLGKTQTAVVQRDADIGVAEAERDAGIREAECKKEMLDVKFMADTKIADSKRAFELQKSAFSEEVNIKTAEAQLAYELQGAREQQKIRQEEIEIEVVQRKKQIAVEAQEILRTDKELIATVRRPAEAEAHRIQQIAEGEKVKQVLLAQAEAEKIRKIGEAEAAVIEAMGKAEAERMKLKAEAYQKYGDAAKMALVLEALPQIAAKIAAPLTKVDEIVVLSGDNSKVTSEVNRLLAELPASVHALTGVDLSKIPLIKKATGVQV

SEQ ID NO: 886292 - protein, 402 aa, Homo sapiens
MGNCHTVGPNEALVVSGGCCGSDYKQYVFGGWAWAWWCISDTQRISLEIMTLQPRCEDVETAEGVALTVTGVAQVKIMTEKELLAVACEQFLGKNVQDIKNVVLQTLEGHLRSILGTLTVEQIYQDRDQFAKLVREVAAPDVGRMGIEILSFTIKDVYDKVDYLSSLGKTQTAVVQRDADIGVAEAERDAGIREAECKKEMLDVKFMADTKIADSKRAFELQKSAFSEEVNIKTAEAQLAYELQGAREQQKIRQEEIEIEVVQRKKQIAVEAQEILRTDKELIATVRRPAEAEAHRIQQIAEGEKVKQVLLAQAEAEKIRKIGEAEAAVIEAMGKAEAERMKLKAEAYQKYGDAAKMALVLEALPQVRLPPKRVLGFKCPCLTSWASARTSLGLASNTGTDG

SEQ ID NO: 886293 - protein, 428 aa, Homo sapiens; identical to SEQ ID NO: 886291

SEQ ID NO: 886294 - protein, 379 aa, Homo sapiens
MTLQPRCEDVETAEGVALTVTGVAQVKIMTEKELLAVACEQFLGKNVQDIKNVVLQTLEGHLRSILGTLTVEQIYQDRDQFAKLVREVAAPDVGRMGIEILSFTIKDVYDKVDYLSSLGKTQTAVVQRDADIGVAEAERDAGIREAECKKEMLDVKFMADTKIADSKRAFELQKSAFSEEVNIKTAEAQLAYELQGAREQQKIRQEEIEIEVVQRKKQIAVEAQEILRTDKELIATVRRPAEAEAHRIQQIAEGEKVKQVLLAQAEAEKIRKIGEAEAAVIEAMGKAEAERMKLKAEAYQKYGDAAKMALVLEALPQIAAKIAAPLTKVDEIVVLSGDNSKVTSEVNRLLAELPASVHALTGVDLSKIPLIKKATGVQV

SEQ ID NO: 886295 - protein, 483 aa, Homo sapiens
MGNCHTVGPNEALVVSGGCCGSDYKQYVFGGWAWAWWCISDTQRLSLEVMTILCRCENIETSEGVPLFVTGVAQVPCPCLLDCKWGNSKGFWKLCQVCQISLEIMTLQPRCEDVETAEGVALTVTGVAQVKIMTEKELLAVACEQFLGKNVQDIKNVVLQTLEGHLRSILGTLTVEQIYQDRDQFAKLVREVAAPDVGRMGIEILSFTIKDVYDKVDYLSSLGKTQTAVVQRDADIGVAEAERDAGIREAECKKEMLDVKFMADTKIADSKRAFELQKSAFSEEVNIKTAEAQLAYELQGAREQQKIRQEEIEIEVVQRKKQIAVEAQEILRTDKELIATVRRPAEAEAHRIQQIAEGEKVKQVLLAQAEAEKIRKIGEAEAAVIEAMGKAEAERMKLKAEAYQKYGDAAKMALVLEALPQIAAKIAAPLTKVDEIVVLSGDNSKVTSEVNRLLAELPASVHALTGVDLSKIPLIKKATGVQV

SEQ ID NO: 886296 - protein, 258 aa, Homo sapiens
TVDNLLGRSSESWKDMNATEQVHTCTMLLDVLEEGAFLLADNVREPARFLAAKENVVLEVNIKTAEAQLAYELQGAREQQKIRQEEIEIEVVQRKKQIAVEAQEILRTDKELIATVRRPAEAEAHRIQQIAEGEKVKQVLLAQAEAEKIRKIGEAEAAVIEAMGKAEAERMKLKAEAYQKYGDAAKMALVLEALPQIAAKIAAPLTKVDEIVVLSGDNSKVTSEVNRLLAELPASVHALTGVDLSKIPLIKKATGVQV

SEQ ID NO: 886297 - protein, 111 aa, Homo sapiens
GIASSVFAEAAVIEAMGKAEAERMKLKAEAYQKYGDAAKMALVLEALPQIAAKIAAPLTKVDEIVVLSGDNSKVTSEVNRLLAELPASVHALTGVDLSKIPLIKKATGVQV

SEQ ID NO: 886298 - protein, 366 aa, Homo sapiens
MGNCHTVGPNEALVVSGGCCGSDYKQYVFGGWAWAWWCISDTQRISLEIMTLQPRCEDVETAEGVALTVTGVAQVKIMTEKELLAVACEQFLGKNVQDIKNVVLQTLEGHLRSILGTLTVEQIYQDRDQFAKLVREVAAPDVGRMGIEILSFTIKDVYDKVDYLSSLGKTQTAVVQRDADIGVAEAERDAGIREAECKKEMLDVKFMADTKIADSKRAFELQKSAFSEEVNIKTAEAQLAYELQGAREQQKIRQEEIEIEVVQRKKQIAVEAQEILRTDKELIATVRRPAEAEAHRIQQIAEGEKVKQVLLAQAEAEKIRKIGEAEAAVIEAMGKAEAERMKLKAEAYQKYGDAAKMALVLEALPQ

SEQ ID NO: 886299 - protein, 402 aa, Homo sapiens; identical to SEQ ID NO: 886292

SEQ ID NO: 886300 - protein, 164 aa, Homo sapiens
MGNCHTVGPNEALVVSGGCCGSDYKQYVFGGWAWAWWCISDTQRISLEIMTLQPRCEDVETAEGVALTVTGVAQVKIMTEKELLAVACEQFLGKNVQDIKNVVLQTLEGHLRSILGTLTVEQIYQDRDQFAKLVREVAAPDVGRMGIEILSFTIKDPSVLAGVL

SEQ ID NO: 886301 - protein, 39 aa, Homo sapiens
MGKGTIPIPLALVAMGGAEAWEAWSTLCGRGRVQASFNT

SEQ ID NO: 886302 - protein, 428 aa, Homo sapiens; identical to SEQ ID NO: 886291

SEQ ID NO: 886303 - protein, 428 aa, Homo sapiens; identical to SEQ ID NO: 886291

SEQ ID NO: 886304 - protein, 428 aa, Homo sapiens; identical to SEQ ID NO: 886291

SEQ ID NO: 886305 - protein, 328 aa, Homo sapiens
MTEKELLAVACEQFLGTLTVEQIYQDRDQFAKLVREVAAPDVGRMGIEILSFTIKDVYDKVDYLSSLGKTQTAVVQRDADIGVAEAERDAGIREAECKKEMLDVKFMADTKIADSKRAFELQKSAFSEEVNIKTAEAQLAYELQGAREQQKIRQEEIEIEVVQRKKQIAVEAQEILRTDKELIATVRRPAEAEAHRIQQIAEGEKVKQVLLAQAEAEKIRKIGEAEAAVIEAMGKAEAERMKLKAEAYQKYGDAAKMALVLEALPQIAAKIAAPLTKVDEIVVLSGDNSKVTSEVNRLLAELPASVHALTGVDLSKIPLIKKATGVQV

SEQ ID NO: 886306 - protein, 428 aa, Homo sapiens; identical to SEQ ID NO: 886291

SEQ ID NO: 886307 - protein, 428 aa, Homo sapiens; identical to SEQ ID NO: 886291

SEQ ID NO: 886308 - protein, 159 aa, Homo sapiens
GIASSVFAEAAVIEAMGKAEAERMKLKAEAYQKYGDAAKMALVLEALPQIAAKIAAPLTKVDEIVVLSGDNSKVTSEVNRLLAELPASVHALTGVDLSKIPCPFSLTPRAQRQGLLSTAASSVSYCLRRPLLVLREGLFMGMFLLGRCGLVPTLLSFLR

SEQ ID NO: 886309 - protein, 130 aa, Homo sapiens
MGNCHTVGPNEALVVSGGCCGSDYKQYVFGGWAWAWWCISDTQRISLEIMTLQPRCEDVETAEGVALTVTGVAQVKIMTEKELLAVACEQFLGKNVQDIKNVVLQTLEGHLRSILGPIHSHKFSLDIRAA

SEQ ID NO: 886310 - protein, 125 aa, Homo sapiens
MGNCHTVGPNEALVVSGGCCGSDYKQYVFGGWAWAWWCISDTQRLSLEVMTILCRCENIETSEGVPLFVTGVAQNQQRRFKSVKSKKKPWSLRQFVVGGHVIYKKFLLPFTHFCCSISSIPKDPH

SEQ ID NO: 886311 - protein, 435 aa, Homo sapiens
SSYWVNTGGSKMAAVATCGSVAASTGSAVATASKSNVTSFQRRGPRASVTNDSGPRLVSIAGTRPSVRNGQLLVSTGLPALDQLLGGGLAVGTVLLIEEDKYNIYSPLLFKYFLAEGIVNGHTLLVASAKEDPANILQELPAPLLDDKCKKEFDEDVYNHKTPESNIKMKIAWRYQLLPKMEIGPVSSSRFGHYYDASKRMPQELIEASNWHGFFLPEKISSTLKVEPCSLTPGYTKLLQFIQNIIYEEGFDGSNPQKKQRNILRIGIQNLGSPLWGDDICCAENGGNSHSLTKFLYVLRGLLRTSLSACIITMPTHLIQNKAIIARVTTLSDVVVGLESFIGSERETNPLYKDYHGLIHIRQIPRLNNLICDESDVKDLAFKLKRKLFTIERLHLPPDLSDTVSRSSKMDLAESAKRLGPGCGMMAGGKKHLDF

SEQ ID NO: 886312 - protein, 546 aa, Homo sapiens
SSYWVNTGGSKMAAVATCGSVAASTGSAVATASKSNVTSFQRRGPRASVTNDSGPRLVSIAGTRPSVRNGQLLVSTGLPALDQLLGGGLAVGTVLLIEEDKYNIYSPLLFKYFLAEGIVNGHTLLVASAKEDPANILQELPAPLLDDKCKKEFDEDVYNHKTPESNIKMKIAWRYQLLPKMEIGPVSSSRFGHYYDASKRMPQELIEASNWHGFFLPEKISSTLKVEPCSLTPGYTKLLQFIQNIIYEEGFDGSNPQKKQRNILRIGIQNLGSPLWGDDICCAENGGNSHSLTKFLYVLRGLLRTSLSACIITMPTHLIQNKAIIARVTTLSDVVVGLESFIGSERETNPLYKDYHGLIHIRQIPRLNNLICDESDVKDLAFKLKRKLFTIEAGVQWHDLGSRQPRLLGSSNSPASASLVAGITGAHHHTQLIFVFLVEMGFHHVGQAGLELLTSGDSSASASQSAGITGMSYRARPRALYFKENKSKVGARQLLETREEHLSSRLLILTQAERLCMGRRFFTAFHIFNELPCKGDCICLQTCQTQ

SEQ ID NO: 886313 - protein, 369 aa, Homo sapiens
GEKGPPVSWLRVSRFFGARGGGLAVGTVLLIEEDKYNIYSPLLFKYFLAEGIVNGHTLLVASAKEDPANILQELPAPLLDDKCKKEFDEDVYNHKTPESNIKMKIAWRYQLLPKMEIGPVSSSRFGHYYDASKRMPQELIEASNWHGFFLPEKISSTLKVEPCSLTPGYTKLLQFIQNIIYEEGFDGSNPQKKQRNILRIGIQNLGSPLWGDDICCAENGGNSHSLTKFLYVLRGLLRTSLSACIITMPTHLIQNKAIIARVTTLSDVVVGLESFIGSERETNPLYKDYHGLIHIRQIPRLNNLICDESDVKDLAFKLKRKLFTIERLHLPPDLSDTVSRSSKMDLAESAKRLGPGCGMMAGGKKHLDF

SEQ ID NO: 886314 - protein, 546 aa, Homo sapiens; identical to SEQ ID NO: 886312

SEQ ID NO: 886315 - protein, 324 aa, Homo sapiens
SSYWVNTGGSKMAAVATCGSVAASTGSAVATASKSNVTSFQRRGPRASVTNDSGPRLVSIAGTRPSVRNGQLLVSTGLPALDQLLGGGLAVGTVLLIEEDKYNIYSPLLFKYFLAEGIVNGHTLLVASAKEDPANILQELPAPLLDDKCKKEFDEDVYNHKTPESNIKMKIAWRYQLLPKMEIGPVSSSRFGHYYDASKRMPQELIEASNWHGFFLPEKISSTLKVEPCSLTPGYTKLLQFIQNIIYEEGFDGSNPQKKQRNILRIGIQNLGSPLWGDDICCAENGGNSHSLTKFLYVLRGLLRTSLSACIITMPTHLIQNKAN

SEQ ID NO: 886316 - protein, 267 aa, Homo sapiens
MKIAWRYQLLPKMEIGPVSSSRFGHYYDASKRMPQELIEASNWHGFFLPEKISSTLKVEPCSLTPGYTKLLQFIQNIIYEEGFDGSNPQKKQRNILRIGIQNLGSPLWGDDICCAENGGNSHSLTKFLYVLRGLLRTSLSACIITMPTHLIQNKAIIARVTTLSDVVVGLESFIGSERETNPLYKDYHGLIHIRQIPRLNNLICDESDVKDLAFKLKRKLFTIERLHLPPDLSDTVSRSSKMDLAESAKRLGPGCGMMAGGKKHLDF

SEQ ID NO: 886317 - protein, 449 aa, Homo sapiens
SSYWVNTGGSKMAAVATCGSVAASTGSAVATASKSNVTSFQRRGPRASVTNDSGPRLVSIAGTRPSVRNGQLLVSTGLPALDQLLGGGLAVGTVLLIEEDKYNIYSPLLFKYFLAEGIVNGHTLLVASAKEDPANILQELPAPLLDDKCKKEFDEDVYNHKTPESNIKMKIAWRYQLLPKMEIGPVSSSRFGHYYDASKRMPQELIEASNWHGFFLPEKISSTLKVEPCSLTPGYTKLLQFIQNIIYEEGFDGSNPQKKQRNILRIGIQNLGSPLWGDDICCAENGGNSHSLTKFLYVLRGLLRTSLSACIITMPTHLIQNKAIIARVTTLSDVVVGLESFIGSERETNPLYKDYHGLIHIRQIPRLNNLICDESDVKDLAFKLKRKLFTIEILENERKEKERIIERLHLPPDLSDTVSRSSKMDLAESAKRLGPGCGMMAGGKKHLDF

SEQ ID NO: 886318 - protein, 461 aa, Homo sapiens
SSYWVNTGGSKMAAVATCGSVAASTGSAVATASKSNVTSFQRRGPRASVTNDSGPRLVSIAGTRPSVRNGQLLVSTGLPALDQLLGGGLAVGTVLLIEEDKYNIYSPLLFKYFLAEGIVNGHTLLVASAKEDPANILQELPAPLLDDKCKKEFDEDVYNHKTPESNIKMKIAWRYQLLPKMEIGPVSSSRFGHYYDASKRMPQELIEASNWHGFFLPEKISSTLKVEPCSLTPGYTKLLQFIQNIIYEEGFDGSNPQKKQRNILRIGIQNLGSPLWGDDICCAENGGNSHSLTKFLYVLRGLLRTSLSACIITMPTHLIQNKAIIARVTTLSDVVVGLESFIGSERETNPLYKDYHGLIHIRQIPRLNNLICDESDVKDLAFKLKRKLFTIEAEVQKGVSTATFLLDGPRKKLFPCLFQLLEVACIPWLMASSSVFKASNIGFESLCYQLSGFFSASLLHF

SEQ ID NO: 886319 - protein, 262 aa, Homo sapiens
GGNNSSSNQGSLPEKMQPILLLLAFLLLPRADAGEIIGGHEAKPHSRPYMAYLMIWDQKSLKRCGGFLIQDDFVLTAAHCWGSSINVTLGAHNIKEQEPTQQFIPVKRPIPHPAYNPKNFSNDIMLLQLERKAKRTRAVQPLRLPSNKAQVKPGQTCSVAGWGQTAPLGKHSHTLQEVKMTVQEDRKCESDLRHYYDSTIELCVGDPEIKKTSFKGDSGGPLVCNKVAQGIVSYGRNNGMPPRACTKVSSFVHWIKKTMKRY

SEQ ID NO: 886320 - protein, 105 aa, Homo sapiens
GGNNSSSNQGSLPEKMQPILLLLAFLLLPRADAGEIIGGHEAKPHSRPYMAYLMIWDQKSLKRCGGFLIQDDFVLTAAHCWGSWRERPSGPELCSPSGYLATRPR

SEQ ID NO: 886321 - protein, 257 aa, Homo sapiens
SGLFQDGGASVASDRAEGRPAKPSKTAAREKTEGAVAAVGGGPSSFRCCYGCCHEARLGRTSLPRGVIMLTEASLSIWGWGSLGIVLFLITFGPFVIFYLTFYILCFVGGGLVVTLLFGKTNSEKYLEQCEHSFLPPTSPGVPKCLEEMKREARTIKIDRRLTGANIIDEPLQQVIQFSLRDYVQYWYYTLSDDESFLLEIRQTLQNALIQFATRVSPCRPGWSTMAQSRLTATSASWNPVLFNKTLVSLCLLEYVI

SEQ ID NO: 886322 - protein, 203 aa, Homo sapiens
MKREARTIKIDRRLTGANIIDEPLQQVIQFSLRDYVQYWYYTLSDDESFLLEIRQTLQNALIQFATRSKEIDWQPYFTTRIVDDFGTHLRVFRKAQQKITEKDDQVKGTAEDLVDTFFEVEVEMEKEVCRDLVCTSPKDEEGFLRDLCEVLLYLLLPPGDFQNKIMRYFVREILARGILLPLINQLSDPDYINQYVIWMVGAF

SEQ ID NO: 886323 - protein, 877 aa, Homo sapiens
MKREARTIKIDRRLTGANIIDEPLQQVIQFSLRDYVQYWYYTLSDDESFLLEIRQTLQNALIQFATRSKEIDWQPYFTTRIVDDFGTHLRVFRKAQQKITEKDDQVKGTAEDLVDTFFEVEVEMEKEVCRDLVCTSPKDEEGFLRDLCEVLLYLLLPPGDFQNKIMRYFVREILARGILLPLINQLSDPDYINQYVIWMIRDSNCNYEAFMNIIKLSDNIGELEAVRDKAAEELQYLRSLDTAGDDINTIKNQINSLLFVKKVCDSRIQRLQSGKEINTVKLAANFGKLCTVPLDSILVDNVALQFFMDYMQQTGGQAHLFFWMTVEGYRVTAQQQLEVLLSRQRDGKHQTNQTKGLLRAAAVGIYEQYLSEKASPRVTVDDYLVAKLADTLNHEDPTPEIFDDIQRKVYELMLRDERFYPSFRQNALYVRMLAELDMLKDPSFRGSDDGDGESFNGSPTGSINLSLDDLSNVSSDDSVQLHAYISDTGVCNDHGKTYALYAITVHRRNLNSEEMWKTYRRYSDFHDFHMRITEQFESLSSILKLPGKKTFNNMDRDFLEKRKKDLNAYLQLLLAPEMMKASPALAHYVYDFLENKAYSKGKGDFARKMDTFVNPLRNSMRNVSNAVKSLPDSLAEGMTKMSDNMGKMSERLGQDIKQSFFKVPPLIPKTDSDPEHRRVSAQLDDNVDDNIPLRVMLLLMDEVFDLKERNQWLRRNIKNLLQQLIRATYGDTINRKIVDHVDWMTSPEQVADSVKRFRDAFWPNGILAEAVPCRDKSIRMRTRVAGKTKLLAIMPDELKHIIGAETTRKGILRVFEMFQHNQLNRRMVYVFLEGFLETLFPQYKFRELFNKLHSRSKQMQKYKQKLQTTQAPSLQKR

SEQ ID NO: 886324 - protein, 877 aa, Homo sapiens; identical to SEQ ID NO: 886323

SEQ ID NO: 886325 - protein, 1025 aa, Homo sapiens
SGLFQDGGASVASDRAEGRPAKPSKTAAREKTEGAVAAVGGGPSSFRCCYGCCHEARLGRTSLPRGVIMLTEASLSIWGWGSLGIVLFLITFGPFVIFYLTFYILCFVGGGLVVTLLFGKTNSEKYLEQCEHSFLPPTSPGVPKCLEEMKREARTIKIDRRLTGANIIDEPLQQVIQFSLRDYVQYWYYTLSDDESFLLEIRQTLQNALIQFATRSKEIDWQPYFTTRIVDDFGTHLRVFRKAQQKITEKDDQVKGTAEDLVDTFFEVEVEMEKEVCRDLVCTSPKDEEGFLRDLCEVLLYLLLPPGDFQNKIMRYFVREILARGILLPLINQLSDPDYINQYVIWMIRDSNCNYEAFMNIIKLSDNIGELEAVRDKAAEELQYLRSLDTAGDDINTIKNQINSLLFVKKVCDSRIQRLQSGKEINTVKLAANFGKLCTVPLDSILVDNVALQFFMDYMQQTGGQAHLFFWMTVEGYRVTAQQQLEVLLSRQRDGKHQTNQTKGLLRAAAVGIYEQYLSEKASPRVTVDDYLVAKLADTLNHEDPTPEIFDDIQRKVYELMLRDERFYPSFRQNALYVRMLAELDMLKDPSFRGSDDGDGESFNGSPTGSINLSLDDLSNVSSDDSVQLHAYISDTGVCNDHGKTYALYAITVHRRNLNSEEMWKTYRRYSDFHDFHMRITEQFESLSSILKLPGKKTFNNMDRDFLEKRKKDLNAYLQLLLAPEMMKASPALAHYVYDFLENKAYSKGKGDFARKMDTFVNPLRNSMRNVSNAVKSLPDSLAEGMTKMSDNMGKMSERLGQDIKQSFFKVPPLIPKTDSDPEHRRVSAQLDDNVDDNIPLRVMLLLMDEVFDLKERNQWLRRNIKNLLQQLIRATYGDTINRKIVDHVDWMTSPEQVADSVKRFRDAFWPNGILAEAVPCRDKSIRMRTRVAGKTKLLAIMPDELKHIIGAETTRKGILRVFEMFQHNQLNRRMVYVFLEGFLETLFPQYKFRELFNKLHSRSKQMQKYKQKLQTTQAPSLQKR

SEQ ID NO: 886326 - protein, 257 aa, Homo sapiens; identical to SEQ ID NO: 886321

SEQ ID NO: 886327 - protein, 349 aa, Homo sapiens
SGLFQDGGASVASDRAEGRPAKPSKTAAREKTEGAVAAVGGGPSSFRCCYGCCHEARLGRTSLPRGVIMLTEASLSIWGWGSLGIVLFLITFGPFVIFYLTFYILCFVGGGLVVTLLFGKTNSEKYLEQCEHSFLPPTSPGVPKCLEEMKREARTIKIDRRLTGANIIDEPLQQVIQFSLRDYVQYWYYTLSDDESFLLEIRQTLQNALIQFATRSKEIDWQPYFTTRIVDDFGTHLRVFRKAQQKITEKDDQVKGTAEDLVDTFFEVEVEMEKEVCRDLVCTSPKDEEGFLRDLCEVLLYLLLPPGDFQNKIMRYFVRVSLNSYHIIPAKKCRAVVFKIFGLKTLLHS

SEQ ID NO: 886328 - protein, 1025 aa, Homo sapiens; identical to SEQ ID NO: 886325

SEQ ID NO: 886329 - protein, 877 aa, Homo sapiens; identical to SEQ ID NO: 886323

SEQ ID NO: 886330 - protein, 712 aa, Homo sapiens [sequence omitted]

SEQ ID NO: 886331 - protein, 294 aa, Homo sapiens
SGLFQDGGASVASDRAEGRPAKPSKTAAREKTEGAVAAVGGGPSSFRCCYGCCHEARLGRTSLPRGVIMLTEASLSIWGWGSLGIVLFLITFGPFVIFYLTFYILCFVGGGLVVTLLFGKTNSEKYLEQCEHSFLPPTSPGVPKCLEEMKREARTIKIDRRLTGANIIDEPLQQVIQFSLRDYVQYWYYTLSDDESFLLEIRQTLQNALIQFATRSKEIDWQPYFTTRIVDDFGTHLRVFRKAQQKITEKDDQVKGTAEDLVDTFFEVEVEMEKEVCRDLVCTSPKDEEGFLLI

SEQ ID NO: 886332 - protein, 760 aa, Homo sapiens
MLTFLPSPQELFTRSLAESELRSAPYEFPEESPIEQLEERRQRLERQISQDVKLEPDILLRAKQDFLKTDSDSDLQLYKEQGEGQGDRSLRERDVLEREFQRVTISGEEKCGVPFTDLLDAAKSVVRALFIREKYMALSLQSFCPTTRRYLQQLAEKPLETRTYEQGPDTPVSADAPVHPPALEQHPYEHCEPSTMPGDLGLGLRMVRGVVHVYTRREPDEHCSEVELPYPDLQEFVADVNVLMALIINGPIKSFCYRRLQYLSSKFQMHVLLNEMKELAAQKKVPHRDFYNIRKVDTHIHASSCMNQKHLLRFIKRAMKRHLEEIVHVEQGREQTLREVFESMNLTAYDLSVDTLDVHADRNTFHRFDKFNAKYNPIGESVLREIFIKTDNRVSGKYFAHIIKEVMSDLEESKYQNAELRLSIYGRSRDEWDKLARWAVMHRVHSPNVRWLVQVPRLFDVYRTKGQLANFQEMLENIFLPLFEATVHPASHPELHLFLEHVDGFDSVDDESKPENHVFNLESPLPEAWVEEDNPPYAYYLYYTFANMAMLNHLRRQRGFHTFVLRPHCGEAGPIHHLVSAFMLAENISHGLLLRKAPVLQYLYYLAQIGIAMSPLSNNSLFLSYHRNPLPEYLSRGLMVSLSTDDPLQFHFTKEPLMEEYSIATQVWKLSSCDMCELARNSVLMSGFSHKVKSHWLGPNYTKEGPEGNDIRRTNVPDIRVGYRYETLCQELALITQAVQSEMLETIPEEAGITMSPGPQ

SEQ ID NO: 886333 - protein, 760 aa, Homo sapiens; identical to SEQ ID NO: 886332

SEQ ID NO: 886334 - protein, 885 aa, Homo sapiens
MDGKCKEIAEELFTRSLAESELRSAPYEFPEESPIEQLEERRQRLERQISQDVKLEPDILLRAKQDFLKTDSDSDLQLYKEQGEGQGDRSLRERDVLEREFQRVTISGEEKCGVPFTDLLDAAKSVVRALFIREKYMALSLQSFCPTTRRYLQQLAEKPLETRTYEQGPDTPVSAGGTPHLCPMPCALASWLLSLVPGTSALPASPYNPGSFQPLGVQGWRLGRSCLTYWVFNISCPLWGLWVGQWVAWKSPALTLPSSPLQMPRCTPLRWSSTRMSTVSQAPCLGTWAWVCAWCGVWCTSTPAGNPTSSKRGVVHVGGMQRGRLRWLGRGHRARLALLTQAPLHASCSEVELPYPDLQEFVADVNVLMALIINGPIKSFCYRRLQYLSSKFQMHVLLNEMKELAAQKKVPHRDFYNIRKVDTHIHASSCMNQKHLLRFIKRAMKRHLEEIVHVEQGREQTLREVFESMNLTAYDLSVDTLDVHADRNTFHRFDKFNAKYNPIGESVLREIFIKTDNRVSGKYFAHIIKEVMSDLEESKYQNAELRLSIYGRSRDEWDKLARWAVMHRVHSPNVRWLVQVPRLFDVYRTKGQLANFQEMLENIFLPLFEATVHPASHPELHLFLEHVDGFDSVDDESKPENHVFNLESPLPEAWVEEDNPPYAYYLYYTFANMAMLNHLRRQRGFHTFVLRPHCGEAGPIHHLVSAFMLAENISHGLLLRKAPVLQYLYYLAQIGIAMSPLSNNSLFLSYHRNPLPEYLSRGLMVSLSTDDPLQFHFTKEPLMEEYSIATQVWKLSSCDMCELARNSVLMSGFSHKVKSHWLGPNYTKEGPEGNDIRRTNVPDIRVGYRYETLCQELALITQAVQSEMLETIPEEAGITMSPGPQ

SEQ ID NO: 886335 - protein, 616 aa, Homo sapiens
MLTFLPSPQELFTRSLAESELRSAPYEFPEESPIEQLEERRQRLERQISQDVKLEPDILLRAKQDFLKTDSDSDLQLYKEQGEGQGDRSLRERDVLEREFQRVTISGEEKCGVPFTDLLDAAKSVVRALFIREKYMALSLQSFCPTTRRYLQQLAEKPLETRTYEQGPDTPVSADAPVHPPALEQHPYEHCEPSTMPGDLGLGLRMVRGVVHVYTRREPDEHCSEVELPYPDLQEFVADVNVLMALIINGPIKSFCYRRLQYLSSKFQMHVLLNEMKELAAQKKVPHRDFYNIRKVDTHIHASSCMNQKHLLRFIKRAMKRHLEEIVHVEQGREQTLREVFESMNLTAYDLSVDTLDVHADRNTFHRFDKFNAKYNPIGESVLREIFIKTDNRVSGKYFAHIIKEVMSDLEESKYQNAELRLSIYGRSRDEWDKLARWAVMHRVHSPNVRWLVQVPRLFDVYRTKGQLANFQEMLENIFLPLFEATVHPASHPELHLFLEHVDGFDSVDDESKPENHVFNLESPLPEAWVEEDNPPYAYYLYYTFANMAMLNHLRRPPSCSTCTTWPRSASPCLRSATTASSSAITGIRYRSTCPAASWSPCPLMIPCSSTSPRSR

SEQ ID NO: 886336 - protein, 760 aa, Homo sapiens; identical to SEQ ID NO: 886332

SEQ ID NO: 886337 - protein, 754 aa, Homo sapiens
MLTFLPSPQELFTRSLAESELRSAPYEFPEESPIEQLEERRQRLERQISQDVKLEPDILLRAKQDFLKTDSDSDLQLYKEQGEGQGDRSLRERDVLEREFQRVTISGEEKCGVPFTDLLDAAKSVVRALFIREKYMALSLQSFCPTTRRYLQQLAEKPLETRTYEQGPDTPVSADAPVHPPALEQHPYEHCEPSTMPGDLGLGLRMVRGVVHVYTRREPDEHCSEVELPYPDLQEFVADVNVLMALIINGPIKSFCYRRLQYLSSKFQMHVLLNEMKELAAQKKVPHRDFYNIRKVDTHIHASSCMNQKHLLRFIKRAMKRHLEEIVHVEQGREQTLREVFESMNLTAYDLSVDTLDVHADRNTFHRFDKFNAKYNPIGESVLREIFIKTDNRVSGKYFAHIIKVRRQPSLPSLEPEDLGAFEGVRLKEGEADDPLKSSDSAHLMSDSAHLMSEEVMSDLEESKYQNAELRLSIYGRSRDEWDKLARWAVMHRVHSPNVRWLVQVPRLFECPWSGRGTDVYRTKGQLANFQEMLENIFLPLFEATVHPASHPELHLFLEHVSRQRRAGYGEGSRLRIQLQLWFLTPGFCIAPVLQYLYYLAQIGIAMSPLSNNSLFLSYHRNPLPEYLSRGLMVSLSTDDPLQFHFTKEPLMEEYSIATQVWKLSSCDMCELARNSVLMSGFSHKVKSHWLGPNYTKEGPEGNDIRRTNVPDIRVGYRYETLCQELALITQAVQSEMLETIPEEAGITMSPGPQ

SEQ ID NO: 886338 - protein, 175 aa, Homo sapiens
FCAPLCVALPEAPVLQYLYYLAQIGIAMSPLSNNSLFLSYHRNPLPEYLSRGLMVSLSTDDPLQFHFTKEPLMEEYSIATQVWKLSSCDMCELARNSVLMSGFSHKVKSHWLGPNYTKEGPEGNDIRRTNVPDIRVGYRYETLCQELALITQAVQSEMLETIPEEAGITMSPGPQ

SEQ ID NO: 886339 - protein, 760 aa, Homo sapiens; identical to SEQ ID NO: 886332

SEQ ID NO: 886340 - protein, 93 aa, Homo sapiens
ARYEAGSLNGQRHSVVMSGFVATEVKSHWLGPNYTKEGPEGNDIRRTNVPDIRVGYRYETLCQELALITQAVQSEMLETIPEEAGITMSPGPQ

SEQ ID NO: 886341 - protein, 798 aa, Homo sapiens
MASEARGGLGAPPLQSARSLPGPAPCLKHFPLDLRTSMDGKCKEIAEELFTRSLAESELRSAPYEFPEESPIEQLEERRQRLERQISQDVKLEPDILLRAKQDFLKTDSDSDLQLYKEQGEGQGDRSLRERDVLEREFQRVTISGEEKCGVPFTDLLDAAKSVVRALFIREKYMALSLQSFCPTTRRYLQQLAEKPLETRTYEQGPDTPVSADAPVHPPALEQHPYEHCEPSTMPGDLGLGLRMVRGVVHVYTRREPDEHCSEVELPYPDLQEFVADVNVLMALIINGPIKSFCYRRLQYLSSKFQMHVLLNEMKELAAQKKVPHRDFYNIRKVDTHIHASSCMNQKHLLRFIKRAMKRHLEEIVHVEQGREQTLREVFESMNLTAYDLSVDTLDVHADRNTFHRFDKFNAKYNPIGESVLREIFIKTDNRVSGKYFAHIIKEVMSDLEESKYQNAELRLSIYGRSRDEWDKLARWAVMHRVHSPNVRWLVQVPRLFDVYRTKGQLANFQEMLENIFLPLFEATVHPASHPELHLFLEHVDGFDSVDDESKPENHVFNLESPLPEAWVEEDNPPYAYYLYYTFANMAMLNHLRRQRGFHTFVLRPHCGEAGPIHHLVSAFMLAENISHGLLLRKAPVLQYLYYLAQIGIAMSPLSNNSLFLSYHRNPLPEYLSRGLMVSLSTDDPLQFHFTKEPLMEEYSIATQVWKLSSCDMCELARNSVLMSGFSHKVKSHWLGPNYTKEGPEGNDIRRTNVPDIRVGYRYETLCQELALITQAVQSEMLETIPEEAGITMSPGPQ

SEQ ID NO: 886342 - protein, 760 aa, Homo sapiens; identical to SEQ ID NO: 886332

SEQ ID NO: 886343 - protein, 723 aa, Homo sapiens
MLTFLPSPQELFTRSLAESELRSAPYEFPEESPIEQLEERRQRLERQISQDVKLEPDILLRAKQDFLKTDSDSDLQLYKEQGEGQGDRSLRERDVLEREFQRVTISGEEKCGVPFTDLLDAAKSVVRALFIREKYMALSLQSFCPTTRRYLQQLAEKPLETRTYEQGPDTPVSADAPVHPPALEQHPYEHCEPSTMPGDLGLGLRMVRGVVHVYTRREPDEHCSEVELPYPDLQEFVADVNVLMALIINGPIKSFCYRRLQYLSSKFQMHVLLNEMKELAAQKKVPHRDFYNIRKVDTHIHASSCMNQKHLLRFIKRAMKRHLEEIVHVEQGREQTLREVFESMNLTAYDLSVDTLDVHADRNTFHRFDKFNAKYNPIGESVLREIFIKTDNRVSGKYFAHIIKEVMSDLEESKYQNAELRLSIYGRSRDEWDKLARWAVMHRVHSPNVRWLVQVPRLFDVYRTKGQLANFQEMLENIFLPLFEATVHPASHPELHLFLEHVDGFDSVDDESKPENHVFNLESPLPEAWVEEDNPPYAYYLYYTFANMAMLNHLRRQRGFHTFVLRPHCGEAGPIHHLVSAFMLAENISHGLLLRKAPVLQYLYYLAQIGIAMSPLSNNSLFLSYHRNPLPEYLSRGLMVSLSTDDPLQFHFTKVKSHWLGPNYTKEGPEGNDIRRTNVPDIRVGYRYETLCQELALITQAVQSEMLETIPEEAGITMSPGPQ

SEQ ID NO: 886344 - protein, 860 aa, Homo sapiens
MLTFLPSPQELFTRSLAESELRSAPYEFPEESPIEQLEERRQRLERQISQDVKLEPDILLRAKQDFLKTDSDSDLQLYKEQGEGQGDRSLRERDVLEREFQRVTISGEEKCGVPFTDLLDAAKSVVRALFIREKYMALSLQSFCPTTRRYLQQLAEKPLETRTYEQGPDTPVSADAPVHPPALEQHPYEHCEPSTMPGDLGLGLRMVRGVVHVYTRREPDEHCSEVELPYPDLQEFVADVNVLMALIINGPIKSFCYRRLQYLSSKFQMHVLLNEMKELAAQKKVPHRDFYNIRKVDTHIHASSCMNQKHLLRFIKRAMKRHLEEIVHVEQGREQTLREVFESMNLTAYDLSVDTLDVHADRNTFHRFDKFNAKYNPIGESVLREIFIKTDNRVSGKYFAHIIKEVMSDLEESKYQNAELRLSIYGRSRDEWDKLARWAVMHRVHSPNVRWLVQVPRLFECPWSGRGTCGVIFKGSGPASCPPRMAEPPLSLPTPLSARKGFLVPSMVCPAWPTWVSLLSQYGSDAPLRSWAKLLTLAGPLGFLPLALTCTYLHVVYLHDVYRTKGQLANFQEMLENIFLPLFEATVHPASHPELHLFLEHVDGFDSVDDESKPENHVFNLESPLPEAWVEEDNPPYAYYLYYTFANMAMLNHLRRQRGFHTFVLRPHCGEAGPIHHLVSAFMLAENISHGLLLRKAPVLQYLYYLAQIGIAMSPLSNNSLFLSYHRNPLPEYLSRGLMVSLSTDDPLQFHFTKEPLMEEYSIATQVWKLSSCDMCELARNSVLMSGFSHKVKSHWLGPNYTKEGPEGNDIRRTNVPDIRVGYRYETLCQELALITQAVQSEMLETIPEEAGITMSPGPQ

SEQ ID NO: 886345 - protein, 760 aa, Homo sapiens; identical to SEQ ID NO: 886332

SEQ ID NO: 886346 - protein, 194 aa, Homo sapiens
MLTFLPSPQELFTRSLAESELRSAPYEFPEESPIEQLEERRQRLERQISQDVKLEPDILLRAKQDFLKTDSDSDLQSTDDPLQFHFTKEPLMEEYSIATQVWKLSSCDMCELARNSVLMSGFSHKVKSHWLGPNYTKEGPEGNDIRRTNVPDIRVGYRYETLCQELALITQAVQSEMLETIPEEAGITMSPGPQ

SEQ ID NO: 886347 - protein, 291 aa, Homo sapiens
MAEISRIQYEMEYTEGISQRMRVPEKLKVAPPNADLEQGFQEGVPNASVIMQVPERIVVAGNNEDVSFSRPADLDLIQSTPFKPLALKTPPRVLTLSERPLDFLDLERPPTTPQNEEIRAVGRLKRERSMSENAVRQNGQLVRNDSLVTPSPQQARVCPPHMLPEDGANLSSARGILSLIQSSTRRAYQQILDVLDENRRPVLRGGSAAATSNPHHDNVRYGISNIDTTIEGTSDDLTVVDAASLRRQIIKLNRRLQLLEEENKERAKREMVMYSITVAFWLLNSWLWFRR

SEQ ID NO: 886348 - protein, 307 aa, Homo sapiens
MDDFISISLLSLAMLVGCYVAGIIPLAVNFSEERLKLVTVLGAGLLCGTALAVIVPEGVHALYEDILEGKHHQASETHNVIASDKAAEKSVVHEHEHSHDHTQLHAYIGVSLVLGFVFMLLVDQIGNSHVHSTDDPEAARSSNSKITTTLGLVVHAAADGVALGAAASTSQTSVQLIVFVAIMLHKAPAAFGLVSFLMHAGLERNRIRKHLLVFALAAPVMSMVTYLGLSKSSKEALSEVNATGVAMLFSAGTFLYVATVHVLPEVGGIGHSHKPDATGGRGLSRLEVAALVLGCLIPLILSVGHQH

SEQ ID NO: 886349 - protein, 307 aa, Homo sapiens; identical to SEQ ID NO: 886348

SEQ ID NO: 886350 - protein, 307 aa, Homo sapiens; identical to SEQ ID NO: 886348

SEQ ID NO: 886351 - protein, 307 aa, Homo sapiens; identical to SEQ ID NO: 886348

SEQ ID NO: 886352 - protein, 307 aa, Homo sapiens; identical to SEQ ID NO: 886348

SEQ ID NO: 886353 - protein, 307 aa, Homo sapiens; identical to SEQ ID NO: 886348

SEQ ID NO: 886354 - protein, 245 aa, Homo sapiens
MDDFISISLLSLAMLVGCYVAGIIPLAVNFSEERLKLVTVLGAGLLCGTALAVIVPEGVHALYEDILEGKHHQASETHNVIASDKAAEKSVVHEHEHSHDHTQLHAYIGVSLVLGFVFMLLVDQIGNSHVHSTDDPEAARSSNSKITTTLGLVVHAAADGVALGAAASTSQTSVQLIVFVAIMLHKAPAAFGLVSFLMHAGLERNRIRKHLLVFALAAPVMSMVTYLGLSKRTKRTHQHRSVLSP

SEQ ID NO: 886355 - protein, 232 aa, Homo sapiens
MDDFISISLLSLAMLVGCYVAGIIPLAVNFSEERLKLVTVLGAGLLCGTALAVIVPEGVHALYEDILEGKHHQASETHNVIASDKAAEKSVVHEHEHSHDHTQLHAYIGVSLVLGFVFMLLVDQIGNSHVHSTDDPEAARSSNSKITTTLGLVVHAAADGVALGAAASTSQTSVQLIVFVAIMLHKAPAAFGLVSFLMHAGLERNRIRKHLLVFALAAPVMSMVTYLGLSKV

SEQ ID NO: 886356 - protein, 107 aa, Homo sapiens [sequence omitted]

SEQ ID NO: 886357 - protein, 307 aa, Homo sapiens; identical to SEQ ID NO: 886348

SEQ ID NO: 886358 - protein, 307 aa, Homo sapiens; identical to SEQ ID NO: 886348

SEQ ID NO: 886359 - protein, 307 aa, Homo sapiens; identical to SEQ ID NO: 886348

SEQ ID NO: 886360 - protein, 307 aa, Homo sapiens; identical to SEQ ID NO: 886348

SEQ ID NO: 886361 - protein, 327 aa, Homo sapiens
MEFKLEAHRIVSISLGKIYNSRVQRGGIKLHKNLLVSLVLRSARQVYLSDPCPGLYLAGPAGTPAPPPQQQPGEPAAGPPAGWGEPPPPAARASWPETEPQPERSSVSDAPRVGDEVPVATVTGVGDVFQGGEADATEAAWSRVEGPRQAAAREAEGTAGGWGVFPEVSRAARRPCGCPLGGEDPPGTPAATPRAACCCAPRPAEDEPPAPPAVCPRKRCAAGVGGGPAGCPAPGSTPLKKPRRNLEQPPSGGEDDDAEEMETGNVANLISIFGSSFSGLLRKSPGGGREEEEGEESGPEAAEPGQICCDKPVLRDMNPWSTAIVAF

SEQ ID NO: 886362 - protein, 327 aa, Homo sapiens; identical to SEQ ID NO: 886361

SEQ ID NO: 886363 - protein, 105 aa, Homo sapiens
SAGGGARRGAAMAAGGSDPRAGDVEEDASQLIFPKEFETAETLLNSEVHMLLEHRKQQNESAEDEQELSEVFMKTLNYTARFSRFKNRETIASVRRDKVSLCCPG

SEQ ID NO: 886364 - protein, 142 aa, Homo sapiens; identical to SEQ ID NO: 771513

SEQ ID NO: 886365 - protein, 142 aa, Homo sapiens; identical to SEQ ID NO: 771513

SEQ ID NO: 886366 - protein, 142 aa, Homo sapiens; identical to SEQ ID NO: 771513

SEQ ID NO: 886367 - protein, 142 aa, Homo sapiens; identical to SEQ ID NO: 771513

SEQ ID NO: 886368 - protein, 142 aa, Homo sapiens; identical to SEQ ID NO: 771513

SEQ ID NO: 886369 - protein, 142 aa, Homo sapiens; identical to SEQ ID NO: 771513

SEQ ID NO: 886370 - protein, 142 aa, Homo sapiens; identical to SEQ ID NO: 771513

SEQ ID NO: 886371 - protein, 142 aa, Homo sapiens; identical to SEQ ID NO: 771513

SEQ ID NO: 886372 - protein, 142 aa, Homo sapiens; identical to SEQ ID NO: 771513

SEQ ID NO: 886373 - protein, 104 aa, Homo sapiens
MLLEHRKQQNESAEDEQELSEVFMKTLNYTARFSRFKNRETIASVRSLLLQKKLHKFELACLANLCPETAEESKALIPSLEGRFEDEELQQILDDIQTKRSFQY

SEQ ID NO: 886374 - protein, 110 aa, Homo sapiens
MAAGGSDPRAGDVEEDASQLIFPKEFETAETLLNSEVHMLLEHRKQQNESAEDEQELSEVFMKTLNYTARFSRFKNRETIASVRSLEGRFEDEELQQILDDIQTKRSFQY

SEQ ID NO: 886375 - protein, 110 aa, Homo sapiens
MAAGGSDPRAGDVEEDASQLIFPKAWRDGLKMRSCSRFLMISRQSAAFSINLQTSLLLGETTSPGITPPSHCLGLTCTEILLKTVENSFGENSPAWRGVRLLFQITHRPR

SEQ ID NO: 886376 - protein, 508 aa, Homo sapiens
MTQTLKYASRVFHRVRWAPELGASLGYREYHSARRSLADIPGPSTPSFLAELFCKGGLSRLHELQVQGAAHFGPVWLASFGTVRTVYVAAPALVEELLRQEGPRPERCSFSPWTEHRRCRQRACGLLTAEGEEWQRLRSLLAPLLLRPQAAARYAGTLNNVVCDLVRRLRRQRGRGTGPPALVRDVAGEFYKFGLEGIAAVLLGSRLGCLEAQVPPDTETFIRAVGSVFVSTLLTMAMPHWLRHLVPGPWGRLCRDWDQMFAFAQRHVERREAEAAMRNGGQPEKDLESGAHLTHFLFREELPAQSILGNVTELLLAGVDTVSNTLSWALYELSRHPEVQTALHSEITAALSPGSSAYPSATVLSQLPLLKAVVKEVLRLYPVVPGNSRVPDKDIHVGDYIIPKNTLVTLCHYATSRDPAQFPEPNSFRPARWLGEGPTPHPFASLPFGFGKRSCMGRRLAELELQMALAQILTHFEVQPEPGAAPVRPKTRTVLVPERSINLQFLDR

SEQ ID NO: 886377 - protein, 536 aa, Homo sapiens
MTQTLKYASRVFHRVRWAPELGASLGYREYHSARRSLADIPGPSTPSFLAELFCKGGLSRLHELQVQGAAHFGPVWLASFGTVRTVYVAAPALVEELLRQEGPRPERCSFSPWTEHRRCRQRACGLLTAEGEEWQRLRSLLAPLLLRPQAAARYAGTLNNVVCDLVRRLRRQRGRGTGPPALVRDVAGEFYKFGLEGESQDRAGQASGAPYQSLPEPCGAPSRQGIAAVLLGSRLGCLEAQVPPDTETFIRAVGSVFVSTLLTMAMPHWLRHLVPGPWGRLCRDWDQMFAFAQRHVERREAEAAMRNGGQPEKDLESGAHLTHFLFREELPAQSILGNVTELLLAGVDTVSNTLSWALYELSRHPEVQTALHSEITAALSPGSSAYPSATVLSQLPLLKAVVKEVLRLYPVVPGNSRVPDKDIHVGDYIIPKNTLVTLCHYATSRDPAQFPEPNSFRPARWLGEGPTPHPFASLPFGFGKRSCMGRRLAELELQMALAQILTHFEVQPEPGAAPVRPKTRTVLVPERSINLQFLDR

SEQ ID NO: 886378 - protein, 105 aa, Homo sapiens
MTQTLKYASRVFHRVRWAPELGASLGYREYHSARRSLADIPGPSTPSFLAELFCKGGLSRLHELQVGRDAFPETECWGNWFCQRQKGLTSAEQMWDSQRERMPMK

SEQ ID NO: 886379 - protein, 479 aa, Homo sapiens
ATLAGPRLPGTREKSRSPGSSQLRLLELRHSTLLKKVQGAAHFGPVWLASFGTVRTVYVAAPALVEELLRQEGPRPERCSFSPWTEHRRCRQRACGLLTAEGEEWQRLRSLLAPLLLRPQAAARYAGTLNNVVCDLVRRLRRQRGRGTGPPALVRDVAGEFYKFGLEGIAAVLLGSRLGCLEAQVPPDTETFIRAVGSVFVSTLLTMAMPHWLRHLVPGPWGRLCRDWDQMFAFAQRHVERREAEAAMRNGGQPEKDLESGAHLTHFLFREELPAQSILGNVTELLLAGVDTVSNTLSWALYELSRHPEVQTALHSEITAALSPGSSAYPSATVLSQLPLLKAVVKEVLRLYPVVPGNSRVPDKDIHVGDYIIPKNTLVTLCHYATSRDPAQFPEPNSFRPARWLGEGPTPHPFASLPFGFGKRSCMGRRLAELELQMALAQILTHFEVQPEPGAAPVRPKTRTVLVPERSINLQFLDR

SEQ ID NO: 886380 - protein, 499 aa, Homo sapiens
MREEEFAVSKAYTSWAPEKEQKLPIPKPSQQPLAWAQVKLKVPAQVSKCPLCPLPQVQGAAHFGPVWLASFGTVRTVYVAAPALVEELLRQEGPRPERCSFSPWTEHRRCRQRACGLLTAEGEEWQRLRSLLAPLLLRPQAAARYAGTLNNVVCDLVRRLRRQRGRGTGPPALVRDVAGEFYKFGLEGIAAVLLGSRLGCLEAQVPPDTETFIRAVGSVFVSTLLTMAMPHWLRHLVPGPWGRLCRDWDQMFAFAQRHVERREAEAAMRNGGQPEKDLESGAHLTHFLFREELPAQSILGNVTELLLAGVDTVSNTLSWALYELSRHPEVQTALHSEITAALSPGSSAYPSATVLSQLPLLKAVVKEVLRLYPVVPGNSRVPDKDIHVGDYIIPKNTLVTLCHYATSRDPAQFPEPNSFRPARWLGEGPTPHPFASLPFGFGKRSCMGRRLAELELQMALAQILTHFEVQPEPGAAPVRPKTRTVLVPERSINLQFLDR

SEQ ID NO: 886381 - protein, 450 aa, Homo sapiens
STEMIREVQGAAHFGPVWLASFGTVRTVYVAAPALVEELLRQEGPRPERCSFSPWTEHRRCRQRACGLLTAEGEEWQRLRSLLAPLLLRPQAAARYAGTLNNVVCDLVRRLRRQRGRGTGPPALVRDVAGEFYKFGLEGIAAVLLGSRLGCLEAQVPPDTETFIRAVGSVFVSTLLTMAMPHWLRHLVPGPWGRLCRDWDQMFAFAQRHVERREAEAAMRNGGQPEKDLESGAHLTHFLFREELPAQSILGNVTELLLAGVDTVSNTLSWALYELSRHPEVQTALHSEITAALSPGSSAYPSATVLSQLPLLKAVVKEVLRLYPVVPGNSRVPDKDIHVGDYIIPKNTLVTLCHYATSRDPAQFPEPNSFRPARWLGEGPTPHPFASLPFGFGKRSCMGRRLAELELQMALAQILTHFEVQPEPGAAPVRPKTRTVLVPERSINLQFLDR

SEQ ID NO: 886382 - protein, 151 aa, Homo sapiens
AAWGCAAVDCLIDTLRTPNASCMRKGTHLLVPCLEEEELALHRRRLDMSEALPCPGKETPTPGCRLGALYWACVHNDPTQLQAILDGGVSPEEATQVDKQWEGHVPLVSLLLNYYVGLDLERRDQRGLTALMKAAMRNRCECVATLLMAGV

SEQ ID NO: 886383 - protein, 274 aa, Homo sapiens
MPGKLRSDAGLESDTAMKKGETLRKQTEEKEKKEKPKSDKTEEIAEEEETVFPKAKQVKKKAEPSEVDMNSPKSKKAKKKEEPSQNDISPKTKSLRKKKEPIEKKVVSSKTKKVTKNEEPSEEEIDAPKPKKMKKEKEMNGETREKSPKLKNGFPHPEPDCNPSEAASEESNSEIEQEIPVEQKEGAFSNFPISEETIKLLKGRGVTFLFPIQAKTFHHVYSGKDLIAQARTGTGKTFSFAIPLIEKLHGELQDRKRGRAPQVWFCAPKGWGPL

SEQ ID NO: 886384 - protein, 814 aa, Homo sapiens
VTRAGWTQGGELPLPLHAVEKTGRPGQPALKMPGKLRSDAGLESDTAMKKGETLRKQTEEKEKKEKPKSDKTEEIAEEEETVFPKAKQVKKKAEPSEVDMNSPKSKKAKKKEEPSQNDISPKTKSLRKKKEPIEKKVVSSKTKKVTKNEEPSEEEIDAPKPKKMKKEKEMNGETREKSPKLKNGFPHPEPDCNPSEAASEESNSEIEQEIPVEQKEGAFSNFPISEETIKLLKGRGVTFLFPIQAKTFHHVYSGKDLIAQARTGTGKTFSFAIPLIEKLHGELQDRKRGRAPQVLVLAPTRELANQVSKDFSDITKKLSVACFYGGTPYGGQFERMRNGIDILVGTPGRIKDHIQNGKLDLTKLKHVVLDEVDQMLDMGFADQVEEILSVAYKKDSEDNPQTLLFSATCPHWVFNVAKKYMKSTYEQVDLIGKKTQKTAITVEHLAIKCHWTQRAAVIGDVIRVYSGHQGRTIIFCETKKEAQELSQNSAIKQDAQSLHGDIPQKQREITLKGFRNGSFGVLVATNVAARGLDIPEVDLVIQSSPPKDVESYIHRSGRTGRAGRTGVCICFYQHKEEYQLVQVEQKAGIKFKRIGVPSATEIIKASSKDAIRLLDSVPPTAISHFKQSAEKLIEEKGAVEALAAALAHISGATSVDQRSLINSNVGFVTMILQCSIEMPNISYAWKELKEQLGEEIDSKVKGMVFLKGKLGVCFDVPTASVTEIQEKWHDSRRWQLSVATEQPELEGPREGYGGFRGQREGSRGFRGQRDGNRRFRGQREGSRGPRGQRSGGGNKSNRSQNKGQKRSFSKAFGQ

SEQ ID NO: 886385 - protein, 814 aa, Homo sapiens; identical to SEQ ID NO: 886384

SEQ ID NO: 886386 - protein, 814 aa, Homo sapiens; identical to SEQ ID NO: 886384

SEQ ID NO: 886387 - protein, 814 aa, Homo sapiens; identical to SEQ ID NO: 886384

SEQ ID NO: 886388 - protein, 806 aa, Homo sapiens
KSSRGWVKSADEKTGRPGQPALKMPGKLRSDAGLESDTAMKKGETLRKQTEEKEKKEKPKSDKTEEIAEEEETVFPKAKQVKKKAEPSEVDMNSPKSKKAKKKEEPSQNDISPKTKSLRKKKEPIEKKVVSSKTKKVTKNEEPSEEEIDAPKPKKMKKEKEMNGETREKSPKLKNGFPHPEPDCNPSEAASEESNSEIEQEIPVEQKEGAFSNFPISEETIKLLKGRGVTFLFPIQAKTFHHVYSGKDLIAQARTGTGKTFSFAIPLIEKLHGELQDRKRGRAPQVLVLAPTRELANQVSKDFSDITKKLSVACFYGGTPYGGQFERMRNGIDILVGTPGRIKDHIQNGKLDLTKLKHVVLDEVDQMLDMGFADQVEEILSVAYKKDSEDNPQTLLFSATCPHWVFNVAKKYMKSTYEQVDLIGKKTQKTAITVEHLAIKCHWTQRAAVIGDVIRVYSGHQGRTIIFCETKKEAQELSQNSAIKQDAQSLHGDIPQKQREITLKGFRNGSFGVLVATNVAARGLDIPEVDLVIQSSPPKDVESYIHRSGRTGRAGRTGVCICFYQHKEEYQLVQVEQKAGIKFKRIGVPSATEIIKASSKDAIRLLDSVPPTAISHFKQSAEKLIEEKGAVEALAAALAHISGATSVDQRSLINSNVGFVTMILQCSIEMPNISYAWKELKEQLGEEIDSKVKGMVFLKGKLGVCFDVPTASVTEIQEKWHDSRRWQLSVATEQPELEGPREGYGGFRGQREGSRGFRGQRDGNRRFRGQREGSRGPRGQRSGGGNKSNRSQNKGQKRSFSKAFGQ

SEQ ID NO: 886389 - protein, 831 aa, Homo sapiens
AEYVCCPQTKIIGSVSKEEEEEDEEEEDEEQMKRKTMMFIKREFPTEADSGKLRSDAGLESDTAMKKGETLRKQTEEKEKKEKPKSDKTEEIAEEEETVFPKAKQVKKKAEPSEVDMNSPKSKKAKKKEEPSQNDISPKTKSLRKKKEPIEKKVVSSKTKKVTKNEEPSEEEIDAPKPKKMKKEKEMNGETREKSPKLKNGFPHPEPDCNPSEAASEESNSEIEQEIPVEQKEGAFSNFPISEETIKLLKGRGVTFLFPIQAKTFHHVYSGKDLIAQARTGTGKTFSFAIPLIEKLHGELQDRKRGRAPQVLVLAPTRELANQVSKDFSDITKKLSVACFYGGTPYGGQFERMRNGIDILVGTPGRIKDHIQNGKLDLTKLKHVVLDEVDQMLDMGFADQVEEILSVAYKKDSEDNPQTLLFSATCPHWVFNVAKKYMKSTYEQVDLIGKKTQKTAITVEHLAIKCHWTQRAAVIGDVIRVYSGHQGRTIIFCETKKEAQELSQNSAIKQDAQSLHGDIPQKQREITLKGFRNGSFGVLVATNVAARGLDIPEVDLVIQSSPPKDVESYIHRSGRTGRAGRTGVCICFYQHKEEYQLVQVEQKAGIKFKRIGVPSATEIIKASSKDAIRLLDSVPPTAISHFKQSAEKLIEEKGAVEALAAALAHISGATSVDQRSLINSNVGFVTMILQCSIEMPNISYAWKELKEQLGEEIDSKVKGMVFLKGKLGVCFDVPTASVTEIQEKWHDSRRWQLSVATEQPELEGPREGYGGFRGQREGSRGFRGQRDGNRRFRGQREGSRGPRGQRSGGGNKSNRSQNKGQKRSFSKAFGQ

SEQ ID NO: 886390 - protein, 754 aa, Homo sapiens
AAARHGCRRRQNEEIAEEEETVFPKAKQVKKKAEPSEVDMNSPKSKKAKKKEEPSQNDISPKTKSLRKKKEPIEKKVVSSKTKKVTKNEEPSEEEIDAPKPKKMKKEKEMNGETREKSPKLKNGFPHPEPDCNPSEAASEESNSEIEQEIPVEQKEGAFSNFPISEETIKLLKGRGVTFLFPIQAKTFHHVYSGKDLIAQARTGTGKTFSFAIPLIEKLHGELQDRKRGRAPQVLVLAPTRELANQVSKDFSDITKKLSVACFYGGTPYGGQFERMRNGIDILVGTPGRIKDHIQNGKLDLTKLKHVVLDEVDQMLDMGFADQVEEILSVAYKKDSEDNPQTLLFSATCPHWVFNVAKKYMKSTYEQVDLIGKKTQKTAITVEHLAIKCHWTQRAAVIGDVIRVYSGHQGRTIIFCETKKEAQELSQNSAIKQDAQSLHGDIPQKQREITLKGFRNGSFGVLVATNVAARGLDIPEVDLVIQSSPPKDVESYIHRSGRTGRAGRTGVCICFYQHKEEYQLVQVEQKAGIKFKRIGVPSATEIIKASSKDAIRLLDSVPPTAISHFKQSAEKLIEEKGAVEALAAALAHISGATSVDQRSLINSNVGFVTMILQCSIEMPNISYAWKELKEQLGEEIDSKVKGMVFLKGKLGVCFDVPTASVTEIQEKWHDSRRWQLSVATEQPELEGPREGYGGFRGQREGSRGFRGQRDGNRRFRGQREGSRGPRGQRSGGGNKSNRSQNKGQKRSFSKAFGQ

SEQ ID NO: 886391 - protein, 785 aa, Homo sapiens
VTRAGWTQGGELPLPLHAVEKTGRPGQPALKMPGKLRSDAGLESDTAMKKGETLRKQTEEKEKKEKPKSDKTEEIAEEEETVFPKAKQVKKKAEPSEVDMNSPKSKKAKKKEEPSQNDISPKTKSLRKKKEPIEKKVVSSKTKKVTKNEEPSEEEIDAPKPKKMKKEKEMNGETREKSPKLKNGFPHPEPDCNPSEAASEESNSEIEQEIPVEQKEGAFSNFPISEETIKLLKGRGVTFLFPIQAKTFHHVYSGKDLIAQARTGTGKTFSFAIPLIEKLHGELQDRKRGRAPQVLVLAPTRELANQVSKDFSDITKKLSVACFYGGTPYGGQFERMRNGIDILVGTPGRIKDHIQNGKLDLTKLKHVVLDEVDQMLDMGFADQVEEILSVAYKKDSEDNPQTLLFSATCPHWVFNVAKKYMKSTYEQVDLIGKKTQKTAITVEHLAIKCHWTQRAAVIGDVIRVYSGHQGRTIIFCETKKEAQELSQNSAIKQDAQSLHGDIPQKQREITLKGFRNGSFGVLVATNVAARGLDIPEVDLVIQSSPPKDVESYIHRSGRTGRAGRTGVCICFYQHKEEYQLVQVEQKAGIKFKRIGVPSATEIIKASSKDAIRLLDSVPPTAISHFKQSAEKLIEEKGAVEALAAALAHISGATSVDQRSLINSNVGFVTMILQCSIEMPNISYAWKELKEQLGEEIDSKVKGMVFLKGKLGVCFDVPTASVTEIQEKWHDSRRWQLSVATEQPELEGPREGYGGFRGHDQEVATKVTDPKTKARSGVSVKHLVNN

SEQ ID NO: 886392 - protein, 569 aa, Homo sapiens
RYEARGEIGRDLIAQARTGTGKTFSFAIPLIEKLHGELQDRKRGRAPQVLVLAPTRELANQVSKDFSDITKKLSVACFYGGTPYGGQFERMRNGIDILVGTPGRIKDHIQNGKLDLTKLKHVVLDEVDQMLDMGFADQVEEILSVAYKKDSEDNPQTLLFSATCPHWVFNVAKKYMKSTYEQVDLIGKKTQKTAITVEHLAIKCHWTQRAAVIGDVIRVYSGHQGRTIIFCETKKEAQELSQNSAIKQDAQSLHGDIPQKQREITLKGFRNGSFGVLVATNVAARGLDIPEVDLVIQSSPPKDVESYIHRSGRTGRAGRTGVCICFYQHKEEYQLVQVEQKAGIKFKRIGVPSATEIIKASSKDAIRLLDSVPPTAISHFKQSAEKLIEEKGAVEALAAALAHISGATSVDQRSLINSNVGFVTMILQCSIEMPNISYAWKELKEQLGEEIDSKVKGMVFLKGKLGVCFDVPTASVTEIQEKWHDSRRWQLSVATEQPELEGPREGYGGFRGQREGSRGFRGQRDGNRRFRGQREGSRGPRGQRSGGGNKSNRSQNKGQKRSFSKAFGQ

SEQ ID NO: 886393 - protein, 230 aa, Homo sapiens
VTRAGWTQGGELPLPLHAVEKTGRPGQPALKMPGKLRSDAGLESDTAMKKGETLRKQTEEKEKKEKPKSDKTEEIAEEEETVFPKAKQVKKKAEPSEVDMNSPKSKKAKKKEEPSQNDISPKTKSLRKKKEPIEKKVVSSKTKKVTKNEEPSEEEIDAPKPKKMKKEKEMNGETREKSPKLKNGFPHPEPDCNPSEAASEESNSEIEQEIPVEQKEGAFSNFPIFQVPRP

SEQ ID NO: 886394 - protein, 331 aa, Homo sapiens
AAAKQRYQSPPREEEEPEPLPQQPLDPPPFFPISPPGLLVLGGRRREGTLDVPGSDLASEEGAAEPGVLEDTLVPELIMKALDEPPYLTVGTDVSAKYKWSKKLGIKFKRIGVPSATEIIKASSKDAIRLLDSVPPTAISHFKQSAEKLIEEKGAVEALAAALAHISGATSVDQRSLINSNVGFVTMILQCSIEMPNISYAWKELKEQLGEEIDSKVKGMVFLKGKLGVCFDVPTASVTEIQEKWHDSRRWQLSVATEQPELEGPREGYGGFRGQREGSRGFRGQRDGNRRFRGQREGSRGPRGQRSGGGNKSNRSQNKGQKRSFSKAFGQ

SEQ ID NO: 886395 - protein, 746 aa, Homo sapiens
VTRAGWTQGGELPLPLHAVEKTGRPGQPALKMPGKLRSDAGLESDTAMKKGETLRKQTEEKEKKEKPKSDKTEEIAEEEETVFPKAKQVKKKAEPSEVDMNSPKSKKAKKKEEPSQNDISPKTKSLRKKKEPIEKKVVSSKTKKVTKNEEPSEEEIDAPKPKKMKKEKEMNGETREKSPKLKNGFPHPEPDCNPSEAASEESNSEIEQEIPVEQKEGAFSNFPISEETIKLLKGRGVTFLFPIQAKTFHHVYSGKDLIAQARTGTGKTFSFAIPLIEKLHGELQDRKRGRAPQVLVLAPTRELANQVSKDFSDITKKLSVACFYGGTPYGGQFERMRNGIDILVGTPGRIKDHIQNGKLDLTKLKHVVLDEVDQMLDMGFADQVEEILSVAYKKDSEDNPQTLLFSATCPHWVFNVAKKYMKSTYEQVDLIGKKTQKTAITVEHLAIKCHWTQRAAVIGDVIRVYSGHQGRTIIFCETKKEAQELSQNSAIKQDAQSLHGDIPQKQREITLKGFRNGSFGVLVATNVAARGLDIPEVDLVIQSSPPKDVESYIHRSGRTGRAGRTGVCICFYQHKEEYQLVQVEQKAGIKFKRIGVPSATEIIKASSKDAIRLLDSVPPTAISHFKQSAEKLIEEKGAVEALAAALAHISGATSVDQRSLINSNVGFVTMILQCSIEMPNISYAWKELKEQLGEEIDSKVKGMVFLKGKLGVCFDVPTASVTEIQEKWHDSRRCLQHMPVPAHHLV

SEQ ID NO: 886396 - protein, 351 aa, Homo sapiens
VTRAGWTQGGELPLPLHAVEKTGRPGQPALKMPGKLRSDAGLESDTAMKKGETLRKQTEEKEKKEKPKSDKTEEIAEEEETVFPKAKQVKKKAEPSEVDMNSPKSKKAKKKEEPSQNDISPKTKSLRKKKEPIEKKVVSSKTKKVTKNEEPSEEEIDAPKPKKMKKEKEMNGETREKSPKLKNGFPHPEPDCNPSEAASEESNSEIEQEIPVEQKEGAFSNFPISEETIKLLKGRGVTFLFPIQAKTFHHVYSGKDLIAQARTGTGKTFSFAIPLIEKLHGELQDRKRGRAPQVNISNTVLGSFRSAQKRDTAWASLHTLFCLVVFCFLFFFLGLHLQHMAVPRLSELAVS

SEQ ID NO: 886397 - protein, 814 aa, Homo sapiens; identical to SEQ ID NO: 886384

SEQ ID NO: 886398 - protein, 814 aa, Homo sapiens; identical to SEQ ID NO: 886384

SEQ ID NO: 886399 - protein, 783 aa, Homo sapiens
MPGKLRSDAGLESDTAMKKGETLRKQTEEKEKKEKPKSDKTEEIAEEEETVFPKAKQVKKKAEPSEVDMNSPKSKKAKKKEEPSQNDISPKTKSLRKKKEPIEKKVVSSKTKKVTKNEEPSEEEIDAPKPKKMKKEKEMNGETREKSPKLKNGFPHPEPDCNPSEAASEESNSEIEQEIPVEQKEGAFSNFPISEETIKLLKGRGVTFLFPIQAKTFHHVYSGKDLIAQARTGTGKTFSFAIPLIEKLHGELQDRKRGRAPQVLVLAPTRELANQVSKDFSDITKKLSVACFYGGTPYGGQFERMRNGIDILVGTPGRIKDHIQNGKLDLTKLKHVVLDEVDQMLDMGFADQVEEILSVAYKKDSEDNPQTLLFSATCPHWVFNVAKKYMKSTYEQVDLIGKKTQKTAITVEHLAIKCHWTQRAAVIGDVIRVYSGHQGRTIIFCETKKEAQELSQNSAIKQDAQSLHGDIPQKQREITLKGFRNGSFGVLVATNVAARGLDIPEVDLVIQSSPPKDVESYIHRSGRTGRAGRTGVCICFYQHKEEYQLVQVEQKAGIKFKRIGVPSATEIIKASSKDAIRLLDSVPPTAISHFKQSAEKLIEEKGAVEALAAALAHISGATSVDQRSLINSNVGFVTMILQCSIEMPNISYAWKELKEQLGEEIDSKVKGMVFLKGKLGVCFDVPTASVTEIQEKWHDSRRWQLSVATEQPELEGPREGYGGFRGQREGSRGFRGQRDGNRRFRGQREGSRGPRGQRSGGGNKSNRSQNKGQKRSFSKAFGQ

SEQ ID NO: 886400 - protein, 807 aa, Homo sapiens
TYASTSSCYRPSEKTGRPGQPALKMPGKLRSDAGLESDTAMKKGETLRKQTEEKEKKEKPKSDKTEEIAEEEETVFPKAKQVKKKAEPSEVDMNSPKSKKAKKKEEPSQNDISPKTKSLRKKKEPIEKKVVSSKTKKVTKNEEPSEEEIDAPKPKKMKKEKEMNGETREKSPKLKNGFPHPEPDCNPSEAASEESNSEIEQEIPVEQKEGAFSNFPISEETIKLLKGRGVTFLFPIQAKTFHHVYSGKDLIAQARTGTGKTFSFAIPLIEKLHGELQDRKRGRAPQVLVLAPTRELANQVSKDFSDITKKLSVACFYGGTPYGGQFERMRNGIDILVGTPGRIKDHIQNGKLDLTKLKHVVLDEVDQMLDMGFADQVEEILSVAYKKDSEDNPQTLLFSATCPHWVFNVAKKYMKSTYEQVDLIGKKTQKTAITVEHLAIKCHWTQRAAVIGDVIRVYSGHQGRTIIFCETKKEAQELSQNSAIKQDAQSLHGDIPQKQREITLKGFRNGSFGVLVATNVAARGLDIPEVDLVIQSSPPKDVESYIHRSGRTGRAGRTGVCICFYQHKEEYQLVQVEQKAGIKFKRIGVPSATEIIKASSKDAIRLLDSVPPTAISHFKQSAEKLIEEKGAVEALAAALAHISGATSVDQRSLINSNVGFVTMILQCSIEMPNISYAWKELKEQLGEEIDSKVKGMVFLKGKLGVCFDVPTASVTEIQEKWHDSRRWQLSVATEQPELEGPREGYGGFRGQREGSRGFRGQRDGNRRFRGQREGSRGPRGQRSGGGNKSNRSQNKGQKRSFSKAFGQ

SEQ ID NO: 886401 - protein, 650 aa, Homo sapiens
PGVNRPRGETREKSPKLKNGFPHPEPDCNPSEAASEESNSEIEQEIPVEQKEGAFSNFPISEETIKLLKGRGVTFLFPIQAKTFHHVYSGKDLIAQARTGTGKTFSFAIPLIEKLHGELQDRKRGRAPQVLVLAPTRELANQVSKDFSDITKKLSVACFYGGTPYGGQFERMRNGIDILVGTPGRIKDHIQNGKLDLTKLKHVVLDEVDQMLDMGFADQVEEILSVAYKKDSEDNPQTLLFSATCPHWVFNVAKKYMKSTYEQVDLIGKKTQKTAITVEHLAIKCHWTQRAAVIGDVIRVYSGHQGRTIIFCETKKEAQELSQNSAIKQDAQSLHGDIPQKQREITLKGFRNGSFGVLVATNVAARGLDIPEVDLVIQSSPPKDVESYIHRSGRTGRAGRTGVCICFYQHKEEYQLVQVEQKAGIKFKRIGVPSATEIIKASSKDAIRLLDSVPPTAISHFKQSAEKLIEEKGAVEALAAALAHISGATSVDQRSLINSNVGFVTMILQCSIEMPNISYAWKELKEQLGEEIDSKVKGMVFLKGKLGVCFDVPTASVTEIQEKWHDSRRWQLSVATEQPELEGPREGYGGFRGQREGSRGFRGQRDGNRRFRGQREGSRGPRGQRSGGGNKSNRSQNKGQKRSFSKAFGQ

SEQ ID NO: 886402 - protein, 479 aa, Homo sapiens [sequence omitted]

SEQ ID NO: 886403 - protein, 440 aa, Homo sapiens
MLDMGFADQVEEILSVAYKKDSEDNPQTLLFSATCPHWVFNVAKKYMKSTYEQVDLIGKKTQKTAITVEHLAIKCHWTQRAAVIGDVIRVYSGHQGRTIIFCETKKEAQELSQNSAIKQDAQSLHGDIPQKQREITLKGFRNGSFGVLVATNVAARGLDIPEVDLVIQSSPPKDVESYIHRSGRTGRAGRTGVCICFYQHKEEYQLVQVEQKAGIKFKRIGVPSATEIIKASSKDAIRLLDSVPPTAISHFKQSAEKLIEEKGAVEALAAALAHISGATSVDQRSLINSNVGFVTMILQCSIEMPNISYAWKELKEQLGEEIDSKVKGMVFLKGKLGVCFDVPTASVTEIQEKWHDSRRWQLSVATEQPELEGPREGYGGFRGQREGSRGFRGQRDGNRRFRGQREGSRGPRGQRSGGGNKSNRSQNKGQKRSFSKAFGQ

SEQ ID NO: 886404 - protein, 846 aa, Homo sapiens
VTRAGWTQGGELPLPLHAVEKTGRPGQPALKMPGKLRSDAGLESDTAMKKGETLRKQTEEKEKKEKPKSDKTEEIAEEEETVFPKAKQVKKKAEPSEVDMNSPKSKKAKKKEEPSQNDISPKTKSLRKKKEPIEKKVVSSKTKKVTKNEEPSEEEIDAPKPKKMKKEKEMNGETREKSPKLKNGFPHPEPDCNPSEAASEESNSEIEQEIPVEQKEGAFSNFPISEETIKLLKGRGVTFLFPIQAKTFHHVYSGKDLIAQARTGTGKTFSFAIPLIEKLHGELQDRKRGRAPQVLVLAPTRELANQVSKDFSDITKKLSVACFYGGTPYGGQFERMRNGIDILVGTPGRIKDHIQNGKLDLTKLKHVVLDEVDQMLDMGFADQVEEILSVAYKKDSEDNPQTLLFSATCPHWVFNVAKKYMKSTYEQVDLIGKKTQKTAITVEHLAIKCHWTQRAAVIGDVIRVYSGHQGRTIIFCETKKEAQELSQNSAIKQDAQSLHGDIPQKQREITLKGFRNGSFGVLVATNVAARGLDIPEVDLVIQSSPPKDVESYIHRSGRTGRAGRTGVCICFYQHKEEYQLVQVEQKAGIKFKRIGVPSATEIIKASSKDAIRLLDSVPPTAISHFKQSAEKLIEEKGAVEALAAALAHISGATSVDQRSLINSNVGFVTMILQCSIEMPNISYAWKELKEQLGEEIDSKVKGMVFLKGKLGVCFDVPTASVTEIQEKWHDSRRWQLSVATEQPELEGPREGYGGFRGQREGSRGFRGQRDGNRRFRGQREGSRGPRGQRSGGGNKSNRSQNKGHIQIGKLDLTKLKHVVLDEVAQMLDMGFADQVERFHVSHTRTF

SEQ ID NO: 886405 - protein, 433 aa, Homo sapiens
VTRAGWTQGGELPLPLHAVEKTGRPGQPALKMPGKLRSDAGLESDTAMKKGETLRKQTEEKEKKEKPKSDKTEEIAEEEETVFPKAKQVKKKAEPSEVDMNSPKSKKAKKKEEPSQNDISPKTKSLRKKKEPIEKKVVSSKTKKVTKNEEPSEEEIDAPKPKKMKKEKEMNGETREKSPKLKNGFPHPEPDCNPSEAASEESNSEIEQEIPVEQKEGAFSNFPISEETIKLLKGRGVTFLFPIQAKTFHHVYSGKDLIAQARTGTGKTFSFAIPLIEKLHGELQDRKRGRAPQVLVLAPTRELANQVSKDFSDITKKLSVACFYGGTPYGGQFERMRNGIDILVGTPGRIKDHIQNGKLDLTKLKHVVLDEVDQMLDMGFADQVEEILSVAYKKVVFDTTWCSNQDINPIPHAFKLTSIGSSTIKTSHLTAFL

SEQ ID NO: 886406 - protein, 405 aa, Homo sapiens
MVDMMNNRFRKDMMKNASESKLSKDNLKKRLKEEFQHAMGGVPAWAETTKRKTSSDDESEEDEDDLLQRTGNFISTSTSLPRGILKMKNCQHANAERPTVARISSVQFHPGAQIVMVAGLDNAVSLFQVDGKTNPKIQSIYLERFPIFKACFSANGEEVLATSTHSKVLYVYDMLAGKLIPVHQVRGLKEKIVRSFEVSPDGSFLLINGIAGYLHLLAMKTKELIGSMKINGRVAASTFSSDSKKVYASSGDGEVYVWDVNSRKCLNRFVDEGSLYGLSIATSRNGQYVACGSNCGVVNIYNQDSCLQETNPKPIKAIMNLVTGVTSLTFNPTTEILAIASEKMKEAVRLVHLPSCTVFSNFPVIKNKNISHVHTMDFSPRSGYFALGNEKGKALMYRLHHYSDF

SEQ ID NO: 886407 - protein, 184 aa, Homo sapiens
PGRMRSEVPRERLRFSSNLTMPPERRRRMKLDRRTGAKPKRKPGMRPDWKAGAGPGGPPQKPAPSSQRKPPARPSAAAAAIAVAAAEEERRLRQRNRLRLEEDKPAVERCLGGKLGVPSGDGRRNERRKRGCLRAFLSKGPRSGFKGNQMQRKLLGQVGNLSQRKQGFGGKPGKTFWRHRARNM

SEQ ID NO: 886408 - protein, 390 aa, Homo sapiens
VTLQDPGYHIILKKRLKEEFQHAMGGVPAWAETTKRKTSSDDESEEDEDDLLQRTGNFISTSTSLPRGILKMKNCQHANAERPTVARISSVQFHPGAQIVMVAGLDNAVSLFQVDGKTNPKIQSIYLERFPIFKACFSANGEEVLATSTHSKVLYVYDMLAGKLIPVHQVRGLKEKIVRSFEVSPDGSFLLINGIAGYLHLLAMKTKELIGSMKINGRVAASTFSSDSKKVYASSGDGEVYVWDVNSRKCLNRFVDEGSLYGLSIATSRNGQYVACGSNCGVVNIYNQDSCLQETNPKPIKAIMNLVTGVTSLTFNPTTEILAIASEKMKEAVRLVHLPSCTVFSNFPVIKNKNISHVHTMDFSPRSGYFALGNEKGKALMYRLHHYSDF

SEQ ID NO: 886409 - protein, 658 aa, Homo sapiens
PGRMRSEVPRERLRFSSNLTMPPERRRRMKLDRRTGAKPKRKPGMRPDWKAGAGPGGPPQKPAPSSQRKPPARPSAAAAAIAVAAAEEERRLRQRNRLRLEEDKPAVERCLEELVFGDVENDEDALLRRLRGPRVQEHEDSGDSEVENEAKGNFPPQKKPVWVDEEDEDEEMVDMMNNRFRKDMMKNASESKLSKDNLKKRLKEEFQHAMGGVPAWAETTKRKTSSDDESEEDEDDLLQRTGNFISTSTSLPRGILKMKNCQHANAERPTVARISSVQFHPGAQIVMVAGLDNAVSLFQVDGKTNPKIQSIYLERFPIFKACFSANGEEVLATSTHSKVLYVYDMLAGKLIPVHQVRGLKEKIVRSFEVSPDGSFLLINGIAGYLHLLAMKTKELIGSMKINGRVAASTFSSDSKKVYASSGDGEVYVWDVNSRKCLNRFVDEGSLYGLSIATSRNGQYVACGSNCGVVNIYNQDSCLQETNPKPIKAIMNLVTGVTSLTFNPTTEILAIASEKMKEAVRLVHLPSCTVFSNFPVIKNKNISHVHTMDFSPRSGYFALGNEKGKALMYRCLVAIPDSKSYGVSESRERRESPKLPIGTRQIHRGLNRGTTGVVTKTCNTNSGSTRITARKALPGGEMRHNHEEDHENGHNSTRTGGAT

SEQ ID NO: 886410 - protein, 172 aa, Homo sapiens
PGRMRSEVPRERLRFSSNLTMPPERRRRMKLDRRTGAKPKRKPGMRPDWKAGAGPGGPPQKPAPSSQRKPPARPSAAAAAIAVAAAEEERRLRQRNRLRLEEDKPAVERCLEELVFGDVENDEDALLRRLRGPRVQEHEDSGDSEVENEAKGNFPPQKKPVWVDEEDEDEEI

SEQ ID NO: 886411 - protein, 534 aa, Homo sapiens
PGRMRSEVPRERLRFSSNLTMPPERRRRMKLDRRTGAKPKRKPGMRPDWKAGAGPGGPPQKPAPSSQRKPPARPSAAAAAIAVAAAEEERRLRQRNRLRLEEDKPAVERCLEELVFGDVENDEDALLRRLRGPRVQEHEDSGDSEVENEAKGNFPPQKKPVWVDEEDEDEEMVDMMNNRFRKDMMKNASESKLSKDNLKKRLKEEFQHAMGGVPAWAETTKRKTSSDDESEEDEDDLLQRTGNFISTSTSLPRGILKMKNCQHANAERPTVARISSVQFHPGAQIVMVAGLDNAVSLFQVDGKTNPKIQSIYLERFPIFKACFSANGEEVLATSTHSKVLYVYDMLAGKLIPVHQVRGLKEKIVRSFEVSPDGSFLLINGIAGYLHLLAMKTKELIGSMKINGRVAASTFSSDSKKVYASSGDGEVYVWDVNSRKCLNRFVDEGSLYGLSIATSRNGQYVACGSNCGVVNIYNQDSCLQETNPKPIKAIMNLVTGVTSLTFNPTTEILAIASEKMKEAVRLACCLNRTEAILGF

SEQ ID NO: 886412 - protein, 264 aa, Homo sapiens
PGRMRSEVPRERLRFSSNLTMPPERRRRMKLDRRTGAKPKRKPGMRPDWKAGAGPGGPPQKPAPSSQRKPPARPSAAAAAIAVAAAEEERRLRQRNRLRLEEDKPAVERCLEELVFGDVENDEDALLRRLRGPRVQEHEDSGDSEVENEAKGNFPPQKKPVWVDEEDEDEEMVDMMNNRFRKDMMKNASESKLSKDNLKKRLKEEFQHAMGGVPAWAETTKRKTSSDDESEEDEDDLLQRTGNFISTSTSLPRGILKRYYVPIA

SEQ ID NO: 886413 - protein, 223 aa, Homo sapiens
PGRMRSEVPRERLRFSSNLTMPPERRRRMKLDRRTGAKPKRKPGMRPDWKAGAGPGGPPQKPAPSSQRKPPARPSAAAAAIAVAAAEEERRLRQRNRLRLEEDKPAVERCLEELVFGDVENDEDALLRRLRGPRVREAAARGLGALGRGARWAVKLRGAEPGRPAAAGSAQVGGSPRTRARRVAAAGPSPPCSRLKVPGGRGPRLSPPLEAPLLGYLLCELWS

SEQ ID NO: 886414 - protein, 576 aa, Homo sapiens
PGRMRSEVPRERLRFSSNLTMPPERRRRMKLDRRTGAKPKRKPGMRPDWKAGAGPGGPPQKPAPSSQRKPPARPSAAAAAIAVAAAEEERRLRQRNRLRLEEDKPAVERCLEELVFGDVENDEDALLRRLRGPRVQEHEDSGDSEVENEAKGNFPPQKKPVWVDEEDEDEEMVDMMNNRFRKDMMKNASESKLSKDNLKKRLKEEFQHAMGGVPAWAETTKRKTSSDDESEEDEDDLLQRTGNFISTSTSLPRGILKMKNCQHANAERPTVARISSVQFHPGAQIVMVAGLDNAVSLFQVDGKTNPKIQSIYLERFPIFKACFSANGEEVLATSTHSKVLYVYDMLAGKLIPVHQVRGLKEKIVRSFEVSPDGSFLLINGIAGYLHLLAMKTKELIGSMKINGRVAASTFSSDSKKVYASSGDGEVYVWDVNSRKCLNRFVDEGSLYGLSIATSRNGQYVACGSNCGVVNIYNQDSCLQETNPKPIKAIMNLVTGVTSLTFNPTTEILAIASEKMKEAVRLVHLPSCTVFSNFPVIKNKNISHVHTMDFSPRSGYFALGNEKGKALMYRLHHYSDF

SEQ ID NO: 886415 - protein, 72 aa, Homo sapiens
PAPPHKSRTRPKREGRGVHLPSCTVFSNFPVIKNKNISHVHTMDFSPRSGYFALGNEKGKALMYRLHHYSDF

SEQ ID NO: 886416 - protein, 530 aa, Homo sapiens
PSGEAVSKTCKNEENIYEEMCAVCLMQDFKKKNNCYATVNLLCILCATGMKGDIAKYSSSSRSVEGVTPGVGGVPAWAETTKRKTSSDVQEHEDSGDSEVENEAKGNFPPQKKPVWVDEEDEDEEMVDMMNNRFRKDMMKNASESKLSKDNLKKRLKEEFQHAMGGVPAWAETTKRKTSSDDESEEDEDDLLQRTGNFISTSTSLPRGILKMKNCQHANAERPTVARISSVQFHPGAQIVMVAGLDNAVSLFQVDGKTNPKIQSIYLERFPIFKACFSANGEEVLATSTHSKVLYVYDMLAGKLIPVHQVRGLKEKIVRSFEVSPDGSFLLINGIAGYLHLLAMKTKELIGSMKINGRVAASTFSSDSKKVYASSGDGEVYVWDVNSRKCLNRFVDEGSLYGLSIATSRNGQYVACGSNCGVVNIYNQDSCLQETNPKPIKAIMNLVTGVTSLTFNPTTEILAIASEKMKEAVRLVHLPSCTVFSNFPVIKNKNISHVHTMDFSPRSGYFALGNEKGKALMYRLHHYSDF

SEQ ID NO: 886417 - protein, 576 aa, Homo sapiens; identical to SEQ ID NO: 886414

SEQ ID NO: 886418 - protein, 544 aa, Homo sapiens
PGRMRSEVPRERLRFSSNLTMPPERRRRMKLDRRTGAKPKRKPGMRPDWKAGAGPGGPPQKPAPSSQRKPPARPSAAAAAIAVAAAEEERRLRQRNRLRLEEDKPAVERCLEELVFGDVENDEDALLRRLRGPRVQEHEDSGDSEVENEAKGNFPPQKKPVWVDEEDEDEEMVDMMNNRFRKDMMKNASESKLSKDNLKKRLKEEFQHAMGGVPAWAETTKRKTSSDDESEEDEDDLLQRTGNFISTSTSLPRGILKMKNCQHANAERPTVARISSVQFHPGAQIVMVAGLDNAVSLFQVDGKTNPKIQSIYLERFPIFKACFSANGEEVLATSTHSKVLYVYDMLAGKLIPVHQVRGLKEKIVRSFEVSPDGSFLLINGIAGYLHLLAMKTKELIGSMKINGRVAASTFSSDSKKVYASSGDGEVYVWDVNSRKCLNRFVDEGSLYGLSIATSRNGQYVACGSNCGVVNIYNQDSCLQETNPKPIKAIMNLVTGVTSLTFNPTTEILAIASEKMKEAVRLVAPLLRLLKRLFEVQLSHKRSLS

SEQ ID NO: 886419 - protein, 495 aa, Homo sapiens
PGRMRSEVPRERLRFSSNLTMPPERRRRMKLDRRTGAKPKRKPGMRPDWKAGAGPGGPPQKPAPSSQRKPPARPSAAAAAIAVAAAEEERRLRQRNRLRLEEDKPAVERCLEELVFGDVENDEDALLRRLRGPRVQEHEDSGDSEVENEAKGNFPPQKKPVWVDEEDEDEEMVDMMNNRFRKDMMKNASESKLSKDNLKKRLKEEFQHAMGGVPAWAETTKRKTSSDDESEEDEDDLLQRTGNFISTSTSLPRGILKMKNCQHANAERPTVARISSVQFHPGAQIVMVAGLDNAVSLFQVDGKTNPKIQSIYLERFPIFKACFSANGEEVLATSTHSKVLYVYDMLAGKLIPVHQVRGLKGEDSEGGLEVSQKWVLHGPIKRKMAGTVAHQYGKHDVKDTKKHGIGNADTIRARGVRHTQCLYAKCSKRIYAIRGKTKEHDREEYTRRRAHTFVKRENRERVAIEEQQGGRQGGQTQATCAHSRDKSKREKSQTT

SEQ ID NO: 886420 - protein, 207 aa, Homo sapiens
PGRMRSEVPRERLRFSSNLTMPPERRRRMKLDRRTGAKPKRKPGMRPDWKAGAGPGGPPQKPAPSSQRKPPARPSAAAAAIAVAAAEEERRLRQRNRLRLEEDKPAVERCLEELVFGDVENDEDALLRRLRGPRVQEHEDSGDSEVENEAKGNFPPQKKPVWVDEEDEDEEMVDMMNNRFRKDMMKKKKKKKKKKKNQKNLFFDCRF

SEQ ID NO: 886421 - protein, 354 aa, Homo sapiens
DGGAHARAPSCAQPPTRPQSEVRGPGARRGWPPRPLGLRGEGASAPVVIAPAAFSLGLRDTAPRPGARCVPGRVLGTVPRVPYKDCQAIMKVLLLKDAKEDDCGQDPYIRELGLYGLEATLIPVLSFEFLSLPSFSEKLSHPEDYGGLIFTSPRAVEAAELCLEQNNKTEVWERSLKEKWNAKSVYVVGNATASLVSKIGLDTEGETCGNAEKLAEYICSRESSALPLLFPCGNLKREILPKALKDKGIAMESITVYQTVAHPGIQGNLNSYYSQQGVPASITFFSPSGLTYSLKHIQELSGDNIDQIKFAAIGPTTARALAAQGLPVSCTAESPTPQALATGIRKALQPHGCC

SEQ ID NO: 886422 - protein, 265 aa, Homo sapiens
MKVLLLKDAKEDDCGQDPYIRELGLYGLEATLIPVLSFEFLSLPSFSEKLSHPEDYGGLIFTSPRAVEAAELCLEQNNKTEVWERSLKEKWNAKSVYVVGNATASLVSKIGLDTEGETCGNAEKLAEYICSRESSALPLLFPCGNLKREILPKALKDKGIAMESITVYQTVAHPGIQGNLNSYYSQQGVPASITFFSPSGLTYSLKHIQELSGDNIDQIKFAAIGPTTARALAAQGLPVSCTAESPTPQALATGIRKALQPHGCC

SEQ ID NO: 886423 - protein, 81 aa, Homo sapiens
SSAQRLNPSPVRASCKLHCREPHATSPGHWHQEGSPAPWLLLSQPPSAGPMQPPWAGLALDGARHRQGLSGAAAVRLLPQA

SEQ ID NO: 886424 - protein, 354 aa, Homo sapiens; identical to SEQ ID NO: 886421

SEQ ID NO: 886425 - protein, 331 aa, Homo sapiens
DGGAHARAPSCAQPPTRPQSEVRGPGARRGWPPRPLGLRGEGASAPVVIAPAAFSLGLRDTAPRPGARCVPGRVLGTVPRVPYKDCQAIMKVLLLKDAKEDDCGQDPYIRELGLYGLEATLIPVLSFEFLSLPSFSEKLSHPEDYGGLIFTSPRAVEAAELCLEQNNKTEVWERSLKEKWNAKSVYVVGNATASLVSKIGLDTEGETCGNAEKLAEYICSRESSALPLLFPCGNLKREILPKALKDKGIAMESITVYQTVAHPGIQGNLNSYYSQQGVPASITFFSPSGLTYSLKHIQELSGDNIDQIKMRRWRPERMGHGPRSLSCGAGI

SEQ ID NO: 886426 - protein, 354 aa, Homo sapiens; identical to SEQ ID NO: 886421

SEQ ID NO: 886427 - protein, 354 aa, Homo sapiens; identical to SEQ ID NO: 886421

SEQ ID NO: 886428 - protein, 381 aa, Homo sapiens
DGGAHARAPSCAQPPTRPQSEVRGPGARRGWPPRPLGLRGEGASAPVVIAPAAFSLGLRDTAPRPGARCVPGRVLGTVPRVPYKDCQAIMKVLLLKDAKEDDCGQDPYIRELGLYGLEATLIPVLSFEFLSLPSFSEKLSHPEDYGGLIFTSPRAVEAAELCLEQNNKTEVWERSLKEKWNAKSVYVVGNATASLVSKIGLDTEGETCGNAEKLAEYICSRESSALPLLFPCGNLKREILPKALKDKGIAMESITVYQTVAHPGIQGNLNSYYSQQGVPASITFFSPSGLTYSLKHIQELSGDNIDQIKTQGPQHPKKNCLQLEPLRKDCTDTAVMFAAIGPTTARALAAQGLPVSCTAESPTPQALATGIRKALQPHGCC

SEQ ID NO: 886429 - protein, 312 aa, Homo sapiens
DGGAHARAPSCAQPPTRPQSEVRGPGARRGWPPRPLGLRGEGASAPVVIAPAAFSLGLRDTAPRPGARCVPGRVLGTVPRVPYKDCQAIMKVLLLKDAKEDDCGQDPYIRELGLYGLEATLIPVLSFEFLSLPSFSEKLSHPEDYGGLIFTSPRAVEAAELCLEQNNKTEVWERSLKEKWNAKSVYVVGNATASLVSKIGLDTEGETCGNAEKLAEYICSRESSALPLLFPCGNLKREILPKALKDKGIAMESITVYQTVAHPGIQGNLNSYYSQQGVPASITFFSPSGLTYSLKHIQELSGDNIDQIKKHL

SEQ ID NO: 886430 - protein, 249 aa, Homo sapiens
DGGAHARAPSCAQPPTRPQSEVRGPGARRGWPPRPLGLRGEGASAPVVIAPAAFSLGLRDTAPRPGARCVPGRVLGTVPRVPYKDCQAIMKVLLLKDAKEDDCGQDPYIRELGLYGLEATLIPVLSFEFLSLPSFSEKLSHPEDYGGLIFTSPRAVEAAELCLEQNNKTEVWERSLKEKWNAKSVYVVGNATASLVSKIGLDTEGETCGNAEKLAEYICSRESSALPLLFPCGNLKREILPKALKDKEA

SEQ ID NO: 886431 - protein, 351 aa, Homo sapiens
DGGAHARAPSCAQPPTRPQSEVRGPGARRGWPPRPLGLRGEGASAPVVIAPAAFSLGLRDTAPRPGARCVPGRVLGTVPRVPYKDCQAIMKVLLLKDAKEDDCGQDPYIRELGLYGLEATLIPVLSFEFLSLPSFSEKLSHPEDYGGLIFTSPRAVEAAELCLEQNNKTEVWERSLKEKWNAKSVYVVGNATASLVSKIGLDTEGETCGNAEKLAEYICSRESSALPLLFPCGNLKREILPKALKDKGIAMESITVYQTVAHPGIQGNLNSYYSQQGVPASITFFSPSGLTYSLKHIQELSGDNIDQIKLLDGGELLKKFMQGRNKGSHRNLRAKVKCNWPPRPRGASSEN

SEQ ID NO: 886432 - protein, 323 aa, Homo sapiens
DGGAHARAPSCAQPPTRPQSEVRGPGARRGWPPRPLGLRGEGASAPVVIAPAAFSLGLRDTAPRPGARCVPGRVLGTVPRVPYKDCQAIMKVLLLKDAKEDDCGQDPYIRELGLYGLEATLIPVLSFEFLSLPSFSEKLSHPEDYGGLIFTSPRAVEAAELCLEQNNKTEVWERSLKEKWNAKSVYVVGNATASLVSKIGLDTEGETCGNAEKLAEYICSRESSALPLLFPCGNLKREILPKALKDKGIAMESITVYQTVAHPGIQGNLNSYYSQQGVPASITFFSPSGLTYSLKHIQELSGDNIDQIKIEELELQWASWALR

SEQ ID NO: 886433 - protein, 326 aa, Homo sapiens
DGGAHARAPSCAQPPTRPQSEVRGPGARRGWPPRPLGLRGEGASAPVVIAPAAFSLGLRDTAPRPGARCVPGRVLGTVPRVPYKDCQAIMKVLLLKDAKEDDCGQDPYIRLSHPEDYGGLIFTSPRAVEAAELCLEQNNKTEVWERSLKEKWNAKSVYVVGNATASLVSKIGLDTEGETCGNAEKLAEYICSRESSALPLLFPCGNLKREILPKALKDKGIAMESITVYQTVAHPGIQGNLNSYYSQQGVPASITFFSPSGLTYSLKHIQELSGDNIDQIKFAAIGPTTARALAAQGLPVSCTAESPTPQALATGIRKALQPHGCC

SEQ ID NO: 886434 - protein, 327 aa, Homo sapiens
DGGAHARAPSCAQPPTRPQSEVRGPGARRGWPPRPLGLRGEGASAPVVIAPAAFSLGLRDTAPRPGARCVPGRVLGTVPRVPYKDCQAIMKVLLLKDAKEDDCGQDPYIRELGLYGLEATLIPVLSFEFLSLPSFSEKLSHPEDYGGLIFTSPRAVEAAELCLEQNNKTEVWERSLKEKWNAKSVYVVGNATASLVSKIGLDTEGETCGNAEKLAEYICSRIAMESITVYQTVAHPGIQGNLNSYYSQQGVPASITFFSPSGLTYSLKHIQELSGDNIDQIKFAAIGPTTARALAAQGLPVSCTAESPTPQALATGIRKALQPHGCC

SEQ ID NO: 886435 - protein, 264 aa, Homo sapiens
DGGAHARAPSCAQPPTRPQSEVRGPGARRGWPPRPLGLRGEGASAPVVIAPAAFSLGLRDTAPRPGARCVPGRVLGTVPRVWERSLKEKWNAKSVYVVGNATASLVSKIGLDTEGETCGNAEKLAEYICSRESSALPLLFPCGNLKREILPKALKDKGIAMESITVYQTVAHPGIQGNLNSYYSQQGVPASITFFSPSGLTYSLKHIQELSGDNIDQIKFAAIGPTTARALAAQGLPVSCTAESPTPQALATGIRKALQPHGCC

SEQ ID NO: 886436 - protein, 228 aa, Homo sapiens
DGGAHARAPSCAQPPTRPQSEVRGPGARRGWPPRPLGLRGEGASAPVVIAPAAFSLGLRDTAPRPGARCVPGRVLGTVPRVPYKDCQAIMKVLLLKDAKEDDCGQDPYIRELGLYGLEATLIPVLSFEFLSLPSFSEKLSHPEDYGGLIFTSPRAVEAAELCLEQNNKTEVWERSLKEKWNAKSVYVVGNATASLVSKIGLDTEGETCGNAEKLAEYICSSEEVKGIF

SEQ ID NO: 886437 - protein, 222 aa, Homo sapiens
DGGAHARAPSCAQPPTRPQSEVRGPGARRGWPPRPLGLRGEGASAPVVIAPAAFSLGLRDTAPRPGARCVPGRVLGTVPRVPYKDCQAIMKVLLLKDAKEDDCGQDPYIRELGLYGLEATLIPVLSFEFLSLPSFSEKLSHPEDYGGLIFTSPRAVEAAELCLEQNNKTEVWERSLKEKWNAKSVYVVGNATASLVSKIGLDTEGETCGNAEKLAEYICSSK

SEQ ID NO: 886438 - protein, 88 aa, Homo sapiens
MAVRMRERLAARSHPRDPSLRCGVLGPGAGGRRGPSGCVGRGLPPLLSLLLQPFRWDCATPPPDRVPAVCQAGCWARSRECPIRTARQ

SEQ ID NO: 886439 - protein, 492 aa, Homo sapiens
MDLLKAITSPLAAGSKPSKKTGEKSSGSSSHSESKKEHHRKKVSGSSGELPLEDGVSHKSKKMKPLYVNTETLTLREPDGLKMKLILSPKEKGSSSVDEESFQYPSQQATVKKSSKKSARDEQGALLLGHELQSFLKTARKKHKSSSDAHSSPGPEGCGSDASQFAESHSANLDLSGLEPILVESDSSSGGELEAGELVIDDSYREIKKKKKSKKSKKKKDKEKHKEKRHSKSKRSLGLSAVPVGEVTVTSGPPPSIPYAGAAAPPLPLPGLHTDGHSEKKKKKEEKDKERERGEKPKKKNMSAYQVFCKEYRVTIVADHPGIDFGELSKKLAEVWKQLPEKDKLIWKQKAQYLQHKQNKAEATTVKRKASSSEGSMKVKASSVGVLSPQKKSPPTTMLLPASPAKAPETEPIDVAAHLQLLGESLSLIGHRLQETEGMVAVSGSLSVLLDSIICALGPLACLTTQLPELNGCPKQVLSNTLDNIAYIMPGL

SEQ ID NO: 886440 - protein, 492 aa, Homo sapiens; identical to SEQ ID NO: 886439

SEQ ID NO: 886441 - protein, 492 aa, Homo sapiens; identical to SEQ ID NO: 886439

SEQ ID NO: 886442 - protein, 492 aa, Homo sapiens; identical to SEQ ID NO: 886439

SEQ ID NO: 886443 - protein, 617 aa, Homo sapiens
PLALFSPSPRWRRSAALRRDPGEPSEDCFDGDHTFEDIGLAAGRSQREKKRSYKDFLREEEEIAAQVRNSSKKKLKDSELYFLGTDTHKKKRKHSSDDYYYGDISSLESSQKKKKKSSPQSTDTAMDLLKAITSPLAAGSKPSKKTGEKSSGSSSHSESKKEHHRKKVSGSSGELPLEDGVSHKSKKMKPLYVNTETLTLREPDGLKMKLILSPKEKGSSSVDEESFQYPSQQATVKKSSKKSARDEQGALLLGHELQSFLKTARKKHKSSSDAHSSPGPEGCGSDASQFAESHSANLDLSGLEPILVESDSSSGGELEAGELVIDDSYREIKKKKKSKKSKKKKDKEKHKEKRHSKSKRSLGLSAVPVGEVTVTSGPPPSIPYAGAAAPPLPLPGLHTDGHSEKKKKKEEKDKERERGEKPKKKNMSAYQVFCKEYRVTIVADHPGIDFGELSKKLAEVWKQLPEKDKLIWKQKAQYLQHKQNKAEATTVKRKASSSEGSMKVKASSVGVLSPQKKSPPTTMLLPASPAKAPETEPIDVAAHLQLLGESLSLIGHRLQETEGMVAVSGSLSVLLDSIICALGPLACLTTQLPELNGCPKQVLSNTLDNIAYIMPGL

SEQ ID NO: 886444 - protein, 601 aa, Homo sapiens
MAYDDSVKKEDCFDGDHTFEDIGLAAGRSQREKKRSYKDFLREEEEIAAQVRNSSKKKLKDSELYFLGTDTHKKKRKHSSDDYYYGDISSLESSQKKKKKSSPQSTDTAMDLLKAITSPLAAGSKPSKKTGEKSSGSSSHSESKKEHHRKKVSGSSGELPLEDGVSHKSKKMKPLYVNTETLTLREPDGLKMKLILSPKEKGSSSVDEESFQYPSQQATVKKSSKKSARDEQGALLLGHELQSFLKTARKKHKSSSDAHSSPGPEGCGSDASQFAESHSANLDLSGLEPILVESDSSSGGELEAGELVIDDSYREIKKKKKSKKSKKKKDKEKHKEKRHSKSKRSLGLSAVPVGEVTVTSGPPPSIPYAGAAAPPLPLPGLHTDGHSEKKKKKEEKDKERERGEKPKKKNMSAYQVFCKEYRVTIVADHPGIDFGELSKKLAEVWKQLPEKDKLIWKQKAQYLQHKQNKAEATTVKRKASSSEGSMKVKASSVGVLSPQKKSPPTTMLLPASPAKAPETEPIDVAAHLQLLGESLSLIGHRLQETEGMVAVSGSLSVLLDSIICALGPLACLTTQLPELNGCPKQVLSNTLDNIAYIMPGL

SEQ ID NO: 886445 - protein, 492 aa, Homo sapiens; identical to SEQ ID NO: 886439

SEQ ID NO: 886446 - protein, 226 aa, Homo sapiens
LSSLPVTCSIVTTQEQEDKDHAVERASEKKPKKKNMSAYQVFCKEYRVTIVADHPGIDFGELSKKLAEVWKQLPEKDKLIWKQKAQYLQHKQNKAEATTVKRKASSSEGSMKVKASSVGVLSPQKKSPPTTMLLPASPAKAPETEPIDVAAHLQLLGESLSLIGHRLQETEGMVAVSGSLSVLLDSIICALGPLACLTTQLPELNGCPKQVLSNTLDNIAYIMPGL

SEQ ID NO: 886447 - protein, 71 aa, Homo sapiens
LVRPSYSGAREDFPAQGALSPQWAMIGNGLGSMSTHLRLLVMFIMSAGTAIASYFIPSTVGVVLFMTGILS

SEQ ID NO: 886448 - protein, 938 aa, Homo sapiens
MPALEHMNQILHILFVFLPFLWALGTLPPPDALLLWAMEQVLEFGLGGSSMSTHLRLLVMFIMSAGTAIASYFIPSTVGVVLFMTGFGFLLSLNLSDMGHKIGTKSKDLPSGPEKHFSWKECLFYIIILVLALLETSLLHHFAGFSQISKSNSQAIVGYGLMILLIILWILREIQSVYIIGIFRNPFYPKDVQTVTVFFEKQTRLMKIGIVRRILLTLVSPFAMIAFLSLDSSLQGLHSVSVCIGFTRAFRMVWQNTENALLETVIVSTVHLISSTDIWWNRSLDTGLRLLLVGIIRDRLIQFISKLQFAVTVLLTSWTEKKQRRKTTATLCILNIVFSPFVLVIIVFSTLLSSPLLPLFTLPVFLVGFPRPIQSWPGAAGTTACVCADTVYYYQMVPRLTAVLQTAMAAGSLGLLLPGSHYLGRFQDRLMWIMILECGYTYCSINIKGLELQETSCHTAEARRVDEVFEDAFEQEYTRVCSLNEHFGNVLTPCTVLPVKLYSDARNVLSGIIDSHENLKEFKGDLIKVLVWILVQYCSKRPGMKENVHNTENKGKAPLMLPALNTLPPPKSPEDIDSLNSETFNDWSDDNIFDDEPTIKKVIEEKHQLKDLPGTNLFIPGSVESQRVGDHSTGTVPENDLYKAVLLGYPAVDKGKQEDMPYIPLMEFSCSHSHLVCLPAEWRTSCMPSSKMKEMSSLFPEDWYQFVLRQLECYHSEEKASNVLEEIAKDKVLKDFYVHTVMTCYFSLFGIDNMAPSPGHILRVYGGVLPWSVALDWLTEKPELFQLALKAFRYTLKLMIDKASLGPIEDFRELIKYLEEYERDWYIGLVSDEKWKEAILQEKPYLFSLGYDSNMGIYTGRVLSLQELLIQVGKLNPEAVRGQWANLSWELLYATNDDEERYSIQAHPLLLRNLTVQAAEPPLGYPIYSSKPLHIHLY

SEQ ID NO: 886449 - protein, 531 aa, Homo sapiens
QDRHSGKQISANKIAAEAISDRLMWIMILECGYTYCSINIKGLELQETSCHTAEARRVDEVFEDAFEQEYTRVCSLNEHFGNVLTPCTVLPVKLYSDARNVLSGIIDSHENLKEFKGDLIKVLVWILVQYCSKRPGMKENVHNTENKGKAPLMLPALNTLPPPKSPEDIDSLNSETFNDWSDDNIFDDEPTIKKVIEEKHQLKDLPGTNLFIPGSVESQRVGDHSTGTVPENDLYKAVLLGYPAVDKGKQEDMPYIPLMEFSCSHSHLVCLPAEWRTSCMPSSKMKEMSSLFPEDWYQFVLRQLECYHSEEKASNVLEEIAKDKVLKDFYVHTVMTCYFSLFGIDNMAPSPGHILRVYGGVLPWSVALDWLTEKPELFQLALKAFRYTLKLMIDKASLGPIEDFRELIKYLEEYERDWYIGLVSDEKWKEAILQEKPYLFSLGYDSNMGIYTGRVLSLQELLIQVGKLNPEAVRGQWANLSWELLYATNDDEERYSIQAHPLLLRNLTVQAAEPPLGYPIYSSKPLHIHLY

SEQ ID NO: 886450 - protein, 857 aa, Homo sapiens
MPALEHMNQILHILFVFLPFLWALGTLPPPDALLLWAMEQVLEFGLGGSSMSTHLRLLVMFIMSAGTAIASYFIPSTVGVVLFMTGFGFLLSLNLSDMGHKIGTKSKDLPSGPEKHFSWKECLFYIIILVLALLETSLLHHFAGFSQISKSNSQAIVGYGLMILLIILWILREIQSVYIIGIFRNPFYPKDVQTVTVFFEKQTRLMKIGIVRRILLTLVSPFAMIAFLSLDSSLQGLHSVSVCIGFTRAFRMVWQNTENALLETVIVSTVHLISSTDIWWNRSLDTGLRLLLVGIIRDRLIQFISKLQFAVTVLLTSWTEKKQRRKTTATLCILNIVFSPFVLVIIVFSTLLSSPLLPLFTLPVFLVGFPRPIQSWPGAAGTTACVCADTVYYYQMVPRLTAVLQTAMAAGSLGLLLPGSHYLGRFQDRLMWIMILECGYTYCSINIKGLELQETSCHTAEARRVDEVFEDAFEQEYTRVCSLNEHFGNVLTPCTVLPVKLYSDARNVLSGIIDSHENLKEFKGDLIKVLVWILVQYCSKRPGMKENVHNTENKGKAPLMLPALNTLPPPKSPEDIDSLNSETFNDWSDDNIFDDEPTIKKVIEEKHQLKDLPGTNLFIPGSVESQRVGDHSTGTVPENDLYKAVLLGYPAVDKGKQEDMPYIPLMEFSCSHSHLVCLPAEWRTSCMPSSKMKEMSSLFPEDWYQFVLRQLECYHSEEKASNVLEEIAKDKVLKDFYVHTVMTCYFSLFGIDNMAPSPGHILRVYGGVLPWSVALDWLTEKPELFQLALKAFRYTLKLMIDKASLGPIEDFRELIKYLEEYERDWYIGLVSDEKWKEAILQEKPYLFSLGYDSNMYL

SEQ ID NO: 886451 - protein, 486 aa, Homo sapiens
MPALEHMNQILHILFVFLPFLWALGTLPPPDALLLWAMEQVLEFGLGGSSMSTHLRLLVMFIMSAGTAIASYFIPSTVGVVLFMTGFGFLLSLNLSDMGHKIGTKSKDLPSGPEKHFSWKECLFYIIILVLALLETSLLHHFAGFSQISKSNSQAIVGYGLMILLIILWILREIQSVYIIGIFRNPFYPKDVQTVTVFFEKQTRLMKIGIVRRILLTLVSPFAMIAFLSLDSSLQGLHSVSVCIGFTRAFRMVWQNTENALLETVIVSTVHLISSTDIWWNRSLDTGLRLLLVGIIRDRLIQFISKLQFAVTVLLTSWTEKKQRRKTTATLCILNIVFSPFVLVIIVFSTLLSSPLLPLFTLPVFLVGFPRPIQSWPGAAGTTACVCADTVYYYQMVPRLTAVLQTAMAAGSLGLLLPGSHYLGRFQDRLMWIMILECGYTYCSINIKGLELQETSCHTAEARRVDEVFEDAFEQEYTRVYSETND

SEQ ID NO: 886452 - protein, 92 aa, Homo sapiens
FRASRLSPLLLLLGPVRDQSTSDSRRPRPGRCWPSPGANEARYFPASSRPSLLYGRARLGSEHRPGQRGQPGADEVPERARAPFSSGWRPPE

SEQ ID NO: 886453 - protein, 230 aa, Homo sapiens
MSPDVPLLNDYKQDFFLKRFPQTVLGGPRFKLGYCAPPYIYVNQIILFLMPWVWGGVGTLLYQLGILKDYYTAALSGGLMLFTAFVIQFTSLYAKNKSTTVERILTTDILAEEDEHEFTSCTGAETVKFLIPGKKYVANTVFHSILAGLACGLGTWYLLPNRITLLYGSTGGTALLFFFGWMTLCIAEYSLIVNTATETATFQTQDTYEIIPLMRPLYIFFFVSVDLAHR

SEQ ID NO: 886454 - protein, 92 aa, Homo sapiens; identical to SEQ ID NO: 886452

SEQ ID NO: 886455 - protein, 856 aa, Homo sapiens
MPALEHMNQILHILFVFLPFLWALGTLPPPDALLLWAMEQVLEFGLGGSSMSTHLRLLVMFIMSAGTAIASYFIPSTVGVVLFMTGFGFLLSLNLSDMGHKIGTKSKDLPSGPEKHFSWKECLFYIIILVLALLETSLLHHFAGFSQISKSNSQAIVGYGLMILLIILWILREIQSVYIIGIFRNPFYPKDVQTVTVFFEKQTRLMKIGIVRRILLTLVSPFAMIAFLSLDSSLQGLHSVSVCIGFTRAFRMVWQNTENALLETVIVSTVHLISSTDIWWNRSLDTGLRLLLSWPGAAGTTACVCADTVYYYQMVPRLTAVLQTAMAAGSLGLLLPGSHYLGRFQDRLMWIMILECGYTYCSINIKGLELQETSCHTAEARRVDEVFEDAFEQEYTRVCSLNEHFGNVLTPCTVLPVKLYSDARNVLSGIIDSHENLKEFKGDLIKVLVWILVQYCSKRPGMKENVHNTENKGKAPLMLPALNTLPPPKSPEDIDSLNSETFNDWSDDNIFDDEPTIKKVIEEKHQLKDLPGTNLFIPGSVESQRVGDHSTGTVPENDLYKAVLLGYPAVDKGKQEDMPYIPLMEFSCSHSHLVCLPAEWRTSCMPSSKMKEMSSLFPEDWYQFVLRQLECYHSEEKASNVLEEIAKDKVLKDFYVHTVMTCYFSLFGIDNMAPSPGHILRVYGGVLPWSVALDWLTEKPELFQLALKAFRYTLKLMIDKASLGPIEDFRELIKYLEEYERDWYIGLVSDEKWKEAILQEKPYLFSLGYDSNMGIYTGRVLSLQELLIQVGKLNPEAVRGQWANLSWELLYATNDDEERYSIQAHPLLLRNLTVQAAEPPLGYPIYSSKPLHIHLY

SEQ ID NO: 886456 - protein, 857 aa, Homo sapiens; identical to SEQ ID NO: 886450

SEQ ID NO: 886457 - protein, 616 aa, Homo sapiens
MPALEHMNQILHILFVFLPFLWALGTLPPPDALLLWAMEQVLEFGLGGSSMSTHLRLLVMFIMSAGTAIASYFIPSTVGVVLFMTGFGFLLSLNLSDMGHKIGTKSKDLPSGPEKHFSWKECLFYIIILVLALLETSLLHHFAGFSQISKSNSQAIVGYGLMILLIILWILREIQSVYIIGIFRNPFYPKDVQTVTVFFEKQTRLMKIGIVRRILLTLVSPFAMIAFLSLDSSLQGLHSVSVCIGFTRAFRMVWQNTENALLETVIVSTVHLISSTDIWWNRSLDTGLRLLLVGIIRDRLIQFISKLQFAVTVLLTSWTEKKQRRKTTATLCILNIVFSPFVLVIIVFSTLLSSPLLPLFTLPVFLVGFPRPIQSWPGAAGTTACVCADTVYYYQMVPRLTAVLQTAMAAGSLGLLLPGSHYLGRFQDRLMWIMILECGYTYCSINIKGLELQETSCHTAEARRVDEVFEDAFEQEYTRVCSLNEHFGNVLTPCTVLPVKLYSDARNVLSGIIDSHENLKEFKGDLIKVLVWILVQYCSKRPGMKENVHNTENKGKAPLMLPALNTLPPPKSPEDIDSLNSETFNDWSDDNIFDDEPTIKKVIEEKHQLKDLPGIL

SEQ ID NO: 886458 - protein, 230 aa, Homo sapiens; identical to SEQ ID NO: 886453

SEQ ID NO: 886459 - protein, 129 aa, Homo sapiens
AIVGYGLMILLIILWILREIQSVYIIGIFRNPFYPKDVQTVTVFFEKQTRLMKIGIVRRILLTLGRKIKSINLVLQIISWKYSKILLNSHICVVLYHIQVFVLLCYGFLFIGFLVHRLNVLIKNVYLPE

SEQ ID NO: 886460 - protein, 130 aa, Homo sapiens
MGGNGSTCKPDTERQGTLSTAAPTTSPAPCLSNHHNKKHLILAFCAGVLLTLLLIAFIFLIIKSYRKYHSKPQAPDPHSDPPAKLSSIPGESLTYASTTFKLSEEKSNHLAENHSADFDPIVYAQIKVTN

SEQ ID NO: 886461 - protein, 112 aa, Homo sapiens
MGGNGSTCKPDTERQGTLSTAAPTTSPAPCLSNHHNKKHLILAFCAGVLLTLLLIAFIFLIIKSYRKYHSKPQAPDPHSDPPAKLSSIPGESLTYASTTFKLSEDAQIKVTN

SEQ ID NO: 886462 - protein, 155 aa, Homo sapiens
MGGNGSTCKPDTERQGTLSTAAPTTSPAPCLSNHHNKKHLILAFCAGVLLTLLLIAFIFLIIKSYRKYRRERLPISPGPLLRWVPLLSGTMADHSKPQAPDPHSDPPAKLSSIPGESLTYASTTFKLSEEKSNHLAENHSADFDPIVYAQIKVTN

SEQ ID NO: 886463 - protein, 289 aa, Homo sapiens
ASFVFGSGINPERDPEISNGFRLISVNNFCVCDLANDNNIENASLSGSNFGIVDSLSELEALMERMKRLQEEREDEEASQEEMSTRFEKEKKESLFVVSGDTFHSFPHSDFEDDMIITSDVSRYIEDPGFGYEDFARRGEEHLPTFRAQDYTWENHGFSLVNRLYSDIGHLLDEKFRMVYNLTYNTMATHEDVDTTMLRRALFNYVHCMFGIRYDDYDYGEVNQLLERSLKVYIKTVTCYPERTTKRMYDSYWRQFKHSEKVHVNLLLMEARMQAELLYALRAITRHLT

SEQ ID NO: 886464 - protein, 289 aa, Homo sapiens; identical to SEQ ID NO: 886463

SEQ ID NO: 886465 - protein, 980 aa, Homo sapiens
MGRRKGRSALSRSSLERVNQGEVKVIGRGAREGGGGQAWGTGGGGRDLSCGIPRSASPLAPLAAPAITQAPEALSRTRASTARFVCRASGEPRPALRWLHNGAPLRPNGRVKVQGGGGSLVITQIGLQDAGYYQCVAENSAGMACAAASLAVVVREGLPSAPTRVTATPLSSSAVLVAWERPEMHSEQIIGFSLHYQKARGMDNVEYQFAVNNDTTELQVRDLEPNTDYEFYVVAYSQLGASRTSTPALVHTLDDVPSAAPQLSLSSPNPSDIRVAWLPLPPSLSNGQVVKYKIEYGLGKEDQIFSTEVRGNETQLMLNSLQPNKVYRVRISAGTAAGFGAPSQWMHHRTPSMHNQSHVPFAPAELKVQAKMESLVVSWQPPPHPTQISGYKLYWREVGAEEEANGDRLPGGRGDQAWDVGPVRLKKKVKQYELTQLVPGRLYEVKLVAFNKHEDGYAAVWKGKTEKAPAPDMPIQRGPPLPPAHVHAESNSSTSIWLRWKKPDFTTVKIVNYTVRFSPWGLRNASLVTYYTSSGEDILIGGLKPFTKYEFAVQSHGVDMDGPFGSVVERSTLPDRPSTPPSDLRLSPLTPSTVRLHWCPPTEPNGEIVEYLILYSSNHTQPEHQWTLLTTQGNIFSAEVHGLESDTRYFFKMGARTEVGPGPFSRLQDVITLQEKLSDSLDMHSVTGIIVGVCLGLLCLLACMCAGLRRSPHRESLPGLSSTATPGNPALYSRARLGPPSPPAAHELESLVHPHPQDWSPPPSDVEDRAEVHSLMGGGVSEGRSHSKRKISWAQPSGLSWAGSWAGCELPQAGPRPALTRALLPPAGTGQTLLLQALVYDAIKGNGRKKSPPACRNQVEAEVIVHSDFSASNGNPDLHLQDLEPEDPLPPEAPDLISGVGDPGQGAAWLDRELGGCELAAPGPDRLTCLPEAASASCSYPDLQPGEVLEETPGDSCQLKSPCPLGASPGLPRSPVSSSA

SEQ ID NO: 886466 - protein, 980 aa, Homo sapiens; identical to SEQ ID NO: 886465

SEQ ID NO: 886467 - protein, 980 aa, Homo sapiens; identical to SEQ ID NO: 886465

SEQ ID NO: 886468 - protein, 548 aa, Homo sapiens
PRFLREDQLGAQLPAATSNSGPLTMHSLDEPLDLKLSITKLRAAREKRERTLGVVRPRALHRELGLVDDSPTPGSPGSPPSGFLLNSKFPEKVEGRFSAAPLVDLSLSPPSGLDSPNGSSSLSPERQGNGDLPPVPSASDFQPLRYLDGVPSSFQFFLPLGSGGALHLPASSFLTPPKDKCLSPDLPLPKQLVCRWAKCNQLFELLQDLVDHVNDYHVKPEKDAGYCCHWEGCARHGRGFNARYKMLIHIRTHTNEKPHRCPTCSKSFSRLENLKIHNRSHTGEKPYVCPYEGCNKRYSNSSDRFKHTRTHYVDKPYYCKMPGCHKRYTDPSSLRKHIKAHGHFVSHEQQELLQLRPPPKPPLPAPDGGPYVSGAQIIIPNPAALFGGPGLPGLPLPLAPGPLDLSALACGNGGGSGGGGGMGPGLPGPVLPLNLAKNPLLPSPFGAGGLGLPVVSLLAGAAGGKAEGEKGRGSVPTRALGMEGHKTPLERTESSCSRPSPDGLPLLPGTVLDLSTGVNSAASSPEALAPGWVVIPPGSVLLKPAVVN

SEQ ID NO: 886469 - protein, 548 aa, Homo sapiens; identical to SEQ ID NO: 886468

SEQ ID NO: 886470 - protein, 115 aa, Homo sapiens
KLWRLVKLRGGGWCHTPVSSTGCSSHSCGLGAWLVSAPKVTVGVRRQEYLAHWDSTLQHTLNCASPSGFLLNSKFPEKVEGRFSAAPLVDLSLSPPSGLDSPNGSSSLSPERQGN

SEQ ID NO: 886471 - protein, 496 aa, Homo sapiens
MDDVPAPTPAPAPPAAAAPRVPFHCSECGKSFRYRSDLRRHFARHTALKPHACPRCGKGFKHSFNLANHLRSHTGERPYRCSACPKGFRDSTGLLHHQVVHTGEKPYCCLVCELRFSSRSSLGRHLKRQHRGVLPSPLQPGPGLPALSAPCSVCCNVGPCSVCGGSGAGGGEGPEGAGAGLGSWGLAEAAAAAAASLPPFACGACARRFDHGRELAAHWAAHTDVKPFKCPRCERDFNAPALLERHKLTHDLQGPGAPPAQAWAAGPGAGPETAGEGTAAEAGDAPLASDRRLLLGPAGGGVPKLGGLLPEGGGEAPAPAAAAEPSEDTLYQCDCGTFFASAAALASHLEAHSGPATYGCGHCGALYAALAALEEHRRVSHGEGGGEEAAAAAREREPASGEPPSGSGRGKKIFGCSECEKLFRSPRDLERHVLVHTGEKPFPCLECGKFFRHECYLKRHRLLHGTERPFPCHICGKGFITLSNLSRHLKLHRGMD

SEQ ID NO: 886472 - protein, 496 aa, Homo sapiens; identical to SEQ ID NO: 886471

SEQ ID NO: 886473 - protein, 496 aa, Homo sapiens; identical to SEQ ID NO: 886471

SEQ ID NO: 886474 - protein, 476 aa, Homo sapiens
MDDVPAPTPAPAPPAAAAPRVPFHCSECGKSFRYRSDLRRHFARHTALKPHACPRCGKGFKHSFNLANHLRSHTGERPYRCSACPKGFRDSTGLLHHQVVHTGEKPYCCLVCELRFSSRSSLGRHLKRQHRGVLPSPLQPGPGLPALSAPCSVCCNVGPCSVCGGSGAGGGEGPEGAGAGLGSWGLAEAAAAAAASLPPFACGACARRFDHGRELAAHWAAHTDVKPFKCPRCERDFNAPALLERHKLTHDLQGPGAPPAQAWAAGPGAGPETAGEGTAAEAGDAPLASDRRLLLGPAGGGVPKLGGLLPEGGGEAPAPAAAAEPSEDTLYQCDCGTFFASAAALASHLEAHSGPATYGCGHCGALYAALAAAREREPASGEPPSGSGRGKKIFGCSECEKLFRSPRDLERHVLVHTGEKPFPCLECGKFFRHECYLKRHRLLHGTERPFPCHICGKGFITLSNLSRHLKLHRGMD

SEQ ID NO: 886475 - protein, 534 aa, Homo sapiens
MDDVPAPTPAPAPPAAAAPRVPFHCSECGKSFRYRSDLRRHFARHTALKPHACPRCGKGFKHSFNLANHLRSHTGERPYRCSACPKGFRDSTGLLHHQEAKQALEELEEGQCDWSMEKQKVWLRRSLESAGPWKYSVVHTGEKPYCCLVCELRFSSRSSLGRHLKRQHRGVLPSPLQPGPGLPALSAPCSVCCNVGPCSVCGGSGAGGGEGPEGAGAGLGSWGLAEAAAAAAASLPPFACGACARRFDHGRELAAHWAAHTDVKPFKCPRCERDFNAPALLERHKLTHDLQGPGAPPAQAWAAGPGAGPETAGEGTAAEAGDAPLASDRRLLLGPAGGGVPKLGGLLPEGGGEAPAPAAAAEPSEDTLYQCDCGTFFASAAALASHLEAHSGPATYGCGHCGALYAALAALEEHRRVSHGEGGGEEAAAAAREREPASGEPPSGSGRGKKIFGCSECEKLFRSPRDLERHVLVHTGEKPFPCLECGKFFRHECYLKRHRLLHGTERPFPCHICGKGFITLSNLSRHLKLHRGMD

SEQ ID NO: 886476 - protein, 1031 aa, Homo sapiens
MGGDHPEDEEDFYEEEMDYGESEEPMGDDDYDEYSKELNQYRRSKDSRGRGLSRGRGRGSRGRGKGMGRGRGRGGSRGGMNKGGMNDDEDFYDEDMGDGGGGSYRSRDHDKPHQQSDKKGKVICKYFVEGRCTWGDHCNFSHDIELPKKRELCKFYITGFCARAENCPYMHGDFPCKLYHTTGNCINGDDCMFSHDPLTEETRELLDKMLADDAEAGAEDEKEVEELKKQGINPLPKPPPGVGLLPTPPRPPGPQAPTSPNGRPMQGGPPPPPPPPPPPPGPPQMPMPVHEPLSPQQLQQQDMYNKKIPSLFEIVVRPTGQLAEKLGVRFPGPGGPPGPMGPGPNMGPPGPMGGPMHPDMHPDMHPDMHPDMHADMHADMPMGPGMNPGPPMGPGGPPMMPYGPGDSPHSGMMPPIPPAQNFYENFYQQQEGMEMEPGLLGDAEDYGHYEELPGEPGEHLFPEHPLEPDSFSEGGPPGRPKPGAGVPDFLPSAQRALYLRIQQKQQEEEERARRLAESSKQDRENEEGDTGNWYSSDEDEGGSSVTSILKTLRQQTSSRPPASVGELSSSGLGDPRLQKGHPTGSRLADPRLSRDPRLTRHVEASGGSGPGDSGPSDPRLARALPTSKPEGSLHSSPVGPSSSKGSGPPPTEEEEGERALREKAVNIPLDPLPGHPLRDPRSQLQQFSHIKKDVTLSKPSFARTVLWNPEDLIPLPIPKQDAVPPVPAALQSMPTLDPRLHRAATAGPPNARQRPGASTDSSTQGANLPDFELLSRILKTVNATGSSAAPGSSDKPSDPRVRKAPTDPRLQKPTDSTASSRAAKPGPAEAPSPTASPSGDASPPATAPYDPRVLAAGGLGQGGGGGQSSVLSGISLYDPRTPNAGGKATEPAADTGAQPKGAEGNGKSSASKAKEPPFVRKSALEQPETGKAGADGGTPTDRYNSYNRPRPKAAAAPAATTATPPPEGAPPQPGVHNLPVPTLFGTVKQTPKTGSGSPFAGNSPAREGEQDAASLKDVFKGFDPTASPFCQ

SEQ ID NO: 886477 - protein, 85 aa, Homo sapiens
RSHLYPSLSFPFTSTPCPLQDGGGGSYRSRDHDKPHQQSDKKGKVICKYFVEGRCTWVRSAESWAPLGGHSPQRTHGFQKVLEPW

SEQ ID NO: 886478 - protein, 632 aa, Homo sapiens
MGGDHPEDEEDFYEEEMDYGESEEPMGDDDYDEYSKELNQYRRSKDSRGRGLSRGRGRGSRGRGKGMGRGRGRGGSRGGMNKGGMNDDEDFYDEDMGDGGGGSYRSRDHDKPHQQSDKKGKVICKYFVEGRCTWGDHCNFSHDIELPKKRELCKFYITGFCARAENCPYMHGDFPCKLYHTTGNCINGDDCMFSHDPLTEETRELLDKMLADDAEAGAEDEKEVEELKKQGINPLPKPPPGVGLLPTPPRPPGPQAPTSPNGRPMQGGPPPPPPPPPPPPGPPQMPMPVHEPLSPQQLQQQDMYNKKIPSLFEIVVRPTGQLAEKLGVRFPGPGGPPGPMGPGPNMGPPGPMGGPMHPDMHPDMHPDMHPDMHADMHADMPMGPGMNPGPPMGPGGPPMMPYGPGDSPHSGMMPPIPPAQNFYENFYQQQEGMEMEPGLLGDAEDYGHYEELPGEPGEHLFPEHPLEPDSFSEGGPPGRPKPGAGVPDFLPSAQRALYLRIQQKQQEEEERARRLAESSKQDRENEEGDTGNWYSSDEDEGGSSVTSILKTLRQQTSSRPPASVGELSSSGLGDPRLQKGHPTGSRLADPRLSRDPRLTRHVEASGGSGPGDSGPSDPRLSLERRYWFSSLD

SEQ ID NO: 886479 - protein, 439 aa, Homo sapiens
MSVPSALMKQPPIQSTAGAVPVRNEKGEISMEKVKVKRYVSGKRPDYAPMESSDEEDEEFQFIKKAKEQEAEPEEQEEDSSSDPRLRRLQNRISEDVEERLARHRKIVEPEVVGESDSEVEGDAWRMEREDSSEEEEEEIDDEEIERRRGMMRQRAQERKNEEMEVMEVEDEGRSGEESESESEYEEYTDSEDEMEPRLKPVFIRKKDRVTVQEREAEALKQKELEQEAKRMAEERRKYTLKIVEEETKKELEENKRSLAALDALNTDDENDEEEYEAWKVRELKRIKRDREDREALEKEKAEIERMRNLTEEERRAELRANGKVITNKAVKGKYKFLQKYYHRGAFFMDEDEEVYKRDFSAPTLEDHFNKTILPKVMQVKNFGRSGRTKYTHLVDQDTTSFDSAWGQESAQNTKFFKQKAAGVRDVFERPSAKKRKTT

SEQ ID NO: 886480 - protein, 439 aa, Homo sapiens; identical to SEQ ID NO: 886479

SEQ ID NO: 886481 - protein, 439 aa, Homo sapiens; identical to SEQ ID NO: 886479

SEQ ID NO: 886482 - protein, 296 aa, Homo sapiens
MSVPSALMKQPPIQSTAGAVPVRNEKGEISMEKVKVKRYVSGKRPDYAPMESSDEEDEEFQFIKKAKEQEAEPEEQEEDSSSDPRLRRLQNRISEDVEERLARHRKIVEPEVVGESDSEVEGDAWRMEREDSSEEEEEEIDDEEIERRRGMMRQRAQERKNEEMEVMEVEDEGRSGEESESESEYEEYTDSEDEMEPRLKPVFIRKKDRVTVQEREAEALKQKELEQEAKRMAEERRKYTLKIVEEETKKELEENKRSLAALDALNTDDENDEEEYEAWKVRELKRIKRDREDREA

SEQ ID NO: 886483 - protein, 309 aa, Homo sapiens
MSVPSALMKQPPIQSTAGAVPVRNEKGEISMEKVKVKRYVSGKRPDYAPMESSDEEDEEFQFIKKAKEQEAEPEEQEEDSSSDPRLRRLQNRISEDVEERLARHRKIVEPEVVGESDSEVEGDAWRMEREDSSEEEEEEIDDEEIERRRGMMRQRAQERKNEEMEVMEVEDEGRFWQQAAQHITQSAANGSSYNRAAASMHDGRPSPFKGQGLPCPGTLKTQGKPPAKPLEPKGSPPTGGKPAWRTKGPPGQQGPATFSRHKTPQVTRRETSTLAAKAHKRGRNNGPQPTSYRSPTWGPRWTTWRNHKG

SEQ ID NO: 886484 - protein, 142 aa, Homo sapiens
MSVPSALMKQPPIQSTAGAVPVRNEKGEISMEKVKVKRYVSGKRPDYAPMESSDEEDEEFQFIKKAKEQEAEPEEQEEDSSSDPRLRRLQNRISEDVEERLARHRKIVEPEVVGESDSEVEGDAWRMEREDSSEERDIMCPA

SEQ ID NO: 886485 - protein, 102 aa, Homo sapiens
MSVPSALMKQPPIQSTAGAVPVRNEKGTVLTPSSQSNFNPFRPQQPPDLSRTDHSNPASFEIWLPDSSIFPPPPTCIRSCSCGLLSYSASTSLLLASTNSLD

SEQ ID NO: 886486 - protein, 439 aa, Homo sapiens; identical to SEQ ID NO: 886479

SEQ ID NO: 886487 - protein, 133 aa, Homo sapiens
MRNLTEEERRAELRANGKVITNKAVKGKYKFLQKYYHRGAFFMDEDEEVYKRDFSAPTLEDHFNKTILPKVMQVKNFGRSGRTKYTHLVDQDTTSFDSAWGQESAQNTKFFKQKAAGVRDVFERPSAKKRKTT

SEQ ID NO: 886488 - protein, 379 aa, Homo sapiens
MSVPSALMKQPPIQSTAGAVPVRNEKGEISMEKVKVKRYVSGKRPDYAPMESSDEEDEEFQFIKKAKEQEAEPEEQEEDSSSDPRLRRLQNRISEDVEERLARHRKIVEPEVVGESDSEVEGDAWRMEREDSSEEEEEEIDDEEIERRRGMMRQRAQERKNEEMEVMEVEDEGRSGEESESESEYEEYTDSEDEMEPRLKPVFIRKKDRVTVQEREAEALKQKELEQEAKRMAEERRKYTLKIVEEETKKELEENKRSLAALDALNTDDENDEEEYEAWKVRELKRIKRDREDREALEKEKAEIERMRNLTEEERRAELRANGKVITNKAVKGKYKFLQKYYHRGAFFMVRSEKRVRKLGSRNNSETLNYFSLQEYSGM

SEQ ID NO: 886489 - protein, 150 aa, Homo sapiens
MSVPSALMKQPPIQSTAGAVPVRNEKGEISMEKVKVKRYVSGKRPDYAPMESSDEEDEEFQFIKKAKEQEAEPEEQEEDSSSDPRLRRLQNRISEDVEERLARHRKIVEPEVVGESDSEVEGDAWRMEREDSSEEEEEEIDDESRWTARS

SEQ ID NO: 886490 - protein, 114 aa, Homo sapiens
LNYGRVDFFLRWSLALLPRLEGSGAISAHCNLCLPGSSSSASASQVAVTKGARRHAQLIFCILVETGFHRVAQAALRTPELRQSTASAYRSARITDVSHRAWSSLHFFSISFIS

SEQ ID NO: 886491 - protein, 176 aa, Homo sapiens
PFPGVHLVAGKATFSERVCLLSGSLSPQPAMEEQPQMQDADEPADSGGEGRAGGPPQVAGAQAACSEDRMTLLLRLRAQTKQQLLEYKSMVDASEEKTPEQIMQEKQIEAKIEDLENEIEEVKVAFEIKKLALDRMRLSTALKKNLEKISRQSSVLMDNMKHLLELNKLIMKSQQN

SEQ ID NO: 886492 - protein, 277 aa, Homo sapiens
PFPGVHLVAGKATFSERVCLLSGSLSPQPAMEEQPQMQDADEPADSGGEGRAGGPPQVAGAQAACSEDRMTLLLRLRAQTKQQLLEYKSMVDASEEKTPEQIMQEKQIEAKIEDLENEIEEVKVAFEIKKLALDRMRLSTALKKNLEKISRQSSVLMDNMKHLLELNKLIMKSQQESWDLEEKLLDIRKKRLQLKQASESKLLEIQTEKNKQKIDLDSMENSERIKIIRQNLQMEIKITTVIQHVFQNLILGSKVNWAEDPALKEIVLQLEKNVDMM

SEQ ID NO: 886493 - protein, 194 aa, Homo sapiens
PFPGVHLVAGKATFSERVCLLSGSLSPQPAMEEQPQMQDADEPADSGGEGRAGGPPQVAGAQAACSEDRMTLLLRLRAQTKQQLLEYKSMVDASEEKTPEQIMQEKQIEAKIEDLENEIEEVKVAFEIKKLALDRMRLSTALKKNLEKISRQSSVLMDNMKHLLELNKLIMKSQQESWDLEEKLLDIRKKRLRM

SEQ ID NO: 886494 - protein, 157 aa, Homo sapiens
SCQAALQLGVGVGRVISPDSLKLLSLHSPRRCPGLADDSPSAYGAGAKLLWVDCTGPHARHQPHLLDPLYTGPGSFLVSPAQRFQGEDQATAHCPASGRKEEEPLCAHISGRPGQLGSVSQPQPTGSGDLKGSTASAPSAHCVRPTPALAVIDRERP

SEQ ID NO: 886495 - protein, 414 aa, Homo sapiens
QEETVPAGGRSCRSGGLLGAGLGGDRWRGGAWGSEGWALEIRGSTLLRCLDSGFRPGASRGLVGSWAAMESTLGAGIVIAEALQNQLAWLENVWLWITFLGDPKILFLFYFPAAYYASRRVGIAVLWISLITEWLNLIFKWFLFGDRPFWWVHESGYYSQAPAQVHQFPSSCETGPGSPSGHCMITGAALWPIMTALSSQVATRARSRWVRVMPSLAYCTFLLAVGLSRIFILAHFPHQVLAGLITGAVLGWLMTPRVPMERELSFYGLTALALMLGTSLIYWTLFTLGLDLSWSISLAFKWCERPEWIHVDSRPFASLSRDSGAALGLGIALHSPCYAQVRRAQLGNGQKIACLVLAMGLLGPLDWLGHPPQISLFYIFNFLKYTLWPCLVLALVPWAVHMFSAQEAPPIHSS

SEQ ID NO: 886496 - protein, 221 aa, Homo sapiens
MTALSSQVATRARSRWVRVMPSLAYCTFLLAVGLSRIFILAHFPHQVLAGLITGAVLGWLMTPRVPMERELSFYGLTALALMLGTSLIYWTLFTLGLDLSWSISLAFKWCERPEWIHVDSRPFASLSRDSGAALGLGIALHSPCYAQVRRAQLGNGQKIACLVLAMGLLGPLDWLGHPPQISLFYIFNFLKYTLWPCLVLALVPWAVHMFSAQEAPPIHSS

SEQ ID NO: 886497 - protein, 257 aa, Homo sapiens
TLLDFKPYYEATVTNNNMVLVQKQAHRTMEQSRQPIMTALSSQVATRARSRWVRVMPSLAYCTFLLAVGLSRIFILAHFPHQVLAGLITGAVLGWLMTPRVPMERELSFYGLTALALMLGTSLIYWTLFTLGLDLSWSISLAFKWCERPEWIHVDSRPFASLSRDSGAALGLGIALHSPCYAQVRRAQLGNGQKIACLVLAMGLLGPLDWLGHPPQISLFYIFNFLKYTLWPCLVLALVPWAVHMFSAQEAPPIHSS

SEQ ID NO: 886498 - protein, 263 aa, Homo sapiens
QEETVPAGGRSCRSGGLLGAGLGGDRWRGGAWGSEGWALEIRGSTLLRCLDSGFRPGASRGLVGSWAAMESTLGAGIVIAEALQNQLAWLENVWLWITFLGDPKILFLFYFPAAYYASRRVGIAVLWISLITEWLNLIFKWFLFGDRPFWWVHESGYYSQAPAQVHQFPSSCETGPGSPSGHCMITGAALWPIMTALSSQVATRARRRCPGLADDSPSAYGAGAKLLWVDCTGPHARHQPHLLDPLYTGPGSFLVHQPSLQVV

SEQ ID NO: 886499 - protein, 264 aa, Homo sapiens
QEETVPAGGRSCRSGGLLGAGLGGDRWRGGAWGSEGWALEIRGSTLLRCLDSGFRPGASRGLVGSWAAMESTLGAGIVIAEALQNQLAWLENVWLWITFLGDPKILFLFYFPAAYYASRRVGIAVLWISLIYWTLFTLGLDLSWSISLAFKWCERPEWIHVDSRPFASLSRDSGAALGLGIALHSPCYAQVRRAQLGNGQKIACLVLAMGLLGPLDWLGHPPQISLFYIFNFLKYTLWPCLVLALVPWAVHMFSAQEAPPIHSS

SEQ ID NO: 886500 - protein, 414 aa, Homo sapiens; identical to SEQ ID NO: 886495

SEQ ID NO: 886501 - protein, 434 aa, Homo sapiens
QEETVPAGGRSCRSGGLLGAGLGGDRWRGGAWGSEGWALEIRGSTLLRCLDSGFRPGASRGLVGSWAAMESTLGAGIVIAEALQNQLAWLENVWLWITFLGDPKILFLFYFPAAYYASRRVGIAVLWISLITEWLNLIFKWLRQRSPPASWSPPPRALSHVFLFGDRPFWWVHESGYYSQAPAQVHQFPSSCETGPGSPSGHCMITGAALWPIMTALSSQVATRARSRWVRVMPSLAYCTFLLAVGLSRIFILAHFPHQVLAGLITGAVLGWLMTPRVPMERELSFYGLTALALMLGTSLIYWTLFTLGLDLSWSISLAFKWCERPEWIHVDSRPFASLSRDSGAALGLGIALHSPCYAQVRRAQLGNGQKIACLVLAMGLLGPLDWLGHPPQISLFYIFNFLKYTLWPCLVLALVPWAVHMFSAQEAPPIHSS

SEQ ID NO: 886502 - protein, 221 aa, Homo sapiens; identical to SEQ ID NO: 886496

SEQ ID NO: 886503 - protein, 425 aa, Homo sapiens
QEETVPAGGRSCRSGGLLGAGLGGDRWRGGAWGSEGWALEIRGSTLLRCLDSGFRPGASRGLVGSWAAMESTLGAGIVIAEALQNQLAWLENVWLWITFLGDPKILFLFYFPAAYYASRRVGIAVLWISLITEWLNLIFKWFLFGDRPFWWVHESGYYSQAPAQVHQFPSSCETGPGSPSGHCMITGAALWPIMTALSSQVATRARSRWVRVMPSLAYCTFLLAVGLSRIFILAHFPHQVLAGLITDSLKLLSLHSPGAVLGWLMTPRVPMERELSFYGLTALALMLGTSLIYWTLFTLGLDLSWSISLAFKWCERPEWIHVDSRPFASLSRDSGAALGLGIALHSPCYAQVRRAQLGNGQKIACLVLAMGLLGPLDWLGHPPQISLFYIFNFLKYTLWPCLVLALVPWAVHMFSAQEAPPIHSS

SEQ ID NO: 886504 - protein, 73 aa, Homo sapiens
IIIGDISTSTECTPVPLPDAKQRLFPRGHPPQISLFYIFNFLKYTLWPCLVLALVPWAVHMFSAQEAPPIHSS

SEQ ID NO: 886505 - protein, 524 aa, Homo sapiens
MKVLGRSFFWVLFPVLPWAVQAVEHEEVAQRVIKLHRGRGVAAMQSRQWVRDSCRKLSGLLRQKNAVLNKLKTAIGAVEKDVGLSDEEKLFQVHTFEIFQKELNESENSVFQAVYGLQRALQGDYKDVVNMKESSRQRLEALREAAIKEETEYMELLAAEKHQVEALKNMQHQNQSLSMLDEILEDVRKAADRLEEEIEEHAFDDNKSVKGVNFEAVLRVEEEEANSKQNITKREVEDDLGLSMLIDSQNNQYILTKPRDSTIPRADHHFIKDIVTIGMLSLPCGWLCTAIGLPTMFGYIICGVLLGPSGLNSIKSIVQVETLGEFGVFFTLFLVGLEFSPEKLRKVWKISLQGPCYMTLLMIAFGLLWGHLLRIKPTQSVFISTCLSLSSTPLVSRFLMGSARGDKEGDIDYSTVLLGMLVTQDVQLGLFMAVMPTLIQAGASASSSIVVEVLRILVLIGQILFSLAAVFLLCLVIKKYLIGPYYRKLHMESKGNKEILILGISAFIFLMLTVILKLCVIYVI

SEQ ID NO: 886506 - protein, 414 aa, Homo sapiens
MKVLGRSFFWVLFPVLPWAVQAVEHEEVAQRVIKLHRGRGVAAMQSRQWVRDSCRKLSGLLRQKNAVLNKLKTAIGAVEKDVGLSDEEKLFQVHTFEIFQKELNESENSVFQAVYGLQRALQGDYKDVVNMKESSRQRLEALREAAIKEETEYMELLAAEKHQVEALKNMQHQNQSLSMLDEILEDVRKAADRLEEEIEEHAFDDNKSVKGVNFEAVLRVEEEEANSKQNITKREVEDDLGLSMLIDSQNNQYILTKPRDSTIPRADHHFIKDIVTIGMLSLPCGWLCTAIGLPTMFGYIICGVLLGPSGLNSIKSIVQVETLGEFGVFFTLFLVGLEFSPEKLRKVWKISLQGPCYMTLLMIAFGLLWGHLLRIKPTQSVFISTCLSLSSTPLVSRFLMGSARGDKEGNRTAL

SEQ ID NO: 886507 - protein, 677 aa, Homo sapiens
MKVLGRSFFWVLFPVLPWAVQAVEHEEVAQRVIKLHRGRGVAAMQSRQWVRDSCRKLSGLLRQKNAVLNKLKTAIGAVEKDVGLSDEEKLFQVHTFEIFQKELNESENSVFQAVYGLQRALQGDYKDVVNMKESSRQRLEALREAAIKEETEYMELLAAEKHQVEALKNMQHQNQSLSMLDEILEDVRKAADRLEEEIEEHAFDDNKSVKGVNFEAVLRVEEEEANSKQNITKREVEDDLGLSMLIDSQNNQYILTKPRDSTIPRADHHFIKDIVTIGMLSLPCGWLCTAIGLPTMFGYIICGVLLGPSGLNSIKSIVQVETLGEFGVFFTLFLVGLEFSPEKLRKVWKISLQGPCYMTLLMIAFGLLWGHLLRIKPTQSVFISTCLSLSSTPLVSRFLMGSARGDKEGDIDYSTVLLGMLVTQDVQLGLFMAVMPTLIQAGASASSSIVVEVLRILVLIGQILFSLAAVFLLCLVIKKYLIGPYYRKLHMESKGNKEILILGISAFIFLMLTVTELLDVSMELGCFLAGALVSSQGPVVTEEIATSIEPIRDFLAIVFFASIGLHVFPTFVAYELTVLVFLTLSVVVMKFLLAALVLSLILPRSSQYIKWIVSAGLAQVSEFSFVLGSRARRAGVISREVYLLILSVTTLSLLLAPVLWRAAITRCVPRPERRSSL

SEQ ID NO: 886508 - protein, 646 aa, Homo sapiens
MKVLGRSFFWVLFPVLPWAVQAVEHEEVAQRVIKLHRGRGVAAMQSRQWVRDSCRKLSGLLRQKNAVLNKLKTAIGAVEKDVGLSDEEKLFQVHTFEIFQKELNESENSVFQAVYGLQRALQGDYKDVVNMKESSRQRLEALREAAIKEETEYMELLAAEKHQVEALKNMQHQNQSLSMLDEILEDVRKAADRLEEEIEEHAFDDNKSVKGVNFEAVLRVEEEEANSKQNITKREVEDDLGLSMLIDSQNNQYILTKPRDSTIPRADHHFIKDIVTIGMLSLPCGWLCTAIGLPTMFGYIICGVLLGPSGLNSIKVWKISLQGPCYMTLLMIAFGLLWGHLLRIKPTQSVFISTCLSLSSTPLVSRFLMGSARGDKEGDIDYSTVLLGMLVTQDVQLGLFMAVMPTLIQAGASASSSIVVEVLRILVLIGQILFSLAAVFLLCLVIKKYLIGPYYRKLHMESKGNKEILILGISAFIFLMLTVTELLDVSMELGCFLAGALVSSQGPVVTEEIATSIEPIRDFLAIVFFASIGLHVFPTFVAYELTVLVFLTLSVVVMKFLLAALVLSLILPRSSQYIKWIVSAGLAQVSEFSFVLGSRARRAGVISREVYLLILSVTTLSLLLAPVLWRAAITRCVPRPERRSSL

SEQ ID NO: 886509 - protein, 677 aa, Homo sapiens; identical to SEQ ID NO: 886507

SEQ ID NO: 886510 - protein, 704 aa, Homo sapiens
MKVLGRSFFWVLFPVLPWAVQAVEHEEVAQRVIKLHRGRGVAAMQSRQWVRDSCRKLSGLLRQKNAVLNKLKTAIGAVEKDVGLSDEEKLFQVHTFEIFQKELNESENSVFQAVYGLQRALQGDYKDVVNMKESSRQRLEALREAAIKEETEYMELLAAEKHQVEALKNMQHQNQSLSMLDEILEDVRKAADRLEEEIEEHAFDDNKSVSVPEQLLLHLLSHSLIRRHVVEIVHSVKGVNFEAVLRVEEEEANSKQNITKREVEDDLGLSMLIDSQNNQYILTKPRDSTIPRADHHFIKDIVTIGMLSLPCGWLCTAIGLPTMFGYIICGVLLGPSGLNSIKSIVQVETLGEFGVFFTLFLVGLEFSPEKLRKVWKISLQGPCYMTLLMIAFGLLWGHLLRIKPTQSVFISTCLSLSSTPLVSRFLMGSARGDKEGDIDYSTVLLGMLVTQDVQLGLFMAVMPTLIQAGASASSSIVVEVLRILVLIGQILFSLAAVFLLCLVIKKYLIGPYYRKLHMESKGNKEILILGISAFIFLMLTVTELLDVSMELGCFLAGALVSSQGPVVTEEIATSIEPIRDFLAIVFFASIGLHVFPTFVAYELTVLVFLTLSVVVMKFLLAALVLSLILPRSSQYIKWIVSAGLAQVSEFSFVLGSRARRAGVISREVYLLILSVTTLSLLLAPVLWRAAITRCVPRPERRSSL

SEQ ID NO: 886511 - protein, 580 aa, Homo sapiens
MKVLGRSFFWVLFPVLPWAVQAVEHEEVAQRVIKLHRGRGVAAMQSRQWVRDSCRKLSGLLRQKNAVLNKLKTAIGAVEKDVGLSDEEKLFQVHTFEIFQKELNESENSVFQAVYGLQRALQGDYKDVVNMKESSRQRLEALREAAIKEETEYMELLAAEKHQVEALKNMQHQNQSLSMLDEILEDVRKAADRLEEEIEEHAFDDNKSVKGVNFEAVLRVEEEEANSKQNITKREVEDDLGLSMLIDSQNNQYILTKPRDSTIPRADHHFIKDIVTIGMLSLPCGWLCTAIGLPTMFGYIICGVLLGPSGLNSIKSIVQVETLGEFGVFFTLFLVGLEFSPEKLRKHCRGSSPNPGFDWSDSFFTSGGFSFMSCYKEVSHWTLLSEAAHGKQGEQRNPDLGNICLYLLNVNGHGAAGRLHGAGLFPGWSARLLSGPRGHRGDRHLHRTHPRLPGHRFLRLHRAPRVPHVCGVRAHGAGVPHLVSGGDEVSPGGAGPVSHSAEEQPVHQVDRLCGACPGQRVFLCPGEPGAKSGRHLSGGVPPYTECDHAQPLARPGAVESCNHEVCAQTGETVQPLMARR

SEQ ID NO: 886512 - protein, 497 aa, Homo sapiens
MKVLGRSFFWVLFPVLPWAVQAVEHEEVAQRVIKLHRGRGVAAMQSRQWVRDSCRKLSGLLRQKNAVLNKLKTAIGAVEKDVGLSDEEKLFQVHTFEIFQKELNESENSVFQAVYGLQRALQGDYKDVVNMKESSRQRLEALREAAIKEETEYMELLAAEKHQVEALKNMQHQNQSLSMLDEILEDVRKAADRLEEEIEEHAFDDNKSVKGVNFEAVLRVEEEEANSKQNITKREVEDDLGLSMLIDSQNNQYILTKPRDSTIPRADHHFIKDIVTIGMLSLPCGWLCTAIGLPTMFGYIICGVLLGPSGLNSIKSIVQVETLGEFGVFFTLFLVGLEFSPEKLRKVWKISLQGPCYMTLLMIAFGLLWGHLLRIKPTQSVFISTCLSLSSTPLVSRFLMGSARGDKEGDIDYSTVLLGMLVTQDVQLGLFMAVMPTLIQAGASASSRSRSCWTSPWSWAVSWLERSSPLRAPWSPRRSPPPSNPSATSWPSFSSPP

SEQ ID NO: 886513 - protein, 677 aa, Homo sapiens; identical to SEQ ID NO: 886507

SEQ ID NO: 886514 - protein, 594 aa, Homo sapiens
ELGTPSFIIPTQGDYKDVVNMKESSRQRLEALREAAIKEETEYMELLAAEKHQVEALKNMQHQNQSLSMLDEILEDVRKAADRLEEEIEEHAFDDNKSVSVPEQLLLHLLSHSLIRRHVVEIVHSVKGVNFEAVLRVEEEEANSKQNITKREVEDDLGLSMLIDSQNNQYILTKPRDSTIPRADHHFIKDIVTIGMLSLPCGWLCTAIGLPTMFGYIICGVLLGPSGLNSIKSIVQVETLGEFGVFFTLFLVGLEFSPEKLRKVWKISLQGPCYMTLLMIAFGLLWGHLLRIKPTQSVFISTCLSLSSTPLVSRFLMGSARGDKEGDIDYSTVLLGMLVTQDVQLGLFMAVMPTLIQAGASASSSIVVEVLRILVLIGQILFSLAAVFLLCLVIKKYLIGPYYRKLHMESKGNKEILILGISAFIFLMLTVTELLDVSMELGCFLAGALVSSQGPVVTEEIATSIEPIRDFLAIVFFASIGLHVFPTFVAYELTVLVFLTLSVVVMKFLLAALVLSLILPRSSQYIKWIVSAGLAQVSEFSFVLGSRARRAGVISREVYLLILSVTTLSLLLAPVLWRAAITRCVPRPERRSSL

SEQ ID NO: 886515 - protein, 161 aa, Homo sapiens
GHSCPAQLRAQEPPGHQRLAGVRDATRCRGGGSGRAGEEERLVEKSRGLHVFPTFVAYELTVLVFLTLSVVVMKFLLAALVLSLILPRSSQYIKWIVSAGLAQVSEFSFVLGSRARRAGVISREVYLLILSVTTLSLLLAPVLWRAAITRCVPRPERRSSL

SEQ ID NO: 886516 - protein, 156 aa, Homo sapiens [sequence omitted]

SEQ ID NO: 886517 - protein, 136 aa, Homo sapiens
MGRKPGISGTGHSQAGRKPVGLEMKGRLSTGQQRGENAARNAQGLHVFPTFVAYELTVLVFLTLSVVVMKFLLAALVLSLILPRSSQYIKWIVSAGLAQVYLLILSVTTLSLLLAPVLWRAAITRCVPRPERRSSL

SEQ ID NO: 886518 - protein, 241 aa, Homo sapiens [sequence omitted]

SEQ ID NO: 886519 - protein, 124 aa, Homo sapiens
MNHCLTMCDNNSFSAENVCLTCKLSGAETRGLLCPALRTWIMKVLGRSFFWVLFPVLPWAVQAVEHEEVAQRVIKLHRGRGVAAMQSRQWVRDSCRKLSGLLRQKNAVLNKLKTAIGAVEKDVG

SEQ ID NO: 886520 - protein, 907 aa, Homo sapiens
MPTAAAPIISSVQKLVLYETRARYFLVGSNNAETKYRVLKIDRTEPKDLVIIDDRHVYTQQEVRELLGRLDLGNRTKMGQKGSSGLFRAVSAFGVVGFVRFLEGYYIVLITKRRKMADIGGHAIYKVEDTNMIYIPNDSVRVTHPDEARYLRIFQNVDLSSNFYFSYSYDLSHSLQYNLTVLRMPLEMLKSEMTQNRQESFDIFEDEGLITQGGSGVFGICSEPYMKYVWNGELLDIIKSTVHRDWLLYIIHGFCGQSKLLIYGRPVYVTLIARRSSKFAGTRFLKRGANCEGDVANEVETEQILCDASVMSFTAGSYSSYVQVRGSVPLYWSQDISTMMPKPPITLDQADPFAHVAALHFDQMFQRFGSPIIILNLVKEREKRKHERILSEELVAAVTYLNQFLPPEHTIVYIPWDMAKYTKSKLCNVLDRLNVIAESVVKKTGFFVNRPDSYCSILRPDEKWNELGGCVIPTGRLQTGILRTNCVDCLDRTNTAQFMVGKCALAYQLYSLGLIDKPNLQFDTDAVRLFEELYEDHGDTLSLQYGGSQLVHRVKTYRKIAPWTQHSKDIMQTLSRYYSNAFSDADRQDSINLFLGVFHPTEGKPHLWELPTDFYLHHKNTMRLLPTRRSYTYWWTPEVIKHLPLPYDEVICAVNLKKLIVKKFHKYEEEIDIHNEFFRPYELSSFDDTFCLAMTSSARDFMPKTVGIDPSPFTVRKPDETGKSVLGNKSNREEAVLQRKTAASAPPPPSEEAVSSSSEDDSGTDREEEGSVSQRSTPVKMTDAGDSAKVTENVVQPMKELYGINLSDGLSEEDFSIYSRFVQLGQSQHKQDKNSQQPCSRCSDGVIKLTPISAFSQDNIYEVQPPRVDRKSTEIFQAHIQASQGIMQPLGKEDSSMYREYIRNRYL

SEQ ID NO: 886521 - protein, 95 aa, Homo sapiens
SACLFNASDSQVLLRLLPVVLPYIFFNAALSLFIFYRTPISAFSQDNIYEVQPPRVDRKSTEIFQAHIQASQGIMQPLGKEDSSMYREYIRNRYL

SEQ ID NO: 886522 - protein, 245 aa, Homo sapiens
MRYFLVGSNNAETKYRVLKIDRTEPKDLVIIDDRHVYTQQEVRELLGRLDLGNRTKMGQKGSSGLFRAVSAFGVVGFVRFLEGYYIVLITKRRKMADIGGHAIYKVEDTNMIYIPNDSVRVTHPDEARYLRIFQNVDLSSNFYFSYSYDLSHSLQYNLTVLRMPLEMLKSEMTQNRQESFDIFEDEGLITQGGSGVFGICSEPYMKYVWNGELLDIIKSTVHRDWLLYIIHGFCGQSSILSEEKV

SEQ ID NO: 886523 - protein, 157 aa, Homo sapiens
TSGYQRITGTMNYHSLIQNAVRLFEELYEDHGDTLSLQYGGSQLVHRVKTYRKIAPWTQHSKDIMQTLSRYYSNAFSDADRQDSINLFLGVFHPTEGKPHLWELPTDFYLHHKNTMRLLPTRRSYTYWWTPEVIKHLPLPYDEGFLARSPANLECSN

SEQ ID NO: 886524 - protein, 725 aa, Homo sapiens [sequence omitted]

SEQ ID NO: 886525 - protein, 264 aa, Homo sapiens
MQYLFLVICAVNLKKLIVKKFHKYEEEIDIHNEFFRPYELSSFDDTFCLAMTSSARDFMPKTVGIDPSPFTVRKPDETGKSVLGNKSNREEAVLQRKTAASAPPPPSEEAVSSSSEDDSGTDREEEGSVSQRSTPVKMTDAGDSAKVTENVVQPMKELYGINLSDGLSEEDFSIYSRFVQLGQSQHKQDKNSQQPCSRCSDGVIKLTPISAFSQDNIYEVQPPRVDRKSTEIFQAHIQASQGIMQPLGKEDSSMYREYIRNRYL

SEQ ID NO: 886526 - protein, 127 aa, Homo sapiens
MTDAGDSAKVTENVVQPMKELYGINLSDGLSEEDFSIYSRFVQLGQSQHKQDKNSQQPCSRCSDGVIKLTPISAFSQDNIYEVQPPRVDRKSTEIFQAHIQASQGIMQPLGKEDSSMYREYIRNRYL

SEQ ID NO: 886527 - protein, 361 aa, Homo sapiens
MPTAAAPIISSVQKLVLYETRARYFLVGSNNAETKYRVLKIDRTEPKDLVIIDDRHVYTQQEVRELLGRLDLGNRTKMGQKGSSGLFRAVSAFGVVGFVRFLEGYYIVLITKRRKMADIGGHAIYKVEDTNMIYIPNDSVRVTHPDEARYLRIFQNVDLSSNFYFSYSYDLSHSLQYNLTVLRMPLEMLKSEMTQNRQESFDIFEDEGLITQGGSGVFGICSEPYMKYVWNGELLDIIKSTVHRDWLLYIIHGFCGQSKLLIYGRPVYVTLIARRSSKFAGTRFLKRGANCEGDVANEVETEQILCDASVMSFTAGSYSSYVQVRGSVPLYWSQDISTMMPKPPITCVWSHVFNNNSCPHI

SEQ ID NO: 886528 - protein, 216 aa, Homo sapiens
MPTAAAPIISSVQKLVLYETRARYFLVGSNNAETKYRVLKIDRTEPKDLVIIDDRHVYTQQEVRELLGRLDLGNRTKMGQKGSSGLFRAVSAFGVVGFVRFLEGYYIVLITKRRKMADIGGHAIYKVEDTNMIYIPNDSVRVTHPDEARYLRIFQNVDLSSNFYFSYSYDLSHSLQYNLTVLRMPLEMLKSEMTQNRQESFDIFEDEGLITQGGSG

SEQ ID NO: 886529 - protein, 157 aa, Homo sapiens
MASMGTLAFDEYGRPFLIIKDQDRKSRLMGLEALKSHIMAAKAVANTMRTSLGPNGLDKMMVDKDGDVTVTNDGATILSMMDVDHQIAKLMVELSKSQDDEIGDGTTGVVVLAGALLEEAEQLLDRGIHPIRIADGYEQAARVAIEHLDKISDSVPC

SEQ ID NO: 886530 - protein, 157 aa, Homo sapiens; identical to SEQ ID NO: 886529

SEQ ID NO: 886531 - protein, 157 aa, Homo sapiens; identical to SEQ ID NO: 886529

SEQ ID NO: 886532 - protein, 157 aa, Homo sapiens
KARYEAGWRAKYGRPFLIIKDQDRKSRLMGLEALKSHIMAAKAVANTMRTSLGPNGLDKMMVDKDGDVTVTNDGATILSMMDVDHQIAKLMVELSKSQDDEIGDGTTGVVVLAGALLEEAEQLLDRGIHPIRIADGYEQAARVAIEHLDKISDSVPC

SEQ ID NO: 886533 - protein, 162 aa, Homo sapiens
QNKNQKQQEEEITMIIEEAKRSLHDALCVIRNLIRDNRVVYGGGAAEISCALAVSQEADKCPTLEQYAMRAFADALEVIPMALSENSGMNPIQTMTEVRARQVKEMNPALGIDCLHKGTNDMKQQHVIETLIGKKQQISLATQMVRMILKIDDIRKPGESEE

SEQ ID NO: 886534 - protein, 303 aa, Homo sapiens [sequence omitted]

SEQ ID NO: 886535 - protein, 303 aa, Homo sapiens [sequence omitted]

SEQ ID NO: 886536 - protein, 303 aa, Homo sapiens [sequence omitted]

SEQ ID NO: 886537 - protein, 303 aa, Homo sapiens [sequence omitted]

SEQ ID NO: 886538 - protein, 303 aa, Homo sapiens [sequence omitted]

SEQ ID NO: 886539 - protein, 303 aa, Homo sapiens [sequence omitted]

SEQ ID NO: 886540 - protein, 303 aa, Homo sapiens [sequence omitted]

SEQ ID NO: 886541 - protein, 303 aa, Homo sapiens [sequence omitted]

SEQ ID NO: 886542 - protein, 303 aa, Homo sapiens [sequence omitted]

SEQ ID NO: 886543 - protein, 303 aa, Homo sapiens [sequence omitted]

SEQ ID NO: 886544 - protein, 303 aa, Homo sapiens [sequence omitted]

SEQ ID NO: 886545 - protein, 303 aa, Homo sapiens [sequence omitted]

SEQ ID NO: 886546 - protein, 157 aa, Homo sapiens; identical to SEQ ID NO: 886529

SEQ ID NO: 886547 - protein, 244 aa, Homo sapiens
MPKKVEDAKIAILTCPFEPPKPKTKHKLDVTSVEDYKALQKYEKEKFEEMIQQIKETGANLAICQWGFDDEANHLLLQNNLPAVRWVGGPEIELIAIATGGRIVPRFSELTAEKLGFAGLVQEISFGTTKDKMLVIEQCKNSRAVTIFIRGGNKMIIEEAKRSLHDALCVIRNLIRDNRVVYGGGAAEISCALAVSQEADKCPTLEQYAMRAFADALEVIPMALSENSGMNPIQTMTEVRARQI

SEQ ID NO: 886548 - protein, 303 aa, Homo sapiens [sequence omitted]

SEQ ID NO: 886549 - protein, 290 aa, Homo sapiens
MPKKVEDAKIAILTCPFEPPKPKTKHKLDVTSVEDYKALQKYEKEKFEEMIQQIKETGANLAICQWGFDDEANHLLLQNNLPAVRWVGGPEIELIAIATGGRIVPRFSELTAEKLGFAGLVQEISFGTTKDKMLVIEQCKNSRAVTIFIRGGNKMIIEEAKRSLHDALCVIRNLIRDNRVVYGGGAAEISCALAVSQEADKCPTLEQYAMRAFADALEVIPMALSENSGMNPIQTMTEVRARQVKEMNPALGIDCCQGALLSTLSRNLLERPFSCPLVDGFGCGSVPDLM

SEQ ID NO: 886550 - protein, 157 aa, Homo sapiens; identical to SEQ ID NO: 886529

SEQ ID NO: 886551 - protein, 303 aa, Homo sapiens [sequence omitted]

SEQ ID NO: 886552 - protein, 303 aa, Homo sapiens [sequence omitted]

SEQ ID NO: 886553 - protein, 303 aa, Homo sapiens [sequence omitted]

SEQ ID NO: 886554 - protein, 303 aa, Homo sapiens [sequence omitted]

SEQ ID NO: 886555 - protein, 303 aa, Homo sapiens [sequence omitted]

SEQ ID NO: 886556 - protein, 303 aa, Homo sapiens [sequence omitted]

SEQ ID NO: 886557 - protein, 157 aa, Homo sapiens; identical to SEQ ID NO: 886529

SEQ ID NO: 886558 - protein, 303 aa, Homo sapiens [sequence omitted]

SEQ ID NO: 886559 - protein, 157 aa, Homo sapiens; identical to SEQ ID NO: 886529

SEQ ID NO: 886560 - protein, 157 aa, Homo sapiens; identical to SEQ ID NO: 886529

SEQ ID NO: 886561 - protein, 108 aa, Homo sapiens
MASMGTLAFDEYGRPFLIIKDQDRKSRLMGLEALKSHIMAAKAVANTMRTSLGPNGLDKMMVDKDGDVTVTNDGATILSMMDVDHREFVFSPPPPPGGGPGAGAGVRR

SEQ ID NO: 886562 - protein, 285 aa, Homo sapiens
MPKKVEDAKIAILTCPFEPPKPKTKHKLDVTSVEDYKALQKYEKEKFEEMIQQIKETGANLAICQWGFDDEANHLLLQNNLPAVRWVGGPEIELIAIATGGRIVPRFSELTAEKLGFAGLVQEISFGTTKDKMLVIEQCKNSRAVTIFIRGGNKMIIEEAKRSLHDALCVIRNLIRDNRVVYGGGAAEISCALAVSQEADKCPTLEQYAMRAFADALEVIPMALSENSGMNPIQTMTEVRARQVKEMNPALGIDCLHKGTNDMKQQHVIETLIGNDIRKPGESEE

SEQ ID NO: 886563 - protein, 303 aa, Homo sapiens [sequence omitted]

SEQ ID NO: 886564 - protein, 157 aa, Homo sapiens; identical to SEQ ID NO: 886529

SEQ ID NO: 886565 - protein, 303 aa, Homo sapiens [sequence omitted]

SEQ ID NO: 886566 - protein, 303 aa, Homo sapiens [sequence omitted]

SEQ ID NO: 886567 - protein, 303 aa, Homo sapiens [sequence omitted]

SEQ ID NO: 886568 - protein, 303 aa, Homo sapiens [sequence omitted]

SEQ ID NO: 886569 - protein, 154 aa, Homo sapiens
RGGNKMIIEEAKRSLHDALCVIRNLIRDNRVVYGGGAAEISCALAVSQEADKCPTLEQYAMRAFADALEVIPMALSENSGMNPIQTMTEVRARQVKEMNPALGIDCLHKGTNDMKQQHVIETLIGKKQQISLATQMVRMILKIDDIRKPGESEE

SEQ ID NO: 886570 - protein, 157 aa, Homo sapiens; identical to SEQ ID NO: 886529

SEQ ID NO: 886571 - protein, 189 aa, Homo sapiens
MALVRGGWLWRQSSILRRWKRNWFALWLDGTLGYYHDETAQDEEDRVLIHFNVRDIKIGPECHDVQPPEGRSRDGLLTVNLREGGRLHLCAETKDDALAWKTALLEANSTPVRVYSPYQDYYEVVPPNAHEATYVRSYYGPPYAGPGVTHVIVREDPCYSAGAPLAMGMLAGAATGAALGSLMWSPCWF

SEQ ID NO: 886572 - protein, 208 aa, Homo sapiens
MSPAAPVPPDSALESPFEEMALVRGGWLWRQSSILRRWKRNWFALWLDGTLGYYHDETAQDEEDRVLIHFNVRDIKIGPECHDVQPPEGRSRDGLLTVNLREGGRLHLCAETKDDALAWKTALLEANSTPVRVYSPYQDYYEVVPPNAHEATYVRSYYGPPYAGPGVTHVIVREDPCYSAGAPLAMGMLAGAATGAALGSLMWSPCWF

SEQ ID NO: 886573 - protein, 224 aa, Homo sapiens
MALVRGGWLWRQSSILRRWKRNWFALWLDGTLGYYHDETAQDEEDRVLIHFNVRDIKIGPECHDVQPPEGRSRDGLLTVNLREGGRLHLCAETKDDALAWKTALLEANSTPAPAGATVPPRSRRVCSKVRCVTRSWSPCKVERRIWVRVYSPYQDYYEVVPPNAHEATYVRSYYGPPYAGPGVTHVIVREDPCYSAGAPLAMGMLAGAATGAALGSLMWSPCWF

SEQ ID NO: 886574 - protein, 189 aa, Homo sapiens; identical to SEQ ID NO: 886571

SEQ ID NO: 886575 - protein, 189 aa, Homo sapiens; identical to SEQ ID NO: 886571

SEQ ID NO: 886576 - protein, 189 aa, Homo sapiens; identical to SEQ ID NO: 886571

SEQ ID NO: 886577 - protein, 209 aa, Homo sapiens
LKPGLLGVPPDSALESPFEEMALVRGGWLWRQSSILRRWKRNWFALWLDGTLGYYHDETAQDEEDRVLIHFNVRDIKIGPECHDVQPPEGRSRDGLLTVNLREGGRLHLCAETKDDALAWKTALLEANSTPVRVYSPYQDYYEVVPPNAHEATYVRSYYGPPYAGPGVTHVIVREDPCYSAGAPLAMGMLAGAATGAALGSLMWSPCWF

SEQ ID NO: 886578 - protein, 189 aa, Homo sapiens; identical to SEQ ID NO: 886571

SEQ ID NO: 886579 - protein, 189 aa, Homo sapiens; identical to SEQ ID NO: 886571

SEQ ID NO: 886580 - protein, 152 aa, Homo sapiens
MWGPNSPTPKLPPHGLVGFALQSMEDSTAGGKLHPGARLQPVPRLLRGGAPQCTRGHVCPQLLRTALRRPWRDARDSAGGSLLQRRRPSGHGHACGSRHWGGAGLAHVVALLVLSPGTRSTDPCAWIARLLFLLDPILYHPSPVPLWPYPLH

SEQ ID NO: 886581 - protein, 148 aa, Homo sapiens
MDPREACARRGGRGPNPGQGVPGHLTWLDSPGARLQPVPRLLRGGAPQCTRGHVCPQLLRTALRRPWRDARDSAGGSLLQRRRPSGHGHACGSRHWGGAGLAHVVALLVLSPGTRSTDPCAWIARLLFLLDPILYHPSPVPLWPYPLH

SEQ ID NO: 886582 - protein, 147 aa, Homo sapiens
MALVRGGWLWRQSSILRRWKRNWFALWLDGTLGYYHDETAQDEEDRVLIHFNVRDIKIGPECHDVQPPEGRSRDGLLTVNLREGGRLHLCAETKDDALAWKTALLEANSTPVSLPFSPPFPTTSMCHGIMSDSDSVSTCQKFSVLCG

SEQ ID NO: 886583 - protein, 243 aa, Homo sapiens
MSPAAPVPPDSALESPFEEMALVRGGWLWRQSSILRRWKRNWFALWLDGTLGYYHDETAQDEEDRVLIHFNVRDIKIGPECHDVQPPEGRSRDGLLTVNLREGGRLHLCAETKDDALAWKTALLEANSTPAPAGATVPPRSRRVCSKVRCVTRSWSPCKVERRIWVRVYSPYQDYYEVVPPNAHEATYVRSYYGPPYAGPGVTHVIVREDPCYSAGAPLAMGMLAGAATGAALGSLMWSPCWF

SEQ ID NO: 886584 - protein, 189 aa, Homo sapiens; identical to SEQ ID NO: 886571

SEQ ID NO: 886585 - protein, 189 aa, Homo sapiens; identical to SEQ ID NO: 886571

SEQ ID NO: 886586 - protein, 261 aa, Homo sapiens
TRSWSEEDWKLQLEAENYEGHTPLHVAVIHKDVEMAGCSEMLELTLTNRSPRAGPCTRTVPPDSALESPFEEMALVRGGWLWRQSSILRRWKRNWFALWLDGTLGYYHDETAQDEEDRVLIHFNVRDIKIGPECHDVQPPEGRSRDGLLTVNLREGGRLHLCAETKDDALAWKTALLEANSTPVRVYSPYQDYYEVVPPNAHEATYVRSYYGPPYAGPGVTHVIVREDPCYSAGAPLAMGMLAGAATGAALGSLMWSPCWF

SEQ ID NO: 886587 - protein, 225 aa, Homo sapiens
RQGWGLLSRELLLRPVSPVAPLTVPPDSALESPFEEMALVRGGWLWRQSSILRRWKRNWFALWLDGTLGYYHDETAQDEEDRVLIHFNVRDIKIGPECHDVQPPEGRSRDGLLTVNLREGGRLHLCAETKDDALAWKTALLEANSTPVRVYSPYQDYYEVVPPNAHEATYVRSYYGPPYAGPGVTHVIVREDPCYSAGAPLAMGMLAGAATGAALGSLMWSPCWF

SEQ ID NO: 886588 - protein, 260 aa, Homo sapiens
DYYEVVPPNAHEATYVRSYYGPPYAGPGVTHVIVREDPCYSAGAPLAIGSNIRNKCETVPPDSALESPFEEMALVRGGWLWRQSSILRRWKRNWFALWLDGTLGYYHDETAQDEEDRVLIHFNVRDIKIGPECHDVQPPEGRSRDGLLTVNLREGGRLHLCAETKDDALAWKTALLEANSTPVRVYSPYQDYYEVVPPNAHEATYVRSYYGPPYAGPGVTHVIVREDPCYSAGAPLAMGMLAGAATGAALGSLMWSPCWF

SEQ ID NO: 886589 - protein, 196 aa, Homo sapiens
MALVRGGWLWRQMHLEYRTGSILRRWKRNWFALWLDGTLGYYHDETAQDEEDRVLIHFNVRDIKIGPECHDVQPPEGRSRDGLLTVNLREGGRLHLCAETKDDALAWKTALLEANSTPVRVYSPYQDYYEVVPPNAHEATYVRSYYGPPYAGPGVTHVIVREDPCYSAGAPLAMGMLAGAATGAALGSLMWSPCWF

SEQ ID NO: 886590 - protein, 129 aa, Homo sapiens
MEDSTAGGKLHPGARLQPVPRLLRGGAPQCTRGHVCPQLLRTALRRPWRDARDSAGGSLLQRRRPSGHGHACGSRHWGGAGLAHVVALLVLSPGTRSTDPCAWIARLLFLLDPILYHPSPVPLWPYPLH

SEQ ID NO: 886591 - protein, 189 aa, Homo sapiens; identical to SEQ ID NO: 886571

SEQ ID NO: 886592 - protein, 142 aa, Homo sapiens
MALVRGGWLWRQSSILRRWKRNWFALWLDGTLGYYHDETAQDEEDRVLIHFNVRDIKIGPECHDVQPPEGRSRDGLLTVNLREGGRLHLCAETKDDALAWKTALLEANSTPMIRLKLIHPHNKYLLSCYYGPGGVPSARDQR

SEQ ID NO: 886593 - protein, 61 aa, Homo sapiens
MALVRGGWLWRQSSILRRWKRNWFALWLDGTLGYYHDETAAPHQGHFFKRTFQSGVRVPSS

SEQ ID NO: 886594 - protein, 197 aa, Homo sapiens
KKKKKKKIPVYWEGYVRFLNTPSDKSEDGRLIYTGNMARAVFGVKCFSYSTSLIGLTFLPYIFTQNNAISESVPLPIQIIFYGIMGSFTVITPVLLHFITKGYVIRLYHEATTDTYKAITYNAMLAETSTVFHQNDVKIPDAKHVFTTFYAKTKSLLVNPVLFPNREDYIHLMGYDKEEFILYMEETSEEKRHKDDK

SEQ ID NO: 886595 - protein, 161 aa, Homo sapiens
MARAVFGVKCFSYSTSLIGLTFLPYIFTQNNAISESVPLPIQIIFYGIMGSFTVITPVLLHFITKGYVIRLYHEATTDTYKAITYNAMLAETSTVFHQNDVKIPDAKHVFTTFYAKTKSLLVNPVLFPNREDYIHLMGYDKEEFILYMEETSEEKRHKDDK

SEQ ID NO: 886596 - protein, 301 aa, Homo sapiens
SCQSGVPGWACATCAAVGWEAVSRSRGLVQLGRPQPLVTRVMLFLALGSPWAVELPLCGRRTALCAAAALRGPRASVSRASSSSGPSGPVAGWSTGPSGAARLLRRPGRAQIPVYWEGYVRFLNTPSDKSEDGRLIYTGNMARAVFGVKCFSYSTSLIGLTFLPYIFTQNNAISESVPLPIQIIFYGIMGSFTVITPVLLHFITKGYVIRLYHEATTDTYKAITYNAMLAETSTVFHQNDVKIPDAKHVFTTFYAKTKSLLVNPVLFPNREDYIHLMGYDKEEFILYMEETSEEKRHKDDK

SEQ ID NO: 886597 - protein, 126 aa, Homo sapiens
LPVRRPGLGMRHLCGSRVGSRVSQSWTRAAGASAAARHPRDAVSGVGQPVGGRTASLRKEDCIVCGRRAPRSPGLCLPGVLQQRAFGAGSRLEYGAFGSRAPSPASGSSADPCLLGRICSILKYAI

SEQ ID NO: 886598 - protein, 301 aa, Homo sapiens; identical to SEQ ID NO: 886596

SEQ ID NO: 886599 - protein, 301 aa, Homo sapiens; identical to SEQ ID NO: 886596

SEQ ID NO: 886600 - protein, 126 aa, Homo sapiens; identical to SEQ ID NO: 886597

SEQ ID NO: 886601 - protein, 543 aa, Homo sapiens [sequence omitted]

SEQ ID NO: 886602 - protein, 497 aa, Homo sapiens
MAQVFVDGVFQRRGAPPLQLPRVCTFRFPSTNIKITFTALSSEKREKQEASESPVKAVQPHISPLTINIPDTMAHLISPLPSPTGTISAANSCPSSPRGAGSSGYKVGRVMPSDLNLMADNSQPENEKEASGGDSPKDDSKPPYSYAQLIVQAITMAPDKQLTLNGIYTHITKNYPYYRTADKGWQNSIRHNLSLNRYFIKVPRSQEEPGKGSFWRIDPASESKLIEQAFRKRRPRGVPCFRTPLGPLSSRSAPASPNHAGVLSAHSSGAQTPESLSREGSPAPLEPEPGAAQPKLAVIQEARFAQSAPGSPLSSQPVLITVQRQLPQAIKPVTYTVATPVTTSTSQPPVVQTVHVVHQIPAVSVTSVAGLAPANTYTVSGQAVVTPAAVLAPPKAEAQENGDHREVKVKVEPIPAIGHATLGTASRIIQTAQTTPVQTVTIVQQAPLGQHQLPIKTVTQNGTHVASVPTAVHGQVNNGPLGLRRPPCASSDWSCLS

SEQ ID NO: 886603 - protein, 398 aa, Homo sapiens
APPPRLLPSSRPRVLPPLAAARSLAGRPPLGPLPQLRCAAADDPRPGPRRATGARAERPGGPHAGPWRRRGALSGRAPRGRGAGGAGPGAGPRRAAGPWRRLEGREFEYLMKKRSVTIGRNSSQGSVDVSMGHSSFISRRHLEIFTPPGGGGHGGAAPELPPAQPRPDAGGDFYLRCLGKNGVFVDGVFQRRGAPPLQLPRVCTFRFPSTNIKITFTALSSEKREKQEASESPVKAVQPHISPLTINIPDTMAHLISPLPSPTGTISAANSCPSSPRGAGSSGYKVGRVMPSDLNLMADNSQPENEKEASGGDSPKDDSKPPYSYAQLIVQAITMAPDKQLTLNGIYTHITKNYPYYRTADKGWQPRRVLCTCWQHTHPHRPPCPQSATTVTSRSSRS

SEQ ID NO: 886604 - protein, 722 aa, Homo sapiens
APPPRLLPSSRPRVLPPLAAARSLAGRPPLGPLPQLRCAAADDPRPGPRRATGARAERPGGPHAGPWRRRGALSGRAPRGRGAGGAGPGAGPRRAAGPWRRLEGREFEYLMKKRSVTIGRNSSQGSVDVSMGHSSFISRRHLEIFTPPGGGGHGGAAPELPPAQPRPDAGGDFYLRCLGKNGVFVDGVFQRRGAPPLQLPRVCTFRFPSTNIKITFTALSSEKREKQEASESPVKAVQPHISPLTINIPDTMAHLISPLPSPTGTISAANSCPSSPRGAGSSGYKVGRVMPSDLNLMADNSQPENEKEASGGDSPKDDSKPPYSYAQLIVQAITMAPDKQLTLNGIYTHITKNYPYYRTADKGWQNSIRHNLSLNRYFIKVPRSQEEPGKGSFWRIDPASESKLIEQAFRKRRPRGVPCFRTPLGPLSSRSAPASPNHAGVLSAHSSGAQTPESLSREGSPAPLEPEPGAAQPKLAVIQEARFAQSAPGSPLSSQPVLITVQRQLPQAIKPVTYTVATPVTTSTSQPPVVQTVHVVHQIPAVSVTSVAGLAPANTYTVSGQAVVTPAAVLAPPKAEAQENGDHREVKVKVEPIPAIGHATLGTASRIIQTAQTTPVQTVTIVQQAPLGQHQLPIKTVTQNGTHVASVPTAVHGQVNNAAASPLHMLATHASASASLPTKRHNGDQPEQPELKRIKTEDGEGIVIALSVDTPPAAVREKGVQN

SEQ ID NO: 886605 - protein, 569 aa, Homo sapiens
LHSCAQLRASFVCRAQQRWRSHLASKHLALFVSTWFCRENPWVLEPLGWCTFRFPSTNIKITFTALSSEKREKQEASESPVKAVQPHISPLTINIPDTMAHLISPLPSPTGTISAANSCPSSPRGAGSSGYKVGRVMPSDLNLMADNSQPENEKEASGGDSPKDDSKPPYSYAQLIVQAITMAPDKQLTLNGIYTHITKNYPYYRTADKGWQNSIRHNLSLNRYFIKVPRSQEEPGKGSFWRIDPASESKLIEQAFRKRRPRGVPCFRTPLGPLSSRSAPASPNHAGVLSAHSSGAQTPESLSREGSPAPLEPEPGAAQPKLAVIQEARFAQSAPGSPLSSQPVLITVQRQLPQAIKPVTYTVATPVTTSTSQPPVVQTVHVVHQIPAVSVTSVAGLAPANTYTVSGQAVVTPAAVLAPPKAEAQENGDHREVKVKVEPIPAIGHATLGTASRIIQTAQTTPVQTVTIVQQAPLGQHQLPIKTVTQNGTHVASVPTAVHGQVNNAAASPLHMLATHASASASLPTKRHNGDQPEQPELKRIKTEDGEGIVIALSVDTPPAAVREKGVQN

SEQ ID NO: 886606 - protein, 189 aa, Homo sapiens
NTRHNDNKLSNYDSVRLAGCTVGLRLGQAVVTPAAVLAPPKAEAQENGDHREVKVKVEPIPAIGHATLGTASRIIQTAQTTPVQTVTIVQQAPLGQHQLPIKTVTQNGTHVASVPTAVHGQVNNAAASPLHMLATHASASASLPTKRHNGDQPEQPELKRIKTEDGEGIVIALSVDTPPAAVREKGVQN

SEQ ID NO: 886607 - protein, 142 aa, Homo sapiens
MGSWAFHITPFLLRLSESHRPFPWISFGAKKQRSFVFVFSLWNDFLLSVLFKFRRSYSGICTFPCYSSCLMNFIHLHFSMWLAWTGGRTLWPHGTLRTQGRASAGKELPGLTELHLTVLFLAIFCCLFLCVDFVPGKIFHSE

SEQ ID NO: 886608 - protein, 722 aa, Homo sapiens; identical to SEQ ID NO: 886604

SEQ ID NO: 886609 - protein, 692 aa, Homo sapiens
APPPRLLPSSRPRVLPPLAAARSLAGRPPLGPLPQLRCAAADDPRPGPRRATGARAERPGGPHAGPWRRRGALSGRAPRGRGAGGAGPGAGPRRAAGPWRRLEGREFEYLMKKRSVTIGRNSSQGSVDVSMGHSSFISRRHLEIFTPPGGGGHGGAAPELPPAQPRPDAGGDFYLRCLGKNGVFVDGVFQRRGAPPLQLPRVCTFRFPSTNIKITFTALSSEKREKQEASESPVKAVQPHISPLTINIPDTMAHLISPLPSPTGTISAANSCPSSPRGAGSSGYKVGRVMPSDLNLMADNSQPENEKEASGGDSPKDDSKPPYSYAQLIVQAITMAPDKQLTLNGIYTHITKNYPYYRTADKGWQNSIRHNLSLNRYFIKVPRSQEEPGKGSFWRIDPASESKLIEQAFRKRRPRGVPCFRTPLGPLSSRSAPASPNHAGVLSAHSSGAQTPESLSREGSPAPLEPEPGAAQPKLAVIQEARFAQSAPGSPLSSQPVLITVQRQLPQAIKPVTYTVATPVTTSTSQPPVVQTVHVVHQIPAVSVTSVAGLAPANTYTVSGQAVVTPAAVLAPPKAEAQENGDHREVKVKVEPIPAIGHATLGTASRIIQTAQTTPVQTVTIVQQAPLGQHQLPIKTVTQNGTHVASVPTAVHGQVNNGKTCWSVAPRGCGYWEQSPFSLVVSVLTVTILAFV

SEQ ID NO: 886610 - protein, 692 aa, Homo sapiens; identical to SEQ ID NO: 886609

SEQ ID NO: 886611 - protein, 676 aa, Homo sapiens
APPPRLLPSSRPRVLPPLAAARSLAGRPPLGPLPQLRCAAADDPRPGPRRATGARAERPGGPHAGPWRRRGALSGRAPRGRGAGGAGPGAGPRRAAGPWRRLEGREFEYLMKKRSVTIGRNSSQGSVDVSMGHSSFISRRHLEIFTPPGGGGHGGAAPELPPAQPRPDAGGDFYLRCLGKNGVFVDGVFQRRGAPPLQLPRVCTFRFPSTNIKITFTALSSEKREKQEASESPVKAVQPHISPLTINIPDTMAHLISPLPSPTGTISAANSCPSSPRGAGSSGYKVGRVMPSDLNLMADNSQPENEKEASGGDSPKDDSKPPYSYAQLIVQAITMAPDKQLTLNGIYTHITKNYPYYRTADKGWQNSIRHNLSLNRYFIKVPRSQEEPGKGSFWRIDPASESKLIEQAFRKRRPRGVPCFRTPLGPLSSRSAPASPNHAGVLSAHSSGAQTPESLSREGSPAPLEPEPGAAQPKLAVIQEARFAQSAPGSPLSSQPVLITVQRQLPQAIKPVTYTVATPVTTSTSQPPVVQTVHVVHQIPAVSVTSVAGLAPANTYTVSGQAVVTPAAVLAPPKAEAQENGDHREVKVKVEPIPAIGHATLGTASRIIQTAQTTPVQTVTIVQQAPLGQHQLPIKTVTQNGTHVASVPTAVHGQVNNGPLGLRRPPCASSDWSCLS

SEQ ID NO: 886612 - protein, 722 aa, Homo sapiens; identical to SEQ ID NO: 886604

SEQ ID NO: 886613 - protein, 676 aa, Homo sapiens; identical to SEQ ID NO: 886611

SEQ ID NO: 886614 - protein, 278 aa, Homo sapiens
APPPRLLPSSRPRVLPPLAAARSLAGRPPLGPLPQLRCAAADDPRPGPRRATGARAERPGGPHAGPWRRRGALSGRAPRGRGAGGAGPGAGPRRAAGPWRRLEGREFEYLMKKRSVTIGRNSSQGSVDVSMGHSSFISRRHLEIFTPPGGGGHGGAAPELPPAQPRPDAGGDFYLRCLGKNGVFVDGVFQRRGAPPLQLPRVCTFRFPSTNIKITFTALSSEKREKQEASESPVKAVQPHISPLTINIPDTMAHLISPLPSPTGTIRMIQSRLTPTRS

SEQ ID NO: 886615 - protein, 388 aa, Homo sapiens
MAPDKQLTLNGIYTHITKNYPYYRTADKGWQNSIRHNLSLNRYFIKVPRSQEEPGKGSFWRIDPASESKLIEQAFRKRRPRGVPCFRTPLGPLSSRSAPASPNHAGVLSAHSSGAQTPESLSREGSPAPLEPEPGAAQPKLAVIQEARFAQSAPGSPLSSQPVLITVQRQLPQAIKPVTYTVATPVTTSTSQPPVVQTVHVVHQIPAVSVTSVAGLAPANTYTVSGQAVVTPAAVLAPPKAEAQENGDHREVKVKVEPIPAIGHATLGTASRIIQTAQTTPVQTVTIVQQAPLGQHQLPIKTVTQNGTHVASVPTAVHGQVNNAAASPLHMLATHASASASLPTKRHNGDQPEQPELKRIKTEDGEGIVIALSVDTPPAAVREKGVQN

SEQ ID NO: 886616 - protein, 558 aa, Homo sapiens
TPQLRSAQSQLRVQSPAEMAEPLGIQAPCPVCVHLVLPCTFRFPSTNIKITFTALSSEKREKQEASESPVKAVQPHISPLTINIPDTMAHLISPLPSPTGTISAANSCPSSPRGAGSSGYKVGRVMPSDLNLMADNSQPENEKEASGGDSPKDDSKPPYSYAQLIVQAITMAPDKQLTLNGIYTHITKNYPYYRTADKGWQNSIRHNLSLNRYFIKVPRSQEEPGKGSFWRIDPASESKLIEQAFRKRRPRGVPCFRTPLGPLSSRSAPASPNHAGVLSAHSSGAQTPESLSREGSPAPLEPEPGAAQPKLAVIQEARFAQSAPGSPLSSQPVLITVQRQLPQAIKPVTYTVATPVTTSTSQPPVVQTVHVVHQIPAVSVTSVAGLAPANTYTVSGQAVVTPAAVLAPPKAEAQENGDHREVKVKVEPIPAIGHATLGTASRIIQTAQTTPVQTVTIVQQAPLGQHQLPIKTVTQNGTHVASVPTAVHGQVNNAAASPLHMLATHASASASLPTKRHNGDQPEQPELKRIKTEDGEGIVIALSVDTPPAAVREKGVQN

SEQ ID NO: 886617 - protein, 722 aa, Homo sapiens; identical to SEQ ID NO: 886604

SEQ ID NO: 886618 - protein, 727 aa, Homo sapiens
APPPRLLPSSRPRVLPPLAAARSLAGRPPLGPLPQLRCAAADDPRPGPRRATGARAERPGGPHAGPWRRRGALSGRAPRGRGAGGAGPGAGPRRAAGPWRRLEGREFEYLMKKRSVTIGRNSSQGSVDVSMGHSSFISRRHLEIFTPPGGGGHGGAAPELPPAQPRPDAGGDFYLRCLGKNGVFVDGVFQRRGAPPLQLPRVCTFRFPSTNIKITFTALSSEKREKQEASESPVKAVQPHISPLTINIPDTMAHLISPLPSPTGTISAANSCPSSPRGAGSSGYKVGRVMPSDLNLMADNSQPENEKEASGGDSPKDDSKPPYSYAQLIVQAITMAPDKQLTLNGIYTHITKNYPYYRTADKGWQNSIRHNLSLNRYFIKVPRSQEEPGKGSFWRIDPASESKLIEQAFRKRRPRGVPCFRTPLGPLSSRSAPASPNHAGVLSAHSSGAQTPESLSREGSPAPLEPEPGAAQPKLAVIQEARFAQSAPGSPLSSQPVLITVQRQLPQAIKPVTYTVATPVTTSTSQPPVVQTVHVVHQIPAVSVTSVAGLAPANTYTVSGQAVVTPAAVLAPPKAEAQENGDHREVKVKVEPIPAIGHATLGTASRIIQTAQTTPVQTVTIVQQAPLGQHQLPIKTVTQNGTHVASVPTAVHGQVNNAAASPLHMLATHASASASLPTKRHNGDQPEQPELKRIKTEDGEGIVIALSVDTPPAAVRGPLSEGILRGQ

SEQ ID NO: 886619 - protein, 692 aa, Homo sapiens; identical to SEQ ID NO: 886609

SEQ ID NO: 886620 - protein, 586 aa, Homo sapiens
PPPHASSPPPARACSRPSPPLARSPAGLRSAPSLSSGARRPTTRGLGLGAPPAPARSGPGALTQAHGGGAARSRAGHHAGAGPGARGRGRVPPGAGPWRRLEGREFEYLMKKRSVTIGRNSSQGSVDVSMGHSSFISRRHLEIFTPPGGGGHGGAAPELPPAQPRPDAGGDFYLRCLGKNGVFVDGVFQRRGAPPLQLPRVCTFRFPSTNIKITFTALSSEKREKQEASESPVKAVQPHISPLTINIPDTMAHLISPLPSPTGTISAANSCPSSPRGAGSSGYKVGRVMPSDLNLMADNSQPENEKEASGGDSPKDDSKPPYSYAQLIVQAITMAPDKQLTLNGIYTHITKNYPYYRTADKGWQNSIRHNLSLNRYFIKVPRSQEEPGKGSFWRIDPASESKLIEQAFRKRRPRGVPCFRTPLGPLSSRSAPASPNHAGVLSAHSSGAQTPESLSREGSPAPLEPEPGAAQPKLAVIQEARFAQSAPGSPLSSQPVLITVQRQLPQAIKPVTYTVATPVTTSTSQPPVVQTVHVVHQIPAVSVTSVAGLAQRTRTLSLDKLWSPRQPCWPLLRQRPRRMETTGKSK

SEQ ID NO: 886621 - protein, 371 aa, Homo sapiens
MSCVLGGVIPLGLLFLVCGSQGYLLPNVTLLEELLSKYQHNESHSRVRRAIPREDKEEILMLHNKLRGQVQPQASNMEYMTWDDELEKSAAAWASQCIWEHGPTSLLVSIGQNLGAHWGRYRSPGFHVQSWYDEVKDYTYPYPSECNPWCPERCSGPMCTHYTQIVWATTNKIGCAVNTCRKMTVWGEVWENAVYFVCNYSPKGNWIGEAPYKNGRPCSECPPSYGGSCRNNLCYREETYTPKPETDEMNEVETAPIPEENHVWLQPRVMRPTKPKKTSAVNYMTQVVRCDTKMKDRCKGSTCNRYQCPAGCLNHKAKIFGTLFYESSSSICRAAIHYGILDDKGGLVDITRNGKVPFFVKSERHGVQSLR

SEQ ID NO: 886622 - protein, 120 aa, Homo sapiens
MSCVLGGVIPLGLLFLVCGSQGYLLPNVTLLEELLSKYQHNESHSRVRRAIPREDKEEILMLHNKLRGQVQPQASNMEYMTWDDELEKSAAAWASQCIWEHGPTSLLVSIGQNLGAHWGR

SEQ ID NO: 886623 - protein, 310 aa, Homo sapiens
MTELVADLLSCNYSPKGNWIGEAPYKNGRPCSECPPSYGGSCRNNLCYREETYTPKPETDEMNEVETAPIPEENHVWLQPRVMRPTKPKKTSAVNYMTQVVRCDTKMKDRCKGSTCNRYQCPAGCLNHKAKIFGTLFYESSSSICRAAIHYGILDDKGGLVDITRNGKVPFFVKSERHGVQSLSKYKPSSSFMVSKVKVQDLDCYTTVAQLCPFEKPATHCPRIHCPAHCKDEPSYWAPVFGTNIYADTSSICKTAVHAGVISNESGGDVDVMPVDKKKTYVGSLRNGVQSESLGTPRDGKAFRIFAVRQ

SEQ ID NO: 886624 - protein, 80 aa, Homo sapiens
IVQKITFRAMITLSAEDHLIVQNITSSCKKIISNESGGDVDVMPVDKKKTYVGSLRNGVQSESLGTPRDGKAFRIFAVRQ

SEQ ID NO: 886625 - protein, 49 aa, Homo sapiens
TAPIPEENHVWLQPRVMRPTKPKKTSAVNYMSESRPSSAPPALPATSKG

SEQ ID NO: 886626 - protein, 497 aa, Homo sapiens
MSCVLGGVIPLGLLFLVCGSQGYLLPNVTLLEELLSKYQHNESHSRVRRAIPREDKEEILMLHNKLRGQVQPQASNMEYMTWDDELEKSAAAWASQCIWEHGPTSLLVSIGQNLGAHWGRYRSPGFHVQSWYDEVKDYTYPYPSECNPWCPERCSGPMCTHYTQIVWATTNKIGCAVNTCRKMTVWGEVWENAVYFVCNYSPKGNWIGEAPYKNGRPCSECPPSYGGSCRNNLCYREETYTPKPETDEMNEVETAPIPEENHVWLQPRVMRPTKPKKTSAVNYMTQVVRCDTKMKDRCKGSTCNRYQCPAGCLNHKAKIFGTLFYESSSSICRAAIHYGILDDKGGLVDITRNGKVPFFVKSERHGVQSLSKYKPSSSFMVSKVKVQDLDCYTTVAQLCPFEKPATHCPRIHCPAHCKDEPSYWAPVFGTNIYADTSSICKTAVHAGVISNESGGDVDVMPVDKKKTYVGSLRNGVQSESLGTPRDGKAFRIFAVRQ

SEQ ID NO: 886627 - protein, 338 aa, Homo sapiens
MSSFQIVWATTNKIGCAVNTCRKMTVWGEVWENAVYFVCNYSPKGNWIGEAPYKNGRPCSECPPSYGGSCRNNLCYREETYTPKPETDEMNEVETAPIPEENHVWLQPRVMRPTKPKKTSAVNYMTQVVRCDTKMKDRCKGSTCNRYQCPAGCLNHKAKIFGTLFYESSSSICRAAIHYGILDDKGGLVDITRNGKVPFFVKSERHGVQSLSKYKPSSSFMVSKVKVQDLDCYTTVAQLCPFEKPATHCPRIHCPAHCKDEPSYWAPVFGTNIYADTSSICKTAVHAGVISNESGGDVDVMPVDKKKTYVGSLRNGVQSESLGTPRDGKAFRIFAVRQ

SEQ ID NO: 886628 - protein, 131 aa, Homo sapiens
MPEAQACWDLTLSPLLLFTVQDLDCYTTVAQLCPFEKPATHCPRIHCPAHCKDEPSYWAPVFGTNIYADTSSICKTAVHAGVISNESGGDVDVMPVDKKKTYVGSLRNGVQSESLGTPRDGKAFRIFAVRQ

SEQ ID NO: 886629 - protein, 337 aa, Homo sapiens
MSCVLGGVIPLGLLFLVCGSQGYLLPNVTLLEELLSKYQHNESHSRVRRAIPREDKEEILMLHNKLRGQVQPQASNMEYMTWDDELEKSAAAWASQCIWEHGPTSLLVSIGQNLGAHWGRYRSPGFHVQSWYDEVKDYTYPYPSECNPWCPERCSGPMCTHYTQIVWATTNKIGCAVNTCRKMTVWGEVWENAVYFVCNYSPKGNWIGEAPYKNGRPCSECPPSYGGSCRNNLCYREETYTPKPETDEMNEVETAPIPEENHVWLQPRVMRPTKPKKTSAVNYMTQVVRCDTKMKDRCKGSTCNRYQCPAGCLNHKAKIFGTLFYESVRLASPALNG

SEQ ID NO: 886630 - protein, 971 aa, Homo sapiens
MATVRASLRGALLLLLAVAGVAEVAGGLAPGSAGALCCNHSKDNQMCRDVCEQIFSSKSESRLKHLLQRAPDYCPETMVEIWNCMNSSLPGVFKKSDGWVGLGCCELAIALECRQACKQASSKNDISKVCRKEYENALFSCISRNEMGSVCCSYAGHHTNCREYCQAIFRTDSSPGPSQIKAVENYCASISPQLIHCVNNYTQSYPMRNPTDSLYCCDRAEDHACQNACKRILMSKKTEMEIVDGLIEGCKTQPLPQDPLWQCFLESSQSVHPGVTVHPPPSTGLDGAKLHCCSKANTSTCRELCTKLYSMSWGNTQSWQEFDRFCEYNPVEVSMLTCLADVREPCQLGCRNLTYCTNFNNRPTELFRSCNAQSDQGAMNDMKLWEKGSIKMPFINIPVLDIKKCQPEMWKAIACSLQIKPCHSKSRGSIICKSDCVEILKKCGDQNKFPEDHTAESICELLSPTDDLKNCIPLDTYLRPSTLGNIVEEVTHPCNPNPCPANELCEVNRKGCPSGDPCLPYFCVQGCKLGEASDFIVRQGTLIQVPSSAGEVGCYKICSCGQSGLLENCMEMHCIDLQKSCIVGGKRKSHGTSFSIDCNVCSCFAGNLVCSTRLCLSEHSSEDDRRTFTGLPCNCADQFVPVCGQNGRTYPSACIARCVGLQDHQFEFGSCMSKDPCNPNPCQKNQRCIPKPQVCLTTFDKFGCSQYECVPRQLACDQVQDPVCDTDHMEHNNLCTLYQRGKSLSYKGPCQPFCRATEPVCGHNGETYSSVCAAYSDRVAVDYYGDCQAVGVLSEHSSVAECASVKCPSLLAAGCKPIIPPGACCPLCAGMLRVLFDKEKLDTIAKVTNKKPITVLEILQKIRMHVSVPQCDVFGYFSIESEIVILIIPVDHYPKALQIEACNKEAEKIESLINSDSPTLASHVPLSALIISQVQVSSSVPSAGVRARPSCHSLLLPLSLGLALHLLWTYN

SEQ ID NO: 886631 - protein, 225 aa, Homo sapiens
MATVRASLRGALLLLLAVAGVAEVAGGLAPGSAGALCCNHSKDNQMCRDVCEQIFSSKSESRLKHLLQRAPDYCPETMVEIWNCMNSSLPGVFKKSDGWVGLGCCELAIALECRQACKQASSKNDISKVCRKEYENALFSCISRNEMGSVCCSYAGHHTNCREYCQAIFRTDSSPGPSQIKAVENYCASISPQLIHCVNNYTQSYPMRNPTDMFEFFANEQLLLL

SEQ ID NO: 886632 - protein, 968 aa, Homo sapiens
MYVNSIHGFYRLSYLQIFSSKSESRLKHLLQRAPDYCPETMVEIWNCMNSSLPGVFKKSDGWVGLGCCELAIALECRQACKQASSKNDISKVCRKEYEPVLRYFSVLPSLVWISALPKEVCQYVLMKDKTGKNALFSCISRNEMGSVCCSYAGHHTNCREYCQAIFRTDSSPGPSQIKAVENYCASISPQLIHCVNNYTQSYPMRNPTDSLYCCDRAEDHACQNACKRILMSKKTEMEIVDGLIEGCKTQPLPQDPLWQCFLESSQSVHPGVTVHPPPSTGLDGAKLHCCSKANTSTCRELCTKLYSMSWGNTQSWQEFDRFCEYNPVEVSMLTCLADVREPCQLGCRNLTYCTNFNNRPTELFRSCNAQSDQGAMNDMKLWEKGSIKMPFINIPVLDIKKCQPEMWKAIACSLQIKPCHSKSRGSIICKSDCVEILKKCGDQNKFPEDHTAESICELLSPTDDLKNCIPLDTYLRPSTLGNIVEEVTHPCNPNPCPANELCEVNRKGCPSGDPCLPYFCVQGCKLGEASDFIVRQGTLIQVPSSAGEVGCYKICSCGQSGLLENCMEMHCIDLQKSCIVGGKRKSHGTSFSIDCNVCSCFAGNLVCSTRLCLSEHSSEDDRRTFTGLPCNCADQFVPVCGQNGRTYPSACIARCVGLQDHQFEFGSCMSKDPCNPNPCQKNQRCIPKPQVCLTTFDKFGCSQYECVPRQLACDQVQDPVCDTDHMEHNNLCTLYQRGKSLSYKGPCQPFCRATEPVCGHNGETYSSVCAAYSDRVAVDYYGDCQAVGVLSEHSSVAECASVKCPSLLAAGCKPIIPPGACCPLCAGMLRVLFDKEKLDTIAKVTNKKPITVLEILQKIRMHVSVPQCDVFGYFSIESEIVILIIPVDHYPKALQIEACNKEAEKIESLINSDSPTLASHVPLSALIISQVQVSSSVPSAGVRARPSCHSLLLPLSLGLALHLLWTYN

SEQ ID NO: 886633 - protein, 359 aa, Homo sapiens
MYVNSIHGFYRLSYLQIFSSKSESRLKHLLQRAPDYCPETMVEIWNCMNSSLPGVFKKSDGWVGLGCCELAIALECRQACKQASSKNDISKVCRKEYEPVLRYFSVLPSLVWISALPKEVCQYVLMKDKTGKNALFSCISRNEMGSVCCSYAGHHTNCREYCQAIFRTDSSPGPSQIKAVENYCASISPQLIHCVNNYTQSYPMRNPTDSLYCCDRAEDHACQNACKRILMSKKTEMEIVDGLIEGCKTQPLPQDPLWQCFLESSQSVHPGVTVHPPPSTGLDGAKLHCCSKANTSTCRELCTKLYSMSWGNTQSWQEFDRFCEYNPVEVSMLTCLADVREPCQLGCRNLTYCTNFNNR

SEQ ID NO: 886634 - protein, 968 aa, Homo sapiens; identical to SEQ ID NO: 886632

SEQ ID NO: 886635 - protein, 220 aa, Homo sapiens
MATVRASLRGALLLLLAVAGVAEVAGGLAPGSAGALCCNHSKDNQMCRDVCEQIFSSKSESRLKHLLQRAPDYCPETMVEIWNCMNSSLPGVFKKSDGWVGLGCCELAIALECRQACKQASSKNDISKVCRKEYENALFSCISRNEMGSVCCSYAGHHTNCREYCQAIFRTDSSPGPSQIKAVENYCASISPQLIHCVNNYTQSYPMRNPTDSRSVLSDI

SEQ ID NO: 886636 - protein, 104 aa, Homo sapiens
PSRGRAAVLASVCCGRNMADRLTQLQDAVNSVRNFIRLASVFLFLEVKQGRKGAQEAKLESGERTERQGFGIKRSLGRRHRELGGLRPAAGRCLKVREGADSFA

SEQ ID NO: 886637 - protein, 144 aa, Homo sapiens
MADRLTQLQDAVNSLADQFCNAIGVLQQCGPPASFNNIQTAINKDQPANPTEEYAQLFAALIARTAKDIDVLIDSLPSEESTAALQAASLYKLEEENHEAATCLEDVVYRGDMLLEKIQSALADIAQSQLKTRSGTHSQSLPDS

SEQ ID NO: 886638 - protein, 144 aa, Homo sapiens; identical to SEQ ID NO: 886637

SEQ ID NO: 886639 - protein, 144 aa, Homo sapiens; identical to SEQ ID NO: 886637

SEQ ID NO: 886640 - protein, 144 aa, Homo sapiens; identical to SEQ ID NO: 886637

SEQ ID NO: 886641 - protein, 118 aa, Homo sapiens
PSRGRAAVLASVCCGRNMADRLTQLQDAVNSLADQFCNAIGVLQQCGPPASFNNIQTAINKDQPANPTEEYAQLFAALIARTAKDIDVLIDSLPSEESTAALQVSLYSFENFTSNREF

SEQ ID NO: 886642 - protein, 306 aa, Homo sapiens
VDPRVRPRVCMAAGGPGAGSAAPVSSTSSLPLAALNMRVRRRLSLFLNVRTQVAADWTALAEEMDFEYLEIRQLETQADPTGRLLDAWQGRPGASVGRLLELLTKLGRDDVLLELGPSIEEDCQKYILKQQQEEAEKPLQVAAVDSSVPRTAELAGITTLDDPLGHMPERFDAFICYCPSDIQFVQEMIRQLEQTNYRLKLCVSDRDVLPGTCVWSIASELIEKRCRRMVVVVSDDYLQSKECDFQTKFALSLSPGAHQKRLIPIKYKAMKKEFPSILRFITVCDYTNPCTKSWFWTRLAKALSLP

SEQ ID NO: 886643 - protein, 440 aa, Homo sapiens
LVPSSPSSRAGPYEPLRFLRGRTVAPPDPKKQGPFPTTPEGGSSSLRRQPTSTITRPSRAVPWTSPDLKRQIPTSYAPHITRLETSRVEVGTPASALLLGAPDCRAGRRFSESESGGAGRVPRRKRKRWQTMRPDRAEAPGPPAMAAGGPGAGSAAPVSSTSSLPLAALNMRVRRRLSLFLNVRTQVAADWTALAEEMDFEYLEIRQLETQADPTGRLLDAWQGRPGASVGRLLELLTKLGRDDVLLELGPSIEEDCQKYILKQQQEEAEKPLQVAAVDSSVPRTAELAGITTLDDPLGHMPERFDAFICYCPSDIQFVQEMIRQLEQTNYRLKLCVSDRDVLPGTCVWSIASELIEKRCRRMVVVVSDDYLQSKECDFQTKFALSLSPGAHQKRLIPIKYKAMKKEFPSILRFITVCDYTNPCTKSWFWTRLAKALSLP

SEQ ID NO: 886644 - protein, 389 aa, Homo sapiens
LVPSSPSSRAGPYEPLRFLRGRTVAPPDPKKQGPFPTTPEGGSSSLRRQPTSTITRPSRAVPWTSPDLKRQIPTSYAPHITRLETSRVEVGTPASALLLGAPDCRAGRRFSESESRRGGAGARRKRKRWQTMRPDRAEAPGPPAMAAGGPGAGSAAPVSSTSSLPLAALNMRVRRRLSLFLNVRTQVAADWTALAEEMDFEYLEIRQLETQADPTGRLLDAWQGRPGASVGRLLELLTKLGRDDVLLELGPSIEEDCQKYILKQQQEEAEKPLQVAAVDSSVPRTAELAGITTLDDPLGHMPERFDAFICYCPSDIQFVQEMIRQLEQTNYRLKLCVSDRDVLPGTCVWSIASAAGWWWLSLMITCRARNVTSRPNLHSASLQVPIRSD

SEQ ID NO: 886645 - protein, 198 aa, Homo sapiens
MGRKQLRQRLSEEDCQKYILKQQQEEAEKPLQVAAVDSSVPRTAELAGITTLDDPLGHMPERFDAFICYCPSDIQFVQEMIRQLEQTNYRLKLCVSDRDVLPGTCVWSIASELIEKRCRRMVVVVSDDYLQSKECDFQTKFALSLSPGAHQKRLIPIKYKAMKKEFPSILRFITVCDYTNPCTKSWFWTRLAKALSLP

SEQ ID NO: 886646 - protein, 144 aa, Homo sapiens
VTVTHPQNSYLIEYAMMARISFIMPGGAESMTTGILTGGNEKQPKLLRRVSWGLVSAEGGAKAGSLPPWATCRELSHQLCTLIALQSYLFTNSDHIKASCPKACGHMGTYRLTYRHTHICTDMYSHTHRHQHTHVFLGTAPRNS

SEQ ID NO: 886647 - protein, 440 aa, Homo sapiens; identical to SEQ ID NO: 886643

SEQ ID NO: 886648 - protein, 440 aa, Homo sapiens; identical to SEQ ID NO: 886643

SEQ ID NO: 886649 - protein, 483 aa, Homo sapiens
LVPSSPSSRAGPYEPLRFLRGRTVAPPDPKKQGPFPTTPEGGSSSLRRQPTSTITRPSRAVPWTSPDLKRQIPTSYAPHITRLETSRVEVGTPASALLLGAPDCRAGRRFSESESGGAGRVPRRKRKRWQTMRPDRAEAPGPPAMAAGGPGAGSAAPVSSTSSLPLAALNMRVRRRLSLFLNVRTQVAADWTALAEEMDFEYLEIRQLETQADPTGRLLDAWQGRPGASVGRLLELLTKLGRDDVLLELGPSIEEDCQKYILKQQQEEAEKPLQVAAVDSSVPRTAELAGITTLDDPLGHMPERFDAFICYCPSDIQFVQEMIRQLEQTNYRLKLCVSDRDVLPGTCVWSIASELIEKRCRRMVVVVSDDYLQSKECDFQTKFALSLSPGAHQKRLIPIRRVSPGQEVTPASTPPSCRYRRLTGDSGIELCPCPASGEGEPVKEVRVSATLTDLEDYSPCALPPESVPQIFPMGLSSSEGDIP

SEQ ID NO: 886650 - protein, 168 aa, Homo sapiens
EAPGPPAMAAGGPGAGSAAPVSSTSSLPLAALNMRVRRRLSLFLNVRTQVAADWTALAEEMDFEYLEIRQLETQADPTGRLLDAWQGRPGASVGRLLELLTKLGRDDVLLELGPSIGEDVPFLASYLGGEEADFPRPQHPVSHGETPFPASGARRSLQRENHAGPVPS

SEQ ID NO: 886651 - protein, 440 aa, Homo sapiens; identical to SEQ ID NO: 886643

SEQ ID NO: 886652 - protein, 440 aa, Homo sapiens; identical to SEQ ID NO: 886643

SEQ ID NO: 886653 - protein, 448 aa, Homo sapiens
LVPSSPSSRAGPYEPLRFLRGRTVAPPDPKKQGPFPTTPEGGSSSLRRQPTSTITRPSRAVPWTSPDLKRQIPTSYAPHITRLETSRVEVGTPASALLLGAPDCRAGRRFSESESGGAGRVPRRKRKRWQTMRPDRAEAPGPPAMAAGGPGAGSAAPVSSTSSLPLAALNMRVRRRLSLFLNVRTQVAADWTALAEEMDFEYLEIRQLETQADPTGRLLDAWQGRPGASVGRLLELLTKLGRDDVLLELGPSIEEDCQKYILKQQQEEAEKPLQVAAVDSSVPRTAELAGITTLDDPLGHMPERFDAFICYCPSDIQFVQEMIRQLEQTNYRLKLCVSDRDVLPGTCVWSIASELIEKRLARRPRGGCRRMVVVVSDDYLQSKECDFQTKFALSLSPGAHQKRLIPIKYKAMKKEFPSILRFITVCDYTNPCTKSWFWTRLAKALSLP

SEQ ID NO: 886654 - protein, 440 aa, Homo sapiens; identical to SEQ ID NO: 886643

SEQ ID NO: 886655 - protein, 440 aa, Homo sapiens; identical to SEQ ID NO: 886643

SEQ ID NO: 886656 - protein, 316 aa, Homo sapiens
LVPSSPSSRAGPYEPLRFLRGRTVAPPDPKKQGPFPTTPEGGSSSLRRQPTSTITRPSRAVPWTSPDLKRQIPTSYAPHITRLETSRVEVGTPASALLLGAPDCRAGRRFSESESRRGGAGARRKRKRWQTMRPDRAEAPGPPAMAAGGPGAGSAAPVSSTSSLPLAALNMRVRRRLSLFLNVRTQVAADWTALAEEMDFEYLEIRQLETQADPTGRLLDAWQGRPGASVGRLLELLTKLGRDDVLLELGPSIEEDCQKYILKQQQEEAEKPLQVAAVDSSVPRTAELAGITTLDDPLGKGPILFPWDRWNRTLWC

SEQ ID NO: 886657 - protein, 476 aa, Homo sapiens
MFRLNSLSALAELAVGSRWYHGGSQPIQIRRRLMMVAFLGASAVTASTGLLWKRAHAESPPCVDNLKSDIGDKGKNKDEGDVCNHEKKTADLAPHPEEKKKKRSGFRDRKVMEYENRIRAYSTPDKIFRYFATLKVISEPGEAEVFMTPEDFVRSITPNEKQPEHLGLDQYIIKRFDGKKISQEREKFADEGSIFYTLGECGLISFSDYIFLTTVLSTPQRNFEIAFKMFDLNGDGEVDMEEFEQVQSIIRSQTSMGMRHRDRPTTGNTLKSGLCSALTTYFFGADLKGKLTIKNFLEFQRKLQHDVLKLEFERHDPVDGRITERQFGGMLLAYSGVQSKKLTAMQRQLKKHFKEGKGLTFQEVENFFTFLKNINDVDTALSFYHMAGASLDKVTMQQVARTVAKVELSDHVCDVVFALFDCDGNGELSNKEFVSIMKQRLMRGLEKPKDMGFTRLMQAMWKCAQETAWDFALPKQ

SEQ ID NO: 886658 - protein, 212 aa, Homo sapiens
MFRLNSLSALAELAVGSRWYHGGSQPIQIRRRLMMVAFLGASAVTASTGLLWKRAHAESPPCVDNLKSDIGDKGKNKDEGDVCNHEKKTADLAPHPEEKKKKRSGFRDRKVMEYENRIRAYSTPDKIFRYFATLKVISEPGEAEVFMTPEDFVRSITPNEKQPEHLGLDQYIIKRFDGKARFSKKKILHRVRKKSKGSILQRRKKALQKEER

SEQ ID NO: 886659 - protein, 476 aa, Homo sapiens; identical to SEQ ID NO: 886657

SEQ ID NO: 886660 - protein, 430 aa, Homo sapiens
MFRLNSLSALAELAVGSRWYHGGSQPIQIRRRLMMVAFLGASAVTASTGLLWKRAHAESPPCVDNLKSDIGDKGKNKDEGDVCNHEKKTADLAPHPEEKKKKRSGFRDRKVMEYENRIRAYSTPDKIFRYFATLKVISEPGEAEVFMTPEDFVRSITPNEKQPEHLGLDQYIIKRFDGKKISQEREKFADEGSIFYTLGECGLISFSDYIFLTTVLSTPQRNFEIAFKMFDLNGDGEVDMEEFEQVQSIIRSQTSMGMRHRDRPTTGNTLKSGLCSALTTYFFGADLKGKLTIKNFLEFQRKLQHDVLKLEGLTFQEVENFFTFLKNINDVDTALSFYHMAGASLDKVTMQQVARTVAKVELSDHVCDVVFALFDCDGNGELSNKEFVSIMKQRLMRGLEKPKDMGFTRLMQAMWKCAQETAWDFALPKQ

SEQ ID NO: 886661 - protein, 443 aa, Homo sapiens
MMVAFLGASAVTASTGLLWKRAHAESPPCVDNLKSDIGDKGKNKDEGDVCNHEKKTADLAPHPEEKKKKRSGFRDRKVMEYENRIRAYSTPDKIFRYFATLKVISEPGEAEVFMTPEDFVRSITPNEKQPEHLGLDQYIIKRFDGKKISQEREKFADEGSIFYTLGECGLISFSDYIFLTTVLSTPQRNFEIAFKMFDLNGDGEVDMEEFEQVQSIIRSQTSMGMRHRDRPTTGNTLKSGLCSALTTYFFGADLKGKLTIKNFLEFQRKLQHDVLKLEFERHDPVDGRITERQFGGMLLAYSGVQSKKLTAMQRQLKKHFKEGKGLTFQEVENFFTFLKNINDVDTALSFYHMAGASLDKVTMQQVARTVAKVELSDHVCDVVFALFDCDGNGELSNKEFVSIMKQRLMRGLEKPKDMGFTRLMQAMWKCAQETAWDFALPKQ

SEQ ID NO: 886662 - protein, 388 aa, Homo sapiens
MFRLNSLSALAELAVGSRWYHGGSQPIQIRRRLMMVAFLGASAVTASTGLLWKRAHAESPPCVDNLKSDIGDKGKNKDEGDVCNHEKKTADLAPHPEEKKKKRSGFRDRKVMEYENRIRAYSTPDKIFRYFATLKVISEPGEAEVFMTPEDFVRSITPNEKQPEHLGLDQYIIKRFDGKKISQEREKFADEGSIFYTLGECGLISFSDYIFLTTVLSTPQRNFEIAFKMFDLNGDGEVDMEEFEQVQSIIRSQTSMGMRHRDRPTTGNTLKSGLCSALTTYFFGADLKGKLTIKNFLEFQRKLQHDVLKLEFERHDPVDGRITERQFGGMLLAYSGVQSKKLTAMQRQLKKHFKEGKPTLQEGTPPPPVPWTPSAESRQSPLCCCFWK

SEQ ID NO: 886663 - protein, 248 aa, Homo sapiens
MFDLNGDGEVDMEEFEQVQSIIRSQTSMGMRHRDRPTTGNTLKSGLCSALTTYFFGADLKGKLTIKNFLEFQRKLQHDVLKLEFERHDPVDGRITERQFGGMLLAYSGVQSKKLTAMQRQLKKHFKEGKGLTFQEVENFFTFLKNINDVDTALSFYHMAGASLDKVTMQQVARTVAKVELSDHVCDVVFALFDCDGNGELSNKEFVSIMKQRLMRGLEKPKDMGFTRLMQAMWKCAQETAWDFALPKQ

SEQ ID NO: 886664 - protein, 206 aa, Homo sapiens
IVDFLEVSPYTGFEADLKGKLTIKNFLEFQRKLQHDVLKLEFERHDPVDGRITERQFGGMLLAYSGVQSKKLTAMQRQLKKHFKEGKGLTFQEVENFFTFLKNINDVDTALSFYHMAGASLDKVTMQQVARTVAKVELSDHVCDVVFALFDCDGNGELSNKEFVSIMKQRLMRGLEKPKDMGFTRLMQAMWKCAQETAWDFALPKQ

SEQ ID NO: 886665 - protein, 476 aa, Homo sapiens; identical to SEQ ID NO: 886657

SEQ ID NO: 886666 - protein, 476 aa, Homo sapiens; identical to SEQ ID NO: 886657

SEQ ID NO: 886667 - protein, 427 aa, Homo sapiens
MFRLNSLSALAELAVGSRWYHGGSQPIQIRRRLMMVAFLGASAVTASTGLLWKRAHAESPPCVDNLKSDIGDKGKNKDEGDVCNHEKKTADLAPHPEEKKKKRSGFRDRKVMEYENRIRAYSTPDKIFRYFATLKVISEPGEAEVFMTPEDFVRSITPNEKQPEHLGLDQYIIKRFDGKKISQEREKFADEGSIFYTLGECGLISFSDYIFLTTVLSTPQRNFEIAFKMFDLNGDGEVDMEEFEQVQSIIRSQTSMGMRHRDRPTTGNTLKSGLCSALTTYFFGADLKGKLTIKNFLEFQRKLQHDVLKLEFERHDPVDGRITERQFGGMLLAYSGVQSKKLTAMQRQLKKHFKEGKGLTFQEVENFFTFLKNINDVDTALSFYHMAGASLDKVTMQQVARTVAKVELSDHVCDVVFALFDCDAMAN

SEQ ID NO: 886668 - protein, 199 aa, Homo sapiens
MFDLNGDGEVDMEEFEQVQSIIRSQTSMGMRHRDRPTTGNTLKSGLCSALTTYFFGADLKGKLTIKNFLEFQRKLQHDVLKLEFERHDPVDGRITERQFGGMLLAYSGVQSKKLTAMQRQLKKHFKEGKGLTFQEVENFFTFLKNINDVDTALSFYHMAGASLDKVTMQQVARTVAKVELSDHVCDVVFALFDCDAMAN

SEQ ID NO: 886669 - protein, 403 aa, Homo sapiens
MFRLNSLSALAELAVGSRWYHGGSQPIQIRRRLMMVAFLGASAVTASTGLLWKRAHAESPPCVDNLKSDIGDKGKNKDEGDVCNHEKKTADLAPHPEEKKKKRSGFRDRKVMEYENRIRAYSTPDKIFRYFATLKVISEPGEAEVFMTPEDFVRSITPNEKQPEHLGLDQYIIKRFDGKKISQEREKFADEGSIFYTLGECGLISFSDYIFLTTVLSTPQRNFEIAFKMFDLNGDGEVDMEEFEQVQSIIRSQTSMGMRHRDRPTTGNTLKSGLCSALTTYFFGADLKGKLTIKNFLEFQRKLQHDVLKLEFERHDPVDGRITERQFGGMLLAYSGVQSKKLTAMQRQLKKHFKEGKGLTFQEVENFFTFLKNINDVDTALSFYHMAGASLDKGKGTIFMGRR

SEQ ID NO: 886670 - protein, 476 aa, Homo sapiens; identical to SEQ ID NO: 886657

SEQ ID NO: 886671 - protein, 356 aa, Homo sapiens
MIDYSVNKLRYLHLKVISEPGEAEVFMTPEDFVRSITPNEKQPEHLGLDQYIIKRFDGKKISQEREKFADEGSIFYTLGECGLISFSDYIFLTTVLSTPQRNFEIAFKMFDLNGDGEVDMEEFEQVQSIIRSQTSMGMRHRDRPTTGNTLKSGLCSALTTYFFGADLKGKLTIKNFLEFQRKLQHDVLKLEFERHDPVDGRITERQFGGMLLAYSGVQSKKLTAMQRQLKKHFKEGKGLTFQEVENFFTFLKNINDVDTALSFYHMAGASLDKVTMQQVARTVAKVELSDHVCDVVFALFDCDGNGELSNKEFVSIMKQRLMRGLEKPKDMGFTRLMQAMWKCAQETAWDFALPKQ

SEQ ID NO: 886672 - protein, 249 aa, Homo sapiens
MVPWRITAHPDPAKTNDGGFPGSICSNSMGMRHRDRPTTGNTLKSGLCSALTTYFFGADLKGKLTIKNFLEFQRKLQHDVLKLEFERHDPVDGRITERQFGGMLLAYSGVQSKKLTAMQRQLKKHFKEGKGLTFQEVENFFTFLKNINDVDTALSFYHMAGASLDKVTMQQVARTVAKVELSDHVCDVVFALFDCDGNGELSNKEFVSIMKQRLMRGLEKPKDMGFTRLMQAMWKCAQETAWDFALPKQ

SEQ ID NO: 886673 - protein, 175 aa, Homo sapiens
MLDNTFLALEFERHDPVDGRITERQFGGMLLAYSGVQSKKLTAMQRQLKKHFKEGKGLTFQEVENFFTFLKNINDVDTALSFYHMAGASLDKVTMQQVARTVAKVELSDHVCDVVFALFDCDGNGELSNKEFVSIMKQRLMRGLEKPKDMGFTRLMQAMWKCAQETAWDFALPKQ

SEQ ID NO: 886674 - protein, 434 aa, Homo sapiens
MFRLNSLSALAELAVGSRWYHGGSQPIQIRRRLMMVAFLGASAVTASTGLLWKRAHAESPPCVDNLKSDIGDKGKNKDEGDVCNHEKKTADLAPHPEEKKKKRSGFRDRKVMEYENRIRAYSTPDKIFRYFATLKVISEPGEAEVFMTPEDFVRSITPNEKQPEHLGLDQYIIKRFDGKKISQEREKFADEGSIFYTLGECGLISFSDYIFLTTVLSTPQRNFEIAFKMFDLNGDGEVDMEEFEQVQSIIRSQTSMGMRHRDRPTTGNTLKSGLCSALTTYFFGADLKGKLTIKNFLEFQRKLQHDVLKLEFERHDPVDGRITERQFGGMLLAYSGVQSKKLTAMQRQLKKHFKEGKGLTFQEVENFFTFLKNINDVDTALSFYHMAGASLDKVTMQQVARTVAKVELSDHVCDVVFALFDCDVCTPFSSSQPP

SEQ ID NO: 886675 - protein, 307 aa, Homo sapiens
MEPSSLELPADTVQRIAAELKCHPTDERVALHLDEEDKLRHFRECFYIPKIQDLPPVDLSLVNKDENAIYFLGNSLGLQPKMVKTYLEEELDKWAKIAAYGHEVGKRPWITGDESIVGLMKDIVGANEKEIALMNALTVNLHLLMLSFFKPTPKRYKILLEAKAFPSDHYAIESQLQLHGLNIEESMRMIKPREGEETLRIEDILEVIEKEGDSIAVILFSGVHFYTGQHFNIPAITKAGQAKGCYVGFDLAHAVGNVELYLHDWGVDFACWCSYKYLNAGAGGIAGAFIHEKHAHTIKPARSEFFN

SEQ ID NO: 886676 - protein, 479 aa, Homo sapiens
MLNTSSLSFREQLVMEPSSLELPADTVQRIAAELKCHPTDERVALHLDEEDKLRHFRECFYIPKIQDLPPVDLSLVNKDENAIYFLGNSLGLQPKMVKTYLEEELDKWAKIAAYGHEVGKRPWITGDESIVGLMKDIVGANEKEIALMNALTVNLHLLMLSFFKPTPKRYKILLEAKAFPSDHYAIESQLQLHGLNIEESMRMIKPREGEETLRIEDILEVIEKEGDSIAVILFSGVHFYTGQHFNIPAITKAGQAKGCYVGFDLAHAVGNVELYLHDWGVDFACWCSYKYLNAGAGGIAGAFIHEKHAHTIKPALVGWFGHELSTRFKMDNKLQLIPGVCGFRISNPPILLVCSLHASLEIFKQATMKALRKKSVLLTGYLEYLIKHNYGKDKAATKKPVVNIITPSHVEERGCQLTITFSVPNKDVFQELEKRGVVCDKRNPNGIRVAPVPLYNSFHDVYKFTNLLTSILDSAETKN

SEQ ID NO: 886677 - protein, 480 aa, Homo sapiens
MIAILTDMSFREQLVMEPSSLELPADTVQRIAAELKCHPTDERVALHLDEEDKLRHFRECFYIPKIQDLPPVDLSLVNKDENAIYFLGNSLGLQPKMVKTYLEEELDKWAKIAAYGHEVGKRPWITGDESIVGLMKDIVGANEKEIALMNALTVNLHLLMLSFFKPTPKRYKILLEAKAFPSDHYAIESQLQLHGLNIEESMRMIKPREGEETLRIEDILEVIEKEGDSIAVILFSGVHFYTGQHFNIPAITKAGQAKGCYVGFDLAHAVGNVELYLHDWGVDFACWCSYKYLNAGAGGIAGAFIHEKHAHTIKPALVGWFGHELSTRFKMDNKLQLIPGVCGFRISNPPILLVCSLHASLEIFKQATMKALRKKSVLLTGYLEYLIKHNYGKDKAATKKPVVNIITPSHVEERGCQLTITFSVPNKDVFQELEKRGVVCDKRNPNGIRVAPVPLYNSFHDVYKFTNLLTSILDSAETKN

SEQ ID NO: 886678 - protein, 492 aa, Homo sapiens
MEPSSLELPADTVQRIAAELKCHPTDERVALHLDEEDKLRHFRECFYIPKIQDLPPVDLSLVNKDENAIYFLGNSLGLQPKMVKTYLEEELDKWAKIAAYGHEVGKRPWITGDESIVGLMKDIVGANEKEIALMNALTVNLHLLMLSFFKPTPKRYKILLEAKAFPSDHYAIESQLQLHGLNIEESMRMIKPREGEETLRIEDILEVIEKEGDSIAVILFSGVHFYTGQHFNIPAITKAGQAKGCYVGFDLAHAVGNVELYLHDWGVDFACWCSYKYLNAGAGGIAGAFIHEKHAHTIKPALVGWFGHELSTRFKMDNKLQLIPGVCGFRISNPPILLVCSLHASLENETFTLCEMNLKVPQNAVALIVVVMEKIFKQATMKALRKKSVLLTGYLEYLIKHNYGKDKAATKKPVVNIITPSHVEERGCQLTITFSVPNKDVFQELEKRGVVCDKRNPNGIRVAPVPLYNSFHDVYKFTNLLTSILDSAETKN

SEQ ID NO: 886679 - protein, 332 aa, Homo sapiens
MNALTVNLHLLMLSFFKPTPKRYKILLEAKAFPSDHYAIESQLQLHGLNIEESMRMIKPREGEETLRIEDILEVIEKEGDSIAVILFSGVHFYTGQHFNIPAITKAGQAKGCYVGFDLAHAVGNVELYLHDWGVDFACWCSYKYLNAGAGGIAGAFIHEKHAHTIKPALVGWFGHELSTRFKMDNKLQLIPGVCGFRISNPPILLVCSLHASLEIFKQATMKALRKKSVLLTGYLEYLIKHNYGKDKAATKKPVVNIITPSHVEERGCQLTITFSVPNKDVFQELEKRGVVCDKRNPNGIRVAPVPLYNSFHDVYKFTNLLTSILDSAETKN

SEQ ID NO: 886680 - protein, 447 aa, Homo sapiens
MEPSSLELPADTVQRIAAELKCHPTDERVALHLDEEDKLRHFRECFYIPKIQDLPPVDLSLVNKDENAIYFLGNSLGLQPKMVKTYLEEELDKWAKIIVGLMKDIVGANEKEIALMNALTVNLHLLMLSFFKPTPKRYKILLEAKAFPSDHYAIESQLQLHGLNIEESMRMIKPREGEETLRIEDILEVIEKEGDSIAVILFSGVHFYTGQHFNIPAITKAGQAKGCYVGFDLAHAVGNVELYLHDWGVDFACWCSYKYLNAGAGGIAGAFIHEKHAHTIKPALVGWFGHELSTRFKMDNKLQLIPGVCGFRISNPPILLVCSLHASLEIFKQATMKALRKKSVLLTGYLEYLIKHNYGKDKAATKKPVVNIITPSHVEERGCQLTITFSVPNKDVFQELEKRGVVCDKRNPNGIRVAPVPLYNSFHDVYKFTNLLTSILDSAETKN

SEQ ID NO: 886681 - protein, 301 aa, Homo sapiens
MEPSSLELPADTVQRIAAELKCHPTDERVALHLDEEDKLRHFRECFYIPKIQDLPPVDLSLVNKDENAIYFLGNSLGLQPKMVKTYLEEELDKWAKIAAYGHEVGKRPWITGDESIVGLMKDIVGANEKEIALMNALTVNLHLLMLSFFKPTPKRYKILLEAKAFPSDHYAIESQLQLHGLNIEESMRMIKPREGEETLRIEDILEVIEKEGDSIAVILFSGVHFYTGQHFNIPAITKAGQAKGCYVGFDLAHAVGNVELYLHDWGVDFACWCSYKYLNAGAGGIAGAFIHEKHAHTIKPA

SEQ ID NO: 886682 - protein, 416 aa, Homo sapiens
MEPSSLELPADTVQRIAAELKCHPTDERVALHLDEEDKLRHFRECFYIPKIQDLPPVDLSLVNKDENAIYFLGNSLGLQPKMVKTYLEEELDKWAKIAAYGHEVGKRPWITGDESIVGLMKDIVGANEKEIALMNALTVNLHLLMLSFFKPTPKRYKILLEAKAFPSDHYAIESQLQLHGLNIEESMRMIKPREGCYVGFDLAHAVGNVELYLHDWGVDFACWCSYKYLNAGAGGIAGAFIHEKHAHTIKPALVGWFGHELSTRFKMDNKLQLIPGVCGFRISNPPILLVCSLHASLEIFKQATMKALRKKSVLLTGYLEYLIKHNYGKDKAATKKPVVNIITPSHVEERGCQLTITFSVPNKDVFQELEKRGVVCDKRNPNGIRVAPVPLYNSFHDVYKFTNLLTSILDSAETKN

SEQ ID NO: 886683 - protein, 465 aa, Homo sapiens
MEPSSLELPADTVQRIAAELKCHPTDERVALHLDEEDKLRHFRECFYIPKIQDLPPVDLSLVNKDENAIYFLGNSLGLQPKMVKTYLEEELDKWAKIAAYGHEVGKRPWITGDESIVGLMKDIVGANEKEIALMNALTVNLHLLMLSFFKPTPKRYKILLEAKAFPSDHYAIESQLQLHGLNIEESMRMIKPREGEETLRIEDILEVIEKEGDSIAVILFSGVHFYTGQHFNIPAITKAGQAKGCYVGFDLAHAVGNVELYLHDWGVDFACWCSYKYLNAGAGGIAGAFIHEKHAHTIKPALVGWFGHELSTRFKMDNKLQLIPGVCGFRISNPPILLVCSLHASLEIFKQATMKALRKKSVLLTGYLEYLIKHNYGKDKAATKKPVVNIITPSHVEERGCQLTITFSVPNKDVFQELEKRGVVCDKRNPNGIRVAPVPLYNSFHDVYKFTNLLTSILDSAETKN

SEQ ID NO: 886684 - protein, 266 aa, Homo sapiens
MEPSSLELPADTVQRIAAELKCHPTDERVALHLDEEDKLRHFRECFYIPKIQDLPPVDLSLVNKDENAIYFLGNSLGLQPKMVKTYLEEELDKWAKIAAYGHEVGKRPWITGDESIVGLMKDIVGANEKEIALMNALTVNLHLLMLSFFKPTPKRYKILLEAKAFPSDHYAIESQLQLHGLNIEESMRMIKPREGEETLRIEDILEVIEKEGDSIAVILFSGVHFYTGQHFNIPAITKAGQAKVCTPFTSSHLTPNITLLKSVLIA

SEQ ID NO: 886685 - protein, 465 aa, Homo sapiens; identical to SEQ ID NO: 886683

SEQ ID NO: 886686 - protein, 465 aa, Homo sapiens; identical to SEQ ID NO: 886683

SEQ ID NO: 886687 - protein, 307 aa, Homo sapiens; identical to SEQ ID NO: 886675

SEQ ID NO: 886688 - protein, 370 aa, Homo sapiens
VFLQVFKLQEQEELLVPSFMKSMPIRLNLRANEKEIALMNALTVNLHLLMLSFFKPTPKRYKILLEAKAFPSDHYAIESQLQLHGLNIEESMRMIKPREGEETLRIEDILEVIEKEGDSIAVILFSGVHFYTGQHFNIPAITKAGQAKGCYVGFDLAHAVGNVELYLHDWGVDFACWCSYKYLNAGAGGIAGAFIHEKHAHTIKPALVGWFGHELSTRFKMDNKLQLIPGVCGFRISNPPILLVCSLHASLEIFKQATMKALRKKSVLLTGYLEYLIKHNYGKDKAATKKPVVNIITPSHVEERGCQLTITFSVPNKDVFQELEKRGVVCDKRNPNGIRVAPVPLYNSFHDVYKFTNLLTSILDSAETKN

SEQ ID NO: 886689 - protein, 159 aa, Homo sapiens
MEPSSLELPADTVQRIAAELKCHPTDERVALHLDEEDKLRHFRECFYIPKIQDLPPVDLSLVNKDENAIYFLGNSLGLQPKMVKTYLEEELDKWAKIAAYGHEVGKRPWITGDESIVGLMKDIVGANEKEIALMNALTVNLHLLMLSFFKPTPKRYICY

SEQ ID NO: 886690 - protein, 417 aa, Homo sapiens
GHLFRRLNCGRMRGSVECTWGWGHCAPSPLLLWTLLLFAAPFGLLGEKTRQVSLEVIPNWLGPLQNLLHIRAVGTNSTLHYVWSSLGPLAVVMVATNTPHSTLSVNWSLLLSPEPDGGLMVLPKDSIQFSSALVFTRLLEFDSTNVSDTAAKPLGRPYPPYSLADFSWNNITDSLDPATLSATFQGHPMNDPTRTFANGSLAFRVQAFSRSSRPAQPPRLLHTADTCQLEVALIGASPRGNRSLFGLEVATLGQGPDCPSMQEQHSIDDEYAPAVFQLDQLLWGSLPSGFAQWRPVAYSQKPGGRESALPCQASPLHPALAYSLPQSPIVRAFFGSQNNFCAFNLTFGASTGPGYWDQHYLSWSMLLGVGFPPVDGLSPLVLGIMAVALGAPGLMLLGGGLVLLLHHKKYSEYQSIN

SEQ ID NO: 886691 - protein, 417 aa, Homo sapiens; identical to SEQ ID NO: 886690

SEQ ID NO: 886692 - protein, 417 aa, Homo sapiens; identical to SEQ ID NO: 886690

SEQ ID NO: 886693 - protein, 417 aa, Homo sapiens; identical to SEQ ID NO: 886690

SEQ ID NO: 886694 - protein, 417 aa, Homo sapiens; identical to SEQ ID NO: 886690

SEQ ID NO: 886695 - protein, 331 aa, Homo sapiens
GHLFRRLNCGRMRGSVECTWGWGHCAPSPLLLWTLLLFAAPFGLLGEKTRQLLEFDSTNVSDTAAKPLGRPYPPYSLADFSWNNITDSLDPATLSATFQGHPMNDPTRTFANGSLAFRVQAFSRSSRPAQPPRLLHTADTCQLEVALIGASPRGNRSLFGLEVATLGQGPDCPSMQEQHSIDDEYAPAVFQLDQLLWGSLPSGFAQWRPVAYSQKPGGRESALPCQASPLHPALAYSLPQSPIVRAFFGSQNNFCAFNLTFGASTGPGYWDQHYLSWSMLLGVGFPPVDGLSPLVLGIMAVALGAPGLMLLGGGLVLLLHHKKYSEYQSIN

SEQ ID NO: 886696 - protein, 229 aa, Homo sapiens
MNDPTRTFANGSLAFRVQAFSRSSRPAQPPRLLHTADTCQLEVALIGASPRGNRSLFGLEVATLGQGPDCPSMQEQHSIDDEYAPAVFQLDQLLWGSLPSGFAQWRPVAYSQKPGGRESALPCQASPLHPALAYSLPQSPIVRAFFGSQNNFCAFNLTFGASTGPGYWDQHYLSWSMLLGVGFPPVDGLSPLVLGIMAVALGAPGLMLLGGGLVLLLHHKKYSEYQSIN

SEQ ID NO: 886697 - protein, 194 aa, Homo sapiens
GHLFRRLNCGRMRGSVECTWGWGHCAPSPLLLWTLLLFAAPFGLLGEKTRQLLEFDSTNVSDTAAKPLGRPYPPYSLADFSWNNITDSLDPATLSATFQGHPMNDPTRTFANGSLAFRVQAFSRSSRPAQPPRLLHTADTCQLEVALIGASPRGNRSLFGLEVATLGQGPDCPSMQEQHSIDDEYAPAVFQRRD

SEQ ID NO: 886698 - protein, 211 aa, Homo sapiens
GHLFRRLNCGRMRGSVECTWGWGHCAPSPLLLWTLLLFAAPFGLLGEKTRQLLEFDSTNVSDTAAKPLGRPYPPYSLADFSWNNITDSLDPATLSATFQGHPMNDPTRTFANGSLAFRVQAFSRSSRPAQPPRLLHTADTCQLEVALIGASPRGNRSLFGLEVATLGQGPDCPSMQEQHSIDDEYAPAVFQVRLPGERQMGEECRWDTIGT

SEQ ID NO: 886699 - protein, 417 aa, Homo sapiens; identical to SEQ ID NO: 886690

SEQ ID NO: 886700 - protein, 417 aa, Homo sapiens; identical to SEQ ID NO: 886690

SEQ ID NO: 886701 - protein, 368 aa, Homo sapiens
GHLFRRLNCGRMRGSVECTWGWGHCAPSPLLLWTLLLFAAPFGLLGEKTRQVSLEVIPNWLGPLQNLLHIRAVGTNSTLHYVWSSLGPLAVVMVATNTPHSTLSVNWSLLLSPEPDGGLMVLPKDSIQFSSALVFTRLLEFDSTNVSDTAAKPLGRPYPPYSLADFSWNNITDSLDPATLSATFQGHPMNDPTRTFANGSLAFRVQAFSRSSRPAQPPRLLHTADTCQLEVALIGASPRGNRSLFGLEVATLGQGPDCPSMQEQHSIDDEYAPAVFQSPIVRAFFGSQNNFCAFNLTFGASTGPGYWDQHYLSWSMLLGVGFPPVDGLSPLVLGIMAVALGAPGLMLLGGGLVLLLHHKKYSEYQSIN

SEQ ID NO: 886702 - protein, 397 aa, Homo sapiens
MPSVSDWVGMCPALLLDLSVHAIWLLGRRPQVSLEVIPNWLGPLQNLLHIRAVGTNSTLHYVWSSLGPLAVVMVATNTPHSTLSVNWSLLLSPEPDGGLMVLPKDSIQFSSALVFTRLLEFDSTNVSDTAAKPLGRPYPPYSLADFSWNNITDSLDPATLSATFQGHPMNDPTRTFANGSLAFRVQAFSRSSRPAQPPRLLHTADTCQLEVALIGASPRGNRSLFGLEVATLGQGPDCPSMQEQHSIDDEYAPAVFQLDQLLWGSLPSGFAQWRPVAYSQKPGGRESALPCQASPLHPALAYSLPQSPIVRAFFGSQNNFCAFNLTFGASTGPGYWDQHYLSWSMLLGVGFPPVDGLSPLVLGIMAVALGAPGLMLLGGGLVLLLHHKKYSEYQSIN

SEQ ID NO: 886703 - protein, 342 aa, Homo sapiens
GHLFRRLNCGRMRGSVECTWGWGHCAPSPLLLWTLLLFAAPFGLLGEKTRQVSLEVIPNWLGPLQNLLHIRAVGTNSTLHYVWSSLGPLAVVMVATNTPHSTLSVNWSLLLSPEPDGGLMVLPKDSIQFSSALVFTRLLEFDSTNVSDTAAKPLGRPYPPYSLADFSWNNITDSLDPATLSATFQGHPMNDPTRTFANGSLAFRVQAFSRSSRPAQPPRLLHTADTCQLEVALIGASPRGNRSLFGLEVATLGQGPDCPSMQEQHSIDDEYAPAVFQVDAPGCGLPSSGRLVPTSPGHHGSGPGCPRAHAARGRLGSAAAPQEVLRVPVHKLRPALWREGHY

SEQ ID NO: 886704 - protein, 300 aa, Homo sapiens
MEGVLYKWTNYLTGWQPRWFVLDNGILSYYDSQDDVCKGSKGSIKMAVCEIKVHSADNTRMELIIPGEQHFYMKAVNAAERQRWLVALGSSKACLTDTRTKKEKEISETSESLKTKMSELRLYCDLLMQQVHTIQEFVHHDENHSSPSAENMNEASSLLSATCNTFITTLEECVKIANAKFKPEMFQLHHPDPLVSPVSPSPVQMMKRSVSHPGSCSSERSSHSIKEPVSTLHRLSQRRRRTYSDTDSCSDIPLEDPDRPVHCSKNTLNGDLASATIPEESRLMAKKQSESEDTLPSFSS

SEQ ID NO: 886705 - protein, 240 aa, Homo sapiens
MELIIPGEQHFYMKAVNAAERQRWLVALGSSKACLTDTRTKKEKEISETSESLKTKMSELRLYCDLLMQQVHTIQEFVHHDENHSSPSAENMNEASSLLSATCNTFITTLEECVKIANAKFKPEMFQLHHPDPLVSPVSPSPVQMMKRSVSHPGSCSSERSSHSIKEPVSTLHRLSQRRRRTYSDTDSCSDIPLEDPDRPVHCSKNTLNGDLASATIPEESRLMAKKQSESEDTLPSFSS

SEQ ID NO: 886706 - protein, 300 aa, Homo sapiens; identical to SEQ ID NO: 886704

SEQ ID NO: 886707 - protein, 300 aa, Homo sapiens; identical to SEQ ID NO: 886704

SEQ ID NO: 886708 - protein, 305 aa, Homo sapiens
MEGVLYKWTNYLTGWQPRWFVLDNGILSYYDSQDDVCKGSKGSIKMAVCEIKVHSADNTRMELIIPGEQHFYMKAVNAAERQRWLVALGSSKACLTDTRTKKEKEISETSESLKTKMSELRLYCDLLMQQVHTIQEFVHHDENHSSPSAENMNEASSLLSATCNTFITTLEECVKIANAKFKPEMFQLHHPDPLVSPVSPSPVQMMKRSVSHPGSCSSERSSHSIKEPVSTLHRLSQRRRRTYSDTDSCSDIPLEDPDNVGGEMKERNREGEGRKKLSWANQARPGREEEERRRVKEVEYVKKVI

SEQ ID NO: 886709 - protein, 300 aa, Homo sapiens; identical to SEQ ID NO: 886704

SEQ ID NO: 886710 - protein, 300 aa, Homo sapiens; identical to SEQ ID NO: 886704

SEQ ID NO: 886711 - protein, 486 aa, Homo sapiens
MKGRRRRRREYCKFALLLVLYTLVLLLVPSVLDGGRDGDKGAEHCPGLQRSLGVWSLEAAAAGEREQGAEARAAEEGGANQSPRFPSNLSGAVGEAVSREKQHIYVHATWRTGSSFLGELFNQHPDVFYLYEPMWHLWQALYPGDAESLQGALRDMLRSLFRCDFSVLRLYAPPGDPAARAPDTANLTTAALFRWRTNKVICSPPLCPGAPRARAEVGLVEDTACERSCPPVAIRALEAECRKYPVVVIKDVRLLDLGVLVPLLRDPGLNLKVVQLFRDPRAVHNSRLKSRQGLLRESIQVLRTRQRGDRFHRVLLAHGVGARPGGQSRALPAAPRADFFLTGALEVICEAWLRDLLFARGAPAWLRRRYLRLRYEDLVRQPRAQLRRLLRFSGLRALAALDAFALNMTRGAAYGADRPFHLSARDAREAVHAWRERLSREQVRQVEAACAPAMRLLAYPRSGEEGDAEQPREGETPLEMDADGAT

SEQ ID NO: 886712 - protein, 121 aa, Homo sapiens
SKQCARAVALKAGQQSLWPMWRSSARASVVMTVFALRGEGMCDHFQRDRVSPCCPDWSQTPGFKQSTRLGLPKCWDYRSVTTNRGTRHAAPALEKQRCGGNLSHSQSLGLDLLPTTAVQFC

SEQ ID NO: 886713 - protein, 460 aa, Homo sapiens
MKGRRRRRREYCKFALLLVLYTLVLLLVPSVLDGGRDGDKGAEHCPGLQRSLGVWSLEAAAAGEREQGAEARAAEEGGANQSPRFPSNLSGAVGEAVSREKQHIYVHATWRTGSSFLGELFNQHPDVFYLYEPMWHLWQALYPGDAESLQGALRDMLRSLFRCDFSVLRLYAPPGDPAARAPDTANLTTAALFRWRTNKVICSPPLCPGAPRARAEVGLVEDTACERSCPPVAIRALEAECRKYPVVVIKDVRLLDLGVLVPLLRDPGLNLKVVQLFRDPRAVHNSRLKSRQGLLRESIQVLRTRQRGDRFHRVLLAHGVGARPGGQSRALPAAPRADFFLTGALEVICEAWLRDLLFARGAPAWLRRRYLRLRYEDLVRQPRAQLRRLLRFSGLRALAALDAFALNMTRGAAYGADRPFHAACAPAMRLLAYPRSGEEGDAEQPREGETPLEMDADGAT

SEQ ID NO: 886714 - protein, 1794 aa, Homo sapiens
GAQAAAPLPATGGAALRRWLVVAVGGGGGERRPRVVRREALRADRALGGGGGGRRRAGARVRPAPAMADAAASPVGKRLLLLFADTAASASASAPAAAAASGDPGPALRTRAWRAGTVRAMSGAVPQDLAIFVEFDGCNWKQHSWVKVHAEEVIVLLLEGSLVWAPREDPVLLQGIRVSIAQWPALTFTPLVDKLGLGSVVPVEYLLDRELRFLSDANGLHLFQMGTDSQNQILLEHAALRETVNALISDQKLQEIFSRGPYSVQGHRVKIYQPEGEEGWLYGVVSHQDSITRLMEVSVTESGEIKSVDPRLIHVMLMDNSTPQSEGGTLKAVKSSKGKKKRESIEGKDGRRRKSASDSGCDPASKKLKGDRGEVDSNGSDGDKPQHSLATYTKENGRTLVVQDEPVGGDTPASFTPYSTATGQTPLAPEVGGAENKEAGKTLEQVGQGIVASAAVVTTASSTPNTVRISDTGLAAGTVPEKQKGSRSQASGENSRNSILASSGFGAPLPSSSQPLTFGSGRSQSNGVLATENKPLGFSFGCSSAQEAQKDTDLSKNLFFQCMSQTLPTSNYFTTVSESLADDSSSRDSFKQSLESLSSGLCKGRSVLGTDTKPGSKAGSSVDRKVPAESMPTLTPAFPRSLLNARTPENHENLFLQPPKLSREEPSNPFLAFVEKVEHSPFSSFASQASGSSSSATTVTSKVAPSWPESHSSADSASLAKKKPLFITTDSSKLVSGVLGSALTSGGPSLSAMGNGRSSSPTSSLTQPIEMPTLSSSPTEERPTVGPGQQDNPLLKTFSNVFGRHSGGFLSSPADFSQENKAPFEAVKRFSLDERSLACRQDSDSSTNSDLSDLSDSEEQLQAKTGLKGIPEHLMGKLGPNGERSAELLLGKSKGKQAPKGRPRTAPLKVGQSVLKDVSKVKKLKQSGEPFLQDGSCINVAPHLHKCRECRLERYRKFKEQEQDDSTVACRFFHFRRLIFTRKGVLRVEGFLSPQQSDPDAMNLWIPSSSLAEGIDLETSKYILANVGDQFCQLVMSEKEAMMMVEPHQKVAWKRAVRGVREMCDVCETTLFNIHWVCRKCGFGVCLDCYRLRKSRPRSETEEMGDEEVFSWLKCAKGQSHEPENLMPTQIIPGTALYNIGDMVHAARGKWGIKANCPCISRQNKSVLRPAVTNGMSQLPSINPSASSGNETTFSGGGGPAPVTTPEPDHVPKADSTDIRSEEPLKTDSSASNSNSELKAIRPPCPDTAPPSSALHWLADLATQKAKEETKEAGSLRSVLNKESHSPFGLDSFNSTAKVSPLTPKLFNSLLLGPTASNNKTEGSSLRDLLHSGPGKLPQTPLDTGIPFPPVFSTSSAGVKSKASLPNFLDHIIASVVENKKTSDASKRACNLTDTQKEVKEMVMGLNVLDPHTSHSWLCDGRLLCLHDPSNKNNWKIFRECWKQGQPVLVSGVHKKLKSELWKPEAFSQEFGDQDVDLVNCRNCAIISDVKVRDFWDGFEIICKRLRSEDGQPMVLKLKDWPPGEDFRDMMPTRFEDLMENLPLPEYTKRDGRLNLASRLPSYFVRPDLGPKMYNAYGLITAEDRRVGTTNLHLDVSDAVNVMVYVGIPIGEGAHDEEVLKTIDEGDADEVTKQRIHDGKEKPGALWHIYAAKDAEKIRELLRKVGEEQGQENPPDHDPIHDQSWYLDQTLRKRLYEEYGVQGWAIVQFLGDAVFIPAGAPHQVHNLYSCIKVAEDFVSPEHVKHCFRLTQEFRHLSNTHTNHEDKLQVKNIIYHAVKDAVGTLKAHESKLARS

SEQ ID NO: 886715 - protein, 1723 aa, Homo sapiens
PPGFNAILLPRPPVVSSDCRRCHHAHIFVEFDGCNWKQHSWVKVHAEEVIVLLLEGSLVWAPREDPVLLQGIRVSIAQWPALTFTPLVDKLGLGSVVPVEYLLDRELRFLSDANGLHLFQMGTDSQNQILLEHAALRETVNALISDQKLQEIFSRGPYSVQGHRVKIYQPEGEEGWLYGVVSHQDSITRLMEVSVTESGEIKSVDPRLIHVMLMDNSTPQSEGGTLKAVKSSKGKKKRESIEGKDGRRRKSASDSGCDPASKKLKGDRGEVDSNGSDGGEASRGPWKGGNASGEPGLDQRAKQPPSTFVPQINRNIRFATYTKENGRTLVVQDEPVGGDTPASFTPYSTATGQTPLAPEVGGAENKEAGKTLEQVGQGIVASAAVVTTASSTPNTVRISDTGLAAGTVPEKQKGSRSQASGENSRNSILASSGFGAPLPSSSQPLTFGSGRSQSNGVLATENKPLGFSFGCSSAQEAQKDTDLSKNLFFQCMSQTLPTSNYFTTVSESLADDSSSRDSFKQSLESLSSGLCKGRSVLGTDTKPGSKAGSSVDRKVPAESMPTLTPAFPRSLLNARTPENHENLFLQPPKLSREEPSNPFLAFVEKVEHSPFSSFASQASGSSSSATTVTSKVAPSWPESHSSADSASLAKKKPLFITTDSSKLVSGVLGSALTSGGPSLSAMGNGRSSSPTSSLTQPIEMPTLSSSPTEERPTVGPGQQDNPLLKTFSNVFGRHSGGFLSSPADFSQENKAPFEAVKRFSLDERSLACRQDSDSSTNSDLSDLSDSEEQLQAKTGLKGIPEHLMGKLGPNGERSAELLLGKSKGKQAPKGRPRTAPLKVGQSVLKDVSKVKKLKQSGEPFLQDGSCINVAPHLHKCRECRLERYRKFKEQEQDDSTVACRFFHFRRLIFTRKGVLRVEGFLSPQQSDPDAMNLWIPSSSLAEGIDLETSKYILANVGDQFCQLVMSEKEAMMMVEPHQKVAWKRAVRGVREMCDVCETTLFNIHWVCRKCGFGVCLDCYRLRKSRPRSETEEMGDEEVFSWLKCAKGQSHEPENLMPTQIIPGTALYNIGDMVHAARGKWGIKANCPCISRQNKSVLRPAVTNGMSQLPSINPSASSGNETTFSGGGGPAPVTTPEPDHVPKADSTDIRSEEPLKTDSSASNSNSELKAIRPPCPDTAPPSSALHWLADLATQKAKEETKEAGSLRSVLNKESHSPFGLDSFNSTAKVSPLTPKLFNSLLLGPTASNNKTEGSSLRDLLHSGPGKLPQTPLDTGIPFPPVFSTSSAGVKSKASLPNFLDHIIASVVENKKTSDASKRACNLTDTQKEVKEMVMGLNVLDPHTSHSWLCDGRLLCLHDPSNKNNWKIFRECWKQGQPVLVSGVHKKLKSELWKPEAFSQEFGDQDVDLVNCRNCAIISDVKVRDFWDGFEIICKRLRSEDGQPMVLKLKDWPPGEDFRDMMPTRFEDLMENLPLPEYTKRDGRLNLASRLPSYFVRPDLGPKMYNAYGLITAEDRRVGTTNLHLDVSDAVNVMVYVGIPIGEGAHDEEVLKTIDEGDADEVTKQRIHDGKEKPGALWHIYAAKDAEKIRELLRKVGEEQGQENPPDHDPIHDQSWYLDQTLRKRLYEEYGVQGWAIVQFLGDAVFIPAGAPHQVHNLYSCIKVAEDFVSPEHVKHCFRLTQEFRHLSNTHTNHEDKLQVKNIIYHAVKDAVGTLKAHESKLARS

SEQ ID NO: 886716 - protein, 1849 aa, Homo sapiens
GAQAAAPLPATGGAALRRWLVVAVGGGGGERRPRVVRREALRADRALGGGGGGRRRAGARVRPAPAMADAAASPVGKRLLLLFADTAASASASAPAAAAASGDPGPALRTRAWRAGTVRAMSGAVPQDLAIFVEFDGCNWKQHSWVKVHAEEVIVLLLEGSLVWAPREDPVLLQGIRVSIAQWPALTFTPLVDKLGLGSVVPVEYLLDRELRFLSDANGLHLFQMGTDSQNQILLEHAALRETVNALISDQKLQEIFSRGPYSVQGHRVKIYQPEGEEGWLYGVVSHQDSITRLMEVSVTESGEIKSVDPRLIHVMLMDNSTPQSEGGTLKAVKSSKGKKKRESIEGKDGRRRKSASDSGCDPASKKLKGDRGEVDSNGSDGGEASRGPWKGGNASGEPGLELRSRRKAEAQTRVRKPHYMDPPSQRQIKNPGKTNYPDIFRHQPFKTKENGRTLVVQDEPVGGDTPASFTPYSTATGQTPLAPEVGGAENKEAGKTLEQVGQGIVASAAVVTTASSTPNTVRISDTGLAAGTVPEKQKGSRSQASGENSRNSILASSGFGAPLPSSSQPLTFGSGRSQSNGVLATENKPLGFSFGCSSAQEAQKDTDLSKNLFFQCMSQTLPTSNYFTTVSESLADDSSSRDSFKQSLESLSSGLCKGRSVLGTDTKPGSKAGSSVDRKVPAESMPTLTPAFPRSLLNARTPENHENLFLQPPKLSREEPSNPFLAFVEKVEHSPFSSFASQASGSSSSATTVTSKVAPSWPESHSSADSASLAKKKPLFITTDSSKLVSGVLGSALTSGGPSLSAMGNGRSSSPTSSLTQPIEMPTLSSSPTEERPTVGPGQQDNPLLKTFSNVFGRHSGGFLSSPADFSQENKAPFEAVKRFSLDERSLACRQDSDSSTNSDLSDLSDSEEQLQAKTGLKGIPEHLMGKLGPNGERSAELLLGKSKGKQAPKGRPRTAPLKVGQSVLKDVSKVKKLKQSGEPFLQDGSCINVAPHLHKCRECRLERYRKFKEQEQDDSTVACRFFHFRRLIFTRKGVLRVEGFLSPQQSDPDAMNLWIPSSSLAEGIDLETSKYILANVGDQFCQLVMSEKEAMMMVEPHQKVAWKRAVRGVREMCDVCETTLFNIHWVCRKCGFGVCLDCYRLRKSRPRSETEEMGDEEVFSWLKCAKGQSHEPENLMPTQIIPGTALYNIGDMVHAARGKWGIKANCPCISRQNKSVLRPAVTNGMSQLPSINPSASSGNETTFSGGGGPAPVTTPEPDHVPKADSTDIRSEEPLKTDSSASNSNSELKAIRPPCPDTAPPSSALHWLADLATQKAKEETKEAGSLRSVLNKESHSPFGLDSFNSTAKVSPLTPKLFNSLLLGPTASNNKTEGSSLRDLLHSGPGKLPQTPLDTGIPFPPVFSTSSAGVKSKASLPNFLDHIIASVVENKKTSDASKRACNLTDTQKEVKEMVMGLNVLDPHTSHSWLCDGRLLCLHDPSNKNNWKIFRECWKQGQPVLVSGVHKKLKSELWKPEAFSQEFGDQDVDLVNCRNCAIISDVKVRDFWDGFEIICKRLRSEDGQPMVLKLKDWPPGEDFRDMMPTRFEDLMENLPLPEYTKRDGRLNLASRLPSYFVRPDLGPKMYNAYGLITAEDRRVGTTNLHLDVSDAVNVMVYVGIPIGEGAHDEEVLKTIDEGDADEVTKQRIHDGKEKPGALWHIYAAKDAEKIRELLRKVGEEQGQENPPDHDPIHDQSWYLDQTLRKRLYEEYGVQGWAIVQFLGDAVFIPAGAPHQVHNLYSCIKVAEDFVSPEHVKHCFRLTQEFRHLSNTHTNHEDKLQVKNIIYHAVKDAVGTLKAHESKLARS

SEQ ID NO: 886717 - protein, 759 aa, Homo sapiens
MSEKEAMMMVEPHQKVAWKRAVRGVREMCDVCETTLFNIHWVCRKCGFGVCLDCYRLRKSRPRSETEEMGDEEVFSWLKCAKGQSHEPENLMPTQIIPGTALYNIGDMVHAARGKWGIKANCPCISRQNKSVLRPAVTNGMSQLPSINPSASSGNETTFSGGGGPAPVTTPEPDHVPKADSTDIRSEEPLKTDSSASNSNSELKAIRPPCPDTAPPSSALHWLADLATQKAKEETKEAGSLRSVLNKESHSPFGLDSFNSTAKVSPLTPKLFNSLLLGPTASNNKTEGSSLRDLLHSGPGKLPQTPLDTGIPFPPVFSTSSAGVKSKASLPNFLDHIIASVVENKKTSDASKRACNLTDTQKEVKEMVMGLNVLDPHTSHSWLCDGRLLCLHDPSNKNNWKIFRECWKQGQPVLVSGVHKKLKSELWKPEAFSQEFGDQDVDLVNCRNCAIISDVKVRDFWDGFEIICKRLRSEDGQPMVLKLKDWPPGEDFRDMMPTRFEDLMENLPLPEYTKRDGRLNLASRLPSYFVRPDLGPKMYNAYGLITAEDRRVGTTNLHLDVSDAVNVMVYVGIPIGEGAHDEEVLKTIDEGDADEVTKQRIHDGKEKPGALWHIYAAKDAEKIRELLRKVGEEQGQENPPDHDPIHDQSWYLDQTLRKRLYEEYGVQGWAIVQFLGDAVFIPAGAPHQVHNLYSCIKVAEDFVSPEHVKHCFRLTQEFRHLSNTHTNHEDKLQVKNIIYHAVKDAVGTLKAHESKLARS

SEQ ID NO: 886718 - protein, 1518 aa, Homo sapiens
GAQAAAPLPATGGAALRRWLVVAVGGGGGERRPRVVRREALRADRALGGGGGGRRRAGARVRPAPAMADAAASPVGKRLLLLFADTAASASASAPAAAAASGDPGPALRTRAWRAGTVRAMSGAVPQDLAIFVEFDGCNWKQHSWVKVHAEEVIVLLLEGSLVWAPREDPVLLQGIRVSIAQWPALTFTPLVDKLGLGSVVPVEYLLDRELRFLSDANGLHLFQMGTDSQNQILLEHAALRETVNALISDQKLQEIFSRGPYSVQGHRVKIYQPEGEEGWLYGVVSHQDSITRLMEVSVTESGEIKSVDPRLIHVMLMDNSTPQSEGGTLKAVKSSKGKKKRESIEGKDGRRRKSASDSGCDPASKKLKGDRGEVDSNGSDGGEASRGPWKGGNASGEPGLDQRAKQPPSTFVPQINRNIRFATYTKENGRTLVVQDEPVGGDTPASFTPYSTATGQTPLAPEVGGAENKEAGKTLEQVGQGIVASAAVVTTASSTPNTVRISDTGLAAGTVPEKQKGSRSQASGENSRNSILASSGFGAPLPSSSQPLTFGSGRSQSNGVLATENKPLGFSFGCSSAQEAQKDTDLSKNLFFQCMSQTLPTSNYFTTVSESLADDSSSRDSFKQSLESLSSGLCKGRSVLGTDTKPGSKAGSSVDRKVPAESMPTLTPAFPRSLLNARTPENHENLFLQPPKLSREEPSNPFLAFVEKVEHSPFSSFASQASGSSSSATTVTSKVAPSWPESHSSADSASLAKKKPLFITTDSSKLVSGVLGSALTSGGPSLSAMGNGRSSSPTSSLTQPIEMPTLSSSPTEERPTVGPGQQDNPLLKTFSNVFGRHSGGFLSSPADFSQENKAPFEAVKRFSLDERSLACRQDSDSSTNSDLSDLSDSEEQLQAKTGLKGIPEHLMGKLGPNGERSAELLLGKSKGKQAPKGRPRTAPLKVGQSVLKDVSKVKKLKQSGEPFLQDGSCINVAPHLHKCRECRLERYRKFKEQEQDDSTVACRFFHFRRLIFTRKGVLRVEGFLSPQQSDPDAMNLWIPSSSLAEGIDLETSKYILANVGDQFCQLVMSEKEAMMMVEPHQKVAWKRAVRGVREMCDVCETTLFNIHWVCRKCGFGVCLDCYRLRKSRPRSETEEMGDEEVFSWLKCAKGQSHEPENLMPTQIIPGTALYNIGDMVHAARGKWGIKANCPCISRQNKSVLRPAVTNGMSQLPSINPSASSGNETTFSGGGGPAPVTTPEPDHVPKADSTDIRSEEPLKTDSSASNSNSELKAIRPPCPDTAPPSSALHWLADLATQKAKEETKEAGSLRSVLNKESHSPFGLDSFNSTAKVSPLTPKLFNSLLLGPTASNNKTEGSSLRDLLHSGPGKLPQTPLDTGIPFPPVFSTSSAGVKSKASLPNFLDHIIASVVENKKTSDASKRACNLTDTQKEVKEMVMGLNVLDPHTSHSWLCDGRLLCLHDPSNKNNWKIFRECWKQGQPVLVSGVHKKLKSELWKPEAFSQEFGDQGWRRTRPREPP

SEQ ID NO: 886719 - protein, 178 aa, Homo sapiens
GRSYAYEVTGDADEVTKQRIHDGKEKPGALWHIYAAKDAEKIRELLRKVGEEQGQENPPDHDPIHDQSWYLDQTLRKRLYEEYGVQGWAIVQFLGDAVFIPAGAPHQVHNLYSCIKVAEDFVSPEHVKHCFRLTQEFRHLSNTHTNHEDKLQVKNIIYHAVKDAVGTLKAHESKLARS

SEQ ID NO: 886720 - protein, 1677 aa, Homo sapiens
GAQAAAPLPATGGAALRRWLVVAVGGGGGERRPRVVRREALRADRALGGGGGGRRRAGARVRPAPAMADAAASPVGKRLLLLFADTAASASASAPAAAAASGDPGPALRTRAWRAGTVRAMSGAVPQDLAIFVEFDGCNWKQHSWVKVHAEEVIVLLLEGSLVWAPREDPVLLQGIRVSIAQWPALTFTPLVDKLGLGSVVPVEYLLDRELRFLSDANGLHLFQMGTDSQNQILLEHAALRETVNALISDQKLQEIFSRGPYSVQGHRVKIYQPEGEEGWLYGVVSHQDSITRLMEVSVTESGEIKSVDPRLIHVMLMDNSTPQSEGGTLKAVKSSKGKKKRESIEGKDGRRRKSASDSGCDPASKKLKGDRGEVDSNGSDGGEASRGPWKGGNASGEPGLDQRAKQPPSTFVPQINRNIRFATYTKENGRTLVVQDEPVGGDTPASFTPYSTATGQTPLAPEVGGAENKEAGKTLEQVGQGIVASAAVVTTASSTPNTVRISDTGLAAGTVPEKQKGSRSQASGENSRNSILASSGFGAPLPSSSQPLTFGSGRSQSNGVLATENKPLGFSFGCSSAQEAQKDTDLSKNLFFQCMSQTLPTSNYFTTVSESLADDSSSRDSFKQSLESLSSGLCKGRSVLGTDTKPGSKAGSSVDRKVPAESMPTLTPAFPRSLLNARTPENHENLFLQPPKLSREEPSNPFLAFVEKVEHSPFSSFASQASGSSSSATTVTSKVAPSWPESHSSADSASLAKKKPLFITTDSSKLVSGVLGSALTSGGPSLSAMGNGRSSSPTSSLTQPIEMPTLSSSPTEERPTVGPGQQDNPLLKTFSNVFGRHSGGFLSSPADFSQENKAPFEAVKRFSLDERSLACRQDSDSSTNSDLSDLSDSEEQLQAKTGLKGIPEHLMGKLGPNGERSAELLLGKSKGKQAPKGRPRTAPLKVGQSVLKDVSKVKKLKQSGEPFLQDGSCINVAPHLHKCRECRLERYRKFKEQEQDDSTVACRFFHFRRLIFTRKGVLRVEGFLSPQQSDPDAMNLWIPSSSLAEGIDLETSKYILANVGDQFCQLVMSEKEAMMMVEPHQKVAWKRAVRGVREMCDVCETTLFNIHWVCRKCGFGVCLDCYRLRKSRPRSETEEMGDEEVFSWLKCAKGQSHEPENLMPTQIIPGTALYNIGDMVHAARGKWGIKANCPCISRQNKSVLRPAVTNGMSQLPSINPSASSGNETTFSGGGGPAPVTTPEPDHVPKADSTDIRSEEPLKTDSSASNSNSELKAIRPPCPDTAPPSSALHWLADLATQKAKEETKEAGSLRSVLNKESHSPFGLDSFNSTAKVSPLTPKLFNSLLLGPTASNNKTEGSSLRDLLHSGPGKLPQTPLDTGIPFPPVFSTSSAGVKSKASLPNFLDHIIASVVENKKTSDASKRACNLTDTQKEVKEMVMGLNVLDPHTSHSWLCDGRLLCLHDPSNKNNWKIFRECWKQGQPVLVSGVHKKLKSELWKPEAFSQEFGDQDVDLVNCRNCAIISDVKVRDFWDGFEIICKRLRSEDGQPMVLKLKDWPPGEDFRDMMPTRFEDLMENLPLPEYTKRDGRLNLASRLPSYFVRPDLGPKMYNAYGLITAEDRRVGTTNLHLDVSDAVNVMVYVGIPIGEGAHDEEVLKTIDEGDADEVTKQRIHESKLARS

SEQ ID NO: 886721 - protein, 1827 aa, Homo sapiens
GAQAAAPLPATGGAALRRWLVVAVGGGGGERRPRVVRREALRADRALGGGGGGRRRAGARVRPAPAMADAAASPVGKRLLLLFADTAASASASAPAAAAASGDPGPALRTRAWRAGTVRAMSGAVPQDLAIFVEFDGCNWKQHSWVKVHAEEVIVLLLEGSLVWAPREDPVLLQGIRVSIAQWPALTFTPLVDKLGLGSVVPVEYLLDRELRFLSDANGLHLFQMGTDSQNQILLEHAALRETVNALISDQKLQEIFSRGPYSVQGHRVKIYQPEGEEGWLYGVVSHQDSITRLMEVSVTESGEIKSVDPRLIHVMLMDNSTPQSEGGTLKAVKSSKGKKKRESIEGKDGRRRKSASDSGCDPASKKLKGDRGEVDSNGSDGGEASRGPWKGGNASGEPGLDQRAKQPPSTFVPQINRNIRFATYTKENGRTLVVQDEPVGGDTPASFTPYSTATGQTPLAPEVGGAENKEAGKTLEQVGQGIVASAAVVTTASSTPNTVRISDTGLAAGTVPEKQKGSRSQASGENSRNSILASSGFGAPLPSSSQPLTFGSGRSQSNGVLATENKPLGFSFGCSSAQEAQKDTDLSKNLFFQCMSQTLPTSNYFTTVSESLADDSSSRDSFKQSLESLSSGLCKGRSVLGTDTKPGSKAGSSVDRKVPAESMPTLTPAFPRSLLNARTPENHENLFLQPPKLSREEPSNPFLAFVEKVEHSPFSSFASQASGSSSSATTVTSKVAPSWPESHSSADSASLAKKKPLFITTDSSKLVSGVLGSALTSGGPSLSAMGNGRSSSPTSSLTQPIEMPTLSSSPTEERPTVGPGQQDNPLLKTFSNVFGRHSGGFLSSPADFSQENKAPFEAVKRFSLDERSLACRQDSDSSTNSDLSDLSDSEEQLQAKTGLKGIPEHLMGKLGPNGERSAELLLGKSKGKQAPKGRPRTAPLKVGQSVLKDVSKVKKLKQSGEPFLQDGSCINVAPHLHKCRECRLERYRKFKEQEQDDSTVACRFFHFRRLIFTRKGVLRVEGFLSPQQSDPDAMNLWIPSSSLAEGIDLETSKYILANVGDQFCQLVMSEKEAMMMVEPHQKVAWKRAVRGVREMCDVCETTLFNIHWVCRKCGFGVCLDCYRLRKSRPRSETEEMGDEEVFSWLKCAKGQSHEPENLMPTQIIPGTALYNIGDMVHAARGKWGIKANCPCISRQNKSVLRPAVTNGMSQLPSINPSASSGNETTFSGGGGPAPVTTPEPDHVPKADSTDIRSEEPLKTDSSASNSNSELKAIRPPCPDTAPPSSALHWLADLATQKAKEETKEAGSLRSVLNKESHSPFGLDSFNSTAKVSPLTPKLFNSLLLGPTASNNKTEGSSLRDLLHSGPGKLPQTPLDTGIPFPPVFSTSSAGVKSKASLPNFLDHIIASVVENKKTSDASKRACNLTDTQKEVKEMVMGLNVLDPHTSHSWLCDGRLLCLHDPSNKNNWKIFRECWKQGQPVLVSGVHKKLKSELWKPEAFSQEFGDQDVDLVNCRNCAIISDVKVRDFWDGFEIICKRLRSEDGQPMVLKLKDWPPGEDFRDMMPTRFEDLMENLPLPEYTKRDGRLNLASRLPSYFVRPDLGPKMYNAYGLITAEDRRVGTTNLHLDVSDAVNVMVYVGIPIGEGAHDEEVLKTIDEGDADEVTKQRIHDGKEKPGALWHIYAAKDAEKIRELLRKVGEEQGQENPPDHDPIHDQSWYLDQTLRKRLYEEYGVQGWAIVQFLGDAVFIPAGAPHQVHNLYSCIKVAEDFVSPEHVKHCFRLTQEFRHLSNTHTNHEDKLQVKNIIYHAVKDAVGTLKAHESKLARS

SEQ ID NO: 886722 - protein, 1538 aa, Homo sapiens
GAQAAAPLPATGGAALRRWLVVAVGGGGGERRPRVVRREALRADRALGGGGGGRRRAGARVRPAPAMADAAASPVGKRLLLLFADTAASASASAPAAAAASGDPGPALRTRAWRAGTVRAMSGAVPQDLAIFVEFDGCNWKQHSWVKVHAEEVIVLLLEGSLVWAPREDPVLLQGIRVSIAQWPALTFTPLVDKLGLGSVVPVEYLLDRELRFLSDANGLHLFQMGTDSQNQILLEHAALRETVNALISDQKLQEIFSRGPYSVQGHRVKIYQPEGEEGWLYGVVSHQDSITRLMEVSVTESGEIKSVDPRLIHVMLMDNSTPQSEGGTLKAVKSSKGKKKRESIEGKDGRRRKSASDSGCDPASKKLKGDRGEVDSNGSDGGEASRGPWKGGNASGEPGLDQRAKQPPSTFVPQINRNIRFATYTKENGRTLVVQDEPVGGDTPASFTPYSTATGQTPLAPEVGGAENKEAGKTLEQVGQGIVASAAVVTTASSTPNTVRISDTGLAAGTVPEKQKGSRSQASGENSRNSILASSGFGAPLPSSSQPLTFGSGRSQSNGVLATENKPLGFSFGCSSAQEAQKDTDLSKNLFFQCMSQTLPTSNYFTTVSESLADDSSSRDSFKQSLESLSSGLCKGRSVLGTDTKPGSKAGSSVDRKVPAESMPTLTPAFPRSLLNARTPENHENLFLQPPKLSREEPSNPFLAFVEKVEHSPFSSFASQASGSSSSATTVTSKVAPSWPESHSSADSASLAKKKPLFITTDSSKLVSGVLGSALTSGGPSLSAMGNGRSSSPTSSLTQPIEMPTLSSSPTEERPTVGPGQQDNPLLKTFSNVFGRHSGGFLSSPADFSQENKAPFEAVKRFSLDERSLACRQDSDSSTNSDLSDLSDSEEQLQAKTGLKGIPEHLMGKLGPNGERSAELLLGKSKGKQAPKGRPRTAPLKVGQSVLKDVSKVKKLKQSGEPFLQDGSCINVAPHLHKCRECRLERYRKFKEQEQDDSTVACRFFHFRRLIFTRKGVLRVEGFLSPQQSDPDAMNLWIPSSSLAEGIDLETSKYILANVGDQFCQLVMSEKEAMMMVEPHQKVAWKRAVRGVREMCDVCETTLFNIHWVCRKCGFGVCLDCYRLRKSRPRSETEEMGDEEVFSWLKCAKGQSHEPENLMPTQIIPGTALYNIGDMVHAARGKWGIKANCPCISRQNKSVLRPAVTNGMSQLPSINPSASSGNETTFSGGGGPAPVTTPEPDHVPKADSTDIRSEEPLKTDSSASNSNSELKAIRPPCPDTAPPSSALHWLADLATQKAKEETKEAGSLRSVLNKESHSPFGLDSFNSTAKVSPLTPKLFNSLLLGPTASNNKTEGSSLRDLLHSGPGKLPQTPLDTGIPFPPVFSTSSAGVKSKASLPNFLDHIIASVVENKKTSDASKRACNLTDTQKEVKEMVMGLNVLDPHTSHSWLCDGRLLCLHDPSNKNNWKIFRECWKQGQPVLVSGVHKKLKSELWKPEAFSQEFGDQDVDLVNCRNCAIISDVKVRDFWDGFEIICSK

SEQ ID NO: 886723 - protein, 1140 aa, Homo sapiens
GAQAAAPLPATGGAALRRWLVVAVGGGGGERRPRVVRREALRADRALGGGGGGRRRAGARVRPAPAMADAAASPVGKRLLLLFADTAASASASAPAAAAASGDPGPALRTRAWRAGTVRAMSGAVPQDLAIFVEFDGCNWKQHSWVKVHAEEVIVLLLEGSLVWAPREDPVLLQGIRVSIAQWPALTFTPLVDKLGLGSVVPVEYLLDRELRFLSDANGLHLFQMGTDSQNQILLEHAALRETVNALISDQKLQEIFSRGPYSVQGHRVKIYQPEGEEGWLYGVVSHQDSITRLMEVSVTESGEIKSVDPRLIHVMLMDNSTPQSEGGTLKAVKSSKGKKKRESIEGKDGRRRKSASDSGCDPASKKLKGDRGEVDSNGSDGGEASRGPWKGGNASGEPGLDQRAKQPPSTFVPQINRNIRFATYTKENGRTLVVQDEPVGGDTPASFTPYSTATGQTPLAPEVGGAENKEAGKTLEQVGQGIVASAAVVTTASSTPNTVRISDTGLAAGTVPEKQKGSRSQASGENSRNSILASSGFGAPLPSSSQPLTFGSGRSQSNGVLATENKPLGFSFGCSSAQEAQKDTDLSKNLFFQCMSQTLPTSNYFTTVSESLADDSSSRDSFKQSLESLSSGLCKGRSVLGTDTKPGSKAGSSVDRKVPAESMPTLTPAFPRSLLNARTPENHENLFLQPPKLSREEPSNPFLAFVEKVEHSPFSSFASQASGSSSSATTVTSKVAPSWPESHSSADSASLAKKKPLFITTDSSKLVSGVLGSALTSGGPSLSAMGNGRSSSPTSSLTQPIEMPTLSSSPTEERPTVGPGQQDNPLLKTFSNVFGRHSGGFLSSPADFSQENKAPFEAVKRFSLDERSLACRQDSDSSTNSDLSDLSDSEEQLQAKTGLKGIPEHLMGKLGPNGERSAELLLGKSKGKQAPKGRPRTAPLKVGQSVLKDVSKVKKLKQSGEPFLQDGSCINVAPHLHKCRECRLERYRKFKEQEQDDSTVACRFFHFRRLIFTRKGVLRVEGFLSPQQSDPDAMNLWIPSSSLAEGIDLETSKYILANVGDQFCQLVMSEKEAMMMVEPHQKVAWKRAVRGVREMCDVCETTLFNIHWVCRKCGFGVCLDCYRLRKSRPRSETEEIGDV

SEQ ID NO: 886724 - protein, 730 aa, Homo sapiens
GAQAAAPLPATGGAALRRWLVVAVGGGGGERRPRVVRREALRADRALGGGGGGRRRAGARVRPAPAMADAAASPVGKRLLLLFADTAASASASAPAAAAASGDPGPALRTRAWRAGTVRAMSGAVPQDLAIFVEFDGCNWKQHSWVKVHAEEVIVLLLEGSLVWAPREDPVLLQGIRVSIAQWPALTFTPLVDKLGLGSVVPVEYLLDRELRFLSDANGLHLFQMGTDSQNQILLEHAALRETVNALISDQKLQEIFSRGPYSVQGHRVKIYQPEGEEGWLYGVVSHQDSITRLMEVSVTESGEIKSVDPRLIHVMLMDNSTPQSEGGTLKAVKSSKGKKKRESIEGKDGRRRKSASDSGCDPASKKLKGDRGEVDSNGSDGGEASRGPWKGGNASGEPGLDQRAKQPPSTFVPQINRNIRFATYTKENGRTLVVQDEPVGGDTPASFTPYSTATGQTPLAPEVGGAENKEAGKTLEQVGQGIVASAAVVTTASSTPNTVRISDTGLAAGTVPEKQKGSRSQASGENSRNSILASSGFGAPLPSSSQPLTFGSGRSQSNGVLATENKPLGFSFGCSSAQEAQKDTDLSKNLFFQCMSQTLPTSNYFTTVSESLADDSSSRDSFKQSLESLSSGLCKGRSVLGTDTKPGSKAGSSVDRKVPAESMPTCTPAWATERDSISKKKKKKKISLLGWAQCLTPVIPATQGESLEPGRPRSCHCTAARVTEQDSVS

SEQ ID NO: 886725 - protein, 328 aa, Homo sapiens
GAQAAAPLPATGGAALRRWLVVAVGGGGGERRPRVVRREALRADRALGGGGGGRRRAGARVRPAPAMADAAASPVGKRLLLLFADTAASASASAPAAAAASGDPGPALRTRAWRAGTVRAMSGAVPQDLAIFVEFDGCNWKQHSWVKVHAEEVIVLLLEGSLVWAPREDPVLLQGIRVSIAQWPALTFTPLVDKLGLGSVVPVEYLLDRELRFLSDANGLHLFQMGTDSQNQILLEHAALRETVNALISDQKLQEIFSRGPYSVQGHRVKIYQPEGEEGWLYGVVSHQDSITRLMEVSVTESGEIKSVDPRLIHVMLMDNSTPQSEVQ

SEQ ID NO: 886726 - protein, 103 aa, Homo sapiens
AIGSCLHLMTNFSSLPLATVGQSVLKDVSKVKKLKQSGEPFLQDGSCINVAPHLHKCRECRLERYRKFKEQEQDDSTVACRFFHFRRYPNSCFPPLLVFISDT

SEQ ID NO: 886727 - protein, 142 aa, Homo sapiens
EPSNPFLAFVEKVEHSPFSSFASQASGSSSSATTVTSKVAPSWPESHSSADSASLAKKKPLFITTDSSKLVSGVLGSALTSGGPSLSAMGNGRSSSPTSSLTQPIEMPTLSSSPTEERPTVGPGQQDNPLLKTFSNVFGRHS

SEQ ID NO: 886728 - protein, 1827 aa, Homo sapiens; identical to SEQ ID NO: 886721

SEQ ID NO: 886729 - protein, 759 aa, Homo sapiens; identical to SEQ ID NO: 886717

SEQ ID NO: 886730 - protein, 1827 aa, Homo sapiens; identical to SEQ ID NO: 886721

SEQ ID NO: 886731 - protein, 116 aa, Homo sapiens
MRLAPSRLMNPNWQGPRHGETPSSSVKQVFHSQHLTGNGRALCWSRGPSPRASVVSIPNSPATLFYAASTLKVDTGKSYCSHTQFETPSQECHIPILWPFGNPNCLNMAGLSCTFS

SEQ ID NO: 886732 - protein, 1827 aa, Homo sapiens; identical to SEQ ID NO: 886721

SEQ ID NO: 886733 - protein, 1272 aa, Homo sapiens
GAQAAAPLPATGGAALRRWLVVAVGGGGGERRPRVVRREALRADRALGGGGGGRRRAGARVRPAPAMADAAASPVGKRLLLLFADTAASASASAPAAAAASGDPGPALRTRAWRAGTVRAMSGAVPQDLAIFVEFDGCNWKQHSWVKVHAEEVIVLLLEGSLVWAPREDPVLLQGIRVSIAQWPALTFTPLVDKLGLGSVVPVEYLLDRELRFLSDANGLHLFQMGTDSQNQILLEHAALRETVNALISDQKLQEIFSRGPYSVQGHRVKIYQPEGEEGWLYGVVSHQDSITRLMEVSVTESGEIKSVDPRLIHVMLMDNSTPQSEGGTLKAVKSSKGKKKRESIEGKDGRRRKSASDSGCDPASKKLKGDRGEVDSNGSDGGEASRGPWKGGNASGEPGLDQRAKQPPSTFVPQINRNIRFATYTKENGRTLVVQDEPVGGDTPASFTPYSTATGQTPLAPEVGGAENKEAGKTLEQVGQGIVASAAVVTTASSTPNTVRISDTGLAAGTVPEKQKGSRSQASGENSRNSILASSGFGAPLPSSSQPLTFGSGRSQSNGVLATENKPLGFSFGCSSAQEAQKDTDLSKNLFFQCMSQTLPTSNYFTTVSESLADDSSSRDSFKQSLESLSSGLCKGRSVLGTDTKPGSKAGSSVDRKVPAESMPTLTPAFPRSLLNARTPENHENLFLQPPKLSREEPSNPFLAFVEKVEHSPFSSFASQASGSSSSATTVTSKVAPSWPESHSSADSASLAKKKPLFITTDSSKLVSGVLGSALTSGGPSLSAMGNGRSSSPTSSLTQPIEMPTLSSSPTEERPTVGPGQQDNPLLKTFSNVFGRHSGGFLSSPADFSQENKAPFEAVKRFSLDERSLACRQDSDSSTNSDLSDLSDSEEQLQAKTGLKGIPEHLMGKLGPNGERSAELLLGKSKGKQAPKGRPRTAPLKVGQSVLKDVSKVKKLKQSGEPFLQDGSCINVAPHLHKCRECRLERYRKFKEQEQDDSTVACRFFHFRRLIFTRKGVLRVEGFLSPQQSDPDAMNLWIPSSSLAEGIDLETSKYILANVGDQFCQLVMSEKEAMMMVEPHQKVAWKRAVRGVREMCDVCETTLFNIHWVCRKCGFGVCLDCYRLRKSRPRSETEEMGDEEVFSWLKCAKGQSHEPENLMPTQIIPGTALYNIGDMVHAARGKWGIKANCPCISRQNKSVLRPAVTNGMSQLPSINPSASSGNETTFSGGGGPAPVTTPEPDHVPKADSTDIRSEEPLKTDSSASNSNMLGL

SEQ ID NO: 886734 - protein, 222 aa, Homo sapiens
MAQSRDGGNPFAEPSELDNPFQDPAVIQHRPSRQYATLDVYNPFETREPPPAYEPPAPAPLPPPSAPSLQPSRKLSPTEPKNYGSYSTQASAAAATAELLKKQEELNRKAEELDRRERELQHAALGGTATRQNNWPPLPSFCPVQPCFFQDISMEIPQEFQKTVSTMYYLWMCSTLALLLNFLACLASFCVETNNGAGFGAFYPLGPPFHSLLLCLLVPPHV

SEQ ID NO: 886735 - protein, 153 aa, Homo sapiens
MAQALGLSILWVLLFTPCSFVCWYRPMYKAFRSDSSFNFFVFFFIFFVQDVLFVLQAIGIPGWGFSGWISALVVPKGNTAVSVLMLLVALLFTGIAVLGIVMLKRIHSLYRRTGASFQKAQQEFAAGVFSNPAVRTAAANAAAGAAENAFRAP

SEQ ID NO: 886736 - protein, 222 aa, Homo sapiens; identical to SEQ ID NO: 886734

SEQ ID NO: 886737 - protein, 222 aa, Homo sapiens; identical to SEQ ID NO: 886734

SEQ ID NO: 886738 - protein, 222 aa, Homo sapiens; identical to SEQ ID NO: 886734

SEQ ID NO: 886739 - protein, 153 aa, Homo sapiens; identical to SEQ ID NO: 886735

SEQ ID NO: 886740 - protein, 196 aa, Homo sapiens
MAQSRDGGNPFAEPSELDNPFQPPPAYEPPAPAPLPPPSAPSLQPSRKLSPTEPKNYGSYSTQASAAAATAELLKKQEELNRKAEELDRRERELQHAALGGTATRQNNWPPLPSFCPVQPCFFQDISMEIPQEFQKTVSTMYYLWMCSTLALLLNFLACLASFCVETNNGAGFGAFYPLGPPFHSLLLCLLVPPHV

SEQ ID NO: 886741 - protein, 153 aa, Homo sapiens; identical to SEQ ID NO: 886735

SEQ ID NO: 886742 - protein, 208 aa, Homo sapiens
MAQSRDGGNPFAEPSELDNPFQDPAVIQHRPSRQYATLDVYNPFETREPPPAYEPPAPAPLPPPSAPSLQPSRKLSPTEPKNYGSYSTQASAAAATAELLKKQEELNRKAEELDRRERELQHAALGGTAIQPCFFQDISMEIPQEFQKTVSTMYYLWMCSTLALLLNFLACLASFCVETNNGAGFGAFYPLGPPFHSLLLCLLVPPHV

SEQ ID NO: 886743 - protein, 153 aa, Homo sapiens; identical to SEQ ID NO: 886735

SEQ ID NO: 886744 - protein, 153 aa, Homo sapiens; identical to SEQ ID NO: 886735

SEQ ID NO: 886745 - protein, 153 aa, Homo sapiens; identical to SEQ ID NO: 886735

SEQ ID NO: 886746 - protein, 204 aa, Homo sapiens
MAQSRDGGNPFAEPSELDNPFQDPAVIQHRPSRQYATLDVYNPFETREPPPAYEPPAPAPLPPPSAPSLQPSRKLSPTEPKNYGSYSTQASAAAATAELLKKQEELNRKAEELDRRERELQHAALGGTATRQNNWPPLPSFCPVQPCFFQDISMEIPQEFQKTVSTMYYLWMLAGSLLWWCRRATQQYPCSCCWSPCSSLALLC

SEQ ID NO: 886747 - protein, 99 aa, Homo sapiens
SRGGTFVLAFGQDAGATHGCCGDPCGPSGRWNQSVHREAGRTEASEVDSEGYRYRHCCGRGVEGRGPRRPQLQTWLRAETAETRSPSPASLTTPFRTQL

SEQ ID NO: 886748 - protein, 251 aa, Homo sapiens
HCVFAAGVFSNPAVRTAAANAAAEAAVANMAQSRDGGNPFAEPSELDNPFQDPAVIQHRPSRQYATLDVYNPFETREPPPAYEPPAPAPLPPPSAPSLQPSRKLSPTEPKNYGSYSTQASAAAATAELLKKQEELNRKAEELDRRERELQHAALGGTATRQNNWPPLPSFCPVQPCFFQDISMEIPQEFQKTVSTMYYLWMCSTLALLLNFLACLASFCVETNNGAGFGAFYPLGPPFHSLLLCLLVPPHV

SEQ ID NO: 886749 - protein, 222 aa, Homo sapiens; identical to SEQ ID NO: 886734

SEQ ID NO: 886750 - protein, 153 aa, Homo sapiens; identical to SEQ ID NO: 886735

SEQ ID NO: 886751 - protein, 153 aa, Homo sapiens; identical to SEQ ID NO: 886735

SEQ ID NO: 886752 - protein, 222 aa, Homo sapiens; identical to SEQ ID NO: 886734

SEQ ID NO: 886753 - protein, 99 aa, Homo sapiens; identical to SEQ ID NO: 886747

SEQ ID NO: 886754 - protein, 96 aa, Homo sapiens
SRGGTFVLAFGQDAGATHGCCGDPCGPSGRWNQSVHREAGRTEASEVDSEGYRYRHCCGRGVEGRGPRRPQLQTWLRAETAETRSPSPASLTTPFR

SEQ ID NO: 886755 - protein, 339 aa, Homo sapiens
QRTSPWWCTPGLGAQRSGGRPLRSLRAQRPARGSEFDHTQRPASCPQRPLPPRFPCPSLSPARSARRLPLPRSLGSRDGGAVRQAQPPAPMAARRSQRRRGRRGEPGTALLVPLALGLGLALACLGLLLAVVSLGSRASLSAQEPAQEELVAEEDQDPSELNPQTEESQDPAPFLNRLVRPRRSAPKGRKTRARRAIAAHYEVHPRPGQDGAQAGVDGTVSGWEEARINSSSPLRYNRQIGEFIVTRAGLYYLYCQVHFDEGKAVYLKLDLLVDGVLALRCLEEFSATAASSLGPQLRLCQVSGLLALRPGSSLRIRTLPWAHLKAAPFLTYFGLFQVH

SEQ ID NO: 886756 - protein, 224 aa, Homo sapiens
QRTSPWWCTPGLGAQRSGGRPLRSLRAQRPARGSEFDHTQRPASCPQRPLPPRFPCPSLSPARSARRLPLPRSLGSRDGGAVRQAQPPAPMAARRSQRRRGRRGEPGTALLVPLALGLGLALACLGLLLAVVSLGSRASLSAQEPAQEELVAEEDQDPSELNPQTEESQDPAPFLNRLVRPRRSAPKGRKTRARRAIAAHYEVHPRPGQDGAQADGGYTTCLRP

SEQ ID NO: 886757 - protein, 192 aa, Homo sapiens
ARGQAEEDQDPSELNPQTEESQDPAPFLNRLVRPRRSAPKGRKTRARRAIAAHYEVHPRPGQDGAQAGVDGTVSGWEEARINSSSPLRYNRQIGEFIVTRAGLYYLYCQVHFDEGKAVYLKLDLLVDGVLALRCLEEFSATAASSLGPQLRLCQVSGLLALRPGSSLRIRTLPWAHLKAAPFLTYFGLFQVH

SEQ ID NO: 886758 - protein, 339 aa, Homo sapiens; identical to SEQ ID NO: 886755

SEQ ID NO: 886759 - protein, 194 aa, Homo sapiens
MCESAWKRGAVVYRELNPQTEESQDPAPFLNRLVRPRRSAPKGRKTRARRAIAAHYEVHPRPGQDGAQAGVDGTVSGWEEARINSSSPLRYNRQIGEFIVTRAGLYYLYCQVHFDEGKAVYLKLDLLVDGVLALRCLEEFSATAASSLGPQLRLCQVSGLLALRPGSSLRIRTLPWAHLKAAPFLTYFGLFQVH

SEQ ID NO: 886760 - protein, 339 aa, Homo sapiens; identical to SEQ ID NO: 886755

SEQ ID NO: 886761 - protein, 337 aa, Homo sapiens [sequence omitted]

SEQ ID NO: 886762 - protein, 156 aa, Homo sapiens
MGAAGSSALARFVLLAQSRPGWLGVAALGLTAVALGAVAWRRAWPTRRRRLLQQVGTVAQLWIYPVKSCKGVPVSEAECTAMGLRSGNLRDRYGQAPARGSADPARGKGVKTQYPLFLFLIMYKFFSSEIKKLGIFRAHFILLKGAPSIGIYWYAL

SEQ ID NO: 886763 - protein, 259 aa, Homo sapiens
MPGPVLPPAFEVFMFWLVINQEGNMVTARQEPRLVLISLTCDGDTLTLSAAYTKDLLLPIKTPTTNAVHKCRVHGLEIEGRDCGEAAAQWITSFLKSQPYRLVHFEPHMRPRRPHQIADLFRPKDQIAYSDTSPFLILSEASLADLNSRLEKKVKATNFRPNIVISGCDVYAEDSWDELLIGDVELKRVMACSRCILTTVDPDTGVMSRKEPLETLKSYRQCDPSERKLYGKSPLFGQYFVLENPGTIKVGDPVYLLGQ

SEQ ID NO: 886764 - protein, 306 aa, Homo sapiens
MGAAGSSALARFVLLAQSRPGWLGVAALGLTAVALGAVAWRRAWPTRRRRLLQQVGTVAQLWIYPVKSCKGVPVSEAECTAMGLRSGNLRDRFWLVINQEGNMVTARQEPRLVLISLTCDGDTLTLSAAYTKDLLLPIKTPTTNAVHKCRVHGLEIEGRDCGEAAAQWITSFLKSQPYRLVHFEPHMRPRRPHQIADLFRPKDQIAYSDTSPFLILSEASLADLNSRLEKKVKATNFRPNIVISGCDVYAEDSWDELLIGDVELKRVMACSRCILTTVDPDTGVMSRKEPLETLKRESDVHTDPHG

SEQ ID NO: 886765 - protein, 285 aa, Homo sapiens
MGAAGSSALARFVLLAQSRPGWLGVAALGLTAVALGAVAWRRAWPTRRRRLLQQVGTVAQLWIYPVKSCKGVPVSEAECTAMGLRSGNLRDRFWLVINQEGNMVTARQEPRLVLISLTCDGDTLTLSAAYTKDLLLPIKTPTTNAVHKCRVHGLEIEGRDCGEAAAQWITSFLKSQPYRLVHFEPHMRPRRPHQIADLFRPKDQIAYSDTSPFLILSEASLADLNSRLEKKVKATNFRPNIVISGCDVYAEVTLCPFGSFLGFDFFFKIYSALNKCRLLCGGYKC

SEQ ID NO: 886766 - protein, 183 aa, Homo sapiens
MASRAGPRAAGTDGSDFQHRERVAMHYQMSVTLKYEIKKLIYVHLVIWLLLVAKMSVGHLRLLSHDQVAMPYQWEYPYLLSILPSLLGLLSFPRNNISYLVLSMISMGLFSIAPLIYGSMEMFPAAQQLYRHGKAYRFLFGFSAVSIMYLVLVLAVQVHAWQLYYSKKLLDSWFTSTQEKKHK

SEQ ID NO: 886767 - protein, 183 aa, Homo sapiens; identical to SEQ ID NO: 886766

SEQ ID NO: 886768 - protein, 183 aa, Homo sapiens; identical to SEQ ID NO: 886766

SEQ ID NO: 886769 - protein, 129 aa, Homo sapiens
MSVGHLRLLSHDQVAMPYQWEYPYLLSILPSLLGLLSFPRNNISYLVLSMISMGLFSIAPLIYGSMEMFPAAQQLYRHGKAYRFLFGFSAVSIMYLVLVLAVQVHAWQLYYSKKLLDSWFTSTQEKKHK

SEQ ID NO: 886770 - protein, 226 aa, Homo sapiens
MCGSSWMRGCKSSRAVRELVHHVRCLETIAPADSDSLAHGGADVFQDQVERGSDDDDYSSMRCDTIKFVIIEDVTLKYEIKKLIYVHLVIWLLLVAKMSVGHLRLLSHDQVAMPYQWEYPYLLSILPSLLGLLSFPRNNISYLVLSMISMGLFSIAPLIYGSMEMFPAAQQLYRHGKAYRFLFGFSAVSIMYLVLVLAVQVHAWQLYYSKKLLDSWFTSTQEKKHK

SEQ ID NO: 886771 - protein, 172 aa, Homo sapiens
VWTSVMVFSYMVFSYMVFSVTLKYEIKKLIYVHLVIWLLLVAKMSVGHLRLLSHDQVAMPYQWEYPYLLSILPSLLGLLSFPRNNISYLVLSMISMGLFSIAPLIYGSMEMFPAAQQLYRHGKAYRFLFGFSAVSIMYLVLVLAVQVHAWQLYYSKKLLDSWFTSTQEKKHK

SEQ ID NO: 886772 - protein, 129 aa, Homo sapiens; identical to SEQ ID NO: 886769

SEQ ID NO: 886773 - protein, 129 aa, Homo sapiens; identical to SEQ ID NO: 886769

SEQ ID NO: 886774 - protein, 357 aa, Homo sapiens
GAAGLRAGAAGTSSTSSSSSCAAGRVRPGPRRGQSAAASGGGASRARAGRASAACSMHPEPAPPPSRSSPELPPSGGSTTSGSRRSRRRSGDGEPPGAPPPPPSAVTYPDWIGQSYSEVMSLNEHSMQALSWRKLYLSRAKLKASSRTSALLSGFAMVAMVEVQLDADHDYPPGLLIAFSACTTVLVAVHLFALMISTCILPNIEAVSNVHNLNSVKESPHERMHRHIELAWAFSTVIGTLLFLAEVVLLCWVKFLPLKKQPGQPRPTSKPPASGAAANVSTSGITPGQAAAIASTTIMVPFGLIFIVFAVHFYRSLVSHKTDRQFQELNELAEFARLQDQLDHRGDHPLTPGSHYA

SEQ ID NO: 886775 - protein, 342 aa, Homo sapiens
MHPEPAPPPSRSSPELPPSGGSTTSGSRRSRRRSGDGEPPGAPPPPPSAVTYPDWIGQSYSEVMSLNEHSMQALSWRKLYLSRAKLKASSRTSALLSGFAMVSSGRPALPPLLSRLLPPAAPTGLSGRAGRARVREELGETVVAMVEVQLDADHDYPPGLLIAFSACTTVLVAVHLFALMISTCILPNIEAVSNVHNLNSVKESPHERMHRHIELAWAFSTVIGTLLFLAEVVLLCWVKFLPLKKQPGQPRPTSKPPASGAAANVSTSGITPGQAAAIASTTIMVPFGLIFIVFAVHFYRSLVSHKTDRQFQELNELAEFARLQDQLDHRGDHPLTPGSHYA

SEQ ID NO: 886776 - protein, 357 aa, Homo sapiens; identical to SEQ ID NO: 886774

SEQ ID NO: 886777 - protein, 357 aa, Homo sapiens; identical to SEQ ID NO: 886774

SEQ ID NO: 886778 - protein, 245 aa, Homo sapiens
MNGRADFREPNAEVPRPIPHIGPDYIPTEEERRVFAECNDESFWFRSVPLAATSMLITQGLISKGILSSHPKYGSIPKLILACIMGYFAGKLSYVKTCQEKFKKLENSPLGEALRSGQARRSSPPGHYYQKSKYDSSVSGQSSFVTSPAADNIEMLPHYEPIPFSSSMNESAPTGITDHIVQGPDPNLEESPKRKNITYEELRNKNRESYEVSLTQKTDPSVRPMHERVPKKEVKVNKYGDTWDE

SEQ ID NO: 886779 - protein, 245 aa, Homo sapiens; identical to SEQ ID NO: 886778

SEQ ID NO: 886780 - protein, 243 aa, Homo sapiens
FLRSQFDGDSPFFQDQPHIGPDYIPTEEERRVFAECNDESFWFRSVPLAATSMLITQGLISKGILSSHPKYGSIPKLILACIMGYFAGKLSYVKTCQEKFKKLENSPLGEALRSGQARRSSPPGHYYQKSKYDSSVSGQSSFVTSPAADNIEMLPHYEPIPFSSSMNESAPTGITDHIVQGPDPNLEESPKRKNITYEELRNKNRESYEVSLTQKTDPSVRPMHERVPKKEVKVNKYGDTWDE

SEQ ID NO: 886781 - protein, 191 aa, Homo sapiens [sequence omitted]

SEQ ID NO: 886782 - protein, 234 aa, Homo sapiens
LALRPAVRSDVISCRKMNGRADFREPNAEVPRPIPPVPLAATSMLITQGLISKGILSSHPKYGSIPKLILACIMGYFAGKLSYVKTCQEKFKKLENSPLGEALRSGQARRSSPPGHYYQKSKYDSSVSGQSSFVTSPAADNIEMLPHYEPIPFSSSMNESAPTGITDHIVQGPDPNLEESPKRKNITYEELRNKNRESYEVSLTQKTDPSVRPMHERVPKKEVKVNKYGDTWDE

SEQ ID NO: 886783 - protein, 245 aa, Homo sapiens; identical to SEQ ID NO: 886778

SEQ ID NO: 886784 - protein, 245 aa, Homo sapiens; identical to SEQ ID NO: 886778

SEQ ID NO: 886785 - protein, 245 aa, Homo sapiens; identical to SEQ ID NO: 886778

SEQ ID NO: 886786 - protein, 245 aa, Homo sapiens; identical to SEQ ID NO: 886778

SEQ ID NO: 886787 - protein, 194 aa, Homo sapiens
MNGRADFREPNAEVPRPIPHIGPDYIPTEEERRVFAECNDESFWFRSVPLAATSMLITQGLISKGILSSHPKYGSIPKLILACIMGYFAGKLSYVKTCQEKFKKLENSPLGEALRSGQARRSSPPGHYYQKSKYDSSVSGQSSFVTSPAADNIEMLPHYEPIPFSSSMNESAPTGITDHIVQVKVNKYGDTWDE

SEQ ID NO: 886788 - protein, 237 aa, Homo sapiens [sequence omitted]

SEQ ID NO: 886789 - protein, 194 aa, Homo sapiens; identical to SEQ ID NO: 886787

SEQ ID NO: 886790 - protein, 187 aa, Homo sapiens
MNGRADFREPNAEVPRPIPHIGPDYIPTEEERRVFAECNDESFWFRSVPLAATSMLITQGLISKGILSSHPKYGSIPKLILACIMGYFAGKLSYVKTCQEKFKKLENSPLGEALRSGQARRSSPPGHYYQKSKYDSSVSGQSSFVTSPAADNIEMLPHYEPIPFSSSMNESAPTGITDHIVQGRNFS

SEQ ID NO: 886791 - protein, 245 aa, Homo sapiens; identical to SEQ ID NO: 886778

SEQ ID NO: 886792 - protein, 245 aa, Homo sapiens; identical to SEQ ID NO: 886778

SEQ ID NO: 886793 - protein, 245 aa, Homo sapiens; identical to SEQ ID NO: 886778

SEQ ID NO: 886794 - protein, 245 aa, Homo sapiens; identical to SEQ ID NO: 886778

SEQ ID NO: 886795 - protein, 245 aa, Homo sapiens; identical to SEQ ID NO: 886778

SEQ ID NO: 886796 - protein, 245 aa, Homo sapiens; identical to SEQ ID NO: 886778

SEQ ID NO: 886797 - protein, 187 aa, Homo sapiens; identical to SEQ ID NO: 886790

SEQ ID NO: 886798 - protein, 196 aa, Homo sapiens
MNGRADFREPNAEVPRPIPHIGPDYIPTEEERRVFAECNDESFWFRSVPLAATSMLITQGLISKGILSSHPKYGSIPKLILACIMGYFAGKLSYVKTCQEKFKKLENSPLGEALRSGQARRSSPPGHYYQKSKYDSSVSGQSSFVTSPAADNIEMLPHYEPIPFSSSMNESAPTGITDHIVQVKVNKYGDTWDEWS

SEQ ID NO: 886799 - protein, 264 aa, Homo sapiens
MNGRADFREPNAEVPRPIPHIGPDYIPTEEERRVFAECNDESFWFRSVPLAATSMLITQGLISKGILSSHPKYGSIPKLILACIMGYFAGKLSYVKTCQEKFKKLENSPLGEALRSGQARRSSPPGHYYQKSKYDSSVSGQSSFVTSPAADNIEMLPHYEPIPFSSSMNESAPTGITDHIVQGPDPNLEESPKRKNITYEELRNKNRESYEVSLTQKTDPSASQVEREPKKQATWGNGGRKHTGERVNDARGEKKSTTPYRVGD

SEQ ID NO: 886800 - protein, 187 aa, Homo sapiens; identical to SEQ ID NO: 886790

SEQ ID NO: 886801 - protein, 250 aa, Homo sapiens
GRGRRGARRPRRGARRPGGASGGEWRTRRRAAVPACRCSAAVAAPVYPALGTAPSGETVPAMSAAMRERFDRFLHEKNCMTDLLAKLEAKTGVNRSFIALGVIGLVALYLVFGYGASLLCNLIGFGYPAYISIKAIESPNKEDDTQWLTYWVVYGVFSIAEFFSDIFLSWFPFYYMLKCGFLLWCMAPSPSNGAELLYKRIIRPFFLKHESQMDSVVKDLKDKAKETADAITKEAKKATVNLLGEEKKST

SEQ ID NO: 886802 - protein, 250 aa, Homo sapiens; identical to SEQ ID NO: 886801

SEQ ID NO: 886803 - protein, 210 aa, Homo sapiens
GTHVDTSGALGTAPSGETVPAMSAAMRERFDRFLHEKNCMTDLLAKLEAKTGVNRSFIALGVIGLVALYLVFGYGASLLCNLIGFGYPAYISIKAIESPNKEDDTQWLTYWVVYGVFSIAEFFSDIFLSWFPFYYMLKCGFLLWCMAPSPSNGAELLYKRIIRPFFLKHESQMDSVVKDLKDKAKETADAITKEAKKATVNLLGEEKKST

SEQ ID NO: 886804 - protein, 250 aa, Homo sapiens; identical to SEQ ID NO: 886801

SEQ ID NO: 886805 - protein, 69 aa, Homo sapiens
GTHVDTSGALGTAPSGETVPAMSAAMRERFDRFLHEKNCMTDLLAKLEVSSDWWPCTWCSVMEPLSSAT

SEQ ID NO: 886806 - protein, 242 aa, Homo sapiens
GRGLGKGGVGDRRDKQHIQGSGWPPGKRGHRRTPRGLPRLRVAGLEGSCGAGRWQLEGPALTYVCPAAGALFLLSCAVGADGGAPAGGRVDGGVIGLVALYLVFGYGASLLCNLIGFGYPAYISIKAIESPNKEDDTQWLTYWVVYGVFSIAEFFSDIFLSWFPFYYMLKCGFLLWCMAPSPSNGAELLYKRIIRPFFLKHESQMDSVVKDLKDKAKETADAITKEAKKATVNLLGEEKKST

SEQ ID NO: 886807 - protein, 167 aa, Homo sapiens
VFNLLITTIFRSSANLFGVIGLVALYLVFGYGASLLCNLIGFGYPAYISIKAIESPNKEDDTQWLTYWVVYGVFSIAEFFSDIFLSWFPFYYMLKCGFLLWCMAPSPSNGAELLYKRIIRPFFLKHESQMDSVVKDLKDKAKETADAITKEAKKATVNLLGEEKKST

SEQ ID NO: 886808 - protein, 250 aa, Homo sapiens; identical to SEQ ID NO: 886801

SEQ ID NO: 886809 - protein, 250 aa, Homo sapiens; identical to SEQ ID NO: 886801

SEQ ID NO: 886810 - protein, 250 aa, Homo sapiens; identical to SEQ ID NO: 886801

SEQ ID NO: 886811 - protein, 250 aa, Homo sapiens; identical to SEQ ID NO: 886801

SEQ ID NO: 886812 - protein, 250 aa, Homo sapiens; identical to SEQ ID NO: 886801

SEQ ID NO: 886813 - protein, 199 aa, Homo sapiens
GRGRRGARRPRRGARRPGGASGGEWRTRRRAAVPACRCSAAVAAPVYPALGTAPSGETVPAMSAAMRERFDRFLHEKNCMTDLLAKLEAKTGVNRSFIALGVIGLVALYLVFGYGASLLCNLIGFGYPAYISIKAIESPNKEDDTQWLTYWVVYGVFSIAEFFSDIFLSWFPFYYMLKQIYLEPPCARFCSTSGRYFGE

SEQ ID NO: 886814 - protein, 192 aa, Homo sapiens
GRGRRGARRPRRGARRPGGASGGEWRTRRRAAVPACRCSAAVAAPVYPALGTAPSGETVPAMSAAMRERFDRFLHEKNCMTDLLAKLEAKTGVNRSFIALGVIGLVALYLVFGYGASLLCNLIGFGYPAYISIKAIESPNKEDDTQWLTYWVVYGVFSIAEFFSDIFLSWFPFYYMLKVWSGLGFLLPRCLL

SEQ ID NO: 886815 - protein, 593 aa, Homo sapiens
MWCLLRGLGRPGALARGALGQQQSLGARALASAGSESRDEYSYVVVGAGSAGCVLAGRLTEDPAERVLLLEAGPKDVRAGSKRLSWKIHMPAALVANLCDDRYNWCYHTEVQRGLDGRVLYWPRGRVWGGSSSLNAMVYVRGHAEDYERWQRQGARGWDYAHCLPYFRKAQGHELGASRYRGADGPLRVSRGKTNHPLHCAFLEATQQAGYPLTEDMNGFQQEGFGWMDMTIHEGKRWSAACAYLHPALSRTNLKAEAETLVSRVLFEGTRAVGVEYVKNGQSHRAYASKEVILSGGAINSPQLLMLSGIGNADDLKKLGIPVVCHLPGVGQNLQDHLEIYIQQACTRPITLHSAQKPLRKVCIGLEWLWKFTGEGATAHLETGGFIRSQPGVPHPDIQFHFLPSQVIDHGRVPTQQEAYQVHVGPMRGTSVGWLKLRSANPQDHPVIQPYLSTETDIEDFRLCVKLTREIFAQEALAPFRGKELQPGSHIQSDKEIDAFVRAKADSAYHPSCTCKMGQPSDPTAVVDPQTRVLGVENLRVVDASIMPSMVSGNLNAPTIMIAEKAADIIKGQPALWDKDVPVYKPRTLATQR

SEQ ID NO: 886816 - protein, 593 aa, Homo sapiens; identical to SEQ ID NO: 886815

SEQ ID NO: 886817 - protein, 593 aa, Homo sapiens; identical to SEQ ID NO: 886815

SEQ ID NO: 886818 - protein, 593 aa, Homo sapiens; identical to SEQ ID NO: 886815

SEQ ID NO: 886819 - protein, 593 aa, Homo sapiens
MWCLLRGLGRPGALARGALGQQQSLGARALASAGSESRDEYSYVVVGAGSAGCVLAGRLTEDPAERVLLLEAGPKDVRAGSKRLSWKIHMPAALVANLCDDRYNWCYHTEVQRGLDGRVLYWPRGRVWGGSSSLNAMVYVRGHAEDYERWQRQGARGWDYAHCLPYFRKAQGHELGASRYRGADGPLRVSRGKTNHPLHCAFLEATQQAGYPLTEDMNGFQQEGFGWMDMTIHEGKRWSAACAYLHPALSRTNLKAEAETLVSRVLFEGTRAVGVEYVKNGQSHRAYASKEVILSGGAINSPQLLMLSGIGNADDLKKLGIPVVCHLPGVGQNLQDHLEIYIQQACTRPITLHSAQKPLRKVCIGLEWLWKFTGEGATAHLETGGFIRSQPGVPHPDIQFHFLPSQVIDHGRVPTQQEAYQVHVGPMRGTSVGWLKLRSANPQDHPVISPYLSTETDIEDFRLCVKLTREIFAQEALAPFRGKELQPGSHIQSDKEIDAFVRAKADSAYHPSCTCKMGQPSDPTAVVDPQTRVLGVENLRVVDASIMPSMVSGNLNAPTIMIAEKAADIIKGQPALWDKDVPVYKPRTLATQR

SEQ ID NO: 886820 - protein, 593 aa, Homo sapiens; identical to SEQ ID NO: 886815

SEQ ID NO: 886821 - protein, 575 aa, Homo sapiens
MWCLLRGLGRPGALARGALGQQQSLGARALASAGSESRDEYSYVVVGAGSAGCVLAGRLTEDPAERVLLLEAGPKDVRAGSKRLSWKIHMPAALVANLCDDRYNWCYHTEVQRGLDGRVLYWPRGRVWGGSSSLNAMVYVRGHAEDYERWQRQGARGWDYAHCLPYFRKAQGHELGASRYRGADGPLRVSRGKTNHPLHCAFLEATQQAGYPLTEDMNGFQQEGFGWMDMTIHEGKRWSAACAYLHPALSRTNLKAEAETLVSRVLFEGTRAVGVEYVKNGQSHRLLMLSGIGNADDLKKLGIPVVCHLPGVGQNLQDHLEIYIQQACTRPITLHSAQKPLRKVCIGLEWLWKFTGEGATAHLETGGFIRSQPGVPHPDIQFHFLPSQVIDHGRVPTQQEAYQVHVGPMRGTSVGWLKLRSANPQDHPVIQPYLSTETDIEDFRLCVKLTREIFAQEALAPFRGKELQPGSHIQSDKEIDAFVRAKADSAYHPSCTCKMGQPSDPTAVVDPQTRVLGVENLRVVDASIMPSMVSGNLNAPTIMIAEKAADIIKGQPALWDKDVPVYKPRTLATQR

SEQ ID NO: 886822 - protein, 2347 aa, Homo sapiens
MKNIYCLIPKLVNFATLGCLWISVVQCTVLNSCLKSCVTNLGQQLDLGTPHNLSEPCIQGCHFWNSVDQKNCALKCRESCEVGCSSAEGAYEEEVLENADLPTAPFASSIGSHNMTLRWKSANFSGVKYIIQWKYAQLLGSWTYTKTVSRPSYVVKPLHPFTEYIFRVVWIFTAQLQLYSPPSPSYRTHPHGVPETAPLIRNIESSSPDTVEVSWDPPQFPGGPILGYNLRLISKNQKLDAGTQRTSFQFYSTLPNTIYRFSIAAVNEVGEGPEAESSITTSSSAVQQEEQWLFLSRKTSLRKRSLKHLVDEAHCLRLDAIYHNITGISVDVHQQIVYFSEGTLIWAKKAANMSDVSDLRIFYRGSGLISSISIDWLYQRMYFIMDELVCVCDLENCSNIEEITPPSISAPQKIVADSYNGYVFYLLRDGIYRADLPVPSGRCAEAVRIVESCTLKDFAIKPQAKRIIYFNDTAQVFMSTFLDGSASHLILPRIPFADVKSFACENNDFLVTDGKVIFQQDALSFNEFIVGCDLSHIEEFGFGNLVIFGSSSQLHPLPGRPQELSVLFGSHQALVQWKPPALAIGANVILISDIIELFELGPSAWQNWTYEVKVSTQDPPEVTHIFLNISGTMLNVPELQSAMKYKVSVRASSPKRPGPWSEPSVGTTLVPASEPPFIMAVKEDGLWSKPLNSFGPGEFLSSDIGNVSDMDWYNNSLYYSDTKGDVFVWLLNGTDISENYHLPSIAGAGALAFEWLGHFLYWAGKTYVIQRQSVLTGHTDIVTHVKLLVNDMVVDSVGGYLYWTTLYSVESTRLNGESSLVLQTQPWFSGKKVIALTLDLSDGLLYWLVQDSQCIHLYTAVLRGQSTGDTTITEFAAWSTSEISQNALMYYSGRLFWINGFRIITTQEIGQKTSVSVLEPARFNQFTIIQTSLKPLPGNFSFTPKVIPDSVQESSFRIEGNASSFQILWNGPPAVDWGVVFYSVEFSAHSKFLASEQHSLPVFTVEGLEPYALFNLSVTPYTYWGKGPKTSLSLRAPETVPSAPENPRIFILPSGKCCNKNEVVVEFRWNKPKHENGVLTKFEIFYNISNQSITNKTCEDWIAVNVTPSVMSFQLEGMSPRCFIAFQVRAFTSKGPGPYADVVKSTTSEINPFPHLITLLGNKIVFLDMDQNQVVWTFSAERVISAVCYTADNEMGYYAEGDSLFLLHLHNRSSSELFQDSLVFDITVITIDWISRHLYFALKESQNGMQVFDVDLEHKVKYPREVKIHNRNSTIISFSVYPLLSRLYWTEVSNFGYQMFYYSIISHTLHRILQPTATNQQNKRNQCSCNVTEFELSGAMAIDTSNLEKPLIYFAKAQEIWAMDLEGCQCWRVITVPAMLAGKTLVSLTVDGDLIYWIITAKDSTQIYQAKKGNGAIVSQVKALRSRHILAYSSVMQPFPDKAFLSLASDTVEPTILNATNTSLTIRLPLAKTNLTWYGITSPTPTYLVYYAEVNDRKNSSDLKYRILEFQDSIALIEDLQPFSTYMIQIAVKNYYSDPLEHLPPGKEIWGKTKNGVPEAVQLINTTVRSDTSLIISWRESHKPNGPKESVRYQLAISHLALIPETPLRQSEFPNGRLTLLVTRLSGGNIYVLKVLACHSEEMWCTESHPVTVEMFNTPEKPYSLVPENTSLQFNWKAPLNVNLIRFWVELQKWKYNEFYHVKTSCSQGPAYVCNITNLQPYTSYNVRVVVVYKTGENSTSLPESFKTKAGVPNKPGIPKLLEGSKNSIQWEKAEDNGCRITYYILEIRKSTSNNLQNQNLRWKMTFNGSCSSVCTWKSKNLKGIFQFRVVAANNLGFGEYSGISENIILVGDDFWIPETSFILTIIVGIFLVVTIPLTFVWHRRLKNQKSAKEGVTVLINEDKELAELRGLAAGVGLANACYAIHTLPTQEEIENLPAFPREKLTLRLLLGSGAFGEVYEGTAVDILGVGSGEIKVAVKTLKKGSTDQEKIEFLKEAHLMSKFNHPNILKQLGVCLLNEPQYIILELMEGGDLLTYLRKARMATFYGPLLTLVDLVDLCVDISKGCVYLERMHFIHRDLAARNCLVSVKDYTSPRIVKIGDFGLARDIYKNDYYRKRGEGLLPVRWMAPESLMDGIFTTQSDVWSFGILIWEILTLGHQPYPAHSNLDVLNYVQTGGRLEPPRNCPDDLWNLMTQCWAQEPDQRPTFHRIQDQLQLFRNFFLNSIYKSRDEANNSGVINESFEGEDGDVICLNSDDIMPVALMETKNREGLNYMVLATECGQGEEKSEGPLGSQESESCGLRKEEKEPHADKDFCQEKQVAYCPSGKPEGLNYACLTHSGYGDGSD

SEQ ID NO: 886823 - protein, 187 aa, Homo sapiens
EFYVLILLLLVLLEKTFVYTTQQCIENLPAFPREKLTLRLLLGSGAFGEVYEGTAVDILGVGSGEIKVAVKTLKKGSTDQEKIEFLKEAHLMSKFNHPNILKQLGVCLLNEPQYIILELMEGGDLLTYLRKARMATFYGPLLTLVDLVDLCVDISKGCVYLERMHFIHRDLAVCNRLFSAKFFPIPV

SEQ ID NO: 886824 - protein, 1790 aa, Homo sapiens
MKNIYCLIPKLVNFATLGCLWISVVQCTVLNSCLKSCVTNLGQQLDLGTPHNLSEPCIQGCHFWNSVDQKNCALKCRESCEVGCSSAEGAYEEEVLENADLPTAPFASSIGSHNMTLRWKSANFSGVKYIIQWKYAQLLGSWTYTKTVSRPSYVVKPLHPFTEYIFRVVWIFTAQLQLYSPPSPSYRTHPHGVPETAPLIRNIESSSPDTVEVSWDPPQFPGGPILGYNLRLISKNQKLDAGTQRTSFQFYSTLPNTIYRFSIAAVNEVGEGPEAESSITTSSSAVQQEEQWLFLSRKTSLRKRSLKHLVDEAHCLRLDAIYHNITGISVDVHQQIVYFSEGTLIWAKKAANMSDVSDLRIFYRGSGLISSISIDWLYQRMYFIMDELVCVCDLENCSNIEEITPPSISAPQKIVADSYNGYVFYLLRDGIYRADLPVPSGRCAEAVRIVESCTLKDFAIKPQAKRIIYFNDTAQVFMSTFLDGSASHLILPRIPFADVKSFACENNDFLVTDGKVIFQQDALSFNEFIVGCDLSHIEEFGFGNLVIFGSSSQLHPLPGRPQELSVLFGSHQALVQWKPPALAIGANVILISDIIELFELGPSAWQNWTYEVKVSTQDPPEVTHIFLNISGTMLNVPELQSAMKYKVSVRASSPKRPGPWSEPSVGTTLVPASEPPFIMAVKEDGLWSKPLNSFGPGEFLSSDIGNVSDMDWYNNSLYYSDTKGDVFVWLLNGTDISENYHLPSIAGAGALAFEWLGHFLYWAGKTYVIQRQSVLTGHTDIVTHVKLLVNDMVVDSVGGYLYWTTLYSVESTRLNGESSLVLQTQPWFSGKKVIALTLDLSDGLLYWLVQDSQCIHLYTAVLRGQSTGDTTITEFAAWSTSEISQNALMYYSGRLFWINGFRIITTQEIGQKTSVSVLEPARFNQFTIIQTSLKPLPGNFSFTPKVIPDSVQESSFRIEGNASSFQILWNGPPAVDWGVVFYSVEFSAHSKFLASEQHSLPVFTVEGLEPYALFNLSVTPYTYWGKGPKTSLSLRAPETVPSAPENPRIFILPSGKCCNKNEVVVEFRWNKPKHENGVLTKFEIFYNISNQSITNKTCEDWIAVNVTPSVMSFQLEGMSPRCFIAFQVRAFTSKGPGPYADVVKSTTSEINPFPHLITLLGNKIVFLDMDQNQVVWTFSAERVISAVCYTADNEMGYYAEGDSLFLLHLHNRSSSELFQDSLVFDITVITIDWISRHLYFALKESQNGMQVFDVDLEHKVKYPREVKIHNRNSTIISFSVYPLLSRLYWTEVSNFGYQMFYYSIISHTLHRILQPTATNQQNKRNQCSCNVTEFELSGAMAIDTSNLEKPLIYFAKAQEIWAMDLEGCQCWRVITVPAMLAGKTLVSLTVDGDLIYWIITAKDSTQIYQAKKGNGAIVSQVKALRSRHILAYSSVMQPFPDKAFLSLASDTVEPTILNATNTSLTIRLPLAKTNLTWYGITSPTPTYLVYYAEVNDRKNSSDLKYRILEFQDSIALIEDLQPFSTYMIQIAVKNYYSDPLEHLPPGKEIWGKTKNGVPEAVQLINTTVRSDTSLIISWRESHKPNGPKESVRYQLAISHLALIPETPLRQSEFPNGRLTLLVTRLSGGNIYVLKVLACHSEEMWCTESHPVTVEMFNTPEKPYSLVPENTSLQFNWKAPLNVNLIRFWVELQKWKYNEFYHVKTSCSQGPAYVCNITNLQPYTSYNVRVVVVYKTGENSTSLPESFKTKAGVPNKPGIPKLLEGSKNSIQWEKAEDNGCRITYYILEIRD

SEQ ID NO: 886825 - protein, 213 aa, Homo sapiens
MAITQFRLFKFCTCLATVFSFLKRLICRSGRGRKLSGDQITLPTTVDYSSVPKQTDVEEWTSWDEDAPTSVKIEGGNGNVATQQNSLEQLEPDYFKDMTPTIRKTQKIVIKKREPLNFGIPDGSTGFSSRLAATQDLPFIHQSSELGDLDTWQENTNAWEEEEDAAWQAEEVLRQQKLADREKRAAEQQRKKMEKEAQRLMKKEQNKIGVKLS

SEQ ID NO: 886826 - protein, 213 aa, Homo sapiens; identical to SEQ ID NO: 886825

SEQ ID NO: 886827 - protein, 153 aa, Homo sapiens
MAITQFRLFKFCTCLATVFSFLKRLICRSGRGRKLSGDQITLPTTVDYSSVPKQTDVEEWTSWDEDAPTSVKIEGGNGNVATQQNSLEQLEPDYFKDMTPTIRKTQKIVIKKREPLNFGIPDGSTGFSSRLAATQDLPFIHQSTSHWVGATII

SEQ ID NO: 886828 - protein, 213 aa, Homo sapiens; identical to SEQ ID NO: 886825

SEQ ID NO: 886829 - protein, 213 aa, Homo sapiens; identical to SEQ ID NO: 886825

SEQ ID NO: 886830 - protein, 119 aa, Homo sapiens
MVKMTRSKTFQAYLPSCHRTYSCIHCRAHLANHDELISKSFQGSQGRAYLFNSVVNVGCGPAEERVLLTGLHAVADIYCENCKTTLGWKYEHAFESSQKYKEGKYIIELAHMIKDNGWD

SEQ ID NO: 886831 - protein, 111 aa, Homo sapiens
GRGGGGDCGFKSVPGARAPAGPRFAAAHPSGAKPHAGRTGPPVAGLLRTSPRPLREGSSAEDITSVWSLPHPPAAKPRPLPVSSGVSRATHPVGVPRGLPQSSPHTQQHQW

SEQ ID NO: 886832 - protein, 119 aa, Homo sapiens; identical to SEQ ID NO: 886830

SEQ ID NO: 886833 - protein, 126 aa, Homo sapiens
DVTGCALQYRGRKMASATRLIQRLRNWASGHDLQGKLQLRYQEISKRTQPPPKLPVGPSHKLSNNYYCTRDGRRESVPPSIIMSSQKALVSGKPAESSAVAATEKKAVTPAPPIKRWELSSDQPYL

SEQ ID NO: 886834 - protein, 126 aa, Homo sapiens; identical to SEQ ID NO: 886833

SEQ ID NO: 886835 - protein, 126 aa, Homo sapiens
INAEWPLWGGGRKMASATRLIQRLRNWASGHDLQGKLQLRYQEISKRTQPPPKLPVGPSHKLSNNYYCTRDGRRESVPPSIIMSSQKALVSGKPAESSAVAATEKKAVTPAPPIKRWELSSDQPYL

SEQ ID NO: 886836 - protein, 119 aa, Homo sapiens
RRLGSERVGVARLIQRLRNWASGHDLQGKLQLRYQEISKRTQPPPKLPVGPSHKLSNNYYCTRDGRRESVPPSIIMSSQKALVSGKPAESSAVAATEKKAVTPAPPIKRWELSSDQPYL

SEQ ID NO: 886837 - protein, 131 aa, Homo sapiens
MAWAVEVREGMAEGYGWRSPRVLIRTVCEVTGRPCHDLQGKLQLRYQEISKRTQPPPKLPVGPSHKLSNNYYCTRDGRRESVPPSIIMSSQKALVSGKPAESSAVAATEKKAVTPAPPIKRWELSSDQPYL

SEQ ID NO: 886838 - protein, 110 aa, Homo sapiens
ARSRPASSNLARSVHDLQGKLQLRYQEISKRTQPPPKLPVGPSHKLSNNYYCTRDGRRESVPPSIIMSSQKALVSGKPAESSAVAATEKKAVTPAPPIKRWELSSDQPYL

SEQ ID NO: 886839 - protein, 97 aa, Homo sapiens
YYYEIRGRVDYYQEISKRTQPPPKLPVGPSHKLSNNYYCTRDGRRESVPPSIIMSSQKALVSGKPAESSAVAATEKKAVTPAPPIKRWELSSDQPYL

SEQ ID NO: 886840 - protein, 157 aa, Homo sapiens
MHIRTHSPQMSYTYPCTLHTHHATHIYRHYTIHTYKAHTYTYHNTDTAHIIRPGMHTWAYGHDLQGKLQLRYQEISKRTQPPPKLPVGPSHKLSNNYYCTRDGRRESVPPSIIMSSQKALVSGKPAESSAVAATEKKAVTPAPPIKRWELSSDQPYL

SEQ ID NO: 886841 - protein, 126 aa, Homo sapiens; identical to SEQ ID NO: 886833

SEQ ID NO: 886842 - protein, 126 aa, Homo sapiens; identical to SEQ ID NO: 886833

SEQ ID NO: 886843 - protein, 126 aa, Homo sapiens; identical to SEQ ID NO: 886833

SEQ ID NO: 886844 - protein, 89 aa, Homo sapiens
INAEWPLWGGGRKMASATRLIQRLRNWASGHDLQGKLQLRYQEISKRRNGVSPCWPVWSRTPDLIIRLPRPPKVLGLQNSASSQAPCGS

SEQ ID NO: 886845 - protein, 111 aa, Homo sapiens
MSVGPRSHPGRLHNLALRVKTLRAESYQEISVTQPPPKLPVGPSHKLSNNYYCTRDGRRESVPPSIIMSSQKALVSGKPAESSAVAATEKKAVTPAPPIKRWELSSDQPYL

SEQ ID NO: 886846 - protein, 188 aa, Homo sapiens
MTAPSCAFPVQFRQPSVSGLSQITKSLYISNGVAANNKLMLSSNQITMVINVSVEVVNTLYEDIQYMQVPVADSPNSRLCDFFDPIADHIHSVEMKQGRTLLHCAAGVSRSAALCLAYLMKYHAMSLLDAHTWTKSCRPIIRPNSGFWEQLIHYEFQLFGKNTVHMVSSPVGMIPDIYEKEVRLMIPL

SEQ ID NO: 886847 - protein, 121 aa, Homo sapiens [sequence omitted]

SEQ ID NO: 886848 - protein, 188 aa, Homo sapiens; identical to SEQ ID NO: 886846

SEQ ID NO: 886849 - protein, 188 aa, Homo sapiens; identical to SEQ ID NO: 886846

SEQ ID NO: 886850 - protein, 188 aa, Homo sapiens; identical to SEQ ID NO: 886846

SEQ ID NO: 886851 - protein, 133 aa, Homo sapiens
VERKQGGWSFLEPEGEGSDAEEGDSESEIEDETFNPSEDDYEEEEEDSDEDYSSEAEESDYSKESLGSEEESGKDWDELEEEARKADRESRYEEEEEQSRSMSRKRKASVHSSGRGSNRGSRHSSAPPKKKRK

SEQ ID NO: 886852 - protein, 1047 aa, Homo sapiens
MAVTLDKDAYYRRVKRLYSNWRKGEDEYANVDAIVVSVGVDEEIVYAKSTALQTWLFGYELTDTIMVFCDDKIIFMASKKKVEFLKQIANTKGNENANGAPAITLLIREKNESNKSSFDKMIEAIKESKNGKKIGVFSKDKFPGEFMKSWNDCLNKEGFDKIDISAVVAYTIAVKEDGELNLMKKAASITSEVFNKFFKERVMEIVDADEKVRHSKLAESVEKAIEEKKYLAGADPSTVEMCYPPIIQSGGNYNLKFSVVSDKNHMHFGAITCAMGIRFKSYCSNLVRTLMVDPSQEVQENYNFLLQLQEELLKELRHGVKICDVYNAVMDVVKKQKPELLNKITKNLGFGMGIEFREGSLVINSKNQYKLKKGMVFSINLGFSDLTNKEGKKPEEKTYALFIGDTVLVDEDGPATVLTSVKKKVKNVGIFLKNEDEEEEEEEKDEAEDLLGRGSRAALLTERTRNEMTAEEKRRAHQKELAAQLNEEAKRRLTEQKGEQQIQKARKSNVSYKNPSLMPKEPHIREMKIYIDKKYETVIMPVFGIATPFHIATIKNISMSVEGDYTYLRINFYCPGSALGRNEGNIFPNPEATFVKEITYRASNIKAPGEQTVPALNLQNAFRIIKEVQKRYKTREAEEKEKEGIVKQDSLVINLNRSNPKLKDLYIRPNIAQKRMQGSLEAHVNGFRFTSVRGDKVDILYNNIKHALFQPCDGEMIIVLHFHLKNAIMFGKKRHTDVQFYTEVGEITTDLGKHQHMHDRDDLYAEQMEREMRHKLKTAFKNFIEKVEALTKEELEFEVPFRDLGFNGAPYRSTCLLQPTSSALVNATEWPPFVVTLDEVELIHFERVQFHLKNFDMVIVYKDYSKKVTMINAIPVASLDPIKEWLNSCDLKYTEGVQSLNWTKIMKTIVDDPEGFFEQGGWSFLEPEGEGSDAEEGDSESEIEDETFNPSEDDYEEEEEDSDEDYSSEAEESDYSKESLGSEEESGKDWDELEEEARKADRESRYEEEEEQSRSMSRKRKASVHSSGRGSNRGSRHSSAPPKKKRK

SEQ ID NO: 886853 - protein, 1047 aa, Homo sapiens; identical to SEQ ID NO: 886852

SEQ ID NO: 886854 - protein, 1047 aa, Homo sapiens; identical to SEQ ID NO: 886852

SEQ ID NO: 886855 - protein, 1024 aa, Homo sapiens
GVQRIPLFSFFMSYQGCDEEDVYAKSTALQTWLFGYELTDTIMVFCDDKIIFMASKKKVEFLKQIANTKGNENANGAPAITLLIREKNESNKSSFDKMIEAIKESKNGKKIGVFSKDKFPGEFMKSWNDCLNKEGFDKIDISAVVAYTIAVKEDGELNLMKKAASITSEVFNKFFKERVMEIVDADEKVRHSKLAESVEKAIEEKKYLAGADPSTVEMCYPPIIQSGGNYNLKFSVVSDKNHMHFGAITCAMGIRFKSYCSNLVRTLMVDPSQEVQENYNFLLQLQEELLKELRHGVKICDVYNAVMDVVKKQKPELLNKITKNLGFGMGIEFREGSLVINSKNQYKLKKGMVFSINLGFSDLTNKEGKKPEEKTYALFIGDTVLVDEDGPATVLTSVKKKVKNVGIFLKNEDEEEEEEEKDEAEDLLGRGSRAALLTERTRNEMTAEEKRRAHQKELAAQLNEEAKRRLTEQKGEQQIQKARKSNVSYKNPSLMPKEPHIREMKIYIDKKYETVIMPVFGIATPFHIATIKNISMSVEGDYTYLRINFYCPGSALGRNEGNIFPNPEATFVKEITYRASNIKAPGEQTVPALNLQNAFRIIKEVQKRYKTREAEEKEKEGIVKQDSLVINLNRSNPKLKDLYIRPNIAQKRMQGSLEAHVNGFRFTSVRGDKVDILYNNIKHALFQPCDGEMIIVLHFHLKNAIMFGKKRHTDVQFYTEVGEITTDLGKHQHMHDRDDLYAEQMEREMRHKLKTAFKNFIEKVEALTKEELEFEVPFRDLGFNGAPYRSTCLLQPTSSALVNATEWPPFVVTLDEVELIHFERVQFHLKNFDMVIVYKDYSKKVTMINAIPVASLDPIKEWLNSCDLKYTEGVQSLNWTKIMKTIVDDPEGFFEQGGWSFLEPEGEGSDAEEGDSESEIEDETFNPSEDDYEEEEEDSDEDYSSEAEESDYSKESLGSEEESGKDWDELEEEARKADRESRYEEEEEQSRSMSRKRKASVHSSGRGSNRGSRHSSAPPKKKRK

SEQ ID NO: 886856 - protein, 173 aa, Homo sapiens
SEARGEKLARYEASCDLKYTEGVQSLNWTKIMKTIVDDPEGFFEQGGWSFLEPEGEGSDAEEGDSESEIEDETFNPSEDDYEEEEEDSDEDYSSEAEESDYSKESLGSEEESGKDWDELEEEARKADRESRYEEEEEQSRSMSRKRKASVHSSGRGSNRGSRHSSAPPKKKRK

SEQ ID NO: 886857 - protein, 1019 aa, Homo sapiens
MAVTLDKDAYYRRVKRLYSNWRKGEDEYANVDAIVVSVGVDEEIVYAKSTALQTWLFGYELTDTIMVFCDDKIIFMASKKKVEFLKQIANTKGNENANGAPAITLLIREKNESNKSSFDKMIEAIKESKNGKKIGVFSKDKFPGEFMKSWNDCLNKEGFDKIDISAVVAYTIAVKEDGELNLMKKAASITSEVFNKFFKERVMEIVDADEKVRHSKLAESVEKAIEEKKYLAGADPSTVEMCYPPIIQSGGNYNLKFSVVSDKNHMHFGAITCAMGIRFKSYCSNLVRTLMVDPSQEVQENYNFLLQLQEELLKELRHGVKICDVYNAVMDVVKKQKPELLNKITKNLGFGMGIEFREGSLVINSKNQYKLKKGMVFSINLGFSDLTNKEGKKPEEKTYALFIGDTVLVDEDGPATVLTSVKKKVKNVGIFLKNEDEEEEEEEKDEAEDLLGRGSRAALLTERTRNEMTAEEKRRAHQKELAAQLNEEAKRRLTEQKGEQQIQKARKSNVSYKNPSLMPKEPHIREMKIYIDKKYETVIMPVFGIATPFHIATIKNISMSVEGDYTYLRINFYCPGSALGRNEGNIFPNPEATFVKEITYRASNIKAPGEQTVPALNLQNAFRIIKEVQKRYKTREAEEKEKEGIVKQDSLVINLNRSNPKLKDLYIRPNIAQKRMQGSLEAHVNGFRFTSVRGDKVDILYNNIKHALFQPCDGEMIIVLHFHLKNAIMFGKKRHTDVQFYTEVGEITTDLGKHQHMHDRDDLYAEQMEREMRHKLKTAFKNFIEKVEALTKEELEFEVPFRDLGFNGAPYRSTCLLQPTSSALVNATEWPPFVVTLDEVELIHFERVQFHLKNFDMVIVYKDYSKKVTMINAIPVASLDPIKEWLNSCDLKYTEGVQSLNWTKIMKTIVDDPEGFFEQGGWSFLEPEGEGSDAEEGDSESEIEDETFNPSEDDYEEEEEDSDEDYSSEAEESDYSKESLGSEEESGKDWDELEEEARKADRESRYEEDAGTGFKKQEL

SEQ ID NO: 886858 - protein, 766 aa, Homo sapiens
MAVTLDKDAYYRRVKRLYSNWRKGEDEYANVDAIVVSVGVDEEIVYAKSTALQTWLFGYELTDTIMVFCDDKIIFMASKKKVEFLKQIANTKGNENANGAPAITLLIREKNESNKSSFDKMIEAIKESKNGKKIGVFSKDKFPGEFMKSWNDCLNKEGFDKIDISAVVAYTIAVKEDGELNLMKKAASITSEVFNKFFKERVMEIVDADEKVRHSKLAESVEKAIEEKKYLAGADPSTVEMCYPPIIQSGGNYNLKFSVVSDKNHMHFGAITCAMGIRFKSYCSNLVRTLMVDPSQEVQENYNFLLQLQEELLKELRHGVKICDVYNAVMDVVKKQKPELLNKITKNLGFGMGIEFREGSLVINSKNQYKLKKGMVFSINLGFSDLTNKEGKKPEEKTYALFIGDTVLVDEDGPATVLTSVKKKVKNVGIFLKNEDEEEEEEEKDEAEDLLGRGSRAALLTERTRNEMTAEEKRRAHQKELAAQLNEEAKRRLTEQKGEQQIQKARKSNVSYKNPSLMPKEPHIREMKIYIDKKYETVIMPVFGIATPFHIATIKNISMSVEGDYTYLRINFYCPGSALGRNEGNIFPNPEATFVKEITYRASNIKAPGEQTVPALNLQNAFRIIKEVQKRYKTREAEEKEKEGIVKQDSLVINLNRSNPKLKDLYIRPNIAQKRMQGSLEAHVNGFRFTSVRGDKVDILYNNIKHALFQPCDGEMIIVLHFHLKKLPPYLSTSFSSLSLRAHSTMFQKPHLHRFSATQNALLLFL

SEQ ID NO: 886859 - protein, 1047 aa, Homo sapiens; identical to SEQ ID NO: 886852

SEQ ID NO: 886860 - protein, 1047 aa, Homo sapiens; identical to SEQ ID NO: 886852

SEQ ID NO: 886861 - protein, 990 aa, Homo sapiens
MAVTLDKDAYYRRVKRLYSNWRKGEDEYANVDAIVVSVGVDEEIVYAKSTALQNESNKSSFDKMIEAIKESKNGKKIGVFSKDKFPGEFMKSWNDCLNKEGFDKIDISAVVAYTIAVKEDGELNLMKKAASITSEVFNKFFKERVMEIVDADEKVRHSKLAESVEKAIEEKKYLAGADPSTVEMCYPPIIQSGGNYNLKFSVVSDKNHMHFGAITCAMGIRFKSYCSNLVRTLMVDPSQEVQENYNFLLQLQEELLKELRHGVKICDVYNAVMDVVKKQKPELLNKITKNLGFGMGIEFREGSLVINSKNQYKLKKGMVFSINLGFSDLTNKEGKKPEEKTYALFIGDTVLVDEDGPATVLTSVKKKVKNVGIFLKNEDEEEEEEEKDEAEDLLGRGSRAALLTERTRNEMTAEEKRRAHQKELAAQLNEEAKRRLTEQKGEQQIQKARKSNVSYKNPSLMPKEPHIREMKIYIDKKYETVIMPVFGIATPFHIATIKNISMSVEGDYTYLRINFYCPGSALGRNEGNIFPNPEATFVKEITYRASNIKAPGEQTVPALNLQNAFRIIKEVQKRYKTREAEEKEKEGIVKQDSLVINLNRSNPKLKDLYIRPNIAQKRMQGSLEAHVNGFRFTSVRGDKVDILYNNIKHALFQPCDGEMIIVLHFHLKNAIMFGKKRHTDVQFYTEVGEITTDLGKHQHMHDRDDLYAEQMEREMRHKLKTAFKNFIEKVEALTKEELEFEVPFRDLGFNGAPYRSTCLLQPTSSALVNATEWPPFVVTLDEVELIHFERVQFHLKNFDMVIVYKDYSKKVTMINAIPVASLDPIKEWLNSCDLKYTEGVQSLNWTKIMKTIVDDPEGFFEQGGWSFLEPEGEGSDAEEGDSESEIEDETFNPSEDDYEEEEEDSDEDYSSEAEESDYSKESLGSEEESGKDWDELEEEARKADRESRYEEEEEQSRSMSRKRKASVHSSGRGSNRGSRHSSAPPKKKRK

SEQ ID NO: 886862 - protein, 633 aa, Homo sapiens
RNEGNIFPNPEDGYGIFLKNEDEEEEEEEKDEAEDLLGRGSRAALLTERTRNEMTAEEKRRAHQKELAAQLNEEAKRRLTEQKGEQQIQKARKSNVSYKNPSLMPKEPHIREMKIYIDKKYETVIMPVFGIATPFHIATIKNISMSVEGDYTYLRINFYCPGSALGRNEGNIFPNPEATFVKEITYRASNIKAPGEQTVPALNLQNAFRIIKEVQKRYKTREAEEKEKEGIVKQDSLVINLNRSNPKLKDLYIRPNIAQKRMQGSLEAHVNGFRFTSVRGDKVDILYNNIKHALFQPCDGEMIIVLHFHLKNAIMFGKKRHTDVQFYTEVGEITTDLGKHQHMHDRDDLYAEQMEREMRHKLKTAFKNFIEKVEALTKEELEFEVPFRDLGFNGAPYRSTCLLQPTSSALVNATEWPPFVVTLDEVELIHFERVQFHLKNFDMVIVYKDYSKKVTMINAIPVASLDPIKEWLNSCDLKYTEGVQSLNWTKIMKTIVDDPEGFFEQGGWSFLEPEGEGSDAEEGDSESEIEDETFNPSEDDYEEEEEDSDEDYSSEAEESDYSKESLGSEEESGKDWDELEEEARKADRESRYEEEEEQSRSMSRKRKASVHSSGRGSNRGSRHSSAPPKKKRK

SEQ ID NO: 886863 - protein, 191 aa, Homo sapiens
MVIVYKDYSKKVTMINAIPVASLDPIKEWLNSCDLKYTEGVQSLNWTKIMKTIVDDPEGFFEQGGWSFLEPEGEGSDAEEGDSESEIEDETFNPSEDDYEEEEEDSDEDYSSEAEESDYSKESLGSEEESGKDWDELEEEARKADRESRYEEEEEQSRSMSRKRKASVHSSGRGSNRGSRHSSAPPKKKRK

SEQ ID NO: 886864 - protein, 408 aa, Homo sapiens
MAVTLDKDAYYRRVKRLYSNWRKGEDEYANVDAIVVSVGVDEEIVYAKSTALQTWLFGYELTDTIMVFCDDKIIFMASKKKVEFLKQIANTKGNENANGAPAITLLIREKNESNKSSFDKMIEAIKESKNGKKIGVFSKDKFPGEFMKSWNDCLNKEGFDKIDISAVVAYTIAVKEDGELNLMKKAASITSEVFNKFFKERVMEIVDADEKVRHSKLAESVEKAIEEKKYLAGADPSTVEMCYPPIIQSGGNYNLKFSVVSDKNHMHFGAITCAMGIRFKSYCSNLVRTLMVDPSQEVQENYNFLLQLQEELLKELRHGVKICDVYNAVMDVVKKQKPELLNKITKNLGFGMGIEFREGSLVINSKNQYKLKKDGSASLRISRLITEGTGEENYAVHWHIVVMPLVSL

SEQ ID NO: 886865 - protein, 4302 aa, Homo sapiens
MPPAAPARLALALGLGLWLGALAGGPGRGCGPCEPPCLCGPAPGAACRVNCSGRGLRTLGPALRIPADATALDVSHNLLRALDVGLLANLSALAELDISNNKISTLEEGIFANLFNLSEINLSGNPFECDCGLAWLPRWAEEQQVRVVQPEAATCAGPGSLAGQPLLGIPLLDSGCGEEYVACLPDNSSGTVAAVSFSAAHEGLLQPEACSAFCFSTGQGLAALSEQGWCLCGAAQPSSASFACLSLCSGPPPPPAPTCRGPTLLQHVFPASPGATLVGPHGPLASGQLAAFHIAAPLPVTATRWDFGDGSAEVDAAGPAASHRYVLPGRYHVTAVLALGAGSALLGTDVQVEAAPAALELVCPSSVQSDESLDLSIQNRGGSGLEAAYSIVALGEEPARAVHPLCPSDTEIFPGNGHCYRLVVEKAAWLQAQEQCQAWAGAALAMVDSPAVQRFLVSRVTRSLDVWIGFSTVQGVEVGPAPQGEAFSLESCQNWLPGEPHPATAEHCVRLGPTGWCNTDLCSAPHSYVCELQPGGPVQDAENLLVGAPSGDLQGPLTPLAQQDGLSAPHEPVEVMVFPGLRLSREAFLTTAEFGTQELRRPAQLRLQVYRLLSTAGTPENGSEPESRSPDNRTQLAPACMPGGRWCPGANICLPLDASCHPQACANGCTSGPGLPGAPYALWREFLFSVPAGPPAQYSVTLHGQDVLMLPGDLVGLQHDAGPGALLHCSPAPGHPGPRAPYLSANASSWLPHLPAQLEGTWACPACALRLLAATEQLTVLLGLRPNPGLRLPGRYEVRAEVGNGVSRHNLSCSFDVVSPVAGLRVIYPAPRDGRLYVPTNGSALVLQVDSGANATATARWPGGSVSARFENVCPALVATFVPGCPWETNDTLFSVVALPWLSEGEHVVDVVVENSASRANLSLRVTAEEPICGLRATPSPEARVLQGVLVRYSPVVEAGSDMVFRWTINDKQSLTFQNVVFNVIYQSAAVFKLSLTASNHVSNVTVNYNVTVERMNRMQGLQVSTVPAVLSPNATLALTAGVLVDSAVEVAFLWTFGDGEQALHQFQPPYNESFPVPDPSVAQVLVEHNVMHTYAAPGEYLLTVLASNAFENLTQQVPVSVRASLPSVAVGVSDGVLVAGRPVTFYPHPLPSPGGVLYTWDFGDGSPVLTQSQPAANHTYASRGTYHVRLEVNNTVSGAAAQADVRVFEELRGLSVDMSLAVEQGAPVVVSAAVQTGDNITWTFDMGDGTVLSGPEATVEHVYLRAQNCTVTVGAASPAGHLARSLHVLVFVLEVLRVEPAACIPTQPDARLTAYVTGNPAHYLFDWTFGDGSSNTTVRGCPTVTHNFTRSGTFPLALVLSSRVNRAHYFTSICVEPEVGNVTLQPERQFVQLGDEAWLVACAWPPFPYRYTWDFGTEEAAPTRARGPEVTFIYRDPGSYLVTVTASNNISAANDSALVEVQEPVLVTSIKVNGSLGLELQQPYLFSAVGRGRPASYLWDLGDGGWLEGPEVTHAYNSTGDFTVRVAGWNEVSRSEAWLNVTVKRRVRGLVVNASRTVVPLNGSVSFSTSLEAGSDVRYSWVLCDRCTPIPGGPTISYTFRSVGTFNIIVTAENEVGSAQDSIFVYVLQLIEGLQVVGGGRYFPTNHTVQLQAVVRDGTNVSYSWTAWRDRGPALAGSGKGFSLTVLEAGTYHVQLRATNMLGSAWADCTMDFVEPVGWLMVAASPNPAAVNTSVTLSAELAGGSGVVYTWSLEEGLSWETSEPFTTHSFPTPGLHLVTMTAGNPLGSANATVEVDVQVPVSGLSIRASEPGGSFVAAGSSVPFWGQLATGTNVSWCWAVPGGSSKRGPHVTMVFPDAGTFSIRLNASNAVSWVSATYNLTAEEPIVGLVLWASSKVVAPGQLVHFQILLAAGSAVTFRLQVGGANPEVLPGPRFSHSFPRVGDHVVSVRGKNHVSWAQAQVRIVVLEAVSGLQVPNCCEPGIATGTERNFTARVQRGSRVAYAWYFSLQKVQGDSLVILSGRDVTYTPVAAGLLEIQVRAFNALGSENRTLVLEVQDAVQYVALQSGPCFTNRSAQFEAATSPSPRRVAYHWDFGDGSPGQDTDEPRAEHSYLRPGDYRVQVNASNLVSFFVAQATVTVQVLACREPEVDVVLPLQVLMRRSQRNYLEAHVDLRDCVTYQTEYRWEVYRTASCQRPGRPARVALPGVDVSRPRLVLPRLALPVGHYCFVFVVSFGDTPLTQSIQANVTVAPERLVPIIEGGSYRVWSDTRDLVLDGSESYDPNLEDGDQTPLSFHWACVASTQREAGGCALNFGPRGSSTVTIPRERLAAGVEYTFSLTVWKAGRKEEATNQTVLIRSGRVPIVSLECVSCKAQAVYEVSRSSYVYLEGRCLNCSSGSKRGRWAARTFSNKTLVLDETTTSTGSAGMRLVLRRGVLRDGEGYTFTLTVLGRSGEEEGCASIRLSPNRPPLGGSCRLFPLGAVHALTTKVHFECTGWHDAEDAGAPLVYALLLRRCRQGHCEEFCVYKGSLSSYGAVLPPGFRPHFEVGLAVVVQDQLGAAVVALNRSLAITLPEPNGSATGLTVWLHGLTASVLPGLLRQADPQHVIEYSLALVTVLNEYERALDVAAEPKHERQHRAQIRKNITETLVSLRVHTVDDIQQIAAALAQCMGPSRELVCRSCLKQTLHKLEAMMLILQAETTAGTVTPTAIGDSILNITGDLIHLASSDVRAPQPSELGAESPSRMVASQAYNLTSALMRILMRSRVLNEEPLTLAGEEIVAQGKRSDPRSLLCYGGAPGPGCHFSIPEAFSGALANLSDVVQLIFLVDSNPFPFGYISNYTVSTKVASMAFQTQAGAQIPIERLASERAITVKVPNNSDWAARGHRSSANSANSVVVQPQASVGAVVTLDSSNPAAGLHLQLNYTLLDGHYLSEEPEPYLAVYLHSEPRPNEHNCSASRRIRPESLQGADHRPYTFFISPGSRDPAGSYHLNLSSHFRWSALQVSVGLYTSLCQYFSEEDMVWRTEGLLPLEETSPRQAVCLTRHLTAFGASLFVPPSHVRFVFPEPTADVNYIVMLTCAVCLVTYMVMAAILHKLDQLDASRGRAIPFCGQRGRFKYEILVKTGWGRGSGTTAHVGIMLYGVDSRSGHRHLDGDRAFHRNSLDIFRIATPHSLGSVWKIRVWHDNKGLSPAWFLQHVIVRDLQTARSAFFLVNDWLSVETEANGGLVEKEVLAASDAALLRFRRLLVAELQRGFFDKHIWLSIWDRPPRSRFTRIQRATCCVLLICLFLGANAVWYGAVGDSAYSTGHVSRLSPLSVDTVAVGLVSSVVVYPVYLAILFLFRMSRSKVAGSPSPTPAGQQVLDIDSCLDSSVLDSSFLTFSGLHAEAFVGQMKSDLFLDDSKSLVCWPSGEGTLSWPDLLSDPSIVGSNLRQLARGQAGHGLGPEEDGFSLASPYSPAKSFSASDEDLIQQVLAEGVSSPAPTQDTHMETDLLSSLSSTPGEKTETLALQRLGELGPPSPGLNWEQPQAARLSRTGLVEGLRKRLLPAWCASLAHGLSLLLVAVAVAVSGWVGASFPPGVSVAWLLSSSASFLASFLGWEPLKVLLEALYFSLVAKRLHPDEDDTLVESPAVTPVSARVPRVRPPHGFALFLAKEEARKVKRLHGMLRSLLVYMLFLLVTLLASYGDASCHGHAYRLQSAIKQELHSRAFLAITRSEELWPWMAHVLLPYVHGNQSSPELGPPRLRQVRLQEALYPDPPGPRVHTCSAAGGFSTSDYDVGWESPHNGSGTWAYSAPDLLGAWSWGSCAVYDSGGYVQELGLSLEESRDRLRFLQLHNWLDNRSRAVFLELTRYSPAVGLHAAVTLRLEFPAAGRALAALSVRPFALRRLSAGLSLPLLTSVCLLLFAVHFAVAEARTWHREGRWRVLRLGAWARWLLVALTAATALVRLAQLGAADRQWTRFVRGRPRRFTSFDQVAQLSSAARGLAASLLFLLLVKAAQQLRFVRQWSVFGKTLCRALPELLGVTLGLVVLGVAYAQLAILLVSSCVDSLWSVAQALLVLCPGTGLSTLCPAESWHLSPLLCVGLWALRLWGALRLGAVILRWRYHALRGELYRPAWEPQDYEMVELFLRRLRLWMGLSKVKEFRHKVRFEGMEPLPSRSSRGSKVSPDVPPPSAGSDASHPSTSSSQLDGLSVSLGRLGTRCEPEPSRLQAVFEALLTQFDRLNQATEDVYQLEQQLHSLQGRRSSRAPAGSSRGPSPGLRPALPSRLARASRGVDLATGPSRTPLRAKNKVHPSST

SEQ ID NO: 886866 - protein, 4302 aa, Homo sapiens; identical to SEQ ID NO: 886865

SEQ ID NO: 886867 - protein, 4351 aa, Homo sapiens
MPPAAPARLALALGLGLWLGALAGGPGRGCGPCEPPCLCGPAPGAACRVNCSGRGLRTLGPALRIPADATALDVSHNLLRALDVGLLANLSALAELDISNNKISTLEEGIFANLFNLSEINLSGNPFECDCGLAWLPRWAEEQQVRVVQPEAATCAGPGSLAGQPLLGIPLLDSGCGEEYVACLPDNSSGTVAAVSFSAAHEGLLQPEACSAFCFSTGQGLAALSEQGWCLCGAAQPSSASFACLSLCSGPPPPPAPTCRGPTLLQHVFPASPGATLVGPHGPLASGQLAAFHIAAPLPVTATRWDFGDGSAEVDAAGPAASHRYVLPGRYHVTAVLALGAGSALLGTDVQVEAAPAALELVCPSSVQSDESLDLSIQNRGGSGLEAAYSIVALGEEPARAVHPLCPSDTEIFPGNGHCYRLVVEKAAWLQAQEQCQAWAGAALAMVDSPAVQRFLVSRVTRSLDVWIGFSTVQGVEVGPAPQGEAFSLESCQNWLPGEPHPATAEHCVRLGPTGWCNTDLCSAPHSYVCELQPGGPVQDAENLLVGAPSGDLQGPLTPLAQQDGLSAPHEPVEVMVFPGLRLSREAFLTTAEFGTQELRRPAQLRLQVYRLLSTAGTPENGSEPESRSPDNRTQLAPACMPGGRWCPGANICLPLDASCHPQACANGCTSGPGLPGAPYALWREFLFSVPAGPPAQYSVTLHGQDVLMLPGDLVGLQHDAGPGALLHCSPAPGHPGPRAPYLSANASSWLPHLPAQLEGTWACPACALRLLAATEQLTVLLGLRPNPGLRLPGRYEVRAEVGNGVSRHNLSCSFDVVSPVAGLRVIYPAPRDGRLYVPTNGSALVLQVDSGANATATARWPGGSVSARFENVCPALVATFVPGCPWETNDTLFSVVALPWLSEGEHVVDVVVENSASRANLSLRVTAEEPICGLRATPSPEARVLQGVLVRYSPVVEAGSDMVFRWTINDKQSLTFQNVVFNVIYQSAAVFKLSLTASNHVSNVTVNYNVTVERMNRMQGLQVSTVPAVLSPNATLALTAGVLVDSAVEVAFLWTFGDGEQALHQFQPPYNESFPVPDPSVAQVLVEHNVMHTYAAPGEYLLTVLASNAFENLTQQVPVSVRASLPSVAVGVSDGVLVAGRPVTFYPHPLPSPGGVLYTWDFGDGSPVLTQSQPAANHTYASRGTYHVRLEVNNTVSGAAAQADVRVFEELRGLSVDMSLAVEQGAPVVVSAAVQTGDNITWTFDMGDGTVLSGPEATVEHVYLRAQNCTVTVGAASPAGHLARSLHVLVFVLEVLRVEPAACIPTQPDARLTAYVTGNPAHYLFDWTFGDGSSNTTVRGCPTVTHNFTRSGTFPLALVLSSRVNRAHYFTSICVEPEVGNVTLQPERQFVQLGDEAWLVACAWPPFPYRYTWDFGTEEAAPTRARGPEVTFIYRDPGSYLVTVTASNNISAANDSALVEVQEPVLVTSIKVNGSLGLELQQPYLFSAVGRGRPASYLWDLGDGGWLEGPEVTHAYNSTGDFTVRVAGWNEVSRSEAWLNVTVKRRVRGLVVNASRTVVPLNGSVSFSTSLEAGSDVRYSWVLCDRCTPIPGGPTISYTFRSVGTFNIIVTAENEVGSAQDSIFVYVLQLIEGLQVVGGGRYFPTNHTVQLQAVVRDGTNVSYSWTAWRDRGPALAGSGKGFSLTVLEAGTYHVQLRATNMLGSAWADCTMDFVEPVGWLMVAASPNPAAVNTSVTLSAELAGGSGVVYTWSLEEGLSWETSEPFTTHSFPTPGLHLVTMTAGNPLGSANATVEVDVQVPVSGLSIRASEPGGSFVAAGSSVPFWGQLATGTNVSWCWAVPGGSSKRGPHVTMVFPDAGTFSIRLNASNAVSWVSATYNLTAEEPIVGLVLWASSKVVAPGQLVHFQILLAAGSAVTFRLQVGGANPEVLPGPRFSHSFPRVGDHVVSVRGKNHVSWAQAQVRIVVLEAVSGLQVPNCCEPGIATGTERNFTARVQRGSRVAYAWYFSLQKVQGDSLVILSGRDVTYTPVAAGLLEIQVRAFNALGSENRTLVLEVQDAVQYVALQSGPCFTNRSAQFEAATSPSPRRVAYHWDFGDGSPGQDTDEPRAEHSYLRPGDYRVQVNASNLVSFFVAQATVTVQVLACREPEVDVVLPLQVLMRRSQRNYLEAHVDLRDCVTYQTEYRWEVYRTASCQRPGRPARVALPGVDVSRPRLVLPRLALPVGHYCFVFVVSFGDTPLTQSIQANVTVAPERLVPIIEGGSYRVWSDTRDLVLDGSESYDPNLEDGDQTPLSFHWACVASTQREAGGCALNFGPRGSSTVTIPRERLAAGVEYTFSLTVWKAGRKEEATNQTVLIRSGRVPIVSLECVSCKAQAVYEVSRSSYVYLEGRCLNCSSGSKRGRWAARTFSNKTLVLDETTTSTGSAGMRLVLRRGVLRDGEGYTFTLTVLGRSGEEEGCASIRLSPNRPPLGGSCRLFPLGAVHALTTKVHFECTGWHDAEDAGAPLVYALLLRRCRQGHCEEFCVYKGSLSSYGAVLPPGFRPHFEVGLAVVVQDQLGAAVVALNRSLAITLPEPNGSATGLTVWLHGLTASVLPGLLRQADPQHVIEYSLALVTVLNEYERALDVAAEPKHERQHRAQIRKNITETLVSLRVHTVDDIQQIAAALAQCMGPSRELVCRSCLKQTLHKLEAMMLILQAETTAGTVTPTAIGDSILNITGDLIHLASSDVRAPQPSELGAESPSRMVASQAYNLTSALMRILMRSRVLNEEPLTLAGEEIVAQGKRSDPRSLLCYGGAPGPGCHFSIPEAFSGALANLSDVVQLIFLVDSNPFPFGYISNYTVSTKVASMAFQTQAGAQIPIERLASERAITVKVPNNSDWAARGHRSSANSANSVVVQPQASVGAVVTLDSSNPAAGLHLQLNYTLLDGHYLSEEPEPYLAVYLHSEPRPNEHNCSASRRIRPESLQGADHRPYTFFISPGSRDPAGSYHLNLSSHFRWSALQVSVGLYTSLCQYFSEEDMVWRTEGLLPLEETSPRQAVCLTRHLTAFGASLFVPPSHVRFVFPEPTADVNYIVMLTCAVCLVTYMVMAAILHKLDQLDASRGRAIPFCGQRGRFKYEILVKTGWGRGSGTTAHVGIMLYGVDSRSGHRHLDGDRAFHRNSLDIFRIATPHSLGSVWKIRVWHDNKGLSPAWFLQHVIVRDLQTARSAFFLVNDWLSVETEANGGLVEKEVLAASDAALLRFRRLLVAELQRGFFDKHIWLSIWDRPPRSRFTRIQRATCCVLLICLFLGANAVWYGAVGDSAYSTGHVSRLSPLSVDTVAVGLVSSVVVYPVYLAILFLFRMSRSKVAGSPSPTPAGQQVLDIDSCLDSSVLDSSFLTFSGLHAEAFVGQMKSDLFLDDSKSLVCWPSGEGTLSWPDLLSDPSIVGSNLRQLARGQAGHGLGPEEDGFSLASPYSPAKSFSASDEDLIQQVLAEGVSSPAPTQDTHMETDLLSSLSSTPGEKTETLALQRLGELGPPSPGLNWEQPQAARLSRTGLVEGLRKRLLPAWCASLAHGLSLLLVAVAVAVSGWVGASFPPGVSVAWLLSSSASFLASFLGWEPLKVLLEALYFSLVAKRLHPDEDDTLVESPAVTPVSARVPRVRPPHGFALFLAKEEARKVKRLHGMLRSLLVYMLFLLVTLLASYGDASCHGHAYRLQSAIKQELHSRAFLAITRSEELWPWMAHVLLPYVHGNQSSPELGPPRLRQVRLQEALYPDPPGPRVHTCSAAGGFSTSDYDVGWESPHNGSGTWAYSAPDLLGAWSWGSCAVYDSGGYVQELGLSLEESRDRLRFLQLHNWLDNRSRAVFLELTRYSPAVGLHAAVTLRLEFPAAGRALAALSVRPFALRRLSAGLSLPLLTSVRPSPARPRASHRQRPAPSRGPAPAASHPSQRPAPSQPSLPPSCPRPPQVCLLLFAVHFAVAEARTWHREGRWRVLRLGAWARWLLVALTAATALVRLAQLGAADRQWTRFVRGRPRRFTSFDQVAQLSSAARGLAASLLFLLLVKAAQQLRFVRQWSVFGKTLCRALPELLGVTLGLVVLGVAYAQLAILLVSSCVDSLWSVAQALLVLCPGTGLSTLCPAESWHLSPLLCVGLWALRLWGALRLGAVILRWRYHALRGELYRPAWEPQDYEMVELFLRRLRLWMGLSKVKEFRHKVRFEGMEPLPSRSSRGSKVSPDVPPPSAGSDASHPSTSSSQLDGLSVSLGRLGTRCEPEPSRLQAVFEALLTQFDRLNQATEDVYQLEQQLHSLQGRRSSRAPAGSSRGPSPGLRPALPSRLARASRGVDLATGPSRTPLRAKNKVHPSST

SEQ ID NO: 886868 - protein, 4302 aa, Homo sapiens; identical to SEQ ID NO: 886865

SEQ ID NO: 886869 - protein, 94 aa, Homo sapiens
FARKPRVSVRDWTGVGCVCDTSPGTLLTRATCSLVCWPSGEGTLSWPDLLSDPSIVGSNLRQLARGQAGHGLGPEEDGFSLASPYSPAKSFSAS

SEQ ID NO: 886870 - protein, 99 aa, Homo sapiens
MACRAPGTSSPLCPAWDSPARREVCPGGDRLRAESSTEPRLTPFPPQRYSPVVEAGSDMVFRWTINDKQSLTFQNVVFNVIYQSAAVFKLSVGGRGWGG

SEQ ID NO: 886871 - protein, 4285 aa, Homo sapiens
MPPAAPARLALALGLGLWLGALAGGPGRGCGPCEPPCLCGPAPGAACRVNCSGRGLRTLGPALRIPADATALDVSHNLLRALDVGLLANLSALAELDISNNKISTLEEGIFANLFNLSEINLSGNPFECDCGLAWLPRWAEEQQVRVVQPEAATCAGPGSLAGQPLLGIPLLDSGCGEEYVACLPDNSSGTVAAVSFSAAHEGLLQPEACSAFCFSTGQGLAALSEQGWCLCGAAQPSSASFACLSLCSGPPPPPAPTCRGPTLLQHVFPASPGATLVGPHGPLASGQLAAFHIAAPLPVTATRWDFGDGSAEVDAAGPAASHRYVLPGRYHVTAVLALGAGSALLGTDVQVEAAPAALELVCPSSVQSDESLDLSIQNRGGSGLEAAYSIVALGEEPARAVHPLCPSDTEIFPGNGHCYRLVVEKAAWLQAQEQCQAWAGAALAMVDSPAVQRFLVSRVTRSLDVWIGFSTVQGVEVGPAPQGEAFSLESCQNWLPGEPHPATAEHCVRLGPTGWCNTDLCSAPHSYVCELQPGGPVQDAENLLVGAPSGDLQGPLTPLAQQDGLSAPHEPVEVMVFPGLRLSREAFLTTAEFGTQELRRPAQLRLQVYRLLSTAGTPENGSEPESRSPDNRTQLAPACMPGGRWCPGANICLPLDASCHPQACANGCTSGPGLPGAPYALWREFLFSVPAGPPAQYSVTLHGQDVLMLPGDLVGLQHDAGPGALLHCSPAPGHPGPRAPYLSANASSWLPHLPAQLEGTWACPACALRLLAATEQLTVLLGLRPNPGLRLPGRYEVRAEVGNGVSRHNLSCSFDVVSPVAGLRVIYPAPRDGRLYVPTNGSALVLQVDSGANATATARWPGGSVSARFENVCPALVATFVPGCPWETNDTLFSVVALPWLSEGEHVVDVVVENSASRANLSLRVTAEEPICGLRATPSPEARVLQGVLVRYSPVVEAGSDMVFRWTINDKQSLTFQNVVFNVIYQSAAVFKLSLTASNHVSNVTVNYNVTVERMNRMQGLQVSTVPAVLSPNATLALTAGVLVDSAVEVAFLWTFGDGEQALHQFQPPYNESFPVPDPSVAQVLVEHNVMHTYAAPGEYLLTVLASNAFENLTQQVPVSVRASLPSVAVGVSDGVLVAGRPVTFYPHPLPSPGGVLYTWDFGDGSPVLTQSQPAANHTYASRGTYHVRLEVNNTVSGAAAQADVRVFEELRGLSVDMSLAVEQGAPVVVSAAVQTGDNITWTFDMGDGTVLSGPEATVEHVYLRAQNCTVTVGAASPAGHLARSLHVLVFVLEVLRVEPAACIPTQPDARLTAYVTGNPAHYLFDWTFGDGSSNTTVRGCPTVTHNFTRSGTFPLALVLSSRVNRAHYFTSICVEPEVGNVTLQPERQFVQLGDEAWLVACAWPPFPYRYTWDFGTEEAAPTRARGPEVTFIYRDPGSYLVTVTASNNISAANDSALVEVQEPVLVTSIKVNGSLGLELQQPYLFSAVGRGRPASYLWDLGDGGWLEGPEVTHAYNSTGDFTVRVAGWNEVSRSEAWLNVTVKRRVRGLVVNASRTVVPLNGSVSFSTSLEAGSDVRYSWVLCDRCTPIPGGPTISYTFRSVGTFNIIVTAENEVGSAQDSIFVYVLQLIEGLQVVGGGRYFPTNHTVQLQAVVRDGTNVSYSWTAWRDRGPALAGSGKGFSLTVLEAGTYHVQLRATNMLGSAWADCTMDFVEPVGWLMVAASPNPAAVNTSVTLSAELAGGSGVVYTWSLEEGLSWETSEPFTTHSFPTPGLHLVTMTAGNPLGSANATVEVDVQVPVSGLSIRASEPGGSFVAAGSSVPFWGQLATGTNVSWCWAVPGGSSKRGPHVTMVFPDAGTFSIRLNASNAVSWVSATYNLTAEEPIVGLVLWASSKVVAPGQLVHFQILLAAGSAVTFRLQVGGANPEVLPGPRFSHSFPRVGDHVVSVRGKNHVSWAQAQVRIVVLEAVSGLQVPNCCEPGIATGTERNFTARVQRGSRVAYAWYFSLQKVQGDSLVILSGRDVTYTPVAAGLLEIQVRAFNALGSENRTLVLEVQDAVQYVALQSGPCFTNRSAQFEAATSPSPRRVAYHWDFGDGSPGQDTDEPRAEHSYLRPGDYRVQVNASNLVSFFVAQATVTVQVLACREPEVDVVLPLQVLMRRSQRNYLEAHVDLRDCVTYQTEYRWEVYRTASCQRPGRPARVALPGVDVSRPRLVLPRLALPVGHYCFVFVVSFGDTPLTQSIQANVTVAPERLVPIIEGGSYRVWSDTRDLVLDGSESYDPNLEDGDQTPLSFHWACVASTQREAGGCALNFGPRGSSTVTIPRERLAAGVEYTFSLTVWKAGRKEEATNQTVLIRSGRVPIVSLECVSCKAQAVYEVSRSSYVYLEGRCLNCSSGSKRGRWAARTFSNKTLVLDETTTSTGSAGMRLVLRRGVLRDGEGYTFTLTVLGRSGEEEGCASIRLSPNRPPLGGSCRLFPLGAVHALTTKVHFECTGWHDAEDAGAPLVYALLLRRCRQGHCEEFCVYKGSLSSYGAVLPPGFRPHFEVGLAVVVQDQLGAAVVALNRSLAITLPEPNGSATGLTVWLHGLTASVLPGLLRQADPQHVIEYSLALVTVLNEYERALDVAAEPKHERQHRAQIRKNITETLVSLRVHTVDDIQQIAAALAQCMGPSRELVCRSCLKQTLHKLEAMMLILQAETTAGTVTPTAIGDSILNITGDLIHLASSDVRAPQPSELGAESPSRMVASQAYNLTSALMRILMRSRVLNEEPLTLAGEEIVAQGKRSDPRSLLCYGGAPGPGCHFSIPEAFSGALANLSDVVQLIFLVDSNPFPFGYISNYTVSTKVASMAFQTQAGAQIPIERLASERAITVKVPNNSDWAARGHRSSANSANSVVVQPQASVGAVVTLDSSNPAAGLHLQLNYTLLDGHYLSEEPEPYLAVYLHSEPRPNEHNCSASRRIRPESLQGADHRPYTFFISPGSRDPAGSYHLNLSSHFRWSALQVSVGLYTSLCQYFSEEDMVWRTEGLLPLEETSPRQAVCLTRHLTAFGASLFVPPSHVRFVFPEPTADVNYIVMLTCAVCLVTYMVMAAILHKLDQLDASRGRAIPFCGQRGRFKYEILVKTGWGRGSGTTAHVGIMLYGVDSRSGHRHLDGDRAFHRNSLDIFRIATPHSLGSVWKIRVWHDNKGLSPAWFLQHVIVRDLQTARSAFFLVNDWLSVETEANGGLVEKEVLAASDAALLRFRRLLVAELQRGFFDKHIWLSIWDRPPRSRFTRIQRATCCVLLICLFLGANAVWYGAVGDSAYSTGHVSRLSPLSVDTVAVGLVSSVVVYPVYLAILFLFRMSRSKVAGSPSPTPAGQQVLDIDSCLDSSVLDSSFLTFSGLHAEAFVGQMKSDLFLDDSKSLVCWPSGEGTLSWPDLLSDPSIVGSNLRQLARGQAGHGLGPEEDGFSLASPYSPAKSFSASDEDLIQQVLAEGVSSPAPTQDTHMETDLLSSLSSTPGEKTETLALQRLGELGPPSPGLNWEQPQAARLSRTGLVEGLRKRLLPAWCASLAHGLSLLLVAVAVAVSGWVGASFPPGVSVAWLLSSSASFLASFLGWEPLKVLLEALYFSLVAKRLHPDEDDTLVESPAVTPVSARVPRVRPPHGFALFLAKEEARKVKRLHGMLRSLLVYMLFLLVTLLASYGDASCHGHAYRLQSAIKQELHSRAFLAITRSEELWPWMAHVLLPYVHGNQSSPELGPPRLRQVRLQEALYSRPSRPQGPHVLGRRRLQHQRLRRWLGESSQWLGDVGLFSAGSAGELGLSLEESRDRLRFLQLHNWLDNRSRAVFLELTRYSPAVGLHAAVTLRLEFPAAGRALAALSVRPFALRRLSAGLSLPLLTSVCLLLFAVHFAVAEARTWHREGRWRVLRLGAWARWLLVALTAATALVRLAQLGAADRQWTRFVRGRPRRFTSFDQVAQLSSAARGLAASLLFLLLVKAAQQLRFVRQWSVFGKTLCRALPELLGVTLGLVVLGVAYAQLAILLVSSCVDSLWSVAQALLVLCPGTGLSTLCPAESWHLSPLLCVGLWALRLWGALRLGAVILRWRYHALRGELYRPAWEPQDYEMVELFLRRLRLWMGLSKVKEFRHKVRFEGMEPLPSRSSRGSKVSPDVPPPSAGSDASHPSTSSSQLDGLSVSLGRLGTRCEPEPSRLQAVFEALLTQFDRLNQATEDVYQLEQQLHSLQGRRSSRAPAGSSRGPSPGLRPALPSRLARASRGVDLATGPSRTPLRAKNKVHPSST

SEQ ID NO: 886872 - protein, 3734 aa, Homo sapiens
MPPAAPARLALALGLGLWLGALAGGPGRGCGPCEPPCLCGPAPGAACRVNCSGRGLRTLGPALRIPADATALDVSHNLLRALDVGLLANLSALAELDISNNKISTLEEGIFANLFNLSEINLSGNPFECDCGLAWLPRWAEEQQVRVVQPEAATCAGPGSLAGQPLLGIPLLDSGCGEEYVACLPDNSSGTVAAVSFSAAHEGLLQPEACSAFCFSTGQGLAALSEQGWCLCGAAQPSSASFACLSLCSGPPPPPAPTCRGPTLLQHVFPASPGATLVGPHGPLASGQLAAFHIAAPLPVTATRWDFGDGSAEVDAAGPAASHRYVLPGRYHVTAVLALGAGSALLGTDVQVEAAPAALELVCPSSVQSDESLDLSIQNRGGSGLEAAYSIVALGEEPARAVHPLCPSDTEIFPGNGHCYRLVVEKAAWLQAQEQCQAWAGAALAMVDSPAVQRFLVSRVTRSLDVWIGFSTVQGVEVGPAPQGEAFSLESCQNWLPGEPHPATAEHCVRLGPTGWCNTDLCSAPHSYVCELQPGGPVQDAENLLVGAPSGDLQGPLTPLAQQDGLSAPHEPVEVMVFPGLRLSREAFLTTAEFGTQELRRPAQLRLQVYRLLSTAGTPENGSEPESRSPDNRTQLAPACMPGGRWCPGANICLPLDASCHPQACANGCTSGPGLPGAPYALWREFLFSVPAGPPAQYSVTLHGQDVLMLPGDLVGLQHDAGPGALLHCSPAPGHPGPRAPYLSANASSWLPHLPAQLEGTWACPACALRLLAATEQLTVLLGLRPNPGLRLPGRYEVRAEVGNGVSRHNLSCSFDVVSPVAGLRVIYPAPRDGRLYVPTNGSALVLQVDSGANATATARWPGGSVSARFENVCPALVATFVPGCPWETNDTLFSVVALPWLSEGEHVVDVVVENSASRANLSLRVTAEEPICGLRATPSPEARVLQGVLVRYSPVVEAGSDMVFRWTINDKQSLTFQNVVFNVIYQSAAVFKLSLTASNHVSNVTVNYNVTVERMNRMQGLQVSTVPAVLSPNATLALTAGVLVDSAVEVAFLWTFGDGEQALHQFQPPYNESFPVPDPSVAQVLVEHNVMHTYAAPGEYLLTVLASNAFENLTQQVPVSVRASLPSVAVGVSDGVLVAGRPVTFYPHPLPSPGGVLYTWDFGDGSPVLTQSQPAANHTYASRGTYHVRLEVNNTVSGAAAQADVRVFEELRGLSVDMSLAVEQGAPVVVSAAVQTGDNITWTFDMGDGTVLSGPEATVEHVYLRAQNCTVTVGAASPAGHLARSLHVLVFVLEVLRVEPAACIPTQPDARLTAYVTGNPAHYLFDWTFGDGSSNTTVRGCPTVTHNFTRSGTFPLALVLSSRVNRAHYFTSICVEPEVGNVTLQPERQFVQLGDEAWLVACAWPPFPYRYTWDFGTEEAAPTRARGPEVTFIYRDPGSYLVTVTASNNISAANDSALVEVQEPVLVTSIKVNGSLGLELQQPYLFSAVGRGRPASYLWDLGDGGWLEGPEVTHAYNSTGDFTVRVAGWNEVSRSEAWLNVTVKRRVRGLVVNASRTVVPLNGSVSFSTSLEAGSDVRYSWVLCDRCTPIPGGPTISYTFRSVGTFNIIVTAENEVGSAQDSIFVYVLQLIEGLQVVGGGRYFPTNHTVQLQAVVRDGTNVSYSWTAWRDRGPALAGSGKGFSLTVLEAGTYHVQLRATNMLGSAWADCTMDFVEPVGWLMVAASPNPAAVNTSVTLSAELAGGSGVVYTWSLEEGLSWETSEPFTTHSFPTPGLHLVTMTAGNPLGSANATVEVDVQVPVSGLSIRASEPGGSFVAAGSSVPFWGQLATGTNVSWCWAVPGGSSKRGPHVTMVFPDAGTFSIRLNASNAVSWVSATYNLTAEEPIVGLVLWASSKVVAPGQLVHFQILLAAGSAVTFRLQVGGANPEVLPGPRFSHSFPRVGDHVVSVRGKNHVSWAQAQVRIVVLEAVSGLQVPNCCEPGIATGTERNFTARVQRGSRVAYAWYFSLQKVQGDSLVILSGRDVTYTPVAAGLLEIQVRAFNALGSENRTLVLEVQDAVQYVALQSGPCFTNRSAQFEAATSPSPRRVAYHWDFGDGSPGQDTDEPRAEHSYLRPGDYRVQVNASNLVSFFVAQATVTVQVLACREPEVDVVLPLQVLMRRSQRNYLEAHVDLRDCVTYQTEYRWEVYRTASCQRPGRPARVALPGVDVSRPRLVLPRLALPVGHYCFVFVVSFGDTPLTQSIQANVTVAPERLVPIIEGGSYRVWSDTRDLVLDGSESYDPNLEDGDQTPLSFHWACVASTQREAGGCALNFGPRGSSTVTIPRERLAAGVEYTFSLTVWKAGRKEEATNQTVLIRSGRVPIVSLECVSCKAQAVYEVSRSSYVYLEGRCLNCSSGSKRGRWAARTFSNKTLVLDETTTSTGSAGMRLVLRRGVLRDGEGYTFTLTVLGRSGEEEGCASIRLSPNRPPLGGSCRLFPLGAVHALTTKVHFECTGWHDAEDAGAPLVYALLLRRCRQGHCEEFCVYKGSLSSYGAVLPPGFRPHFEVGLAVVVQDQLGAAVVALNRSLAITLPEPNGSATGLTVWLHGLTASVLPGLLRQADPQHVIEYSLALVTVLNEYERALDVAAEPKHERQHRAQIRKNITETLVSLRVHTVDDIQQIAAALAQCMGPSRELVCRSCLKQTLHKLEAMMLILQAETTAGTVTPTAIGDSILNITGDLIHLASSDVRAPQPSELGAESPSRMVASQAYNLTSALMRILMRSRVLNEEPLTLAGEEIVAQGKRSDPRSLLCYGGAPGPGCHFSIPEAFSGALANLSDVVQLIFLVDSNPFPFGYISNYTVSTKVASMAFQTQAGAQIPIERLASERAITVKVPNNSDWAARGHRSSANSANSVVVQPQASVGAVVTLDSSNPAAGLHLQLNYTLLDGHYLSEEPEPYLAVYLHSEPRPNEHNCSASRRIRPESLQGADHRPYTFFISPGSRDPAGSYHLNLSSHFRWSALQVSVGLYTSLCQYFSEEDMVWRTEGLLPLEETSPRQAVCLTRHLTAFGASLFVPPSHVRFVFPEPTADVNYIVMLTCAVCLVTYMVMAAILHKLDQLDASRGRAIPFCGQRGRFKYEILVKTGWGRGSGTTAHVGIMLYGVDSRSGHRHLDGDRAFHRNSLDIFRIATPHSLGSVWKIRVWHDNKGLSPAWFLQHVIVRDLQTARSAFFLVNDWLSVETEANGGLVEKEVLAASDAALLRFRRLLVAELQRGFFDKHIWLSIWDRPPRSRFTRIQRATCCVLLICLFLGANAVWYGAVGDSAYSTGHVSRLSPLSVDTVAVGLVSSVVVYPVYLAILFLFRMSRSKVAGSPSPTPAGQQVLDIDSCLDSSVLDSSFLTFSGLHAEAFVGQMKSDLFLDDSKSLVCWPSGEGTLSWPDLLSDPSIVGSNLRQLARGQAGHGLGPEEDGFSLASPYSPAKSFSASDEDLIQQVLAEGVSSPAPTQDTHMETDLLSSLSSTPGEKTETLALQRLGELGPPSPGLNWEQPQAARLSRTGLVEGLRKRLLPAWCASLAHGLSLLLVAVAVAVSGWVGASFPPGVSVAWLLSSSASFLASFLGWEPLKVLLEALYFSLVAKRLHPDEDDTLVESPAVTPVSARVPRVRPPHGFALFLAKEEARKVKRLHGMLRVSLGAACAPATSVSCLPPPTHARRTLLSPFPHLRRPLGVQCSAAFARSPSYPTPPTCCPSPCQ

SEQ ID NO: 886873 - protein, 151 aa, Homo sapiens
RWPVGKSGPQHPPLLTGTPENGSEPESRSPDNRTQLAPACMPGGRWCPGANICLPLDASCHPQACANGCTSGPGLPGAPYALWREFLFSVPAGPPAQYSVCGPDLGLFPASPQATFLSAAQGLGLCTRHTQPAGPSHVLATSDLRPLQCPR

SEQ ID NO: 886874 - protein, 739 aa, Homo sapiens
MDFLGYCSSHYESDLEATHTLEAEGSHGGDLTKRSSQQLRALAPGQRHRKETAWGLGPDCCHWGVGVWVGTESGALGYRQVNSQDLEQGKGFYSIISVLHLAPSKCYLQKLKLSQYSPPHTTKTHPTQCEEAGGWWGRQAKEKKTRSTQCNVDVYAFKAPINSYVENNTCSILKIHAIFSNCIDASGVIFRNVFIGKEAILAGSASASQEDPLSGLYLTLFAGEPPALSRGMGFSGGNLDLLKEGSSCEQNSSSWRILSFLWTHYLPFCTRGIPTLGSADYSTSGSHYYSALRISCQPSAVSLFTSVDEARAVIFQLMLCYALGLSRSPQGMQLSHKSFFAVKCVQICIFKQILTRKCVLGMCASGEENGKGRRQINSSTLEGQMGNQLGKVGQWAEADSEMIMNEDSSSTIQKKAHEHSVQMDQVHMCLDRLPLSSHKGISEIEPRQRSSPRRPQGPLPPARVRSSGVYQPEGCVSISSTWQRSGPCGLGNQISGNCKNSQNLSDFLGGIRIIEWFQNLNKVTASLYRRRKDGKLSFKPQHEEFKAAMKTVATEESNHRALPVIEQKEGPRVAAQLAERVVAKGPSRSLPALGSDNPNLTGSAGPASDTSSTRVFPVVRMSVETLVLYSWYMLIKYNLFEGRSGCGPLTLSAAQCLSQCWGSPGHVELELNIKHPSDITHKMTAPACFPLRHCYWKCQSSEIEPWAWLVSEVAQSQAVLAWMGGWPPPFRAGQEAVCR

SEQ ID NO: 886875 - protein, 145 aa, Homo sapiens
MGITPWPKGHTEPKGSYSLRKKPCYGTVAALDCAGCQEGMAEAASVGLAQSESTTIMGHVCAERHTHDRYVTSMCPYLPLPMDGNAMDFSFLSSARAKQFFTVFSRSSSHLSAPQTGLLQWITNLAGRPWPALTAASGAGMKQKQ

SEQ ID NO: 886876 - protein, 107 aa, Homo sapiens
MVGESWAQGLEPATCHLHGFGYTPSFICGTGNGDNTLAQGSHRTKRKLQPKEETLLWDCGCSGLRRLPGRNGGDASGVIFRNVSLEKKLFWRALLQLARKTPSVACI

SEQ ID NO: 886877 - protein, 145 aa, Homo sapiens; identical to SEQ ID NO: 886875

SEQ ID NO: 886878 - protein, 745 aa, Homo sapiens
MGVISQSEALSSSEPWHQDRGTEKRQHGGWGLLLPLGSRGVGGHRVGGLRVRQVNSQDLEQGKGFYSIIYSAFGSKQMLFTKTQIKPDTPHHTPPKHTPHSVKRQEVGEEGRQRRKRLDLLSVMWMCMLLRHLYIPMFKTIHVQSLKFTQFFPIDRCFWCYIQKCFIGKEAILAGSASASQEDPLSGLYLTLFAGEPPALSRGMGFSGGNLDLLKEGSSCEQNSSSWRILSFLWTHYLPFCTRGIPTLGSADYSTSGSHYYSALRISCQPSAVSLFTSVDEARAVIFQLMLCYALGLSRSPQGMQLSHKSFFAVKCVQICIFKQILTRKCVLGMCASGEENGKGRRQINSSTLEGQMGNQLGKVGQWAEADSEMIMNEDSSSTIQKKAHEHSVQMDQVHMCLDRLPLSSHKGISEIEPRQRSSPRRPQGPLPPARVRSSGVYQPEGCVSISSTWQRSGPCGLGNQISGNCKNSQNLSDFLGGIRIIEWFQNLNKVTASLYRRRKDGKLSFKPQHEEFKAAMKTVATEESNHRALPVIEQKEGPRVAAQLAERVVAKGPSRSLPALGSDNPNLTGSAGPASDTSSTRVFPVVRMSVETLVLYSWYMLIKYNLFEGRSGCGPLTLSAAQCLSQCWGSPGHVELELNIKHPSDITHKMTAPACFPLSIVNGNARAQKLSPGPGLYLRWLRAKLSSPGWEAGPHHLGQGRRRSVDDDREGVSGWTCRLPDLTYLATGNSTFLLGSFKKI

SEQ ID NO: 886879 - protein, 306 aa, Homo sapiens
MDTLDRVVKPKTKRAKRFLEKREPKLNENIKNAMLIKGGNANATVTKVLKDVYALKKPYGVLYKKKNITRPFEDQTSLEFFSKKSDCSLFMFGSHNKKRPNNLVIGRMYDYHVLDMIELGIENFVSLKDIKNSKCPEGTKPMLIFAGDDFDVTEDYRRLKSLLIDFFRGPTVSNIRLAGLEYVLHFTALNGKIYFRSYKLLLKKSGCRTPRIELEEMGPSLDLVLRRTHLASDDLYKLSMKMPKALKPKKKKNISHDTFGTTYGRIHMQKQDLSKLQTRKMKGLKKRPAERITEDHEKKSKRIKKN

SEQ ID NO: 886880 - protein, 260 aa, Homo sapiens
MDTLYRVKPKTKRAKRFLEKREPKLNENIKNAMLIKGGNANATVTKVLKDVYALKKPYGVLYKKKNITRPFEDQTSLEFFSKKSDCSLFMFGSHNKKRPNNLVIGRMYDYHVLDMIELDFFRGPTVSNIRLAGLEYVLHFTALNGKIYFRSYKLLLKKSGCRTPRIELEEMGPSLDLVLRRTHLASDDLYKLSMKMPKALKPKKKKNISHDTFGTTYGRIHMQKQDLSKLQTRKMKGLKKRPAERITEDHEKKSKRIKKN

SEQ ID NO: 886881 - protein, 306 aa, Homo sapiens; identical to SEQ ID NO: 886879

SEQ ID NO: 886882 - protein, 143 aa, Homo sapiens
LFPATSALHSVHSGMTGSYVLHFTALNGKIYFRSYKLLLKKSGCRTPRIELEEMGPSLDLVLRRTHLASDDLYKLSMKMPKALKPKKKKNISHDTFGTTYGRIHMQKQDLSKLQTRKMKGLKKRPAERITEDHEKKSKRIKKN

SEQ ID NO: 886883 - protein, 380 aa, Homo sapiens
ADVVLPARIKVGKMASSGGELGSLFDHHVQRAVCDTRAKYREGRRPRAVKVYTINLESQYLLIQGVPAVGVMKELVERFALYGAIEQYNALDEYPAEDFTEVYLIKFMNLQSARTAKRKMDEQSFFGGLLHVCYAPEFETVEETRKKLQMRKAYVVKTTENKDHYVTKKKLVTEHKDTEDFRQDFHSEMSGFCKAALNTSAGNSNPYLPYSCELPLCYFSSKCMCSSGGPVDRAPDSSKDGRNHHKTMGHYNHNDSLRKTQINSLKNSVACPGAQKAITSSEAVDRFMPRTTQLQERKRRREDDRKLGTFLQTNPTGNEIMIGPLLPDISKVDMHDDSLNTTANLIRHKLKEVISSVPKPPEDKPEDVHTSHPLKQRRRI

SEQ ID NO: 886884 - protein, 389 aa, Homo sapiens
ADVVLPARIKVGKMASSGGELGSLFDHHVQRAVCDTRAKYREGRRPRAVKVYTINLESQYLLIQGVPAVGVMKELVERFALYGAIEQYNALDEYPAEDFTEVYLIKFMNLQSARTAKRKMDEQSFFGGLLHVCYAPEFETVEETRKKLQMRKAYVVKTTENKDHYVTKKKLVTEHKDTEDFRQDFHSEMSGFCKAALNTSAGNSNPYLPYSCELPLCYFSSKCMCSSGGPVDRAPDSSKDGRNHHKTMGHYNHNDSLRKTQINSLKNSVACPGAQKAITSSEAVDRFMPRTTQLQERKRRREDDRKLGTFLQTNPTGNEIMIGPLLPDISKVDMHDDSLNTTANLIRHKLKEVRLFLKNYSKTRFGYRIKWRIICGNNSTVIFFHFLVF

SEQ ID NO: 886885 - protein, 362 aa, Homo sapiens
ADVVLPARIKVGKMASSGGELGSLFDHHVQRAVCDTRAKYREGRRPRAVKVYTINLESQYLLIQGVPAVGVMKELVERFALYGAIEQYNALDEYPAEDFTEVYLIKFMNLQSARTAKRKMDEQSFFGGLLHVCYAPEFETVEETRKKLQMRKAYVVKTTENKDHYVTKKKLVTEHKDTEDFRQDFHSEMSGFCKAALNTSAGNSNPYLPYSCELPLCYFSSDGRNHHKTMGHYNHNDSLRKTQINSLKNSVACPGAQKAITSSEAVDRFMPRTTQLQERKRRREDDRKLGTFLQTNPTGNEIMIGPLLPDISKVDMHDDSLNTTANLIRHKLKEVISSVPKPPEDKPEDVHTSHPLKQRRRI

SEQ ID NO: 886886 - protein, 192 aa, Homo sapiens
MSGFCKAALNTSAGNSNPYLPYSCELPLCYFSSKCMCSSGGPVDRAPDSSKDGRNHHKTMGHYNHNDSLRKTQINSLKNSVACPGAQKAITSSEAVDRFMPRTTQLQERKRRREDDRKLGTFLQTNPTGNEIMIGPLLPDISKVDMHDDSLNTTANLIRHKLKEVISSVPKPPEDKPEDVHTSHPLKQRRRI

SEQ ID NO: 886887 - protein, 380 aa, Homo sapiens; identical to SEQ ID NO: 886883

SEQ ID NO: 886888 - protein, 309 aa, Homo sapiens [sequence omitted]

SEQ ID NO: 886889 - protein, 264 aa, Homo sapiens
MGPPSAPPCRLHVPWKEVLLTASLLTFWNPPTTAKLTIESTPFNVAEGKEVLLLVHNLPQNLFGYSWYKGERVDGNSLIVGYVIGTQQATPGPAYSGRETIYPNASLLIQNVTQNDTGFYTLQVIKSDLVNEEATGQFHVYPELPKPSISSNNSNPVEDKDAVAFTCEPEIQNTTYLWWVNNQSLPVSPRLQLSNGNRTLTLLSVTRNDAGTYECEIQNPVSASRSDPVILNVLYGPDGPTISPSKGTYYRSRGKSEPLLPRSL

SEQ ID NO: 886890 - protein, 176 aa, Homo sapiens
PPKPFITSNNSNPVEDEDAVALTCEPEIQNTTYLWWVNNQSLPVSPRLQLSNDNRTLTLLSVTRNDVGPYECGIQNKLSVDHSDPVILNVLYGPDDPTISPSYTYYRPGVNLSLSCHAASNPPAQYSWLIDGNIQQYTQELFISNITEKNSGLYTCQANNSASGHSRTTVKTITVS

SEQ ID NO: 886891 - protein, 76 aa, Homo sapiens
PPKPFITSNNSNPVEDEDAVALTCEPEIQNTTSARGGIYTHPQQHWLATHNTDPCQLHKRWPSGRIYHLPELAKLK

SEQ ID NO: 886892 - protein, 93 aa, Homo sapiens
MESPSAPPHRWCIPWQRLLLTASLLTFWNPPTTAKLTIESTPFNVAEGKEVLLLVHNLPQNLFGYSWLEDEAVSRTSFQGTCNLQGGAEGGPM

SEQ ID NO: 886893 - protein, 264 aa, Homo sapiens; identical to SEQ ID NO: 886889

SEQ ID NO: 886894 - protein, 157 aa, Homo sapiens
MGPPSAPPCRLHVPWKEVLLTASLLTFWNPPTTAKLTIESTPFNVAEGKEVLLLVHNLPQNLFGYSWYKGERVDGNSLIVGYVIGTQQATPGPAYSGRETIYPNASLLIQNVTQNDTGFYTLQVIKSDLVNEEATGQFHVYPELPKSSFSQSLITSE

SEQ ID NO: 886895 - protein, 116 aa, Homo sapiens
SYVLSQNSGVQTAVIQSSWMSSMARMPPTISPLNTSYRSGENLNLSCHAASNPPAQYSWFVNGTFQQSTQELFIPNITVNNSGSYTCQAHNSDTGLNRTTVTTITVYANIVKPHLY

SEQ ID NO: 886896 - protein, 114 aa, Homo sapiens
MSSMAQMPPPFPPLKAHITDPGENLNLSCHAASNPPAQYSWFINGTFQQSTQELFIPNITVNNSGSYMCQAHNSATGLNRTTVTMITVSGSAPVLSAVATVGITIGVLARVALI

SEQ ID NO: 886897 - protein, 676 aa, Homo sapiens
MQLEHCLSPSIMLSKKFLNVSSSYPHSGGSELVLHDHPIISTTDNLERSSPLKKITRGMTNQSDTDNFPDSKDSPGDVQRSKLSPVLDGVSELRHSFDGSAADRYLLSQSSQPQSAATAPSAMFPYPGQHGPAHPAFSIGSPSRYMAHHPVITNGAYNSLLSNSSPQGYPTAGYPYPQQYGHSYQGAPFYQFSSTQPGLVPGKAQVYLCNRPLWLKFHRHQTEMIITKQGRRMFPFLSFNISGLDPTAHYNILVDVILADPNHWRFQGGKWVPCGKADTNVQGNRVYMHPDSPNTGAHWMRQEISFGKLKLTNNKGASNNNGQMVVLQSLHKYQPRLHVVEVNEDGTEDTSQPGRVQTFTFPETQFIAVTAYQNTDITQLKIDHNPFAKGFRDNYDTIYTGCDMDRLTPSPNDSPRSQIVPGARYAMAGSFLQDQFVSNYAKARFHPGRVRTAACRTTNGLLSPQQAEDPGAPSPQRWFVTPANNRLDFAASAYDTATDFAGNAATLLSYAAAGVKALPLQAAGCTGRPLGYYADPSGWGARSPPQYCGTKSGSVLPCWPNSAAAAARMAGANPYLGEEAEGLAAERSPLPPGAAEDAKPKDLSDSSWIETPSSIKSIDSSDSGIYEQAKRRRISPADTPVSESSSPLKSEVLAQRDCEKNCAKDISGYYGFYSHS

SEQ ID NO: 886898 - protein, 682 aa, Homo sapiens
MQLEHCLSPSIMLSKKFLNVSSSYPHSGGSELVLHDHPIISTTDNLERSSPLKKITRGMTNQSDTDNFPDSKDSPGDVQRSKLSPVLDGVSELRHSFDGSAADRYLLSQSSQPQSAATAPSAMFPYPGQHGPAHPAFSIGSPSRYMAHHPVITNGAYNSLLSNSSPQGYPTAGYPYPQQYGHSYQGAPFYQFSSTQPGLVPGKAQVYLCNRPLWLKFHRHQTEMIITKQGRRMFPFLSFNISGLDPTAHYNILVDVILADPNHWRFQGGKWVPCGKADTNVQGNRVYMHPDSPNTGAHWMRQEISFGKLKLTNNKGASNNNGQMVVLQSLHKYQPRLHVVEVNEDGTEDTSQPGRVQTFTFPETQFIAVTAYQNTDITQLKIDHNPFAKGFRDNYDTIYTGCDMDRLTPSPNDSPRSQIVPGARYAMAGSFLQDQFVSNYAKARFHPGAGAGPGPGTDRSVPHTNGLLSPQQAEDPGAPSPQRWFVTPANNRLDFAASAYDTATDFAGNAATLLSYAAAGVKALPLQAAGCTGRPLGYYADPSGWGARSPPQYCGTKSGSVLPCWPNSAAAAARMAGANPYLGEEAEGLAAERSPLPPGAAEDAKPKDLSDSSWIETPSSIKSIDSSDSGIYEQAKRRRISPADTPVSESSSPLKSEVLAQRDCEKNCAKDISGYYGFYSHS

SEQ ID NO: 886899 - protein, 92 aa, Homo sapiens
SCDGRGTAKMLRNLLALRQIGQRTISTASRRHFKNKVPEKQKLFQEDDEIPLYLKGGVADALLYRATMILTVGGTAYAIYELAVASFPKKQE

SEQ ID NO: 886900 - protein, 115 aa, Homo sapiens
MHTQDSEVVPVPAWPFSLVVFSCGGCWSVTAKMLRNLLALRQIGQRTISTASRRHFKNKVPEKQKLFQEDDEIPLYLKGGVADALLYRATMILTVGGTAYAIYELAVASFPKKQE

SEQ ID NO: 886901 - protein, 115 aa, Homo sapiens; identical to SEQ ID NO: 886900

SEQ ID NO: 886902 - protein, 92 aa, Homo sapiens; identical to SEQ ID NO: 886899

SEQ ID NO: 886903 - protein, 115 aa, Homo sapiens; identical to SEQ ID NO: 886900

SEQ ID NO: 886904 - protein, 115 aa, Homo sapiens; identical to SEQ ID NO: 886900

SEQ ID NO: 886905 - protein, 115 aa, Homo sapiens; identical to SEQ ID NO: 886900

SEQ ID NO: 886906 - protein, 245 aa, Homo sapiens
MRKKKTTKNHQKQIWGRRPTRKASLSTHHLSLEQARVTPSPAFNCNQSATKARFPTGHLRGRVTCGGGGFTTHNKNTCRGENTQTRGSGNQPHQVVGLSAEHTREASINQGEFANASSAAKQNNKHTAHEEDKQSAHDQKRNKTIANKTRRETSTDNSKSTVRARTETHPAALRSRTTDNDEANNYKMKKRAEPQNHSTSRTTRPSNTQNTHQDRQHRSRRPETHTAHHKPLQKRKITTDRTGND

SEQ ID NO: 886907 - protein, 115 aa, Homo sapiens; identical to SEQ ID NO: 886900

SEQ ID NO: 886908 - protein, 115 aa, Homo sapiens; identical to SEQ ID NO: 886900

SEQ ID NO: 886909 - protein, 103 aa, Homo sapiens
MHTQDSEVVPVPAWPFSLVVFSCGGCWSVTAKMLRNLLALRQIGQRTISTASRRHFKNKVPEKQKLFQEDDEIPLYLKGGVADALLYRATMILTVGASGYAIY

SEQ ID NO: 886910 - protein, 106 aa, Homo sapiens
MHTQDSEVVPVPAWPFSLVVFSCGGCWSVTAKMLRNLLALRQIGQRTISTASRRHFKNKVPEKQKLFQEDDEIPLYLKGGVADALLYRATMILTVGGKAFGMFEGL

SEQ ID NO: 886911 - protein, 115 aa, Homo sapiens; identical to SEQ ID NO: 886900

SEQ ID NO: 886912 - protein, 115 aa, Homo sapiens; identical to SEQ ID NO: 886900

SEQ ID NO: 886913 - protein, 115 aa, Homo sapiens; identical to SEQ ID NO: 886900

SEQ ID NO: 886914 - protein, 115 aa, Homo sapiens; identical to SEQ ID NO: 886900

SEQ ID NO: 886915 - protein, 166 aa, Homo sapiens
MAATMFRATLRGWRTGVQRGCGLRLLSQTQGPPDYPRFVESVDEYQFVERLLPATRIPDPPKHEHYPTPSGWQPPRDPPPNLPYFVRRSRMHNIPVYKDITHGNRQMTVIRKVEGDIWALQKDVEDFLSPLLGKTPVTQVNEVTGTLRIKGYFDQELKAWLLEKGF

SEQ ID NO: 886916 - protein, 178 aa, Homo sapiens
VTRGSTHASGQKMAATMFRATLRGWRTGVQRGCGLRLLSQTQGPPDYPRFVESVDEYQFVERLLPATRIPDPPKHEHYPTPSGWQPPRDPPPNLPYFVRRSRMHNIPVYKDITHGNRQMTVIRKVEGDIWALQKDVEDFLSPLLGKTPVTQVNEVTGTLRIKGYFDQELKAWLLEKGF

SEQ ID NO: 886917 - protein, 166 aa, Homo sapiens; identical to SEQ ID NO: 886915

SEQ ID NO: 886918 - protein, 146 aa, Homo sapiens
APANLPGQAARAGRGGTRQLRAQKAGVAGKDGSYHVPGYAAGMENRCPAGLRATAVDPPPNLPYFVRRSRMHNIPVYKDITHGNRQMTVIRKVEGDIWALQKDVEDFLSPLLGKTPVTQVNEVTGTLRIKGYFDQELKAWLLEKGF

SEQ ID NO: 886919 - protein, 150 aa, Homo sapiens
TPLIPSHTYRYPAAVESDEEKMAATMFRATLRGWRTGVQRGCGLRLLVRALSEELRASRGYPPPNLPYFVRRSRMHNIPVYKDITHGNRQMTVIRKVEGDIWALQKDVEDFLSPLLGKTPVTQVNEVTGTLRIKGYFDQELKAWLLEKGF

SEQ ID NO: 886920 - protein, 166 aa, Homo sapiens; identical to SEQ ID NO: 886915

SEQ ID NO: 886921 - protein, 166 aa, Homo sapiens; identical to SEQ ID NO: 886915

SEQ ID NO: 886922 - protein, 166 aa, Homo sapiens; identical to SEQ ID NO: 886915

SEQ ID NO: 886923 - protein, 166 aa, Homo sapiens; identical to SEQ ID NO: 886915

SEQ ID NO: 886924 - protein, 166 aa, Homo sapiens; identical to SEQ ID NO: 886915

SEQ ID NO: 886925 - protein, 119 aa, Homo sapiens
APANLPGQAARAGRGGTRQLRAQKAGVAGNPPPNLPYFVRRSRMHNIPVYKDITHGNRQMTVIRKVEGDIWALQKDVEDFLSPLLGKTPVTQVNEVTGTLRIKGYFDQELKAWLLEKGF

SEQ ID NO: 886926 - protein, 166 aa, Homo sapiens; identical to SEQ ID NO: 886915

SEQ ID NO: 886927 - protein, 166 aa, Homo sapiens; identical to SEQ ID NO: 886915

SEQ ID NO: 886928 - protein, 120 aa, Homo sapiens
TPLIPSHTYRYPAAVESDEEKMAATMFRATLRGWRTGVQRGCGLRLLSQTQGPPDYPRFVESVDEYQFVERLLPATRIPDPPKHEHYPTPSGWQPPRDPTLPPNWLRQLSVPDSPTWSLP

SEQ ID NO: 886929 - protein, 479 aa, Homo sapiens
MKSQGQHWYSSSDKNCKVSFREKLLIIDSNLGVQDVENLKFLCIGLVPNKKLEKSSSASDVFEHLLAEDLLSEEDPFFLAELLYIIRQKKLLQHLNCTKEEVERLLPTRQRVSLFRNLLYELSEGIDSENLKDMIFLLKDSLPKTEMTSLSFLAFLEKQGKIDEDNLTCLEDLCKTVVPKLLRNIEKYKREKAIQIVTPPVDKEAESYQGEEELVSQTDVKTFLEALPRAAVYRMNRNHRGLCVIVNNHSFTSLKDRQGTHKDAEILSHVFQWLGFTVHIHNNVTKVEMEMVLQKQKCNPAHADGDCFVFCILTHGRFGAVYSSDEALIPIREIMSHFTALQCPRLAEKPKLFFIQACQGEEIQPSVSIEADALNPEQAPTSLQDSIPAEADFLLGLATVPGYVSFRHVEEGSWYIQSLCNHLKKLVPRHEDILSILTAVNDDVSRRVDKQGTKKQMPQPAFTLRKKLVFPVPLDALSI

SEQ ID NO: 886930 - protein, 522 aa, Homo sapiens [sequence omitted]

SEQ ID NO: 886931 - protein, 521 aa, Homo sapiens
MKSQGQHWYSSSDKNCKVSFREKLLIIDSNLGVQDVENLKFLCIGLVPNKKLEKSSSASDVFEHLLAEDLLSEEDPFFLAELLYIIRQKKLLQHLNCTKEEVERLLPTRQRVSLFRNLLYELSEGIDSENLKDMIFLLKDSLPKTEMTSLSFLAFLEKQGKIDEDNLTCLEDLCKTVVPKLLRNIEKYKREKAIQIVTPPVDKEAESYQGEEELVSQTDVKTFLEALPQESWQNKHAGSNGNRATNGAPSLVSRGMQGASANTLNSETSTKRAAVYRMNRNHRGLCVIVNNHSFTSLKDRQGTHKDAEILSHVFQWLGFTVHIHNNVTKVEMEMVLQKQKCNPAHADGDCFVFCILTHGRFGAVYSSDEALIPIREIMSHFTALQCPRLAEKPKLFFIQACQGEEIQPSVSIEADALNPEQAPTSLQDSIPAEADFLLGLATVPGYVSFRHVEEGSWYIQSLCNHLKKLVPRMLKFLEKTMEIRGRKRTVWGAKQISATSLPTAISAQTPRPPMRRWSSVS

SEQ ID NO: 886932 - protein, 522 aa, Homo sapiens [sequence omitted]

SEQ ID NO: 886933 - protein, 245 aa, Homo sapiens [sequence omitted]

SEQ ID NO: 886934 - protein, 265 aa, Homo sapiens
MKSQGQHWYSSSDKNCKVSFREKLLIIDSNLGVQDVENLKFLCIGLVPNKKLEKSSSASDVFEHLLAEDLLSEEDPFFLAELLYIIRQKKLLQHLNCTKEEVERLLPTRQRVSLFRNLLYELSEGIDSENLKDMIFLLKDSLPKTEMTSLSFLAFLEKQGKIDEDNLTCLEDLCKTVVPKLLRNIEKYKREKAIQIVTPPVDKEAESYQGEEELVSQTDVKTFLEALPVGSVVCWSMLNNRLHPPTSPPCHPKKKRPLSLCRNKE

SEQ ID NO: 886935 - protein, 182 aa, Homo sapiens
HKCKALFVILGVCLRNLLYELSEGIDSENLKDMIFLLKDSLPKTEMTSLSFLAFLEKQGKIDEDNLTCLEDLCKTVVPKLLRNIEKYKREKAIQIVTPPVDKEAESYQGEEELVSQTDVKTFLEALPVGSVVCWSMLNNRLHPPTSPPCHPKKKRPLSLCRNKERTIHSWKLERRLEQQQKG

SEQ ID NO: 886936 - protein, 491 aa, Homo sapiens
MKSQGQHWYSSSDKNCKVSFREKLLIIDSNLGVQDVENLKFLCIGLVPNKKLEKSSSASDVFEHLLAEDLLSEEDPFFLAELLYIIRQKKLLQHLNCTKEEVERLLPTRQRVSLFRNLLYELSEGIDSENLKDMIFLLKDSLPKTEMTSLSFLAFLEKQGKIDEDNLTCLEDLCKTVVPKLLRNIEKYKREKAIQIVTPPVDKEAESYQGEEELVSQTDVKTFLEALPQEPGKISMQVVMRAAVYRMNRNHRGLCVIVNNHSFTSLKDRQGTHKDAEILSHVFQWLGFTVHIHNNVTKVEMEMVLQKQKCNPAHADGDCFVFCILTHGRFGAVYSSDEALIPIREIMSHFTALQCPRLAEKPKLFFIQACQGEEIQPSVSIEADALNPEQAPTSLQDSIPAEADFLLGLATVPGYVSFRHVEEGSWYIQSLCNHLKKLVPRHEDILSILTAVNDDVSRRVDKQGTKKQMPQPAFTLRKKLVFPVPLDALSI

SEQ ID NO: 886937 - protein, 161 aa, Homo sapiens
MKSQGQHWYSSSDKNCKVSFREKLLIIDSNLGVQDVENLKFLCIGLVPNKKLEKSSSASDVFEHLLAEDLLSEEDPFFLAELLYIIRQKKLLQHLNCTKEEVERLLPTRQRVSLFRNLLYELSEGIDSENLKDMIFLLKDSLPKTEMTSLFLAFLEKGPKL

SEQ ID NO: 886938 - protein, 522 aa, Homo sapiens [sequence omitted]

SEQ ID NO: 886939 - protein, 194 aa, Homo sapiens
MKSQGQHWYSSSDKNCKVSFREKLLIIDSNLGVQDVENLKFLCIGLVPNKKLEKSSSASDVFEHLLAEDLLSEEDPFFLAELLYIIRQKKLLQHLNCTKEEVERLLPTRQRVSLFRNLLYELSEGIDSENLKDMIFLLKDSLPKTEMTSLSFLAFLEKQGKIDEDNLTCLEDLCKTVVPKLLRNIEKYKREKGK

SEQ ID NO: 886940 - protein, 221 aa, Homo sapiens
REGDAVRRRVGAPVLGRLASPRRRGRRCCCGPHGAAVADPAQPGASGMSSAAADHWAWLLVLSFVFGCNVLRILLPSFSSFMSRVLQKDAEQESQMRAEIQDMKQELSTVNMMDEFARYARLERKINKMTDKLKTHVKARTAQLAKIKWVISVAFYVLQAALMISLIWKYYSVPVAVVPSKWITPLDRLVAFPTRVAGGVGITCWILVCNKVVAIVLHPFS

SEQ ID NO: 886941 - protein, 115 aa, Homo sapiens
FKVSPRDISGCACSSVVCGDWVPRLEVLSLESFPGFIFAFPCPPFCVVGCVIGRLLCSPEVSLQAALMISLIWKYYSVPVAVVPSKWITPLDRLVAFPTRVAGKNFLEDAVEECE

SEQ ID NO: 886942 - protein, 90 aa, Homo sapiens
MSSAAADHWAWLLVLSFVFGCNVLRILLPSFSSFKSRGLQKGAERELQNYSRDHDISRAFPINMLRVFKFHVEESSQCGIFTPLLASLLP

SEQ ID NO: 886943 - protein, 221 aa, Homo sapiens; identical to SEQ ID NO: 886940

SEQ ID NO: 886944 - protein, 169 aa, Homo sapiens
ADTLRRLAGRGFQALNGELSLLCGRRRRPMSRVLQKDAEQESQMRAEIQDMKQELSTVNMMDEFARYARLERKINKMTDKLKTHVKARTAQLAKIKWVISVAFYVLQAALMISLIWKYYSVPVAVVPSKWITPLDRLVAFPTRVAGGVGITCWILVCNKVVAIVLHPFS

SEQ ID NO: 886945 - protein, 140 aa, Homo sapiens
MSRVLQKDAEQESQMRAEIQDMKQELSTVNMMDEFARYARLERKINKMTDKLKTHVKARTAQLAKIKWVISVAFYVLQAALMISLIWKYYSVPVAVVPSKWITPLDRLVAFPTRVAGGVGITCWILVCNKVVAIVLHPFS

SEQ ID NO: 886946 - protein, 221 aa, Homo sapiens; identical to SEQ ID NO: 886940

SEQ ID NO: 886947 - protein, 209 aa, Homo sapiens
MDQAWEWSPSISLGGRLSASQDLPQNPVTQKRACEVRMCGQGLQWGSRGGSSQGLGLVAWRAARFSALPMSRVLQKDAEQESQMRAEIQDMKQELSTVNMMDEFARYARLERKINKMTDKLKTHVKARTAQLAKIKWVISVAFYVLQAALMISLIWKYYSVPVAVVPSKWITPLDRLVAFPTRVAGGVGITCWILVCNKVVAIVLHPFS

SEQ ID NO: 886948 - protein, 150 aa, Homo sapiens
REGDAVRRRVGAPVLGRLASPRRRGRRCCCGPHGAAVADPAQPGASGMSSAAADHWAWLLVLSFVFGCNVLRILLPSFSSFMSRVLQKDAEQESQMRAEIQDMKQELSTVNMMDEFARYARLERKINKMTDKLKTHGTVSLAAWRLHESG

SEQ ID NO: 886949 - protein, 151 aa, Homo sapiens
ADTLRRLAGRGFQALNGELSLLCGRRRRPMSRVLQKDAEQESQMRAEIQDMKQELSTVNMMDEFARYARLERKINKMTDKLKTHVKARTAQLAKIIIWKYYSVPVAVVPSKWITPLDRLVAFPTRVAGGVGITCWILVCNKVVAIVLHPFS

SEQ ID NO: 886950 - protein, 168 aa, Homo sapiens
REGDAVRRRVGAPVLGRLASPRRRGRRCCCGPHGAAVADPAQPGASGMSSAAADHWAWLLVLSFVFGCNVLRILLPSFSSFMSRVLQKDAEQESQMRAEIQDMKQELSTVNMMDEFARYARLERKINKMTDKLKTHVKARTAQLAKIKWVISVAFYVLQVVLELPVGF

SEQ ID NO: 886951 - protein, 66 aa, Homo sapiens
ERPPGQVHLPCYDLSPLYKCVGVLVQMSFEVYLRRVTGGVYAGGVGITCWILVCNKVVAIVLHPFS

SEQ ID NO: 886952 - protein, 220 aa, Homo sapiens
REGDAVRRRVGAPVLGRLASPRRRGRRCCCGPHGAAVADPAQPGASGMSSAAADHWAWLLVLSFVFGCNVLRILLPSFSSFMSRVLQKDAEQESQMRAEIQDMKQELSTVNMMDEFARYARLERKINKMTDKLKTHVKARTAQLAKIKWVISVAFYVLQAALMISLIWKYYSVPVAVVPSKWITPLDRLVAFPTRVAGDDGLIEFTTVTLESPKAWLVEA

SEQ ID NO: 886953 - protein, 150 aa, Homo sapiens; identical to SEQ ID NO: 886948

SEQ ID NO: 886954 - protein, 473 aa, Homo sapiens
AWARALPTECGFEPPHLAPLSDPEAPSMESPEPVKPEQGFVWQEASEFEADTAGSTVERHKKAQLDRLDINVQIDDSYLVEAGDRQKRWQCRMCEKSYTSKYNLVTHILGHNGIKPHSCPHCSKLFKQPSHLQTHLLTHQGTRPHKCQVCHKAFTQTSHLKRHMLLHSEVKPYSCHFCGRGFAYPSELKAHEVKHESGRCHVCVECGLDFSTLTQLKRHLASHQGPTLYQCLECDKSFHYRSQLQNHMLKHQNVRPFVCTECGMEFSQIHHLKQHSLTHKGVKEFKCEVCGREFTLQANMKRHMLIHTSVRPYQCHICFKTFVQKQTLKTHMIVHSPVKPFKCKVCGKSFNRMYNLLGHMHLHAGSKPFKCPYCSSKFNLKGNLSRHMKVKHGVMDIGLDSQGGWAKRNGQSRNDTNMTHSGASCPVRGVGRLAKAETSLGWAQVWKGGTLEGHDDNNDGIFMSSSKDLNEIT

SEQ ID NO: 886955 - protein, 473 aa, Homo sapiens; identical to SEQ ID NO: 886954

SEQ ID NO: 886956 - protein, 581 aa, Homo sapiens
AWARALPTECGFEPPHLAPLSDPEAPSMESPEPVKPEQGFVWQEASEFEADTAGSTVERHKKAQLDRLDINVQIDDSYLVEAGDRQKRWQCRMCEKSYTSKYNLVTHILGHNGIKPHSCPHCSKLFKQPSHLQTHLLTHQGTRPHKCQVCHKAFTQTSHLKRHMLLHSEVKPYSCHFCGRGFAYPSELKAHEVKHESGRCHVCVECGLDFSTLTQLKRHLASHQGPTLYQCLECDKSFHYRSQLQNHMLKHQNVRPFVCTECGMEFSQIHHLKQHSLTHKGVKEFKCEVCGREFTLQANMKRHMLIHTSVRPYQCHICFKTFVQKQTLKTHMIVHSPVKPFKCKVCGKSFNRMYNLLGHMHLHAGSKPFKCPYCSSKFNLKGNLSRHMKVKHGVMDIGLDSQDPMMELTGTDPSELDGQQEMEDFEENAYSYASVDSSAEASVLTEQAMKEMAYYNVLVAQAGPPLTGAGGEGMGVRPMGCRLHLLQPRNKLLPHCSEPSLPESFAPLGTFRPNGDCTTGPGCEPAQAQASQQGKENTRGPDLGLPGLLPWGVGEVGPLGTGHKGTGPRGLSRPSRALQGS

SEQ ID NO: 886957 - protein, 581 aa, Homo sapiens; identical to SEQ ID NO: 886956

SEQ ID NO: 886958 - protein, 473 aa, Homo sapiens; identical to SEQ ID NO: 886954

SEQ ID NO: 886959 - protein, 581 aa, Homo sapiens; identical to SEQ ID NO: 886956

SEQ ID NO: 886960 - protein, 158 aa, Homo sapiens
MNKQRGTYSEVSLAQDPKRQQRKLKGNKISISGTKQEIFQVELNLQNASSDHQGNDKTYHCKGLLPPPEKLTAEVLGIICIVLMATVLKTIVLIPCIGVLEQNNFSLNRRMQKARHCGHCPEEWITYSNSCYYIGKERRTWEERVCWPVLRRTLICFL

SEQ ID NO: 886961 - protein, 158 aa, Homo sapiens; identical to SEQ ID NO: 886960

SEQ ID NO: 886962 - protein, 158 aa, Homo sapiens; identical to SEQ ID NO: 886960

SEQ ID NO: 886963 - protein, 1154 aa, Homo sapiens
MQYLNIKEDCNAMAFCAKMRSSKKTEVNLEAPEPGVEVIFYLSDREPLRLGSGEYTAEELCIRAAQACRISPLCHNLFALYDENTKLWYAPNRTITVDDKMSLRLHYRMRFYFTNWHGTNDNEQSVWRHSPKKQKNGYEKKKIPDATPLLDASSLEYLFAQGQYDLVKCLAPIRDPKTEQDGHDIENECLGMAVLAISHYAMMKKMQLPELPKDISYKRYIPETLNKSIRQRNLLTRMRINNVFKDFLKEFNNKTICDSSVSTHDLKVKYLATLETLTKHYGAEIFETSMLLISSENEMNWFHSNDGGNVLYYEVMVTGNLGIQWRHKPNVVSVEKEKNKLKRKKLENKHKKDEEKNKIREEWNNFSYFPEITHIVIKESVVSINKQDNKKMELKLSSHEEALSFVSLVDGYFRLTADAHHYLCTDVAPPLIVHNIQNGCHGPICTEYAINKLRQEGSEEGMYVLRWSCTDFDNILMTVTCFEKSEQVQGAQKQFKNFQIEVQKGRYSLHGSDRSFPSLGDLMSHLKKQILRTDNISFMLKRCCQPKPREISNLLVATKKAQEWQPVYPMSQLSFDRILKKDLVQGEHLGRGTRTHIYSGTLMDYKDDEGTSEEKKIKVILKVLDPSHRDISLAFFEAASMMRQVSHKHIVYLYGVCVRDVENIMVEEFVEGGPLDLFMHRKSDVLTTPWKFKVAKQLASALSYLEDKDLVHGNVCTKNLLLAREGIDSECGPFIKLSDPGIPITVLSRQECIERIPWIAPECVEDSKNLSVAADKWSFGTTLWEICYNGEIPLKDKTLIEKERFYESRCRPVTPSCKELADLMTRCMNYDPNQRPFFRAIMRDINKLEEQNPDIVSEKKPATEVDPTHFEKRFLKRIRDLGEGHFGKVELCRYDPEGDNTGEQVAVKSLKPESGGNHIADLKKEIEILRNLYHENIVKYKGICTEDGGNGIKLIMEFLPSGSLKEYLPKNKNKINLKQQLKYAVQICKGMDYLGSRQYVHRDLAARNVLVESEHQVKIGDFGLTKAIETDKEYYTVKDDRDSPVFWYAPECLMQSKFYIASDVWSFGVTLHELLTYCDSDSSPMALFLKMIGPTHGQMTVTRLVNTLKEGKRLPCPPNCPDEVYQLMRKCWEFQPSNRTSFQNLIEGFEALLK

SEQ ID NO: 886964 - protein, 1154 aa, Homo sapiens; identical to SEQ ID NO: 886963

SEQ ID NO: 886965 - protein, 1154 aa, Homo sapiens; identical to SEQ ID NO: 886963

SEQ ID NO: 886966 - protein, 175 aa, Homo sapiens [sequence omitted]

SEQ ID NO: 886967 - protein, 175 aa, Homo sapiens [sequence omitted]

SEQ ID NO: 886968 - protein, 1174 aa, Homo sapiens
MQYLNIKEDCNAMAFCAKMRSSKKTEVNLEAPEPGVEVIFYLSDREPLRLGSGEYTAEELCIRAAQACRISPLCHNLFALYDENTKLWYAPNRTITVDDKMSLRLHYRMRFYFTNWHGTNDNEQSVWRHSPKKQKNGYEKKKIPDATPLLDASSLEYLFAQGQYDLVKCLAPIRDPKTEQDGHDIENECLGMAVLAISHYAMMKKMQLPELPKDISYKRYIPETLNKSIRQRNLLTRMRINNVFKDFLKEFNNKTICDSSVSTHDLKVKYLATLETLTKHYGAEIFETSMLLISSENEMNWFHSNDGGNVLYYEVMVTGNLGIQWRHKPNVVSVEKEKNKLKRKKLENKHKKDEEKNKIREEWNNFSYFPEITHIVIKESVVSINKQDNKKMELKLSSHEEALSFVSLVDGYFRLTADAHHYLCTDVAPPLIVHNIQNGCHGPICTEYAINKLRQEGSEEGMYVLRWSCTDFDNILMTVTCFEKSEQVQGAQKQFKNFQIEVQKGRYSLHGSDRSFPSLGDLMSHLKKQILRTDNISFMLKRCCQPKPREISNLLVATKKAQEWQPVYPMSQLSFDRILKKDLVQGEHLGRGTRTHIYSGTLMDYKDDEGTSEEKKIKVILKVLDPSHRDISLAFFEAASMMRQVSHKHIVYLYGVCVRDVENIMVEEFVEGGPLDLFMHRKSDVLTTPWKFKVAKQLASALSYLEDKDLVHGNVCTKNLLLAREGIDSECGPFIKLSDPGIPITVLSRQECIERIPWIAPECVEDSKNLSVAADKWSFGTTLWEICYNGEIPLKDKTLIEKERFYESRCRPVTPSCKELADLMTRCMNYDPNQRPFFRAIMRDINKLEEQNPDIVSEKKPATEVDPTHFEKRFLKRIRDLGEGHFGKVELCRYDPEGDNTGEQVAVKSLKPESGGNHIADLKKEIEILRNLYHENIVKYKGICTEDGGNGIKLIMEFLPSGSLKEYLPKNKNKINLKQQLKYAVQICKGMDYLGSRQYVHRDLAARNVLVESEHQVKIGDFGLTKAIETDKEYYTVKDDRDSPVFWYAPECLMQSKFYIASDVWSFGVTLHELLTYCDSDSSPMALFLKMIGPTHGQMTVTRLVNTLKEGKRLPCPPNCPDEVYQLMRKCWEFQPSNRTSFQNLIEGFEALLNVIHGFLFYKVDAAANLVVVV

SEQ ID NO: 886969 - protein, 666 aa, Homo sapiens
MQYLNIKEDCNAMAFCAKMRSSKKTEVNLEAPEPGVEVIFYLSDREPLRLGSGEYTAEELCIRAAQACRISPLCHNLFALYDENTKLWYAPNRTITVDDKMSLRLHYRMRFYFTNWHGTNDNEQSVWRHSPKKQKNGYEKKKIPDATPLLDASSLEYLFAQGQYDLVKCLAPIRDPKTEQDGHDIENECLGMAVLAISHYAMMKKMQLPELPKDISYKRYIPETLNKSIRQRNLLTRMRINNVFKDFLKEFNNKTICDSSVSTHDLKVKYLATLETLTKHYGAEIFETSMLLISSENEMNWFHSNDGGNVLYYEVMVTGNLGIQWRHKPNVVSVEKEKNKLKRKKLENKHKKDEEKNKIREEWNNFSYFPEITHIVIKESVVSINKQDNKKMELKLSSHEEALSFVSLVDGYFRLTADAHHYLCTDVAPPLIVHNIQNGCHGPICTEYAINKLRQEGSEEGMYVLRWSCTDFDNILMTVTCFEKSEQVQGAQKQFKNFQIEVQKGRYSLHGSDRSFPSLGDLMSHLKKQILRTDNISFMLKRCCQPKPREISNLLVATKKAQEWQPVYPMSQLSFDRILKKDLVQGEHLGRGTRTHIYSGTLMDYKDDEGTSEEKKIKVILKVLDPSHRDISLAFFEAASMMRQVSHKLFHHDILHVADTDAIEVH

SEQ ID NO: 886970 - protein, 367 aa, Homo sapiens
MQYLNIKEDCNAMAFCAKMRSSKKTEVNLEAPEPGVEVIFYLSDREPLRLGSGEYTAEELCIRAAQACRISPLCHNLFALYDENTKLWYAPNRTITVDDKMSLRLHYRMRFYFTNWHGTNDNEQSVWRHSPKKQKNGYEKKKIPDATPLLDASSLEYLFAQGQYDLVKCLAPIRDPKTEQDGHDIENECLGMAVLAISHYAMMKKMQLPELPKDISYKRYIPETLNKSIRQRNLLTRMRINNVFKDFLKEFNNKTICDSSVSTHDLKVKYLATLETLTKHYGAEIFETSMLLISSENEMNWFHSNDGGNVLYYEVMVTGNLGIQWRHKPNVVSVEKEKNKLKRKKLENKQGVGRKFLFSSPVRPTPR

SEQ ID NO: 886971 - protein, 1154 aa, Homo sapiens; identical to SEQ ID NO: 886963

SEQ ID NO: 886972 - protein, 581 aa, Homo sapiens
GICKPLHRVAQPGEHLGRGTRTHIYSGTLMDYKDDEGTSEEKKIKVILKVLDPSHRDISLAFFEAASMMRQVSHKHIVYLYGVCVRDVENIMVEEFVEGGPLDLFMHRKSDVLTTPWKFKVAKQLASALSYLEDKDLVHGNVCTKNLLLAREGIDSECGPFIKLSDPGIPITVLSRQECIERIPWIAPECVEDSKNLSVAADKWSFGTTLWEICYNGEIPLKDKTLIEKERFYESRCRPVTPSCKELADLMTRCMNYDPNQRPFFRAIMRDINKLEEQNPDIVSEKKPATEVDPTHFEKRFLKRIRDLGEGHFGKVELCRYDPEGDNTGEQVAVKSLKPESGGNHIADLKKEIEILRNLYHENIVKYKGICTEDGGNGIKLIMEFLPSGSLKEYLPKNKNKINLKQQLKYAVQICKGMDYLGSRQYVHRDLAARNVLVESEHQVKIGDFGLTKAIETDKEYYTVKDDRDSPVFWYAPECLMQSKFYIASDVWSFGVTLHELLTYCDSDSSPMALFLKMIGPTHGQMTVTRLVNTLKEGKRLPCPPNCPDEVYQLMRKCWEFQPSNRTSFQNLIEGFEALLK

SEQ ID NO: 886973 - protein, 175 aa, Homo sapiens [sequence omitted]

SEQ ID NO: 886974 - protein, 1047 aa, Homo sapiens
MQYLNIKEDCNAMAFCAKMRSSKKTEVNLEAPEPGVEVIFYLSDREPLRLGSGEYTAEELCIRAAQACRISPLCHNLFALYDENTKLWYAPNRTITVDDKMSLRLHYRMRFYFTNWHGTNDNEQSVWRHSPKKQKNGYEKKKIPDATPLLDASSLEYLFAQGQYDLVKCLAPIRDPKTEQDGHDIENECLGMAVLAISHYAMMKKMQLPELPKDISYKRYIPETLNKSIRQRNLLTRMRINNVFKDFLKEFNNKTICDSSVSTHDLKVKYLATLETLTKHYGAEIFETSMLLISSENEMNWFHSNDGGNVLYYEVMVTGNLGIQWRHKPNVVSVEKEKNKLKRKKLENKHKKDEEKNKIREEWNNFSYFPEITHIVIKESVVSINKQDNKKMELKLSSHEEALSFVSLVDGYFRLTADAHHYLCTDVAPPLIVHNIQNGCHGPICTEYAINKLRQEGSEEGMYVLRWSCTDFDNILMTVTCFEKSEQVQGAQKQFKNFQIEVQKGRYSLHGSDRSFPSLGDLMSHLKKQILRTDNISFMLKRCCQPKPREISNLLVATKKAQEWQPVYPMSQLSFDRILKKDLVQGEHLGRGTRTHIYSGTLMDYKDDEGTSEEKKIKVILKVLDPSHRDISLAFFEAASMMRQVSHKHIVYLYGVCVRDVENIMVEEFVEGGPLDLFMHRKSDVLTTPWKFKVAKQLASALSYLEDKDLVHGNVCTKNLLLAREGIDSECGPFIKLSDPGIPITVLSRQECIERIPWIAPECVEDSKNLSVAADKWSFGTTLWEICYNGEIPLKDKTLIEKERFYESRCRPVTPSCKELADLMTRCMNYDPNQRPFFRAIMRDINKLEEQNPDIVSEKKPATEVDPTHFEKRFLKRIRDLGEGHFGKVELCRYDPEGDNTGEQVAVKSLKPESGGNHIADLKKEIEILRNLYHENIVKYKGICTEDGGNGIKLIMEFLPSGSLKEYLPKNKNKINLKQQLKYAVQICKGMDYLGSRQYVHRDLAARNVLVESEHQVKIGDFGLTKAIETDKEYYTVKDDRDSPVFW

SEQ ID NO: 886975 - protein, 574 aa, Homo sapiens [sequence omitted]

SEQ ID NO: 886976 - protein, 179 aa, Homo sapiens
MQYLNIKEDCNAMAFCAKMRSSKKTEVNLEAPEPGVEVIFYLSDREPLRLGSGEYTAEELCIRAAQACRISPLCHNLFALYDENTKLWYAPNRTITVDDKMSLRLHYRMRFYFTNWHGTNDNEQSVWRHSPKKQKNGYEKKKIPDATPLLDASSLEYLFAQVGSLGPGEAGVCGMGEAL

SEQ ID NO: 886977 - protein, 114 aa, Homo sapiens
MAAIPSSGSLVATHDYYRRRLGSTSSNSSCSSTECPGEAIPHPPGLPKADPGHWWASFFFGKSTLPFMATVLESAEHSEPPQASSSMTACGLARDAPRKQPGGQSSTASAGPPS

SEQ ID NO: 886978 - protein, 114 aa, Homo sapiens; identical to SEQ ID NO: 886977

SEQ ID NO: 886979 - protein, 114 aa, Homo sapiens; identical to SEQ ID NO: 886977

SEQ ID NO: 886980 - protein, 114 aa, Homo sapiens; identical to SEQ ID NO: 886977

SEQ ID NO: 886981 - protein, 114 aa, Homo sapiens; identical to SEQ ID NO: 886977

SEQ ID NO: 886982 - protein, 114 aa, Homo sapiens; identical to SEQ ID NO: 886977

SEQ ID NO: 886983 - protein, 114 aa, Homo sapiens; identical to SEQ ID NO: 886977

SEQ ID NO: 886984 - protein, 114 aa, Homo sapiens; identical to SEQ ID NO: 886977

SEQ ID NO: 886985 - protein, 114 aa, Homo sapiens; identical to SEQ ID NO: 886977

SEQ ID NO: 886986 - protein, 114 aa, Homo sapiens; identical to SEQ ID NO: 886977

SEQ ID NO: 886987 - protein, 114 aa, Homo sapiens; identical to SEQ ID NO: 886977

SEQ ID NO: 886988 - protein, 114 aa, Homo sapiens; identical to SEQ ID NO: 886977

SEQ ID NO: 886989 - protein, 114 aa, Homo sapiens; identical to SEQ ID NO: 886977

SEQ ID NO: 886990 - protein, 114 aa, Homo sapiens; identical to SEQ ID NO: 886977

SEQ ID NO: 886991 - protein, 114 aa, Homo sapiens; identical to SEQ ID NO: 886977

SEQ ID NO: 886992 - protein, 223 aa, Homo sapiens
PGAGPFNPCRPRTGRAAPRRTPQGWAQPKPDGESRTEVEAGGAASPGPGKGRGRVGPGEEPVRPALRDAPRPPAYKWARRTRGSTPRAPLCRGAASRGLLCKWAPWPSAPVPATRDRAPRPARGRRPGRLGSTSSNSSCSSTECPGEAIPHPPGLPKADPGHWWASFFFGKSTLPFMATVLESAEHSEPPQASSSMTACGLARDAPRKQPGGQSSTASAGPPS

SEQ ID NO: 886993 - protein, 140 aa, Homo sapiens
MAAIPSSGSLVATHDYYRRRLGSTSSNSSCSSTECPGEAIPHPPGECRIAPFSPRSSRSWQHQDPTSLLSGLPKADPGHWWASFFFGKSTLPFMATVLESAEHSEPPQASSSMTACGLARDAPRKQPGGQSSTASAGPPS

SEQ ID NO: 886994 - protein, 239 aa, Homo sapiens
RARGLLTPADPGPAGPPQDERRRAGLSPSQTARVAPRWKLGARPRRGQERGGAGWGPGRSLCAPPSVTRRGPRAYKWARRTRGSTPRAPLCRGAASRGLLCKWAPWPSAPVPATRDRAPRPARGRRPDPTSQQAKAWRPSPPAARSWPPTTTTGAAWVPLPATAPAAVPSAPGKPFPTPQLLFREVHPPVHGHGVGVRRALGTSPGLQQHDRLWPGSGRPEEAARRSVQHSQRWAPVLT

SEQ ID NO: 886995 - protein, 114 aa, Homo sapiens; identical to SEQ ID NO: 886977

SEQ ID NO: 886996 - protein, 185 aa, Homo sapiens
RARGLLTPADPGPAGPPQDERRRAGLSPSQTARVAPRWKLGARPRRGQERGGAGWGPGRSLCAPPSVTRRGPRAYKWARRTRGSTPRAPLCRGAASRGLLCKWAPWPSAPVPATRDRAPRPARGRRPDPTSQQAKAWRPSPPAARSWPPTTTTGQHDRLWPGSGRPEEAARRSVQHSQRWAPVLT

SEQ ID NO: 886997 - protein, 205 aa, Homo sapiens
RARGLLTPADPGPAGPPQDERRRAGLSPSQTARVAPRWKLGARPRRGQERGGAGWGPGRSLCAPPSVTRRGPRAYKWARRTRGSTPRAPLCRGAASRGLLCKWAPWPSAPVPATRDRAPRPARGRRPDPTSQQAKAWRPSPPAARSWPPTTTTGAAWVPLPATAPAAVPSAPGKPFPTPQVSPRLTRVIGGPASFSGSPPPPPTL

SEQ ID NO: 886998 - protein, 128 aa, Homo sapiens
MAAIPSSGSLVATHDYYRRRLGSTSSNSSCSSTECPGEAIPHPPASPRVDPGLFVCGPRFLSRRMLPPSWIGSPDGLVVPLGKIVCGTSPHEALTVAVSSMTACGLARDAPRKQPGGQSSTASAGPPS

SEQ ID NO: 886999 - protein, 114 aa, Homo sapiens; identical to SEQ ID NO: 886977

SEQ ID NO: 887000 - protein, 74 aa, Homo sapiens
SPRRPDPASRSSVEPAAAFSGCAAGVRAAAAASRPSHQHSRHQKPVRAPLSTARPQHSLAFLTPGTVHLAPSGK

SEQ ID NO: 887001 - protein, 376 aa, Homo sapiens
MSKSVPAFLQDESDDRETDTASESSYQLSRHKKSPSSLTNLSSSSGMTSLSSVSGSVMSVYSGDFGNLEVKGNIQFAIEYVESLKELHVFVAQCKDLAAADVKKQRSDPYVKAYLLPDKGKMGKKKTLVVKKTLNPVYNEILRYKIEKQILKTQKLNLSIWHRDTFKRNSFLGEVELDLETWDWDNKQNKQLRWYPLKRKTAPVALEAENRGEMKLALQYVPEPVPGKKLPTTGEVHIWVKECLDLPLLRGSHLNSFVKCTILPDTSRKSRQKTRAVGKTTNPIFNHTMVYDGFRPEDLMEACVELTVWDHYKLTNQFLGGLRIGFGTGKSYGTEVDWMDSTSEEVALWEKMVNSPNTWIEATLPLRMLLIAKISK

SEQ ID NO: 887002 - protein, 910 aa, Homo sapiens
MIDLSFLTEEEQEAIMKVLQRDAALKRAEEERVRHLPEKIKDDQQLKNMSGQWFYEAKAKRHRDKIHGADIIRASMRKKRPQIAAEQSKDRENGAKESWVNNVNKDAFLPPELAGVVEEPEEDAAPASPSSSVVNPASSVIDMSQENTRKPNVSPEKRKNPFNSSKLPEGHSSQQTKNEQSKNGRTGLFQTSKEDELSESKEKSTVADTSIQKLEKSKQTLPGLSNGSQIKAPIPKARKMIYKSTDLNKDDNQSFPRQRTDSLKARGAPRGILKRNSSSSSTDSETLRYNHNFEPKSKIVSPGLTIHERISEKEHSLEDNSSPNSLEPLKHVRFSAVKDELPQSPGLIHGREVGEFSVLESDRLKNGMEDAGDTEEFQSDPKPSQYRKPSLFHQSTSSPYVSKSETHQPMTSGSFPINGLHSHSEVLTARPQSMENSPTINEPKDKSSELTRLESVLPRSPADELSHCVEPEPSQVPGGSSRDRQQGSEEEPSPVLKTLERSAARKMPSKSLEDISSDSSNQAKVDNQPEELVRSAEDDEKPDQKPVTNECVPRISTVPTQPDNPFSHPDKLKRMSKSVPAFLQDEVSGSVMSVYSGDFGNLEVKGNIQFAIEYVESLKELHVFVAQCKDLAAADVKKQRSDPYVKAYLLPDKGKMGKKKTLVVKKTLNPVYNEILRYKIEKQILKTQKLNLSIWHRDTFKRNSFLGEVELDLETWDWDNKQNKQLRWYPLKRKTAPVALEAENRGEMKLALQYVPEPVPGKKLPTTGEVHIWVKECLDLPLLRGSHLNSFVKCTILPDTSRKSRQKTRAVGKTTNPIFNHTMVYDGFRPEDLMEACVELTVWDHYKLTNQFLGGLRIGFGTGKSYGTEVDWMDSTSEEVALWEKMVNSPNTWIEATLPLRMLLIAKISK

SEQ ID NO: 887003 - protein, 934 aa, Homo sapiens
MIDLSFLTEEEQEAIMKVLQRDAALKRAEEERVRHLPEKIKDDQQLKNMSGQWFYEAKAKRHRDKIHGADIIRASMRKKRPQIAAEQSKDRENGAKESWVNNVNKDAFLPPELAGVVEEPEEDAAPASPSSSVVNPASSVIDMSQENTRKPNVSPEKRKNPFNSSKLPEGHSSQQTKNEQSKNGRTGLFQTSKEDELSESKEKSTVADTSIQKLEKSKQTLPGLSNGSQIKAPIPKARKMIYKSTDLNKDDNQSFPRQRTDSLKARGAPRGILKRNSSSSSTDSETLRYNHNFEPKSKIVSPGLTIHERISEKEHSLEDNSSPNSLEPLKHVRFSAVKDELPQSPGLIHGREVGEFSVLESDRLKNGMEDAGDTEEFQSDPKPSQYRKPSLFHQSTSSPYVSKSETHQPMTSGSFPINGLHSHSEVLTARPQSMENSPTINEPKDKSSELTRLESVLPRSPADELSHCVEPEPSQVPGGSSRDRQQGSEEEPSPVLKTLERSAARKMPSKSLEDISSDSSNQAKVDNQPEELVRSAEDVSTVPTQPDNPFSHPDKLKRMSKSVPAFLQDESDDRETDTASESSYQLSRHKKSPSSLTNLSSSSGMTSLSSVSGSVMSVYSGDFGNLEVKGNIQFAIEYVESLKELHVFVAQCKDLAAADVKKQRSDPYVKAYLLPDKGKMGKKKTLVVKKTLNPVYNEILRYKIEKQILKTQKLNLSIWHRDTFKRNSFLGEVELDLETWDWDNKQNKQLRWYPLKRKTAPVALEAENRGEMKLALQYVPEPVPGKKLPTTGEVHIWVKECLDLPLLRGSHLNSFVKCTILPDTSRKSRQKTRAVGKTTNPIFNHTMVYDGFRPEDLMEACVELTVWDHYKLTNQFLGGLRIGFGTGKSYGTEVDWMDSTSEEVALWEKMVNSPNTWIEATLPLRMLLIAKISK

SEQ ID NO: 887004 - protein, 336 aa, Homo sapiens
MSKSVPAFLQDEVSGSVMSVYSGDFGNLEVKGNIQFAIEYVESLKELHVFVAQCKDLAAADVKKQRSDPYVKAYLLPDKGKMGKKKTLVVKKTLNPVYNEILRYKIEKQILKTQKLNLSIWHRDTFKRNSFLGEVELDLETWDWDNKQNKQLRWYPLKRKTAPVALEAENRGEMKLALQYVPEPVPGKKLPTTGEVHIWVKECLDLPLLRGSHLNSFVKCTILPDTSRKSRQKTRAVGKTTNPIFNHTMVYDGFRPEDLMEACVELTVWDHYKLTNQFLGGLRIGFGTGKSYGTEVDWMDSTSEEVALWEKMVNSPNTWIEATLPLRMLLIAKISK

SEQ ID NO: 887005 - protein, 336 aa, Homo sapiens; identical to SEQ ID NO: 887004

SEQ ID NO: 887006 - protein, 365 aa, Homo sapiens
MSDDRETDTASESSYQLSRHKKSPSSLTNLSSSSGMTSLSSVSGSVMSVYSGDFGNLEVKGNIQFAIEYVESLKELHVFVAQCKDLAAADVKKQRSDPYVKAYLLPDKGKMGKKKTLVVKKTLNPVYNEILRYKIEKQILKTQKLNLSIWHRDTFKRNSFLGEVELDLETWDWDNKQNKQLRWYPLKRKTAPVALEAENRGEMKLALQYVPEPVPGKKLPTTGEVHIWVKECLDLPLLRGSHLNSFVKCTILPDTSRKSRQKTRAVGKTTNPIFNHTMVYDGFRPEDLMEACVELTVWDHYKLTNQFLGGLRIGFGTGKSYGTEVDWMDSTSEEVALWEKMVNSPNTWIEATLPLRMLLIAKISK

SEQ ID NO: 887007 - protein, 163 aa, Homo sapiens [sequence omitted]

SEQ ID NO: 887008 - protein, 934 aa, Homo sapiens; identical to SEQ ID NO: 887003

SEQ ID NO: 887009 - protein, 163 aa, Homo sapiens [sequence omitted]

SEQ ID NO: 887010 - protein, 133 aa, Homo sapiens
MFTILLKCSHNHASFCSTILPDTSRKSRQKTRAVGKTTNPIFNHTMVYDGFRPEDLMEACVELTVWDHYKLTNQFLGGLRIGFGTGKSYGTEVDWMDSTSEEVALWEKMVNSPNTWIEATLPLRMLLIAKISK

SEQ ID NO: 887011 - protein, 405 aa, Homo sapiens
MIDLSFLTEEEQEAIMKVLQRDAALKRAEEERVRHLPEKIKDDQQLKNMSGQWFYEAKAKRHRDKIHGADIIRASMRKKRPQIAAEQSKDRENGAKESWVNNVNKDAFLPPELAGVVEEPEEDAAPASPSSSVVNPASSVIDMSQENTRKPNVSPEKRKNPFNSSKLPEGHSSQQTKNEQSKNGRTGLFQTSKEDELSESKEKSTVADTSIQKLEKSKQTLPGLSNGSQIKAPIPKARKMIYKSTDLNKDDNQSFPRQRTDSLKARGAPRGILKRNSSSSSTDSETLRYNHNFEPKSKIVSPGLTIHERISEKEHSLEDNSSPNSLEPLKHVRFSAVKDELPQSPGLIHGREVGEFSVLESDRLKNGMEDAGDTEEFQSDPKPSQYRKPSLFHQSTSRPCGFVRD

SEQ ID NO: 887012 - protein, 376 aa, Homo sapiens; identical to SEQ ID NO: 887001

SEQ ID NO: 887013 - protein, 376 aa, Homo sapiens; identical to SEQ ID NO: 887001

SEQ ID NO: 887014 - protein, 336 aa, Homo sapiens; identical to SEQ ID NO: 887004

SEQ ID NO: 887015 - protein, 255 aa, Homo sapiens
MGKKKTLVVKKTLNPVYNEILRYKIEKQILKTQKLNLSIWHRDTFKRNSFLGEVELDLETWDWDNKQNKQLRWYPLKRKTAPVALEAENRGEMKLALQYVPEPVPGKKLPTTGEVHIWVKECLDLPLLRGSHLNSFVKCTILPDTSRKSRQKTRAVGKTTNPIFNHTMVYDGFRPEDLMEACVELTVWDHYKLTNQFLGGLRIGFGTGKSYGTEVDWMDSTSEEVALWEKMVNSPNTWIEATLPLRMLLIAKISK

SEQ ID NO: 887016 - protein, 934 aa, Homo sapiens; identical to SEQ ID NO: 887003

SEQ ID NO: 887017 - protein, 818 aa, Homo sapiens
MIDLSFLTEEEQEAIMKVLQRDAALKRAEEERVRHLPEKIKDDQQLKNMSGQWFYEAKAKRHRDKIHGADIIRASMRKKRPQIAAEQSKDRENGAKESWVNNVNKDAFLPPELAGVVEEPEEDAAPASPSSSVVNPASSVIDMSQENTRKPNVSPEKRKNPFNSSKLPEGHSSQQTKNEQSKNGRTGLFQTSKEDELSESKEKSTVADTSIQKLEKSKQTLPGLSNGSQIKAPIPKARKMIYKSTDLNKDDNQSFPRQRTDSLKARGAPRGILKRNSSSSSTDSETLRYNHNFEPKSKIVSPGLTIHERISEKEHSLEDNSSPNSLEPLKHVRFSAVKDELPQSPGLIHGREVGEFSVLESDRLKNGMEDAGDTEEFQSDPKPSQYRKPSLFHQSTSSPYVSKSETHQPMTSGSFPINGLHSHSEVLTARPQSMENSPTINEPKDKSSELTRLESVLPRSPADELSHCVEPEPSQVPGGSSRDRQQGSEEEPSPVLKTLERSAARKMPSKSLEDISSDSSNQAKVDNQPEELVRSAEDVSTVPTQPDNPFSHPDKLKRMSKSVPAFLQDESDDRETDTASESSYQLSRHKKSPSSLTNLSSSSGMTSLSSVSGSVMSVYSGDFGNLEVKGNIQFAIEYVESLKELHVFVAQCKDLAAADVKKQRSDPYVKAYLLPDKGKMGKKKTLVVKKTLNPVYNEILRYKIEKQILKTQKLNLSIWHRDTFKRNSFLGEVELDLETWDWDNKQNKQLRWYPLKRKTAPVALEAENRGEMKLALQYVPEPVPGKKLPTTGEVHIWVKECLDLPLLRGSHLNSFVKW

SEQ ID NO: 887018 - protein, 471 aa, Homo sapiens
MIDLSFLTEEEQEAIMKVLQRDAALKRAEEERVRHLPEKIKDDQQLKNMSGQWFYEAKAKRHRDKIHGADIIRASMRKKRPQIAAEQSKDRENGAKESWVNNVNKDAFLPPELAGVVEEPEEDAAPASPSSSVVNPASSVIDMSQENTRKPNVSPEKRKNPFNSSKLPEGHSSQQTKNEQSKNGRTGLFQTSKEDELSESKEKSTVADTSIQKLEKSKQTLPGLSNGSQIKAPIPKARKMIYKSTDLNKDDNQSFPRQRTDSLKARGAPRGILKRNSSSSSTDSETLRYNHNFEPKSKIVSPGLTIHERISEKEHSLEDNSSPNSLEPLKHVRFSAVKDELPQSPGLIHGREVGEFSVLESDRLKNGMEDAGDTEEFQSDPKPSQYRKPSLFHQSTSSPYVSKSETHQPMTSGSFPINGLHSHSEVLTARPQSMENSPTINEPKDKSSELTRLESVLPRSPAGKRVVTTRL

SEQ ID NO: 887019 - protein, 111 aa, Homo sapiens
MIDLSFLTEEEQEAIMKVLQRDAALKRAEEERVRHLPEKIKDDQQLKNMSGQWFYEAKAKRHRDKIHGADIIRASMRKKRPQIAGIQHPSESLFSTLSHRPGLPHGKEHLG

SEQ ID NO: 887020 - protein, 330 aa, Homo sapiens
MRFRLCHQRGCCPHERENTCTCKMIISSLQVIAADCKRVTVLKYFLEALCGQEEPLLAFKGGKYVSVAPVPDTMGKEMGSQEGTRLEDEEEDVVIEDFEEDSEAEGSGGEDDIRELRAKKLALARKIAEQQRRQEKIQAVLEDHSQMRQMELEIRPLFLVPDTNGFIDHLASLARLLESRKYILVVPLIVINELDGLAKGQETDHRAGGYARVVQEKARKSIEFLEQRFESRDSCLRALTSRGNELESIAFRSEDITGQLGNNDDLILSCCLHYCKDKAKDFMPASKEEPIRLLREVVLLTDDRNLRVKALTRNVPVRDIPAFLTWAQVG

SEQ ID NO: 887021 - protein, 411 aa, Homo sapiens [sequence omitted]

SEQ ID NO: 887022 - protein, 1388 aa, Homo sapiens
MKELKEARPRKDNRRPDLEIYKPGLSRLRNKPKIKEPPGSEEFKDEIVNDRDCSAVENGTQPVKDVCKELNNQEQNGPIDPENNRGQESFPRTAGQEDRSLKIIKRTKKPDLQIYQPGRRLQTVSKESASRVEEEEVLNQVEQLRVEEDECRGNVAKEEVANKPDRAEIEKSPGGGRVGAAKGEKGKRMGKGEGVRETHDDPARGRPGSAKRYSRSDKRRNRYRTRSTSSAGSNNSAEGAGLTDNGCRRRRQDRTKERPRLKKQVSVSSTDSLDEDRIDEPDGLGPRRSSERKRHLERNWSGRGEGEQKNSAKEYRGTLRVTFDAEAMNKESPMVRSARDDMDRGKPDKGLSSGGKGSEKQESKNPKQELRGRGRGILILPAHTTLSVNSAGSPESAPLGPRLLFGSGSKGSRSWGRGGTTRRLWDPNNPDQKPALKTQTPQLHFLDTDDEVSPTSWGDSRQAQASYYKFQNSDNPYYYPRTPGPASQYPYTGYNPLQYPVGPTNGVYPGPYYPGYPTPSGQYVCSPLPTSTMSPEEVEQHMRNLQQQELHRLLRVADNQELQLSNLLSRDRISPEGLEKMAQLRAELLQLYERCILLDIEFSDNQNVDQILWKNAFYQVIEKFRQLVKDPNVENPEQIRNRLLELLDEGSDFFDSLLQKLQVTYKFKLEDYMDGLAIRSKPLRKTVKYALISAQRCMICQGDIARYREQASDTANYGKARSWYLKAQHIAPKNGRPYNQLALLAVYTRRKLDAVYYYMRSLAASNPILTAKESLMSLFEETKRKAEQMEKKQHEEFDLSPDQWRKGKKSTFRHVGDDTTRLEIWIHPSHPRSSQGTESGKDSEQENGLGSLSPSDLNKRFILSFLHAHGKLFTRIGMETFPAVAEKVLKEFQVLLQHSPSPIGSTRMLQLMTINMFAVHNSQLKDCFSEECRSVIQEQAAALGLAMFSLLVRRCTCLLKESAKAQLSSPEDQDDQDDIKVSSFVPDLKELLPSVKVWSDWMLGYPDTWNPPPTSLDLPSHVAVDVWSTLADFCNILTAVNQSEVPLYKDPDDDLTLLILEEDRLLSGFVPLLAAPQDPCYVEKTSDKVIAADCKRVTVLKYFLEALCGQEEPLLAFKGGKYVSVAPVPDTMGKEMGSQEGTRLEDEEEDVVIEDFEEDSEAEGSGGEDDIRELRAKKLALARKIAEQQRRQEKIQAVLEDHSQMRQMELEIRPLFLVPDTNGFIDHLASLARLLESRKYILVVPLIVINELDGLAKGQETDHRAGGYARVVQEKARKSIEFLEQRFESRDSCLRALTSRGNELESIAFRSEDITGQLGNNDDLILSCCLHYCKDKAKDFMPASKEEPIRLLREVVLLTDDRNLRVKALTRNVPVRDIPAFLTWAQVG

SEQ ID NO: 887023 - protein, 600 aa, Homo sapiens
SLNPPDTPPMTNLDCAATGKKSTFRHVGDDTTRLEIWIHPSHPRSSQGTESGKDSEQENGLGSLSPSDLNKRFILSFLHAHGKLFTRIGMETFPAVAEKVLKEFQVLLQHSPSPIGSTRMLQLMTINMFAVHNSQLKDCFSEECRSVIQEQAAALGLAMFSLLVRRCTCLLKESAKAQLSSPEDQDDQDDIKVSSFVPDLKELLPSVKVWSDWMLGYPDTWNPPPTSLDLPSHVAVDVWSTLADFCNILTAVNQSEVPLYKDPDDDLTLLILEEDRLLSGFVPLLAAPQDPCYVEKTSDKVIAADCKRVTVLKYFLEALCGQEEPLLAFKGGKYVSVAPVPDTMGKEMGSQEGTRLEDEEEDVVIEDFEEDSEAEGSGGEDDIRELRAKKLALARKIAEQQRRQEKIQAVLEDHSQMRQMELEIRPLFLVPDTNGFIDHLASLARLLESRKYILVVPLIVINELDGLAKGQETDHRAGGYARVVQEKARKSIEFLEQRFESRDSCLRALTSRGNELESIAFRSEDITGQLGNNDDLILSCCLHYCKDKAKDFMPASKEEPIRLLREVVLLTDDRNLRVKALTRNVPVRDIPAFLTWAQVG

SEQ ID NO: 887024 - protein, 257 aa, Homo sapiens
GLKFDFVSVYQEEQQSEEDVVIEDFEEDSEAEGSGGEDDIRELRAKKLALARKIAEQQRRQEKIQAVLEDHSQMRQMELEIRPLFLVPDTNGFIDHLASLARLLESRKYILVVPLIVINELDGLAKGQETDHRAGGYARVVQEKARKSIEFLEQRFESRDSCLRALTSRGNELESIAFRSEDITGQLGNNDDLILSCCLHYCKDKAKDFMPASKEEPIRLLREVVLLTDDRNLRVKALTRNVPVRDIPAFLTWAQVG

SEQ ID NO: 887025 - protein, 105 aa, Homo sapiens
MSLTAALGPHLFYHPPQTYHTPFLLLLFLPLSTWVPHTSPVASPWTVMSLEERGIWSQARALGWPPPAPFLLTGLSFRLASSSGNVLTLLSSPFTPPCPPTLPPE

SEQ ID NO: 887026 - protein, 105 aa, Homo sapiens; identical to SEQ ID NO: 887025

SEQ ID NO: 887027 - protein, 1388 aa, Homo sapiens; identical to SEQ ID NO: 887022

SEQ ID NO: 887028 - protein, 1132 aa, Homo sapiens
MKELKEARPRKDNRRPDLEIYKPGLSRLRNKPKIKEPPGSEEFKDEIVNDRDCSAVENGTQPVKDVCKELNNQEQNGPIDPENNRGQESFPRTAGQEDRSLKIIKRTKKPDLQIYQPGRRLQTVSKESASRVEEEEVLNQVEQLRVEEDECRGNVAKEEVANKPDRAEIEKSPGGGRVGAAKGEKGKRMGKGEGVRETHDDPARGRPGSAKRYSRSDKRRNRYRTRSTSSAGSNNSAEGAGLTDNGCRRRRQDRTKERPRLKKQVSVSSTDSLDEDRIDEPDGLGPRRSSERKRHLERNWSGRGEGEQKNSAKEYRGTLRVTFDAEAMNKESPMVRSARDDMDRGKPDKGLSSGGKGSEKQESKNPKQELRGRGRGILILPAHTTLSVNSAGSPESAPLGPRLLFGSGSKGSRSWGRGGTTRRLWDPNNPDQKPALKTQTPQLHFLDTDDEVSPTSWGDSRQAQASYYKFQNSDNPYYYPRTPGPASQYPYTGYNPLQYPVGPTNGVYPGPYYPGYPTPSGQYVCSPLPTSTMSPEEVEQHMRNLQQQELHRLLRVADNQELQLSNLLSRDRISPEGLEKMAQLRAELLQLYERCILLDIEFSDNQNVDQILWKNAFYQVIEKFRQLVKDPNVENPEQIRNRLLELLDEGSDFFDSLLQKLQVTYKFKLEDYMDGLAIRSKPLRKTVKYALISAQRCMICQGDIARYREQASDTANYGKARSWYLKAQHIAPKNGRPYNQLALLAVYTRRKLDAVYYYMRSLAASNPILTAKESLMSLFEETKRKAEQMEKKQHEEFDLSPDQWRKGKKSTFRHVGDDTTRLEIWIHPSHPRSSQGTESGKDSEQENGLGSLSPSDLNKRFILSFLHAHGKLFTRIGMETFPAVAEKVLKEFQVLLQHSPSPIGSTRMLQLMTINMFAVHNSQLKDCFSEECRSVIQEQAAALGLAMFSLLVRRCTCLLKESAKAQLSSPEDQDDQDDIKVSSFVPDLKELLPSVKVWSDWMLGYPDTWNPPPTSLDLPSHVAVDVWSTLADFCNILTAVNQSEVPLYKDPDDDLTLLILEEDRLLSGFVPLLAAPQDPCYVEKTSDKVSPRPNIPPHSPLLLILQTFLFLGSFLCKWNMIKSLRRVLRENI

SEQ ID NO: 887029 - protein, 940 aa, Homo sapiens
MKELKEARPRKDNRRPDLEIYKPGLSRLRNKPKIKEPPGSEEFKDEIVNDRDCSAVENGTQPVKDVCKELNNQEQNGPIDPENNRGQESFPRTAGQEDRSLKIIKRTKKPDLQIYQPGRRLQTVSKESASRVEEEEVLNQVEQLRVEEDECRGNVAKEEVANKPDRAEIEKSPGGGRVGAAKGEKGKRMGKGEGVRETHDDPARGRPGSAKRYSRSDKRRNRYRTRSTSSAGSNNSAEGAGLTDNGCRRRRQDRTKERPRLKKQVSVSSTDSLDEDRIDEPDGLGPRRSSERKRHLERNWSGRGEGEQKNSAKEYRGTLRVTFDAEAMNKESPMVRSARDDMDRGKPDKGLSSGGKGSEKQESKNPKQELRGRGRGILILPAHTTLSVNSAGSPESAPLGPRLLFGSGSKGSRSWGRGGTTRRLWDPNNPDQKPALKTQTPQLHFLDTDDEVSPTSWGDSRQAQASYYKFQNSDNPYYYPRTPGPASQYPYTGYNPLQYPVGPTNGVYPGPYYPGYPTPSGQYVCSPLPTSTMSPEEVEQHMRNLQQQELHRLLRVADNQELQLSNLLSRDRISPEGLEKMAQLRAELLQLYERCILLDIEFSDNQNVDQILWKNAFYQVIEKFRQLVKDPNVENPEQIRNRLLELLDEGSDFFDSLLQKLQVTYKFKLEDYMDGLAIRSKPLRKTVKYALISAQRCMICQGDIARYREQASDTANYGKARSWYLKAQHIAPKNGRPYNQLALLAVYTRRKLDAVYYYMRSLAASNPILTAKESLMSLFEETKRKAEQMEKKQHEEFDLSPDQWRKGKKSTFRHVGDDTTRLEIWIHPSHPRSSQGTESGKDSEQENGLGSLSPSDLNKRFILSFLHAHGKLFTRIGMETFPAVAEKVLKEFQVLLQHSPSPIGSTRMLQLMTINMFAVHNSQLKAPPGSSMYLKVHRFD

SEQ ID NO: 887030 - protein, 1449 aa, Homo sapiens
GRSRSRTSGRVGLAARGGGGAATAVAAAAKMAEGLERVRISASELRGILATLAPQAGSRENMKELKEARPRKDNRRPDLEIYKPGLSRLRNKPKIKEPPGSEEFKDEIVNDRDCSAVENGTQPVKDVCKELNNQEQNGPIDPENNRGQESFPRTAGQEDRSLKIIKRTKKPDLQIYQPGRRLQTVSKESASRVEEEEVLNQVEQLRVEEDECRGNVAKEEVANKPDRAEIEKSPGGGRVGAAKGEKGKRMGKGEGVRETHDDPARGRPGSAKRYSRSDKRRNRYRTRSTSSAGSNNSAEGAGLTDNGCRRRRQDRTKERPRLKKQVSVSSTDSLDEDRIDEPDGLGPRRSSERKRHLERNWSGRGEGEQKNSAKEYRGTLRVTFDAEAMNKESPMVRSARDDMDRGKPDKGLSSGGKGSEKQESKNPKQELRGRGRGILILPAHTTLSVNSAGSPESAPLGPRLLFGSGSKGSRSWGRGGTTRRLWDPNNPDQKPALKTQTPQLHFLDTDDEVSPTSWGDSRQAQASYYKFQNSDNPYYYPRTPGPASQYPYTGYNPLQYPVGPTNGVYPGPYYPGYPTPSGQYVCSPLPTSTMSPEEVEQHMRNLQQQELHRLLRVADNQELQLSNLLSRDRISPEGLEKMAQLRAELLQLYERCILLDIEFSDNQNVDQILWKNAFYQVIEKFRQLVKDPNVENPEQIRNRLLELLDEGSDFFDSLLQKLQVTYKFKLEDYMDGLAIRSKPLRKTVKYALISAQRCMICQGDIARYREQASDTANYGKARSWYLKAQHIAPKNGRPYNQLALLAVYTRRKLDAVYYYMRSLAASNPILTAKESLMSLFEETKRKAEQMEKKQHEEFDLSPDQWRKGKKSTFRHVGDDTTRLEIWIHPSHPRSSQGTESGKDSEQENGLGSLSPSDLNKRFILSFLHAHGKLFTRIGMETFPAVAEKVLKEFQVLLQHSPSPIGSTRMLQLMTINMFAVHNSQLKDCFSEECRSVIQEQAAALGLAMFSLLVRRCTCLLKESAKAQLSSPEDQDDQDDIKVSSFVPDLKELLPSVKVWSDWMLGYPDTWNPPPTSLDLPSHVAVDVWSTLADFCNILTAVNQSEVPLYKDPDDDLTLLILEEDRLLSGFVPLLAAPQDPCYVEKTSDKVIAADCKRVTVLKYFLEALCGQEEPLLAFKGGKYVSVAPVPDTMGKEMGSQEGTRLEDEEEDVVIEDFEEDSEAEGSGGEDDIRELRAKKLALARKIAEQQRRQEKIQAVLEDHSQMRQMELEIRPLFLVPDTNGFIDHLASLARLLESRKYILVVPLIVINELDGLAKGQETDHRAGGYARVVQEKARKSIEFLEQRFESRDSCLRALTSRGNELESIAFRSEDITGQLGNNDDLILSCCLHYCKDKAKDFMPASKEEPIRLLREVVLLTDDRNLRVKALTRNVPVRDIPAFLTWAQVG

SEQ ID NO: 887031 - protein, 1221 aa, Homo sapiens
MVKSNQWGNCKEEKAAWNDSPKKNREGVRETHDDPARGRPGSAKRYSRSDKRRNRYRTRSTSSAGSNNSAEGAGLTDNGCRRRRQDRTKERPRLKKQVSVSSTDSLDEDRIDEPDGLGPRRSSERKRHLERNWSGRGEGEQKNSAKEYRGTLRVTFDAEAMNKESPMVRSARDDMDRGKPDKGLSSGGKGSEKQESKNPKQELRGRGRGILILPAHTTLSVNSAGSPESAPLGPRLLFGSGSKGSRSWGRGGTTRRLWDPNNPDQKPALKTQTPQLHFLDTDDEVSPTSWGDSRQAQASYYKFQNSDNPYYYPRTPGPASQYPYTGYNPLQYPVGPTNGVYPGPYYPGYPTPSGQYVCSPLPTSTMSPEEVEQHMRNLQQQELHRLLRVADNQELQLSNLLSRDRISPEGLEKMAQLRAELLQLYERCILLDIEFSDNQNVDQILWKNAFYQVIEKFRQLVKDPNVENPEQIRNRLLELLDEGSDFFDSLLQKLQVTYKFKLEDYMDGLAIRSKPLRKTVKYALISAQRCMICQGDIARYREQASDTANYGKARSWYLKAQHIAPKNGRPYNQLALLAVYTRRKLDAVYYYMRSLAASNPILTAKESLMSLFEETKRKAEQMEKKQHEEFDLSPDQWRKGKKSTFRHVGDDTTRLEIWIHPSHPRSSQGTESGKDSEQENGLGSLSPSDLNKRFILSFLHAHGKLFTRIGMETFPAVAEKVLKEFQVLLQHSPSPIGSTRMLQLMTINMFAVHNSQLKDCFSEECRSVIQEQAAALGLAMFSLLVRRCTCLLKESAKAQLSSPEDQDDQDDIKVSSFVPDLKELLPSVKVWSDWMLGYPDTWNPPPTSLDLPSHVAVDVWSTLADFCNILTAVNQSEVPLYKDPDDDLTLLILEEDRLLSGFVPLLAAPQDPCYVEKTSDKVIAADCKRVTVLKYFLEALCGQEEPLLAFKGGKYVSVAPVPDTMGKEMGSQEGTRLEDEEEDVVIEDFEEDSEAEGSGGEDDIRELRAKKLALARKIAEQQRRQEKIQAVLEDHSQMRQMELEIRPLFLVPDTNGFIDHLASLARLLESRKYILVVPLIVINELDGLAKGQETDHRAGGYARVVQEKARKSIEFLEQRFESRDSCLRALTSRGNELESIAFRSEDITGQLGNNDDLILSCCLHYCKDKAKDFMPASKEEPIRLLREVVLLTDDRNLRVKALTRNVPVRDIPAFLTWAQVG

SEQ ID NO: 887032 - protein, 511 aa, Homo sapiens
METFPAVAEKVLKEFQVLLQHSPSPIGSTRMLQLMTINMFAVHNSQLKDCFSEECRSVIQEQAAALGLAMFSLLVRRCTCLLKESAKAQLSSPEDQDDQDDIKVSSFVPDLKELLPSVKVWSDWMLGYPDTWNPPPTSLDLPSHVAVDVWSTLADFCNILTAVNQSEVPLYKDPDDDLTLLILEEDRLLSGFVPLLAAPQDPCYVEKTSDKVIAADCKRVTVLKYFLEALCGQEEPLLAFKGGKYVSVAPVPDTMGKEMGSQEGTRLEDEEEDVVIEDFEEDSEAEGSGGEDDIRELRAKKLALARKIAEQQRRQEKIQAVLEDHSQMRQMELEIRPLFLVPDTNGFIDHLASLARLLESRKYILVVPLIVINELDGLAKGQETDHRAGGYARVVQEKARKSIEFLEQRFESRDSCLRALTSRGNELESIAFRSEDITGQLGNNDDLILSCCLHYCKDKAKDFMPASKEEPIRLLREVVLLTDDRNLRVKALTRNVPVRDIPAFLTWAQVG

SEQ ID NO: 887033 - protein, 184 aa, Homo sapiens [sequence omitted]

SEQ ID NO: 887034 - protein, 1388 aa, Homo sapiens; identical to SEQ ID NO: 887022

SEQ ID NO: 887035 - protein, 1388 aa, Homo sapiens; identical to SEQ ID NO: 887022

SEQ ID NO: 887036 - protein, 147 aa, Homo sapiens
ALSQAVAGAVVLLSCCPFKLRLDRGRASCRWSRLQREQPPRPPHSSRQDLVPLAIFQPRSQESGGCRKRRVFRLTRARPGGPRGGRGHDSGSRRLPFHALPAGDEGKMSVSRFKAKLKLLASIFHENQEAQLRLTLHCNMRMGQQKK

SEQ ID NO: 887037 - protein, 132 aa, Homo sapiens
MAETYRRSRQHEQLPGQRHMDLLTGYSKLIQSRLKLLLHLGSQPPVGKTFFFSCWCHPLFHGSKTTPNVWYKFSETALSILNSCQASQLGVRKMPGDMSSSPRVREFSALVAIKEKIHILPTNAKVGSKLGS

SEQ ID NO: 887038 - protein, 176 aa, Homo sapiens
EVPGRPSNQVAPGAVLAPSSLPAAELAAQGESQSLEDLSNTSRPTSEVYKISFIFPNGDKYDGDCTRTSSGIYERNGIGIHTTPNGIVYTGSWKDDKMNGFGRLEHFSGAVYEGQFKDNMFHGLGTYTFPNGAKYTGNFNENRVEGEGEYTDIQGLEWSGNFHFTAAPDLKLKLHM

SEQ ID NO: 887039 - protein, 151 aa, Homo sapiens
EVPGRPSNQVAPGAVLAPSSLPAAELAAQGESQSLEDLSNTSRPTSEVYKISFIFPNGDKYDGDCTRTSSGIYERNGIGIHTTPNGIVYTGSWKDDKMNGFGRLEHFSGAVYEGQFKDNMFHGLGTYTFPNGAKYTGNFNENSFILQLLQT

SEQ ID NO: 887040 - protein, 176 aa, Homo sapiens; identical to SEQ ID NO: 887038

SEQ ID NO: 887041 - protein, 165 aa, Homo sapiens
EVPGRPSNQVAPGAVLAPSSLPAAELAAQGESQSLEDLSNTSRPTSEVYKISFIFPNGDKYDGDCTRTSSGIYERNGIGIHTTPNGIVYTGSWKDDKMNGFGRLEHFSGAVYEGQFKDNMFHGLGTYTFPNGAKYTGNFNENRIGKLKIKKNHCISKRLFSGMFA

SEQ ID NO: 887042 - protein, 151 aa, Homo sapiens
MSDNDDIEVESDADKRAHHNALERKRRDHIKDSFHSLRDSVPSLQGEKASRAQILDKATEYIQYMRRKNHTHQQDIDDLKRQNALLEQQVRALEKARSSAQLQTNYPSSDNSLYTNAKGSTISAFDGGSDSSSESEPEEPQSRKKLRMEAS

SEQ ID NO: 887043 - protein, 160 aa, Homo sapiens
MSDNDDIEVESDEEQPRFQSAADKRAHHNALERKRRDHIKDSFHSLRDSVPSLQGEKASRAQILDKATEYIQYMRRKNHTHQQDIDDLKRQNALLEQQVRALEKARSSAQLQTNYPSSDNSLYTNAKGSTISAFDGGSDSSSESEPEEPQSRKKLRMEAS

SEQ ID NO: 887044 - protein, 150 aa, Homo sapiens
GWRRLDAVSSGICSFSGATRAVCERDKNYKSRLPQRCEPGHVAGADRACVPPLIRCCSEEEQPRFQSAADKRAHHNALERKRRDHIKDSFHSLRDSVPSLQGEKASRAQILDKATEYIQYMRRKNHTHQQDIDDLKRQNALLEQQGESES

SEQ ID NO: 887045 - protein, 160 aa, Homo sapiens; identical to SEQ ID NO: 887043

SEQ ID NO: 887046 - protein, 103 aa, Homo sapiens
MSDNDDIEVESDEEQPRFQSAADKRAHHNALERKRRDHIKDSFHSLRDSVPSLQGEKASRAQILDKATEYIQYMRRKNHTHQQDIDDLKRQNALLEQQGESES

SEQ ID NO: 887047 - protein, 96 aa, Homo sapiens
MSDNDDIEVESDEEQPRFQSAADKRAHHNALERKRRDHIKDSFHSLRDSVPSLQGEKLYFLFWKLCTPVLHRQSLMQKCHTFISSYQVHKKKECKI

SEQ ID NO: 887048 - protein, 151 aa, Homo sapiens; identical to SEQ ID NO: 887042

SEQ ID NO: 887049 - protein, 66 aa, Homo sapiens
FGKEFTPEVQAAAEDEVTGVASALSSQIPTELTAHDAELSKDRLSCKQSNNKSLLRDHKKVSSRSQ

SEQ ID NO: 887050 - protein, 103 aa, Homo sapiens; identical to SEQ ID NO: 887046

SEQ ID NO: 887051 - protein, 103 aa, Homo sapiens; identical to SEQ ID NO: 887046

SEQ ID NO: 887052 - protein, 126 aa, Homo sapiens
MSDNDDIEVESDEEQPRFQSAADKRAHHNALERKRRDHIKDSFHSLRDSVPSLQGEKASRAQILDKATEYIQYMRRKNHTHQQDIDDLKRQNALLEQQVRALEKARSMAIWGWDREGVLGGIEVLY

SEQ ID NO: 887053 - protein, 160 aa, Homo sapiens; identical to SEQ ID NO: 887043

SEQ ID NO: 887054 - protein, 133 aa, Homo sapiens
MSDNDDIEVESDEEQPRFQSAADKRAHHNALERKRRDHIKDSFHSLRDSVPSLQGEKASRAQILDKATEYIQYMRRKNHTHQQDIDDLKRQNALLEQQGEHPSSWGSWPCCAPARSGFGTWACRVRASHGVCA

SEQ ID NO: 887055 - protein, 1045 aa, Homo sapiens
MGEIEQRPTPGSRLGAPENSGISTLERGQKPPPTPSGKLVSIKIQMLDDTQEAFEVPQRAPGKVLLDAVCNHLNLVEGDYFGLEFPDHKKITVWLDLLKPIVKQIRRPKHVVVKFVVKFFPPDHTQLQEELTRYLFALQVKQDLAQGRLTCNDTSAALLISHIVQSEIGDFDEALDREHLAKNKYIPQQDALEDKIVEFHHNHIGQTPAESDFQLLEIARRLEMYGIRLHPAKDREGTKINLAVANTGILVFQGFTKINAFNWAKVRKLSFKRKRFLIKLRPDANSAYQDTLEFLMASRDFCKSFWKICVEHHAFFRLFEEPKPKPKPVLFSRGSSFRFSGRTQKQVLDYVKEGGHKKVQFERKHSKIHSIRSLASQPTELNSEVLEQSQQSTSLTFGEGAESPGGQSCRRGKEPKVSAGEPGSHPSPAPRRSPAGNKQADGAASAPTEEEEEVVKDRTQQSKPQPPQPSTGSLTGSPHLSELSVNSQGGVAPANVTLSPNLSPDTKQASPLISPLLNDQACPRTDDEDEGRRKRFPTDKAYFIAKEVSTTERTYLKDLEVITSWFQSTVSKEDAMPEALKSLIFPNFEPLHKFHTNFLKEIEQRLALWEGRSNAQIRDYQRIGDVMLKNIQGMKHLAAHLWKHSEALEALENGIKSSRRLENFCRDFELQKVCYLPLNTFLLRPLHRLMHYKQVLERLCKHHPPSHADFRDCRAALAEITEMVAQLHGTMIKMENFQKLHELKKDLIGIDNLVVPGREFIRLGSLSKLSGKGLQQRMFFLFNDVLLYTSRGLTASNQFKVHGQLPLYGMTIEESEDEWGVPHCLTLRGQRQSIIVAASSRSEMEKWVEDIQMAIDLAEKSSSPAPEFLASSPPDNKSPDEATAADQESEDDLSASRTSLERQAPHRGNTMVHVCWHRNTSVSMVDFSIAVENQLSGNLLRKFKNSNGWQKLWVVFTNFCLFFYKSHQDNHPLASLPLLGYSLTIPSESENIQKDYVFKLHFKSHVYYFRAESEYTFERWMEVIRSATSSASRPHVLSHKESLVY

SEQ ID NO: 887056 - protein, 1045 aa, Homo sapiens; identical to SEQ ID NO: 887055

SEQ ID NO: 887057 - protein, 1045 aa, Homo sapiens; identical to SEQ ID NO: 887055

SEQ ID NO: 887058 - protein, 1045 aa, Homo sapiens; identical to SEQ ID NO: 887055

SEQ ID NO: 887059 - protein, 1027 aa, Homo sapiens
MGEIEQRPTPGSRLGAPENSGISTLERGQKPPPTPSGKLVSIKIQMLDDTQEAFEVPQRAPGKVLLDAVCNHLNLVEGDYFGLEFPDHKKITVWLDLLKPIVKQIRRPKHVVVKFVVKFFPPDHTQLQEELTRYLFALQVKQDLAQGRLTCNDTSAALLISHIVQSEIGDFDEALDREHLAKNKYIPQQDALEDKIVEFHHNHIGQTPAESDFQLLEIARRLEMYGIRLHPAKDREGTKINLAVANTGILVFQGFTKINAFNWAKVRKLSFKRKRFLIKLRPDANSAYQDTLEFLMASRDFCKSFWKPKPVLFSRGSSFRFSGRTQKQVLDYVKEGGHKKVQFERKHSKIHSIRSLASQPTELNSEVLEQSQQSTSLTFGEGAESPGGQSCRRGKEPKVSAGEPGSHPSPAPRRSPAGNKQADGAASAPTEEEEEVVKDRTQQSKPQPPQPSTGSLTGSPHLSELSVNSQGGVAPANVTLSPNLSPDTKQASPLISPLLNDQACPRTDDEDEGRRKRFPTDKAYFIAKEVSTTERTYLKDLEVITSWFQSTVSKEDAMPEALKSLIFPNFEPLHKFHTNFLKEIEQRLALWEGRSNAQIRDYQRIGDVMLKNIQGMKHLAAHLWKHSEALEALENGIKSSRRLENFCRDFELQKVCYLPLNTFLLRPLHRLMHYKQVLERLCKHHPPSHADFRDCRAALAEITEMVAQLHGTMIKMENFQKLHELKKDLIGIDNLVVPGREFIRLGSLSKLSGKGLQQRMFFLFNDVLLYTSRGLTASNQFKVHGQLPLYGMTIEESEDEWGVPHCLTLRGQRQSIIVAASSRSEMEKWVEDIQMAIDLAEKSSSPAPEFLASSPPDNKSPDEATAADQESEDDLSASRTSLERQAPHRGNTMVHVCWHRNTSVSMVDFSIAVENQLSGNLLRKFKNSNGWQKLWVVFTNFCLFFYKSHQDNHPLASLPLLGYSLTIPSESENIQKDYVFKLHFKSHVYYFRAESEYTFERWMEVIRSATSSASRPHVLSHKESLVY

SEQ ID NO: 887060 - protein, 922 aa, Homo sapiens
MGEIEQRPTPGSRLGAPENSGISTLERGQKPPPTPSGKLVSIKIQMLDDTQEAFEVPQRAPGKVLLDAVCNHLNLVEGDYFGLEFPDHKKITVWLDLLKPIVKQIRRPKHVVVKFVVKFFPPDHTQLQEELTRYLFALQVKQDLAQGRLTCNDTSAALLISHIVQSEIGDFDEALDREHLAKNKYIPQQDALEDKIVEFHHNHIGQTPAESDFQLLEIARRLEMYGIRLHPAKDREGTKINLAVANTGILVFQGFTKINAFNWAKVRKLSFKRKRFLIKLRPDANSAYQDTLEFLMASRDFCKSFWKICVEHHAFFRLFEEPKPKPKPVLFSRGSSFRFSGRTQKQVLDYVKEGGHKKVQFERKHSKIHSIRSLASQPTELNSEVLEQSQQSTSLTFGEGAESPGGQSCRRGKEPKVSAGEPGSHPSPAPRRSPAGNKQADGAASAPTEEEEEVVKDRTQQSKPQPPQPSTGSLTGSPHLSELSVNSQGGVAPANVTLSPNLSPDTKQASPLISPLLNDQACPRTDDEDEGRRKRFPTDKAYFIAKEVSTTERTYLKDLEVITSWFQSTVSKEDAMPEALKSLIFPNFEPLHKFHTNFLKEIEQRLALWEGRSNAQIRDYQRIGDVMLKNIQGMKEFIRLGSLSKLSGKGLQQRMFFLFNDVLLYTSRGLTASNQFKVHGQLPLYGMTIEESEDEWGVPHCLTLRGQRQSIIVAASSRSEMEKWVEDIQMAIDLAEKSSSPAPEFLASSPPDNKSPDEATAADQESEDDLSASRTSLERQAPHRGNTMVHVCWHRNTSVSMVDFSIAVENQLSGNLLRKFKNSNGWQKLWVVFTNFCLFFYKSHQDNHPLASLPLLGYSLTIPSESENIQKDYVFKLHFKSHVYYFRAESEYTFERWMEVIRSATSSASRPHVLSHKESLVY

SEQ ID NO: 887061 - protein, 786 aa, Homo sapiens
MYVDEAVYSYGGASLEEACHPARQMHSAYQDTLEFLMASRDFCKSFWKICVEHHAFFRLFEEPKPKPKPVLFSRGSSFRFSGRTQKQVLDYVKEGGHKKVQFERKHSKIHSIRSLASQPTELNSEVLEQSQQSTSLTFGEGAESPGGQSCRRGKEPKVSAGEPGSHPSPAPRRSPAGNKQADGAASAPTEEEEEVVKDRTQQSKPQPPQPSTGSLTGSPHLSELSVNSQGGVAPANVTLSPNLSPDTKQASPLISPLLNDQACPRTDDEDEGRRKRFPTDKAYFIAKEVSTTERTYLKDLEVITSWFQSTVSKEDAMPEALKSLIFPNFEPLHKFHTNFLKEIEQRLALWEGRSNAQIRDYQRIGDVMLKNIQGMKHLAAHLWKHSEALEALENGIKSSRRLENFCRDFELQKVCYLPLNTFLLRPLHRLMHYKQVLERLCKHHPPSHADFRDCRAALAEITEMVAQLHGTMIKMENFQKLHELKKDLIGIDNLVVPGREFIRLGSLSKLSGKGLQQRMFFLFNDVLLYTSRGLTASNQFKVHGQLPLYGMTIEESEDEWGVPHCLTLRGQRQSIIVAASSRSEMEKWVEDIQMAIDLAEKSSSPAPEFLASSPPDNKSPDEATAADQESEDDLSASRTSLERQAPHRGNTMVHVCWHRNTSVSMVDFSIAVENQLSGNLLRKFKNSNGWQKLWVVFTNFCLFFYKSHQDNHPLASLPLLGYSLTIPSESENIQKDYVFKLHFKSHVYYFRAESEYTFERWMEVIRSATSSASRPHVLSHKESLVY

SEQ ID NO: 887062 - protein, 1045 aa, Homo sapiens; identical to SEQ ID NO: 887055

SEQ ID NO: 887063 - protein, 657 aa, Homo sapiens
MGEIEQRPTPGSRLGAPENSGISTLERGQKPPPTPSGKLVSIKIQMLDDTQEAFEVPQRAPGKVLLDAVCNHLNLVEGDYFGLEFPDHKKITVWLDLLKPIVKQIRRPKHVVVKFVVKFFPPDHTQLQEELTRYLFALQVKQDLAQGRLTCNDTSAALLISHIVQSEIGDFDEALDREHLAKNKYIPQQDALEDKIVEFHHNHIGQTPAESDFQLLEIARRLEMYGIRLHPAKDREGTKINLAVANTGILVFQGFTKINAFNWAKVRKLSFKRKRFLIKLRPDANSAYQDTLEFLMASRDFCKSFWKICVEHHAFFRLFEEPKPKPKPVLFSRGSSFRFSGRTQKQVLDYVKEGGHKKVQFERKHSKIHSIRSLASQPTELNSEVLEQSQQSTSLTFGEGAESPGGQSCRRGKEPKVSAGEPGSHPSPAPRRSPAGNKQADGAASAPTEEEEEVVKDRTQQSKPQPPQPSTGSLTGSPHLSELSVNSQGGVAPANVTLSPNLSPDTKQASPLISPLLNDQACPRTDDEDEGRRKRFPTDKAYFIAKEVSTTERTYLKDLEVITSWFQSTVSKEDAMPEALKSLIFPNFEPLHKFHTNFLKEIEQRLALWEGRSNAQIRDYQRIGDVMLKNIQGMKAGVRWRDLGSLQPPPPKFRAIL

SEQ ID NO: 887064 - protein, 151 aa, Homo sapiens
AAAARFAPLLPARVALAPASRRPWRPGARSPPTPPAPPSPPPRATFDGSDLSRPPPALLARPRRRRPRVLIAGAAAPSAAGGLGAADPGARAGRGSRRSRRRCGDGVLLLLPRLECNGVISAHRNLHLPGSSDSPVSTSQIFSKPLSSWEK

SEQ ID NO: 887065 - protein, 117 aa, Homo sapiens
MGEIEQRPTPGSRLGAPENSGISTLERGQKPPPTPSGKLVSIKIQMLDDTQEAFEVPMVSSSSFLKATGSSWTGWVLRCSMKPKHHSHLIEKFGEDRILTHLTGSISYTNWAGSRSL

SEQ ID NO: 887066 - protein, 161 aa, Homo sapiens
MHYKQVLERLCKHHPPSHADFRDCRAALAEITEMVAQLHGTMIKMENFQKLHELKKDLIGIDNLVVPGRVSSSGLTMHCAGSRKEASEGLTFEPFEERPLQSKMSSFHPPGRQLEKHNSVVSSESLCSEEIKQSSDLIFCFFSLRGDSLLYLFPYHIPQKI

SEQ ID NO: 887067 - protein, 1045 aa, Homo sapiens; identical to SEQ ID NO: 887055

SEQ ID NO: 887068 - protein, 1045 aa, Homo sapiens; identical to SEQ ID NO: 887055

SEQ ID NO: 887069 - protein, 822 aa, Homo sapiens [sequence omitted]

SEQ ID NO: 887070 - protein, 470 aa, Homo sapiens [sequence omitted]

SEQ ID NO: 887071 - protein, 850 aa, Homo sapiens [sequence omitted]

SEQ ID NO: 887072 - protein, 160 aa, Homo sapiens
MEAERPQEEEDGEQGPPQDEEGWPPPNSTTRPWRSAPPSPPPPGTRHTALGPRSASLLSLQTELLLDLVAEAQSRRLEEQRATFYTPQNPSSLAPAPLRPLEDREQLYSTILSHQCQRMEAQRSEPPLPPGGQELLELLLRVQGGGRMEEQRSRPPTHTC

SEQ ID NO: 887073 - protein, 160 aa, Homo sapiens; identical to SEQ ID NO: 887072

SEQ ID NO: 887074 - protein, 160 aa, Homo sapiens; identical to SEQ ID NO: 887072

SEQ ID NO: 887075 - protein, 160 aa, Homo sapiens; identical to SEQ ID NO: 887072

SEQ ID NO: 887076 - protein, 128 aa, Homo sapiens [sequence omitted]

SEQ ID NO: 887077 - protein, 128 aa, Homo sapiens [sequence omitted]

SEQ ID NO: 887078 - protein, 128 aa, Homo sapiens [sequence omitted]

SEQ ID NO: 887079 - protein, 110 aa, Homo sapiens
PTIPYPKKKTPTSRSRDAANFEQFLQERIKVNGKAGNLGGGVVTIERSKSKITVTSEVPFSKRYLKYLTKKYLKKNNLRDWLRVVANSKESYELRYFQINQDEEEEEDED

SEQ ID NO: 887080 - protein, 241 aa, Homo sapiens
MDAANFEQFLQERIKVNGKAGNLGGGVVTIERSKSKITVTSEVPFSKRYLKYLTKKYLKKNNLRDWLRVVANSKESYELRYFQINQDEEDPFVSIAVHCWDKHYGFQLYQSDPSGNYGGWKAHAGNIIALSCVTVETRLKEGTNDLEVRTGLAINVLHKTMDVSKLSAEQRENLHPYNERCTTGIRVLTQTKGAVVKHEERSKLGKQTQQHKLCAPPRNLKRGPPGKHGTVQHVRWVQNRA

SEQ ID NO: 887081 - protein, 236 aa, Homo sapiens
MDAANFEQFLQERIKVNGKAGNLGGGVVTIERSKSKITVTSEVPFSKRYLKYLTKKKKRKKKIGGILYLRGGEKRGYGKWAVGSLGGSRGPQVFWVQGGETVAGLPIKGEGGIKLGKGRVTLICLEKGRRRTAQTAPRHRKRGHNPGTTEQRGASKATITQEHKRTTFESINNMDDTLNRKTDVHRKERYSKKRPETSKPDKEQKKGSRQLNEQTTKRELRRAINAQRRFAQAKED

SEQ ID NO: 887082 - protein, 128 aa, Homo sapiens [sequence omitted]

SEQ ID NO: 887083 - protein, 96 aa, Homo sapiens
VASELRALCVCVVRSPPFLTPLPPWLLWLVWLRVRPRLQGRHVGLAEPGIYPGSLGTAPCSVLLGWAGRSAGAGQSPCRSQHVVGGGGRGPRKSLW

SEQ ID NO: 887084 - protein, 128 aa, Homo sapiens [sequence omitted]

SEQ ID NO: 887085 - protein, 128 aa, Homo sapiens [sequence omitted]

SEQ ID NO: 887086 - protein, 134 aa, Homo sapiens
MWDGASLRGSSPQLPTKSVARHQVLKFTLDCTHPVEDGIMDAANFEQFLQERIKVNGKAGNLGGGVVTIERSKSKITVTSEVPFSKRYLKYLTKKYLKKNNLRDWLRVVANSKESYELRYFQINQDEEEEEDED

SEQ ID NO: 887087 - protein, 128 aa, Homo sapiens [sequence omitted]

SEQ ID NO: 887088 - protein, 115 aa, Homo sapiens
AAAYYYYYCSEFKLLTMYGDMDAANFEQFLQERIKVNGKAGNLGGGVVTIERSKSKITVTSEVPFSKRYLKYLTKKYLKKNNLRDWLRVVANSKESYELRYFQINQDEEEEEDED

SEQ ID NO: 887089 - protein, 109 aa, Homo sapiens
MAPVKKLVVKGGRIMDAANFEQFLQERIKVNGKAGNLGGGVVTIERSKSKITVTSEVPFSKRYLKYLTKKYLKKNNLRDWLRVVANSKESYELRYFQINQDEEEEEDED

SEQ ID NO: 887090 - protein, 106 aa, Homo sapiens
MCFYYKYEDGIMDAAKNEQFLQERIKVNGKAGNLGGGVVTIERSKSKITVTSEVPFSKRYLKYLTKKYLKKNNLRDWLRVVANSKESYELRYFQINQDEEEEEDED

SEQ ID NO: 887091 - protein, 110 aa, Homo sapiens; identical to SEQ ID NO: 887079

SEQ ID NO: 887092 - protein, 128 aa, Homo sapiens [sequence omitted]

SEQ ID NO: 887093 - protein, 128 aa, Homo sapiens [sequence omitted]

SEQ ID NO: 887094 - protein, 128 aa, Homo sapiens [sequence omitted]

SEQ ID NO: 887095 - protein, 128 aa, Homo sapiens [sequence omitted]

SEQ ID NO: 887096 - protein, 109 aa, Homo sapiens; identical to SEQ ID NO: 887089

SEQ ID NO: 887097 - protein, 113 aa, Homo sapiens
MDAANFEQFLQERIKVNGKAGNLGGGVVTIERSKSKITVTSEVPFSKRYLKYLTKKYLKKNNLRDWLRVVANSKESYELRYFQINQDEEENEIYILVFLLFFVRRRGREFSSS

SEQ ID NO: 887098 - protein, 114 aa, Homo sapiens
YPISSPSYLFLSHTKITLDLPAANFEQFLQERIKVNGKAGNLGGGVVTIERSKSKITVTSEVPFSKRYLKYLTKKYLKKNNLRDWLRVVANSKESYELRYFQINQDEEEEEDED

SEQ ID NO: 887099 - protein, 110 aa, Homo sapiens
EIINSITYLERNNLKRTAANFEQFLQERIKVNGKAGNLGGGVVTIERSKSKITVTSEVPFSKRYLKYLTKKYLKKNNLRDWLRVVANSKESYELRYFQINQDEEEEEDED

SEQ ID NO: 887100 - protein, 107 aa, Homo sapiens
VASELRALCVCVVRSPPFLTPLPPWLLWLVWLRVRPRLQGRHVGLAEPGIYPGSLGTAPCSVLLGWAGRSAGAGQSPCRSQHVVGGGGRGPRLVREIREVSEARGPS

SEQ ID NO: 887101 - protein, 134 aa, Homo sapiens
MVLSDPGDSEGDGGINRMQLWKQVLKFTLDCTHPVEDGIMDAANFEQFLQERIKVNGKAGNLGGGVVTIERSKSKITVTSEVPFSKRYLKYLTKKYLKKNNLRDWLRVVANSKESYELRYFQINQDEEEEEDED

SEQ ID NO: 887102 - protein, 128 aa, Homo sapiens
HSGWNTWSYQRPSAEWPIDLSKLRHVVLVEDGIMDAANFEQFLQERIKVNGKAGNLGGGVVTIERSKSKITVTSEVPFSKRYLKYLTKKYLKKNNLRDWLRVVANSKESYELRYFQINQDEEEEEDED

SEQ ID NO: 887103 - protein, 106 aa, Homo sapiens
NLLMQDKKPSDHGCCHFEQFLQERIKVNGKAGNLGGGVVTIERSKSKITVTSEVPFSKRYLKYLTKKYLKKNNLRDWLRVVANSKESYELRYFQINQDEEEEEDED

SEQ ID NO: 887104 - protein, 114 aa, Homo sapiens; identical to SEQ ID NO: 887098

SEQ ID NO: 887105 - protein, 109 aa, Homo sapiens; identical to SEQ ID NO: 887089

SEQ ID NO: 887106 - protein, 110 aa, Homo sapiens; identical to SEQ ID NO: 887099

SEQ ID NO: 887107 - protein, 128 aa, Homo sapiens [sequence omitted]

SEQ ID NO: 887108 - protein, 128 aa, Homo sapiens [sequence omitted]

SEQ ID NO: 887109 - protein, 128 aa, Homo sapiens [sequence omitted]

SEQ ID NO: 887110 - protein, 128 aa, Homo sapiens [sequence omitted]

SEQ ID NO: 887111 - protein, 128 aa, Homo sapiens [sequence omitted]

SEQ ID NO: 887112 - protein, 128 aa, Homo sapiens [sequence omitted]

SEQ ID NO: 887113 - protein, 128 aa, Homo sapiens [sequence omitted]

SEQ ID NO: 887114 - protein, 128 aa, Homo sapiens [sequence omitted]

SEQ ID NO: 887115 - protein, 128 aa, Homo sapiens [sequence omitted]

SEQ ID NO: 887116 - protein, 149 aa, Homo sapiens
MAADIPRVTTPLSSLVQVPQEEDRQEEEVTTMILEDDSWVQEAVLQEDGPESEPFPQSAGKGGPQEEVTRGPQGALGRLRELCRRWLRPEVHTKEQMLTMLPKEIQAWLQEHRPESSEEAAALVEDLTQTLQDSAVAVFASLPVEVTSL

SEQ ID NO: 887117 - protein, 163 aa, Homo sapiens [sequence omitted]

SEQ ID NO: 887118 - protein, 152 aa, Homo sapiens
MAVAVDQQIQTPSVQDLQIVKLEEDSHWEQEISLQGNYPGPETSCQSFWHFRYQEASRPREALLQLQKLCCQWLRPEKCTKEQILELLVLEQFPTVLLQEIQIWVRQQHPESGEEAVALVEDLQKEPGRQRLEPCLMWLWEFLQRRAGVARR

SEQ ID NO: 887119 - protein, 163 aa, Homo sapiens [sequence omitted]

SEQ ID NO: 887120 - protein, 152 aa, Homo sapiens; identical to SEQ ID NO: 887118

SEQ ID NO: 887121 - protein, 163 aa, Homo sapiens [sequence omitted]

SEQ ID NO: 887122 - protein, 163 aa, Homo sapiens [sequence omitted]

SEQ ID NO: 887123 - protein, 163 aa, Homo sapiens [sequence omitted]

SEQ ID NO: 887124 - protein, 614 aa, Homo sapiens
MAADIPRVTTPLSSLVQVPQEEDRQEEEVTTMILEDDSWVQEAVLQEDGPESEPFPQSAGKGGPQEEVTRGPQGALGRLRELCRRWLRPEVHTKEQMLTMLPKEIQAWLQEHRPESSEEAAALVEDLTQTLQDSDFEIQSENGENCNQDMFENESRKIFSEMPEGESAQHSDGESDFERDAGIQRLQGHTPGEDHGEVVSQDREVGQLIGLQGTYLGEKPYECPQCGKTFSRKSHLITHERTHTGEKYYKCDECGKSFSDGSNFSRHQTTHTGEKPYKCRDCGKSFSRSANLITHQRIHTGEKPFQCAECGKSFSRSPNLIAHQRTHTGEKPYSCPECGKSFGNRSSLNTHQGIHTGEKPYECKECGESFSYNSNLIRHQRIHTGEKPYKCTDCGQRFSQSSALITHRRTHTGEKPYQCSECGKSFSRSSNLATHRRTHMVEKPYKCGVCGKSFSQSSSLIAHQGMHTGEKPYELPDHVGKSFSWSSNLLKHQRIHTGEKPYKCSECGKCFSQRSQLVVHQRTHTGEKPYKCLMCGKSFSRGSILVMHQRAHLGDKPYRCPECGKGFSWNSVLIIHQRIHTGEKPYKCPECGKGFSNSSNFITHQRTHMKEKLY

SEQ ID NO: 887125 - protein, 163 aa, Homo sapiens [sequence omitted]

SEQ ID NO: 887126 - protein, 614 aa, Homo sapiens; identical to SEQ ID NO: 887124

SEQ ID NO: 887127 - protein, 614 aa, Homo sapiens; identical to SEQ ID NO: 887124

SEQ ID NO: 887128 - protein, 140 aa, Homo sapiens [sequence omitted]

SEQ ID NO: 887129 - protein, 199 aa, Homo sapiens
MAADIPRVTTPLSSLVQVPQEEDRQEEEVTTMILEDDSWVQEAVLQEDGPESEPFPQSAGKGGPQEEVTRGPQGALGRLRELCRRWLRPEVHTKEQMLTMLPKEIQAWLQEHRPESSEEAAALVEDLTQTLQDSDFEIQSENGENCNQDMFENESRKIFSEMPEGESAQHSDGESDFERDAGIQRLQGHTPESVRSTET

SEQ ID NO: 887130 - protein, 145 aa, Homo sapiens
MAADIPRVTTPLSSLVQVPQEEDRQEEEVTTMILEDDSWVQEAVLQEDGPESEPFPQSAGKGGPQEEVTRGPQGALGRLRELCRRWLRPEVHTKEQMLTMLPKEIQAWLQEHRPESSEEAAALVEDLTQTLQDSETASCVHGCPV

SEQ ID NO: 887131 - protein, 149 aa, Homo sapiens; identical to SEQ ID NO: 887116

SEQ ID NO: 887132 - protein, 122 aa, Homo sapiens
GRAEPLARRERQAGQACAAAAAAVAAAPTMSAAKENPCRKFQANIFNKSKCQNCFKPRESHLLNDEDLTQAKPIYGGWLLLAPDGTDFDNPVHRSRKWQRRFFILYEHGLLRYALDEMMSSQ

SEQ ID NO: 887133 - protein, 92 aa, Homo sapiens
GRAEPLARRERQAGQACAAAAAAVAAAPTMSAAKENPCRKFQANIFNKSKCQNCFKPRESHLLNDEDLTQQNTHPLEMKRGAHIYDARMFSC

SEQ ID NO: 887134 - protein, 1027 aa, Homo sapiens
GRAEPLARRERQAGQACAAAAAAVAAAPTMSAAKENPCRKFQANIFNKSKCQNCFKPRESHLLNDEDLTQAKPIYGGWLLLAPDGTDFDNPVHRSRKWQRRFFILYEHGLLRYALDEMPTTLPQGTINMNQCTDVVDGEGRTGQKFSLCILTPEKEHFIRAETKEIVSGWLEMLMVYPRTNKQNQKKKRKVEPPTPQEPGPAKVAVTSSSSSSSSSIPSAEKVPTTKSTLWQEEMRTKDQPDGSSLSPAQSPSQSQPPAASSLREPGLESKEEESAMSSDRMDCGRKVRVESGYFSLEKTKQDLKAEEQQLPPPLSPPSPSTPNHRRSQVIEKFEALDIEKAEHMETNAVGPSPSSDTRQGRSEKRAFPRKRPDLLNFKKGWLTKQYEDGQWKKHWFVLADQSLRYYRDSVAEEAADLDGEIDLSACYDVTEYPVQRNYGFQIHTKEGEFTLSAMTSGIRRNWIQTIMKHVHPTTAPDVTSSLPEEKNKSSCSFETCPRPTEKQEAELGEPDPEQKRSRARERRREGRSKTFDWAEFRPIQQALAQERVGGVGPADTHEPLRPEAEPGELERERARRREERRKRFGMLDATDGPGTEDAALRMEVDRSPGLPMSDLKTHNVHVEIEQRWHQVETTPLREEKQVPIAPVHLSSEDGGDRLSTHELTSLLEKELEQSQKEASDLLEQNRLLQDQLRVALGREQSAREGYVLQATCERGFAAMEETHQKKIEDLQRQHQRELEKLREEKDRLLAEETAATISAIEAMKNAHREEMERELEKSQRSQISSVNSDVEALRRQYLEELQSVQRELEVLSEQYSQKCLENAHLAQALEAERQALRQCQRENQELNAHNQELNNRLAAEITRLRTLLTGDGGGEATGSPLAQGKDAYELEVLLRVKESEIQYLKQEISSLKDELQTALRDKKYASDKYKDIYTELSIAKAKADCDISRLKEQLKAATEALGEKSPDSATVSGYDIMKSKSNPDFLKKDRSCVTRQLRNIRSKSLKEGLTVQERLKLFESRDLKKD

SEQ ID NO: 887135 - protein, 902 aa, Homo sapiens
MAVGCSWLQMGPTLTTQCTGLGNGSDGSSSFTSTASCATPWMRWWLEMLMVYPRTNKQNQKKKRKVEPPTPQEPGPAKVAVTSSSSSSSSSIPSAEKVPTTKSTLWQEEMRTKDQPDGSSLSPAQSPSQSQPPAASSLREPGLESKEEESAMSSDRMDCGRKVRVESGYFSLEKTKQDLKAEEQQLPPPLSPPSPSTPNHRRSQVIEKFEALDIEKAEHMETNAVGPSPSSDTRQGRSEKRAFPRKRPDLLNFKKGWLTKQYEDGQWKKHWFVLADQSLRYYRDSVAEEAADLDGEIDLSACYDVTEYPVQRNYGFQIHTKEGEFTLSAMTSGIRRNWIQTIMKHVHPTTAPDVTSSLPEEKNKSSCSFETCPRPTEKQEAELGEPDPEQKRSRARERRREGRSKTFDWAEFRPIQQALAQERVGGVGPADTHEPLRPEAEPGELERERARRREERRKRFGMLDATDGPGTEDAALRMEVDRSPGLPMSDLKTHNVHVEIEQRWHQVETTPLREEKQVPIAPVHLSSEDGGDRLSTHELTSLLEKELEQSQKEASDLLEQNRLLQDQLRVALGREQSAREGYVLQATCERGFAAMEETHQKKIEDLQRQHQRELEKLREEKDRLLAEETAATISAIEAMKNAHREEMERELEKSQRSQISSVNSDVEALRRQYLEELQSVQRELEVLSEQYSQKCLENAHLAQALEAERQALRQCQRENQELNAHNQELNNRLAAEITRLRTLLTGDGGGEATGSPLAQGKDAYELEVLLRVKESEIQYLKQEISSLKDELQTALRDKKYASDKYKDIYTELSIAKAKADCDISRLKEQLKAATEALGEKSPDSATVSGYDIMKSKSNPDFLKKDRSCVTRQLRNIRSKSLKEGLTVQERLKLFESRDLKKD

SEQ ID NO: 887136 - protein, 1065 aa, Homo sapiens
GRAEPLARRERQAGQACAAAAAAVAAAPTMSAAKENPCRKFQANIFNKSKCQNCFKPRESHLLNDEDLTQAKPIYGGWLLLAPDGTDFDNPVHRSRKWQRRFFILYEHGLLRYALDEMPTTLPQGTINMNQCTDVVDGEGRTGQKFSLCILTPEKEHFIRAETKEIVSGWLEMLMVYPRTNKQNQKKKRKVEPPTPQEPGPAKVAVTSSSSSSSSSIPSAEKVPTTKSTLWQEEMRTKDQPDGSSLSPAQSPSQSQPPAASSLREPGLESKEEESAMSSDRMDCGRKVRVESGYFSLEKTKQDLKAEEQQLPPPLSPPSPSTPNHRRSQVIEKFEALDIEKAEHMETNAVGPSPSSDTRQGRSEKRAFPRKRDFTNEAPPAPLPDASASPLSPHRRAKSLDRRSTEPSVTPDLLNFKKGWLTKQYEDGQWKKHWFVLADQSLRYYRDSVAEEAADLDGEIDLSACYDVTEYPVQRNYGFQIHTKEGEFTLSAMTSGIRRNWIQTIMKHVHPTTAPDVTSSLPEEKNKSSCSFETCPRPTEKQEAELGEPDPEQKRSRARERRREGRSKTFDWAEFRPIQQALAQERVGGVGPADTHEPLRPEAEPGELERERARRREERRKRFGMLDATDGPGTEDAALRMEVDRSPGLPMSDLKTHNVHVEIEQRWHQVETTPLREEKQVPIAPVHLSSEDGGDRLSTHELTSLLEKELEQSQKEASDLLEQNRLLQDQLRVALGREQSAREGYVLQATCERGFAAMEETHQKKIEDLQRQHQRELEKLREEKDRLLAEETAATISAIEAMKNAHREEMERELEKSQRSQISSVNSDVEALRRQYLEELQSVQRELEVLSEQYSQKCLENAHLAQALEAERQALRQCQRENQELNAHNQELNNRLAAEITRLRTLLTGDGGGEATGSPLAQGKDAYELEVLLRVKESEIQYLKQEISSLKDELQTALRDKKYASDKYKDIYTELSIAKAKADCDISRLKEQLKAATEALGEKSPDSATVSGYDIMKSKSNPDFLKKDRSCVTRQLRNIRSKSLKEGLTVQERLKLFESRDLKKD

SEQ ID NO: 887137 - protein, 2334 aa, Homo sapiens
GRAEPLARRERQAGQACAAAAAAVAAAPTMSAAKENPCRKFQANIFNKSKCQNCFKPRESHLLNDEDLTQAKPIYGGWLLLAPDGTDFDNPVHRSRKWQRRFFILYEHGLLRYALDEMPTTLPQGTINMNQCTDVVDGEGRTGQKFSLCILTPEKEHFIRAETKEIVSGWLEMLMVYPRTNKQNQKKKRKVEPPTPQEPGPAKVAVTSSSSSSSSSIPSAEKVPTTKSTLWQEEMRTKDQPDGSSLSPAQSPSQSQPPAASSLREPGLESKEEESAMSSDRMDCGRKVRVESGYFSLEKTKQDLKAEEQQLPPPLSPPSPSTPNHRRSQVIEKFEALDIEKAEHMETNAVGPSPSSDTRQGRSEKRAFPRKRDFTNEAPPAPLPDASASPLSPHRRAKSLDRRSTEPSVTPDLLNFKKGWLTKQYEDGQWKKHWFVLADQSLRYYRDSVAEEAADLDGEIDLSACYDVTEYPVQRNYGFQIHTKEGEFTLSAMTSGIRRNWIQTIMKHVHPTTAPDVTSSLPEEKNKSSCSFETCPRPTEKQEAELGEPDPEQKRSRARERRREGRSKTFDWAEFRPIQQALAQERVGGVGPADTHEPLRPEAEPGELERERARRREERRKRFGMLDATDGPGTEDAALRMEVDRSPGLPMSDLKTHNVHVEIEQRWHQVETTPLREEKQVPIAPVHLSSEDGGDRLSTHELTSLLEKELEQSQKEASDLLEQNRLLQDQLRVALGREQSAREGYVLQTEVAASPSGAWQRLHRVNQDLQSELEAQCQRQELITHQIQTLKRSYGEAKDTIRHHEAEIRSLQARLSNAAAELAIKEQALAKLKGDLKREQGRVREQLEERQHSEAALSSQLRASEQKLKSAEALLLEKTQELRGLETQQALQRDRQKEVQRLQERIADLSQQLGASEQAQRLMEEKLQRNYELLLESCEKEKQALLQNLKEVEDKASAYEDQLQGQAQQVETLQKEKLSATFEGSEQVHQLEEQLEAREASVRRLAEHVQSLCDERDLLRQRFQELTERVATSDEDVAELREKLRRREADNQSLEHSYQRVSSQLQSMHTLLREKEEELERIKEAHEKVLEKKEQDLNEALVKMVALGSSLEETEIKLQAKEEILRKFASESPKDMEEPRSTPEETERDGTLLPGQPVQATRAPLGLPHTRLEDEDEDLGAPPGEEYGDGSPSREDSMVPPKSVEVLDREGHQQGTAKLDQGAPGVKRQRIRFSTIQCQRYIHPEGSEKTWTSSTSSDTSQDRSPSEESMSSEPAPSVLPATGDSDTYLSIIHSLETKLYVTEEKLKDVTVRLESQQGQSREALLALHHQWAGTEAQLREQLRASLLQVGALASQLEQERQERARRVEGHVGELGDFQVKNSQALMCLENCREQLRSLPRASQEDEQDARAASLASVESALVSAIQALQHWPAPAHGGARAQLETGGTEENGKPASLQQCSQSELTEQEQVRLLSDQIALEASLISQIADSLKNTTSDVSRMLHEISWSGQPPMESAGAPVDTWARKVLVDGEFWSQVESLRKHLGTLGGEAVGASGDGQQSIPQGLAPILANATWVRAELSFATQSVRESFHRRLQSIQETLRGTQTALRQHKCLLREILGAYQTPDFERVMQQVLEALRLPAGHEDGVQLSWDLSPLGEVLGRDSDSSQEPFDVSDQSPGAFVAIQEELAQQLKEKASLLEEIAAALPSLPPVESLRDCQKLLQVSQSLSYNTCLGGLGQYSSLLVQDAIIQAQVCYASCRIRLEYEKELQLCKESWQTREPSCSEQAQAARALREEYEELLRKQKSEYLDVIAIVERENAELKAKAAQLDHQQQCLEDAESKHSMSMFTLRGRYEEEIRCVVEQLTRTESTLQAERSRVLSQLDASVRDRQDMERHHGEQIQTLEDRFQLKVRELQTIHEEELRTLQEHYSQSLRCLQDTLCLHQGPHPKALPAPAPNWQATQGEADSMTGLRERIQELEAQMDVMREELGHKDLEGDAATLREKYQRDLESLKATCERGFAAMEETHQKKIEDLQRQHQRELEKLREEKDRLLAEETAATISAIEAMKNAHREEMERELEKSQRSQISSVNSDVEALRRQYLEELQSVQRELEVLSEQYSQKCLENAHLAQALEAERQALRQCQRENQELNAHNQELNNRLAAEITRLRTLLTGDGGGEATGSPLAQGKDAYELEVLLRVKESEIQYLKQEISSLKDELQTALRDKKYASDKYKDIYTELSIAKAKADCDISRLKEQLKAATEALGEKSPDSATVSGYDIMKSKSNPDFLKKDRSCVTRQLRNIRSKSLKEGLTVQERLKLFESRDLKKD

SEQ ID NO: 887138 - protein, 2321 aa, Homo sapiens
GRAEPLARRERQAGQACAAAAAAVAAAPTMSAAKENPCRKFQANIFNKSKCQNCFKPRESHLLNDEDLTQAKPIYGGWLLLAPDGTDFDNPVHRSRKWQRRFFILYEHGLLRYALDEMPTTLPQGTINMNQCTDVVDGEGRTGQKFSLCILTPEKEHFIRAETKEIVSGWLEMLMVYPRTNKQNQKKKRKVEPPTPQEPGPAKVAVTSSSSSSSSSIPSAEKVPTTKSTLWQEEMRTKDQPDGSSLSPAQSPSQSQPPAASSLREPGLESKEEESAMSSDRMDCGRKVRVESGYFSLEKTKQDLKAEEQQLPPPLSPPSPSTPNHRRSQVIEKFEALDIEKAEHMETNAVGPSPSSDTRQGRSEKRAFPRKRDFTNEAPPAPLPDASASPLSPHRRAKSLDRRSTEPSVTPDLLNFKKGWLTKQYEDGQWKKHWFVLADQSLRYYRDSVAEEAADLDGEIDLSACYDVTEYPVQRNYGFQIHTKEGEFTLSAMTSGIRRNWIQTIMKHVHPTTAPDVTSSLPEEKNKSSCSFETCPRPTEKQEAELGEPDPEQKRSRARERRREGRSKTFDWAEFRPIQQALAQERVGGVGPADTHEPLRPEAEPGELERERARRREERRKRFGMLDATDGPGTEDAALRMEVDRSPGLPMSDLKTHNVHVEIEQRWHQVETTPLREEKQVPIAPVHLSSEDGGDRLSTHELTSLLEKELEQSQKEASDLLEQNRLLQDQLRVALGREQSAREGYVLQTEVAASPSGAWQRLHRVNQDLQSELEAQCQRQELITHQIQTLKRSYGEAKDTIRHHEAEIRSLQARLSNAAAELAIKEQALAKLKGDLKREQGRVREQLEERQHSEAALSSQLRASEQKLKSAEALLLEKTQELRGLETQQALQRDRQKEVQRLQERIADLSQQLGASEQAQRLMEEKLQRNYELLLESCEKEKQALLQNLKEVEDKASAYEDQLQGQAQQVETLQKEKLSATFEGSEQVHQLEEQLEAREASVRRLAEHVQSLCDERDLLRQRFQELTERVATSDEDVAELREKLRRREADNQSLEHSYQRVSSQLQSMHTLLREKEEELERIKEAHEKVLEKKEQDLNEALVKMVALGSSLEETEIKLQAKEEILRKFASESPKDMEEPRSTPEETERDGTLLPGQPVQATRAPLGLPHTRLEDEDEDLGAPPGEEYGDGSPSREDSMVPPKSVEVLDREGHQQGTAKLDQGAPGVKRQRIRFSTIQCQRYIHPEGSEKTWTSSTSSDTSQDRSPSEESMSSEPAPSVLPATGDSDTYLSIIHSLETKLYVTEEKLKDVTVRLESQQGQSREALLALHHQWAGTEAQLREQLRASLLQVGALASQLEQERQERARRVEGHVGELGDFQVKNSQALMCLENCREQLRSLPRASQEDEQDARAASLASVESALVSAIQALQHWPAPAHGGARAQLETGGTEENGKPASLQQCSQSELTEQEQVRLLSDQIALEASLISQIADSLKNTTSDVSRMLHEISWSGQPPMESAGAPVDTWARKVLVDGEFWSQVESLRKHLGTLGGEAVGASGDGQQSIPQGLAPILANATWVRAELSFATQSVRESFHRRLQSIQETLRGTQTALRQHKCLLREILGAYQTPDFERVMQQVLEALRLPAGHEDGVQLSWDLSPLGEVLGRDSDSSQEPFDVSDQSPGAFVAIQEELAQQLKEKASLLEEIAAALPSLPPVESLRDCQKLLQVSQSLSYNTCLGGLGQYSSLLVQDAIIQAQVCYASCRIRLEYEKELQLCKESWQTREPSCSEQAQAARALREEYEELLRKQKSEYLDVIAIVERENAELKAKAAQLDHQQQCLEDAESKHSMSMFTLRGRYEEEIRCVVEQLTRTESTLQAERSRVLSQLDASVRDRQDMERHHGEQIQTLEDRFQLKVRELQTIHEEELRTLQEHYSQSLRCLQDTLCLHQGPHPKALPAPAPNWQATQGEADSMTGLRERIQELEAQMDVMREELGHKDLEGDAATLREKYQRDLESLKATCERGFAAMEETHQKKIEDLQRQHQRELEKLREEKDRLLAEETAATISAIEAMKNAHREEMERELEKSQRSQISSVNSDVEALRRQYLEELQSVQRELEVLSEQYSQKCLENAHLAQALEAERQALRQCQRENQELNAHNQELNNRLAAEITRLRTLLTGDGGGEATGSPLAQGKDAYELEVLLRVKESEIQYLKQEISSLKDELQTALRDKKYASDKYKDIYTELSIAKAKADCDISRLKEQLKAATEALGEKSPDSATVSGYDIMKSKSNPDFLKKDRSCVTRQLRNIRSKSVIEQVSWDT

SEQ ID NO: 887139 - protein, 1634 aa, Homo sapiens
MGKKNKVVQRIKAKAIKELSVVVPGQRCDTQNWEARVLLTSIYIGFFKTEVAASPSGAWQRLHRVNQDLQSELEAQCQRQELITHQIQTLKRSYGEAKDTIRHHEAEIRSLQARLSNAAAELAIKEQALAKLKGDLKREQGRVREQLEERQHSEAALSSQLRASEQKLKSAEALLLEKTQELRGLETQQALQRDRQKEVQRLQERIADLSQQLGASEQAQRLMEEKLQRNYELLLESCEKEKQALLQNLKEVEDKASAYEDQLQGQAQQVETLQKEKLSATFEGSEQVHQLEEQLEAREASVRRLAEHVQSLCDERDLLRQRFQELTERVATSDEDVAELREKLRRREADNQSLEHSYQRVSSQLQSMHTLLREKEEELERIKEAHEKVLEKKEQDLNEALVKMVALGSSLEETEIKLQAKEEILRKFASESPKDMEEPRSTPEETERDGTLLPGQPVQATRAPLGLPHTRLEDEDEDLGAPPGEEYGDGSPSREDSMVPPKSVEVLDREGHQQGTAKLDQGAPGVKRQRIRFSTIQCQRYIHPEGSEKTWTSSTSSDTSQDRSPSEESMSSEPAPSVLPATGDSDTYLSIIHSLETKLYVTEEKLKDVTVRLESQQGQSREALLALHHQWAGTEAQLREQLRASLLQVGALASQLEQERQERARRVEGHVGELGDFQVKNSQALMCLENCREQLRSLPRASQEDEQDARAASLASVESALVSAIQALQHWPAPAHGGARAQLETGGTEENGKPASLQQCSQSELTEQEQVRLLSDQIALEASLISQIADSLKNTTSDVSRMLHEISWSGQPPMESAGAPVDTWARKVLVDGEFWSQVESLRKHLGTLGGEAVGASGDGQQSIPQGLAPILANATWVRAELSFATQSVRESFHRRLQSIQETLRGTQTALRQHKCLLREILGAYQTPDFERVMQQVLEALRLPAGHEDGVQLSWDLSPLGEVLGRDSDSSQEPFDVSDQSPGAFVAIQEELAQQLKEKASLLEEIAAALPSLPPVESLRDCQKLLQVSQSLSYNTCLGGLGQYSSLLVQDAIIQAQVCYASCRIRLEYEKELQLCKESWQTREPSCSEQAQAARALREEYEELLRKQKSEYLDVIAIVERENAELKAKAAQLDHQQQCLEDAESKHSMSMFTLRGRYEEEIRCVVEQLTRTESTLQAERSRVLSQLDASVRDRQDMERHHGEQIQTLEDRFQLKVRELQTIHEEELRTLQEHYSQSLRCLQDTLCLHQGPHPKALPAPAPNWQATQGEADSMTGLRERIQELEAQMDVMREELGHKDLEGDAATLREKYQRDLESLKATCERGFAAMEETHQKKIEDLQRQHQRELEKLREEKDRLLAEETAATISAIEAMKNAHREEMERELEKSQRSQISSVNSDVEALRRQYLEELQSVQRELEVLSEQYSQKCLENAHLAQALEAERQALRQCQRENQELNAHNQELNNRLAAEITRLRTLLTGDGGGEATGSPLAQGKDAYELEVLLRVKESEIQYLKQEISSLKDELQTALRDKKYASDKYKDIYTELSIAKAKADCDISRLKEQLKAATEALGEKSPDSATVSGYDIMKSKSNPDFLKKDRSCVTRQLRNIRSKSLKEGLTVQERLKLFESRDLKKD

SEQ ID NO: 887140 - protein, 526 aa, Homo sapiens
TRLPRVLGEPDPEQKRSRARERRREGRSKTFDWAEFRPIQQALAQERVGGVGPADTHEPLRPEAEPGELERERARRREERRKRFGMLDATDGPGTEDAALRMEVDRSPGLPMSDLKTHNVHVEIEQRWHQVETTPLREEKQVPIAPVHLSSEDGGDRLSTHELTSLLEKELEQSQKEASDLLEQNRLLQDQLRVALGREQSAREGYVLQATCERGFAAMEETHQKKIEDLQRQHQRELEKLREEKDRLLAEETAATISAIEAMKNAHREEMERELEKSQRSQISSVNSDVEALRRQYLEELQSVQRELEVLSEQYSQKCLENAHLAQALEAERQALRQCQRENQELNAHNQELNNRLAAEITRLRTLLTGDGGGEATGSPLAQGKDAYELEVLLRVKESEIQYLKQEISSLKDELQTALRDKKYASDKYKDIYTELSIAKAKADCDISRLKEQLKAATEALGEKSPDSATVSGYDIMKSKSNPDFLKKDRSCVTRQLRNIRSKSLKEGLTVQERLKLFESRDLKKD

SEQ ID NO: 887141 - protein, 1012 aa, Homo sapiens
GRAEPLARRERQAGQACAAAAAAVAAAPTMSAAKENPCRKFQANIFNKSKCQNCFKPRESHLLNDEDLTQAKPIYGGWLLLAPDGTDFDNPVHRSRKWQRRFFILYEHGLLRYALDEMPTTLPQGTINMNQCTDVVDGEGRTGQKFSLCILTPEKEHFIRAETKEIVSGWLEMLMVYPRTNKQNQKKKRKVEPPTPQEPGPAKVAVTSSSSSSSSSIPSAEKVPTTKSTLWQEEMRTKDQPDGSSLSPAQSPSQSQPPAASSLREPGLESKEEESAMSSDRMDCGRKVRVESGYFSLEKTKQDLKAEEQQLPPPLSPPSPSTPNHRRSQVIEKFEALDIEKAEHMETNAVGPSPSSDTRQGRSEKRAFPRKRDFTNEAPPAPLPDASASPLSPHRRAKSLDRRSTEPSVTPDLLNFKKGWLTKQYEDGQWKKHWFVLADQSLRYYRDSVAEEAADLDGEIDLSACYDVTEYPVQRNYGFQIHTKEGEFTLSAMTSGIRRNWIQTIMKHVHPTTAPDVTSSLPEEKNKSSCSFETCPRPTEKQEAELGEPDPEQKRSRARERRREGRSKTFDWAEFRPIQQALAQERVGGVGPADTHEPLRPEAEPGELERERARRREERRKRFGMLDATDGPGTEDAALRMEVDRSPGLPMSDLKTHNVHVEIEQRWHQVETTPLREEKQVPIAPVHLSSEDGGDRLSTHELTSLLEKELEQSQKEASDLLEQNRLLQDQLRVALGREQSAREGYVLQATCERGFAAMEETHQKKIEDLQRQHQRELEKLREEKDRLLAEETAATISAIEAMKNAHREEMERELEKSQRSQISSVNSDVEALRRQYLEELQSVQRELEVLSEQYSQKCLENAHLAQALEAERQALRQCQRENQELNAHNQVLLRVKESEIQYLKQEISSLKDELQTALRDKKYASDKYKDIYTELSIAKAKADCDISRLKEQLKAATEALGEKSPDSATVSGYDIMKSKSNPDFLKKDRSCVTRQLRNIRSKSVIEQVSWDT

SEQ ID NO: 887142 - protein, 1025 aa, Homo sapiens
GRAEPLARRERQAGQACAAAAAAVAAAPTMSAAKENPCRKFQANIFNKSKCQNCFKPRESHLLNDEDLTQAKPIYGGWLLLAPDGTDFDNPVHRSRKWQRRFFILYEHGLLRYALDEMPTTLPQGTINMNQCTDVVDGEGRTGQKFSLCILTPEKEHFIRAETKEIVSGWLEMLMVYPRTNKQNQKKKRKVEPPTPQEPGPAKVAVTSSSSSSSSSIPSAEKVPTTKSTLWQEEMRTKDQPDGSSLSPAQSPSQSQPPAASSLREPGLESKEEESAMSSDRMDCGRKVRVESGYFSLEKTKQDLKAEEQQLPPPLSPPSPSTPNHRRSQVIEKFEALDIEKAEHMETNAVGPSPSSDTRQGRSEKRAFPRKRDFTNEAPPAPLPDASASPLSPHRRAKSLDRRSTEPSVTPDLLNFKKGWLTKQYEDGQWKKHWFVLADQSLRYYRDSVAEEAADLDGEIDLSACYDVTEYPVQRNYGFQIHTKEGEFTLSAMTSGIRRNWIQTIMKHVHPTTAPDVTSSLPEEKNKSSCSFETCPRPTEKQEAELGEPDPEQKRSRARERRREGRSKTFDWAEFRPIQQALAQERVGGVGPADTHEPLRPEAEPGELERERARRREERRKRFGMLDATDGPGTEDAALRMEVDRSPGLPMSDLKTHNVHVEIEQRWHQVETTPLREEKQVPIAPVHLSSEDGGDRLSTHELTSLLEKELEQSQKEASDLLEQNRLLQDQLRVALGREQSAREGYVLQATCERGFAAMEETHQKKIEDLQRQHQRELEKLREEKDRLLAEETAATISAIEAMKNAHREEMERELEKSQRSQISSVNSDVEALRRQYLEELQSVQRELEVLSEQYSQKCLENAHLAQALEAERQALRQCQRENQELNAHNQVLLRVKESEIQYLKQEISSLKDELQTALRDKKYASDKYKDIYTELSIAKAKADCDISRLKEQLKAATEALGEKSPDSATVSGYDIMKSKSNPDFLKKDRSCVTRQLRNIRSKSLKEGLTVQERLKLFESRDLKKD

SEQ ID NO: 887143 - protein, 841 aa, Homo sapiens
GRAEPLARRERQAGQACAAAAAAVAAAPTMSAAKENPCRKFQANIFNKSKCQNCFKPRESHLLNDEDLTQAKPIYGGWLLLAPDGTDFDNPVHRSRKWQRRFFILYEHGLLRYALDEMPTTLPQGTINMNQCTDVVDGEGRTGQKFSLCILTPEKEHFIRAETKEIVSGWLEMLMVYPRTNKQNQKKKRKVEPPTPQEPGPAKVAVTSSSSSSSSSIPSAEKVPTTKSTLWQEEMRTKDQPDGSSLSPAQSPSQSQPPAASSLREPGLESKEEESAMSSDRMDCGRKVRVESGYFSLEKTKQDLKAEEQQLPPPLSPPSPSTPNHRRSQVIEKFEALDIEKAEHMETNAVGPSPSSDTRQGRSEKRAFPRKRDFTNEAPPAPLPDASASPLSPHRRAKSLDRRSTEPSVTPDLLNFKKGWLTKQYEDGQWKKHWFVLADQSLRYYRDSVAEEAADLDGEIDLSACYDVTEYPVQRNYGFQIHTKEGEFTLSAMTSGIRRNWIQTIMKHVHPTTAPDVTSSLPEEKNKSSCSFETCPRPTEKQEAELGEPDPEQKRSRARERRREGRSKTFDWAEFRPIQQALAQERVGGVGPADTHEPLRPEAEPGELERERARRREERRKRFGMLDATDGPGTEDAALRMEVDRSPGLPMSDLKTHNVHVEIEQRWHQVETTPLREEKQVPIAPVHLSSEDGGDRLSTHELTSLLEKELEQSQKEASDLLEQNRLLQDQLRVALGREQSAREGYVLQATCERGFAAMEETHQKKIEDLQRQHQRELEKLREEKDRLLAEETAATISAIEAMKNAHREEMERELEKSQRSQISSVNSDVEALRRQYLSYCG

SEQ ID NO: 887144 - protein, 1065 aa, Homo sapiens; identical to SEQ ID NO: 887136

SEQ ID NO: 887145 - protein, 1065 aa, Homo sapiens; identical to SEQ ID NO: 887136

SEQ ID NO: 887146 - protein, 220 aa, Homo sapiens
GRAEPLARRERQAGQACAAAAAAVAAAPTMSAAKENPCRKFQANIFNKSKCQNCFKPRESHLLNDEDLTQAKPIYGGWLLLAPDGTDFDNPVHRSRKWQRRFFILYEHGLLRYALDEMPTTLPQGTINMNQCTDVVDGEGRTGQKFSLCILTPEKEHFIRAETKEIVSGWLEMLMVYPRTNKQNQKKKRKVEPPTPQEPGPAKVAVTSRQQQQQQQHPQC

SEQ ID NO: 887147 - protein, 648 aa, Homo sapiens
GRAEPLARRERQAGQACAAAAAAVAAAPTMSAAKENPCRKFQANIFNKSKCQNCFKPRESHLLNDEDLTQAKPIYGGWLLLAPDGTDFDNPVHRSRKWQRRFFILYEHGLLRYALDEMPTTLPQGTINMNQCTDVVDGEGRTGQKFSLCILTPEKEHFIRAETKEIVSGWLEMLMVYPRTNKQNQKKKRKVEPPTPQEPGPAKVAVTSSSSSSSSSIPSAEKVPTTKSTLWQEEMRTKDQPDGSSLSPAQSPSQSQPPAASSLREPGLESKEEESAMSSDRMDCGRKVRVESGYFSLEKTKQDLKAEEQQLPPPLSPPSPSTPNHRRSQVIEKFEALDIEKAEHMETNAVGPSPSSDTRQGRSEKRAFPRKRDFTNEAPPAPLPDASASPLSPHRRAKSLDRRSTEPSVTPDLLNFKKGWLTKQYEDGQWKKHWFVLADQSLRYYRDSVAEEAADLDGEIDLSACYDVTEYPVQRNYGFQIHTKEGEFTLSAMTSGIRRNWIQTIMKHVHPTTAPDVTSCSLCHFKVLLRVKESEIQYLKQEISSLKDELQTALRDKKYASDKYKDIYTELSIAKAKADCDISRLKEQLKAATEALGEKSPDSATVSGYDIMKSKSNPDFLKKDRSCVTRQLRNIRSKSVIEQVSWDT

SEQ ID NO: 887148 - protein, 1065 aa, Homo sapiens; identical to SEQ ID NO: 887136

SEQ ID NO: 887149 - protein, 1065 aa, Homo sapiens; identical to SEQ ID NO: 887136

SEQ ID NO: 887150 - protein, 1065 aa, Homo sapiens; identical to SEQ ID NO: 887136

SEQ ID NO: 887151 - protein, 1065 aa, Homo sapiens; identical to SEQ ID NO: 887136

SEQ ID NO: 887152 - protein, 1065 aa, Homo sapiens; identical to SEQ ID NO: 887136

SEQ ID NO: 887153 - protein, 136 aa, Homo sapiens
SRLPSDSKDAYELEVLLRVKESEIQYLKQEISSLKDELQTALRDKKYASDKYKDIYTELSIAKAKADCDISRLKEQLKAATEALGEKSPDSATVSGYDIMKSKSNPDFLKKDRSCVTRQLRNIRSKSVIEQVSWDT

SEQ ID NO: 887154 - protein, 525 aa, Homo sapiens
GRAEPLARRERQAGQACAAAAAAVAAAPTMSAAKENPCRKFQANIFNKSKCQNCFKPRESHLLNDEDLTQAKPIYGGWLLLAPDGTDFDNPVHRSRKWQRRFFILYEHGLLRYALDEMPTTLPQGTINMNQCTDVVDGEGRTGQKFSLCILTPEKEHFIRAETKEIVSGWLEMLMVYPRTNKQNQKKKRKVEPPTPQEPGPAKVAVTSSSSSSSSSIPSAEKVPTTKSTLWQEEMRTKDQPDGSSLSPAQSPSQSQPPAASSLREPGLESKEEESAMSSDRMDCGRKVRVESGYFSLEKTKQDLKAEEQQLPPPLSPPSPSTPNHRRSQVIEKFEALDIEKAEHMETNAVGPSPSSDTRQGRSEKRAFPRKRDFTNEAPPAPLPDASASPLSPHRRAKSLDRRSTEPSVTPDLLNFKKGWLTKQYEDGQWKKHWFVLADQSLRYYRDSVAEEAADLDGEIDLSACYDVTEYPVQRNYGFQIHTKEGEFTLSAMTSGIRRNWIQTIMKHVHPTTAPDVTSSLNPGT

SEQ ID NO: 887155 - protein, 1054 aa, Homo sapiens
GRAEPLARRERQAGQACAAAAAAVAAAPTMSAAKENPCRKFQANIFNKSKCQNCFKPRESHLLNDEDLTQAKPIYGGWLLLAPDGTDFDNPVHRSRKWQRRFFILYEHGLLRYALDEMPTTLPQGTINMNQCTDVVDGEGRTGQKFSLCILTPEKEHFIRAETKEIVSGWLEMLMVYPRTNKQNQKKKRKVEPPTPQEPGPAKVAVTSSSSSSSSSIPSAEKVPTTKSTLWQEEMRTKDQPDGSSLSPAQSPSQSQPPAASSLREPGLESKEEESAMSSDRMDCGRKVRVESGYFSLEKTKQDLKAEEQQLPPPLSPPSPSTPNHRRSQVIEKFEALDIEKAEHMETNAVGPSPSSDTRQGRSEKRAFPRKRDFTNEAPPAPLPDASASPLSPHRRAKSLDRRSTEPSVTPDLLNFKKGWLTKQYEDGQWKKHWFVLADQSLRYYRDSVAEEAADLDGEIDLSACYDVTEYPVQRNYGFQIHTKEGEFTLSAMTSGIRRNWIQTIMKHVHPTTAPDVTSSLPEEKNKSSCSFETCPRPTEKQEAELGEPDPEQKRSRARERRREGRSKTFDWAEFRPIQQALAQERVGGVGPADTHEPLRPEAEPGELERERARRREERRKRFGMLDATDGPGTEDAALRMEVDRSPGLPMSDLKTHNVHVEIEQRWHQVETTPLREEKQVPIAPVHLSSEDGGDRLSTHELTSLLEKELEQSQKEASDLLEQNRLLQDQLRVALGREQSAREGYVLQATCERGFAAMEETHQKKIEDLQRQHQRELEKLREEKDRLLAEETAATISAIEAMKNAHREEMERELEKSQRSQISSVNSDVEALRRQYLEELQSVQRELEVLSEQYSQKCLENAHLAQALEAERQALRQCQRENQELNAHNQELNNRLAAEITRLRTLLTGDGGGEATGSPLAQGKDAYELEVLLRVKESEIQYLKQEISSLKDELQTALRDKKYASDKYKDIYTELSIAKAKADCDISRLKEQLKAATEALGEKSPDSATVSGYDIMKSKSNPDFLKKDRSCVTRQLRNIRSKVSLGSSPLVGGA

SEQ ID NO: 887156 - protein, 370 aa, Homo sapiens
GRAEPLARRERQAGQACAAAAAAVAAAPTMSAAKENPCRKFQANIFNKSKCQNCFKPRESHLLNDEDLTQAKPIYGGWLLLAPDGTDFDNPVHRSRKWQRRFFILYEHGLLRYALDEMPTTLPQGTINMNQCTDVVDGEGRTGQKFSLCILTPEKEHFIRAETKEIVSGWLEMLMVYPRTNKQNQKKKRKVEPPTPQEPGPAKVAVTSSSSSSSSSIPSAEKVPTTKSTLWQEEMRTKDQPDGSSLSPAQSPSQSQPPAASSLREPGLESKEEESAMSSDRMDCGRKVRVESGYFSLEKTKQDLKAEEQQLPPPLSPPSPSTPNHRYSCPESPSQELGGPLPSPGPRLPHQMVCSISLSSLDVASQPPAY

SEQ ID NO: 887157 - protein, 329 aa, Homo sapiens
GRAEPLARRERQAGQACAAAAAAVAAAPTMSAAKENPCRKFQANIFNKSKCQNCFKPRESHLLNDEDLTQAKPIYGGWLLLAPDGTDFDNPVHRSRKWQRRFFILYEHGLLRYALDEMPTTLPQGTINMNQCTDVVDGEGRTGQKFSLCILTPEKEHFIRAETKEIVSGWLEMLMVYPRTNKQNQKKKRKVEPPTPQEPGPAKVAVTSSSSSSSSSIPSAEKVPTTKSTLWQEEMRTKDQPDGSSLSPAQSPSQSQPPAASSLREPGLESKEVGSAFAFKASRQYATLADVPKAIRISHREAFQVERRRLERRTRARSPGREEVARLFG

SEQ ID NO: 887158 - protein, 269 aa, Homo sapiens
GRAEPLARRERQAGQACAAAAAAVAAAPTMSAAKENPCRKFQANIFNKSKCQNCFKPRESHLLNDEDLTQAKPIYGGWLLLAPDGTDFDNPVHRSRKWQRRFFILYEHGLLRYALDEMPTTLPQGTINMNQCTDVVDGEGRTGQKFSLCILTPEKEHFIRAETKEIVSGWLEMLMVYPRTNKQNQKKKRKVEPPTPQEPGPAKVAAAAAAAAAKVPAKKITAASKKAPAQKVPAQKATGQKAAPAPKAQKGQKAPAQKAPAPKAFGKKA

SEQ ID NO: 887159 - protein, 102 aa, Homo sapiens
LDIEKAEHMETNAVGPSPSSDTRQGRSEKRAFPRKRVSSWGWAAPQGWLGGGSACTPCAKSPPHRPGMCSCQASLQPPPLHSDFLRAGLSPAASYQSLLRLC

SEQ ID NO: 887160 - protein, 92 aa, Homo sapiens
VDRSPGLPMSDLKTHNVHVEIEQRWHQVETTPLREEKQVPIAPVHLSSEDGGDRLSTHELTSLLEKEVIAWDQIPTLLPAAFPEHQLCPAVA

SEQ ID NO: 887161 - protein, 804 aa, Homo sapiens
MAAHRPGPLKQQNKAHKGGRHRGRGSAQRDGKGRLALKTLSKKVRKELSRVDQRHRASQLRKQKKEAVLAEKRQLGGKDGPPHQVLVVPLHSRISLPEAMQLLQDRDTGTVHLNELGNTQNFMLLCPRLKHRWFFTSARPGDLHVVLDMAKVADTILFLLDPLEGWDSTGDYCLSCLFAQGLPTYTLAVQGISGLPLKKQIDTRKKLSKAVEKRFPHDKLLLLDTQQEAGMLLRQLANQKQQHLAFRDRRAYLFAHAVDFVPSEENNLVGTLKISGYVRGQTLNVNRLLHIVGYGDFQMKQIDAPGDPFPLNPRGIKPQKDPDMAMEICATDAVDDMEEGLKVLMKADPGRQESLQAEVIPDPMEGEQTWPTEEELSEAKDFLKESSKVVKKVPKGTSSYQAEWILDGGSQSGGEGDEYEYDDMEHEDFMEEESQDESSEEEEEYETMTIGESVHDDLYDKKVDEEAEAKMLEKYKQERLEEMFPDEVDTPRDVAARIRFQKYRGLKSFRTSPWDPKENLPQDYARIFQFQNFTNTRKSIFKEVEEKEVEGAEVGWYVTLHVSEVPVSVVECFRQGTPLIAFSLLPHEQKMSVLNMVVRRDPGNTEPVKAKEELIFHCGFRRFRASPLFSQHTAADKHKLQRFLTADMALVATVYAPITFPPASVLLFKQKSNGMHSLIATGHLMSVDPDRMVIKRVVLSGHPFKIFTKMAVVRYMFFNREDVLWFKPVELRTKWGRRGHIKEPLGTHGHMKCSFDGKLKSQDTVLMNLYKRVFPKWTYDPYVPEPVPWLKSEISSTVPQGGME

SEQ ID NO: 887162 - protein, 804 aa, Homo sapiens; identical to SEQ ID NO: 887161

SEQ ID NO: 887163 - protein, 763 aa, Homo sapiens
RSGRGRSAGGTASDGHAPPPDSAAGGVLAEKRQLGGKDGPPHQVLVVPLHSRISLPEAMQLLQDRDTGTVHLNELGNTQNFMLLCPRLKHRWFFTSARPGDLHVVLDMAKVADTILFLLDPLEGWDSTGDYCLSCLFAQGLPTYTLAVQGISGLPLKKQIDTRKKLSKAVEKRFPHDKLLLLDTQQEAGMLLRQLANQKQQHLAFRDRRAYLFAHAVDFVPSEENNLVGTLKISGYVRGQTLNVNRLLHIVGYGDFQMKQIDAPGDPFPLNPRGIKPQKDPDMAMEICATDAVDDMEEGLKVLMKADPGRQESLQAEVIPDPMEGEQTWPTEEELSEAKDFLKESSKVVKKVPKGTSSYQAEWILDGGSQSGGEGDEYEYDDMEHEDFMEEESQDESSEEEEEYETMTIGESVHDDLYDKKVDEEAEAKMLEKYKQERLEEMFPDEVDTPRDVAARIRFQKYRGLKSFRTSPWDPKENLPQDYARIFQFQNFTNTRKSIFKEVEEKEVEGAEVGWYVTLHVSEVPVSVVECFRQGTPLIAFSLLPHEQKMSVLNMVVRRDPGNTEPVKAKEELIFHCGFRRFRASPLFSQHTAADKHKLQRFLTADMALVATVYAPITFPPASVLLFKQKSNGMHSLIATGHLMSVDPDRMVIKRVVLSGHPFKIFTKMAVVRYMFFNREDVLWFKPVELRTKWGRRGHIKEPLGTHGHMKCSFDGKLKSQDTVLMNLYKRVFPKWTYDPYVPEPVPWLKSEISSTVPQGGME

SEQ ID NO: 887164 - protein, 735 aa, Homo sapiens
MAAHRPGPLKQQNKAHKGGRHRGRGSAQRDGKGRLALKTLSKKVRKELSRVDQRHRASQLRKQKKEAVLAEKRQLGGKDGPPHQVLVVPLHSRISLPEAMQLLQDRDTGTVHLNELGNTQNFMLLCPRLKHRWFFTSARPGDLHVVLDMAKVADTILFLLDPLEGWDSTGDYCLSCLFAQGLPTYTLAVQGISGLPLKKQIDTRKKLSKAVEKRFPHDKLLLLDTQQEAGMLLRQLANQKQQHLAFRDRRAYLFAHAVDFVPSEENNLVGTLKISGYVRGQTLNVNRLLHIVGYGDFQMKQIDAPGDPFPLNPRGIKPQKDPDMAMEICATDAVDDMEEGLKVLMKADPGRQESLQAEVIPDPMEGEQTWPTEEELSEAKDFLKESSKVVKKVPKGTSSYQAEWILDGGSQSGGEGDEYEYDDMEHEDFMEEESQDESSEEEEEYETMTIGESVHDDLYDKKVDEEAEAKMLEKYKQERLEEMFPDEVDTPRDVAARIRFQKYRGLKSFRTSPWDPKENLPQDYARIFQFQNFTNTRKSIFKEVEEKEVEGAEVGWYVTLHVSEVPVSVVECFRQGTPLIAFSLLPHEQKMSVLNMVVRRDPGNTEPVKAKEELIFHCGFRRFRASPLFSQHTAADKHKLQRFLTADMALVATVYAPITFPPASVLLFKQKSNGMHSLIATGHLMSVDPDRMVIKRVVLSGHPFKIFTKMAVVRYMFFNRGGYEGGGWDLIAFVV

SEQ ID NO: 887165 - protein, 390 aa, Homo sapiens
MTVCKKQAGTAGIPGYREESQDESSEEEEEYETMTIGESVHDDLYDKKVDEEAEAKMLEKYKQERLEEMFPDEVDTPRDVAARIRFQKYRGLKSFRTSPWDPKENLPQDYARIFQFQNFTNTRKSIFKEVEEKEVEGAEVGWYVTLHVSEVPVSVVECFRQGTPLIAFSLLPHEQKMSVLNMVVRRDPGNTEPVKAKEELIFHCGFRRFRASPLFSQHTAADKHKLQRFLTADMALVATVYAPITFPPASVLLFKQKSNGMHSLIATGHLMSVDPDRMVIKRVVLSGHPFKIFTKMAVVRYMFFNREDVLWFKPVELRTKWGRRGHIKEPLGTHGHMKCSFDGKLKSQDTVLMNLYKRVFPKWTYDPYVPEPVPWLKSEISSTVPQGGME

SEQ ID NO: 887166 - protein, 689 aa, Homo sapiens
MAAHRPGPLKQQNKAHKGGRHRGRGSAQRDGKGRLALKTLSKKVRKELSRVDQRHRASQLRKQKKEAVLAEKRQLGGKDGPPHQVLVVPLHSRISLPEAMQLLQDRDTGTVHLNELGNTQNFMLLCPRLKHRWFFTSARPGDLHVVLDMAKVADTILFLLDPLEGWDSTGDYCLSCLFAQGLPTYTLAVQGISGLPLKKQIDTRKKLSKAVEKRFPHDKLLLLDTQQEAGMLLRQLANQKQQHLAFRDRRAYLFAHAVDFVPSEENNLVGTLKISGYVRGQTLNVNRLLHIVGYGDFQMKQIDAPGDPFPLNPRGIKPQKDPDMAMEICATDAVDDMEEGLKVLMKADPGRQESLQAEVIPDPMEGEQTWPTEEELSEAKDFLKESSKVVKKVPKGTSSYQAEWILDGGSQSGGEGDEYEYDDMEHEDFMEEESQDESSEEEEEYETMTIGESVHDDLYDKKVDEEAEAKMLEKYKQERLEEMFPDEVDTPRDVAARIRFQKYRGLKSFRTSPWDPKENLPQDYARIFQFQNFTNTRKSIFKEVEEKEVEGAEVGWYVTLHVSEVPVSVVECFRQGTPLIAFSLLPHEQKMSVLNMVVRRDPGNTEPVKAKEELIFHCGFRRFRASPLFSQHTAADKHKLQRFLTADMALVATVYAPITFPPASVLLFKQKSNGKLSHRDEQTLQVLNR

SEQ ID NO: 887167 - protein, 425 aa, Homo sapiens
MAAHRPGPLKQQNKAHKGGRHRGRGSAQRDGKGRLALKTLSKKVRKELSRVDQRHRASQLRKQKKEAVLAEKRQLGGKDGPPHQVLVVPLHSRISLPEAMQLLQDRDTGTVHLNELGNTQNFMLLCPRLKHRWFFTSARPGDLHVVLDMAKVADTILFLLDPLEGWDSTGDYCLSCLFAQGLPTYTLAVQGISGLPLKKQIDTRKKLSKAVEKRFPHDKLLLLDTQQEAGMLLRQLANQKQQHLAFRDRRAYLFAHAVDFVPSEENNLVGTLKISGYVRGQTLNVNRLLHIVGYGDFQMKQIDAPGDPFPLNPRGIKPQKDPDMAMEICATDAVDDMEEGLKVLMKADPGRQESLQAEVIPDPMEGEQTWPTEEELSEAKDFLKESSKVVKKVPKGTSSYQAEWILDGGSQSGGEGDEYEYDDME

SEQ ID NO: 887168 - protein, 804 aa, Homo sapiens; identical to SEQ ID NO: 887161

SEQ ID NO: 887169 - protein, 804 aa, Homo sapiens; identical to SEQ ID NO: 887161

SEQ ID NO: 887170 - protein, 599 aa, Homo sapiens
MAAHRPGPLKQQNKAHKGGRHRGRGSAQRDGKGRLALKTLSKKVRKELSRVDQRHRASQLRKQKKEAVLAEKRQLGGKDGPPHQVLVVPLHSRISLPEAMQLLQDRDTGTVHLNELGNTQNFMLLCPRLKHRWFFTSARPGDLHVVLDMAKVADTILFLLDPLEGWDSTGDYCLSCLFAQGLPTYTLAVQGISGLPLKKQIDTRKKLSKAVEKRFPHDKLLLLDTQQEAGMLLRQLANQKQQHLAFRDRRAYLFAHAVDFVPSEENNLVGTLKISGYVRGQTLNVNRLLHIVGYGDFQMKQIDAPGDPFPLNPRGIKPQKDPDMAMEICATDAVDDMEEGLKVLMKADPGRQESLQAEVIPDPMEGEQTWPTEEELSEAKDFLKESSKVVKKVPKGTSSYQAEWILDGGSQSGGEGDEYEYDDMEHEDFMEEESQDESSEEEEEYETMTIGESVHDDLYDKKVDEEAEAKMLEKYKQERLEEMFPDEVDTPRDVAARIRFQKYRGLKSFRTSPWDPKENLPQDYARIFQFQNFTNTRKSIFKEVEEKEVEGAEVGWYVTLHVSEVPVSVVECFRQGTPLIAFSLLPHEQKRTNINCRDS

SEQ ID NO: 887171 - protein, 708 aa, Homo sapiens
MAAHRPGPLKQQNKAHKGGRHRGRGSAQRDGKGRLALKTLSKKVRKELSRVDQRHRASQLRKQKKEAVLAEKRQLGGKDGPPHQVLVVPLHSRISLPEAMQLLQDRDTGTVHLNELGNTQNFMLLCPRLKHRWFFTSARPGDLHVVLDMAKVADTILFLLDPLEGWDSTGDYCLSCLFAQGLPTYTLAVQGISGLPLKKQIDTRKKLSKAVEKRFPHDKLLLLDTQQEAGMLLRQLANQKQQHLAFRDRRAYLFAHAVDFVPSEENNLVGTLKISGYVRGQTLNVNRLLHIVGYGDFQMKQIDAPGDPFPLNPRGIKPQKDPDMAMEICATDAVDDMEEGLKVLMKADPGRQESLQAEVIPDPMEGEQTWPTEEELSEAKDFLKESSKVVKKVPKGTSSYQAEWILDGGSQSGGEGDEYEYDDMEHEDFMEEESQDESSEEEEEYETMTIGESVHDDLYDKKVDEEAEAKMLEKYKQERLEEMFPDEVDTPRDVAARIRFQKYRGLKSFRTSPWDPKENLPQDYARIFQFQNFTNTRKSIFKEVEEKEVEGAEVGWYVTLHVSEVPVSVVECFRQGTPLIAFSLLPHEQKMSVLNMVVRRDPGNTEPVKAKEELIFHCGFRRFRASPLFSQHTAADKHKLQRFLTADMALVATVYAPITFPPASVLLFKQKSNGMHSLFVTGPLIVTDSDTIGIPIPVLRGPPLQNYY

SEQ ID NO: 887172 - protein, 206 aa, Homo sapiens [sequence omitted]

SEQ ID NO: 887173 - protein, 206 aa, Homo sapiens [sequence omitted]

SEQ ID NO: 887174 - protein, 192 aa, Homo sapiens
HSAFPRVVPCSVCSSSHQLSWKEELRVATQEKEGSSGRCMLTLLGLSFILAGLIVGGACIYKYFMPKSTIYRGEMCFFDSEDPANSLRGGEPNFLPVTEEADIREDDNIAIIDVPVPSFSDSDPAAIIHDFEKGMTAYLDLLLGNCYLMPLNTSIVMPPKKSGRALWQTGEWQISASNLCGSRRPSCCGGNS

SEQ ID NO: 887175 - protein, 162 aa, Homo sapiens
MVKIAFNTPTAVQKEEARQDVEALLSRTVRTQILTGKSTIYRGEMCFFDSEDPANSLRGGEPNFLPVTEEADIREDDNIAIIDVPVPSFSDSDPAAIIHDFEKGMTAYLDLLLGNCYLMPLNTSIVMPPKKSGRALWQTGEWQISASNLCGSRRPSCCGGNS

SEQ ID NO: 887176 - protein, 215 aa, Homo sapiens
MVKIAFNTPTAVQKEEARQDVEALLSRTVRTQILTGKELRVATQEKEGSSGRCMLTLLGLSFILAGLIVGGACIYKYFMPKVVIFPFCLLSTIYRGEMCFFDSEDPANSLRGGEPNFLPVTEEADIREDDNIAIIDVPVPSFSDSDPAAIIHDFEKGMTAYLDLLLGNCYLMPLNTSIVMPPKKSGRALWQTGEWQISASNLCGSRRPSCCGGNS

SEQ ID NO: 887177 - protein, 181 aa, Homo sapiens
MVKIAFNTPTAVQKEEARQDVEALLSRTVRTQILTGKELRVATQEKEGSSGRCMLTLLGLSFILAGLIVGGACIYKYFMPKSTIYRGEMCFFDSEDPANSLRGGEPNFLPVTEEADIREDDNIAIIDVPVPSFSDSDPAAIIHDFEKGMTAYLDLLLGNCYLMPLNTSIVMPPKKLWFEKT

SEQ ID NO: 887178 - protein, 128 aa, Homo sapiens
MPKSTIYRGEMCFFDSEDPANSLRGGEPNFLPVTEEADIREDDNIAIIDVPVPSFSDSDPAAIIHDFEKGMTAYLDLLLGNCYLMPLNTSIVMPPKKSGRALWQTGEWQISASNLCGSRRPSCCGGNS

SEQ ID NO: 887179 - protein, 206 aa, Homo sapiens [sequence omitted]

SEQ ID NO: 887180 - protein, 203 aa, Homo sapiens
MVKIAFNTPTAVQKEEARQDVEALLSRTVRTQILTGKELRVATQEKEGSSGRCMLTLLGLSFILAGLIVGGACIYKYFMPKSTIYRGEMCFFDSEDPANSLRGGEPNFLPVTEEADIREDDNIAIIDVPVPSFSDSDPAAIIHDFEKGMTAYLDLLLGNCYLMPLNTSIVMPPKKSGRYLPHASLPKSSTSRPAANLAVVVGA

SEQ ID NO: 887181 - protein, 1937 aa, Homo sapiens
MSASSDAEMAVFGEAAPYLRKSEKERIEAQNKPFDAKTSVFVAEPKESYVKSTIQSKEGGKVTVKTEGGATLTVREDQVFPMNPPKYDKIEDMAMMTHLHEPGVLYNLKERYAAWMIYTYSGLFCVTVNPYKWLPVYKPEVVAAYRGKKRQEAPPHIFSISDNAYQFMLTDRENQSILITGESGAGKTVNTKRVIQYFATIAVTGEKKKDESGKMQGTLEDQIISANPLLEAFGNAKTVRNDNSSRFGKFIRIHFGTTGKLASADIETYLLEKSRVTFQLKAERSYHIFYQITSNKKPDLIEMLLITTNPYDYAFVSQGEITVPSIDDQEELMATDSAIDILGFTPEEKVSIYKLTGAVMHYGNMKFKQKQREEQAEPDGTEVADKAAYLQSLNSADLLKALCYPRVKVGNEYVTKGQTVQQVYNAVGALAKAVYEKMFLWMVTRINQQLDTKQPRQYFIGVLDIAGFEIFDFNSLEQLCINFTNEKLQQFFNHHMFVLEQEEYKKEGIEWTFIDFGMDLAACIELIEKPLGIFSILEEECMFPKATDTSFKNKLYDQHLGKSANFQKPKVVKGKAEAHFSLIHYAGTVDYNITGWLDKNKDPLNDTVVGLYQKSAMKTLASLFSTYASAEADSSAKKGAKKKGSSFQTVSALFRENLNKLMTNLRSTHPHFVRCIIPNETKTPGAMEHELVLHQLRCNGVLEGIRICRKGFPSRILYGDFKQRYKVLNASAIPEGQFIDSKKASEKLLASIDIDHTQYKFGHTKVFFKAGLLGLLEEMRDEKLAQIITRTQAVCRGFLMRVEYQKMLQRREALFCIQYNVRAFMNVKHWPWMKLFFKIKPLLKSAETEKEMATMKEEFQKTKDELAKSEAKRKELEEKMVTLLKEKNDLQLQVQSEADSLADAEERCEQLIKNKIQLEAKIKEVTERAEEEEEINAELTAKKRKLEDECSELKKDIDDLELTLAKVEKEKHATENKVKNLTEEMAGLDETIAKLSKEKKALQETHQQTLDDLQAEEDKVNILTKAKTKLEQQVDDLEGSLEQEKKLRMDLERAKRKLEGDLKLAQESTMDMENDKQQLDEKLEKKEFEISNLISKIEDEQAVEIQLQKKIKELQARIEELGEEIEAERASRAKAEKQRSDLSRELEEISERLEEAGGATSAQVELNKKREAEFQKLRRDLEEATLQHEAMVAALRKKHADSMAELGEQIDNLQRVKQKLEKEKSELKMETDDLSSNAEAISKAKGNLEKMCRSLEDQVSELKTKEEEQQRLINDLTAQRARLQTEAGEYSRQLDEKDALVSQLSRSKQASTQQIEELKHQLEEETKAKNALAHALQSSRHDCDLLREQYEEEQEGKAELQRALSKANSEVAQWRTKYETDAIQRTEELEEAKKKLAQRLQEAEEHVEAVNAKCASLEKTKQRLQNEVEDLMLDVERSNAACAALDKKQRNFDKVLSEWKQKYEETQAELEASQKESRSLSTELFKVKNVYEESLDQLETLRRENKNLQQEISDLTEQIAEGGKQIHELEKIKKQVEQEKCEIQAALEEAEASLEHEEGKILRIQLELNQVKSEVDRKIAEKDEEIDQLKRNHTRVVETMQSTLDAEIRSRNDALRVKKKMEGDLNEMEIQLNHANRLAAESLRNYRNTQGILKETQLHLDDALRGQEDLKEQLAIVERRANLLQAEIEELWATLEQTERSRKIAEQELLDASERVQLLHTQNTSLINTKKKLENDVSQLQSEVEEVIQESRNAEEKAKKAITDAAMMAEELKKEQDTSAHLERMKKNLEQTVKDLQHRLDEAEQLALKGGKKQIQKLEARVRELEGEVENEQKRNAEAVKGLRKHERRVKELTYQTEEDRKNVLRLQDLVDKLQAKVKSYKRQAEEAEEQSNANLSKFRKLQHELEEAEERADIAESQVNKLRVKSREVHTKISAE

SEQ ID NO: 887182 - protein, 1919 aa, Homo sapiens
MSASSDAEMAVFGEAAPYLRKSEKERIEAQNKPFDAKTSVFVAEPKESYVKSTIQSKEGGKVTVKTEGGATLTVREDQVFPMNPPKYDKIEDMAMMTHLHEPGVLYNLKERYAAWMIYTYSGLFCVTVNPYKWLPVYKPEVVAAYRGKKRQEAPPHIFSISDNAYQFMLTDRENQSILITGESGAGKTVNTKRVIQYFATIAVTGEKKKDESGKMQGTLEDQIISANPLLEAFGNAKTVRNDNSSRFGKFIRIHFGTTGKLASADIETYLLEKSRVTFQLKAERSYHIFYQITSNKKPDLIEMLLITTNPYDYAFVSQGEITVPSIDDQEELMATDSAIDILGFTPEEKVSIYKLTGAVMHYGNMKFKQKQREEQAEPDGTEVADKAAYLQSLNSADLLKALCYPRVKVGNEYVTKGQTVQQVYNAVGALAKAVYEKMFLWMVTRINQQLDTKQPRQYFIGVLDIAGFEIFDFNSLEQLCINFTNEKLQQFFNHHMFVLEQEEYKKEGIEWTFIDFGMDLAACIELIEKPLGIFSILEEECMFPKATDTSFKNKLYDQHLGKSANFQKPKVVKGKAEAHFSLIHYAGTVDYNITGWLDKNKDPLNDTVVGLYQKSAMKTLASLFSTYASAEADSSAKKGAKKKGSSFQTVSALFRENLNKLMTNLRSTHPHFVRCIIPNETKTPGAMEHELVLHQLRCNGVLEGIRICRKGFPSRILYGDFKQRYKVLNASAIPEGQFIDSKKASEKLLASIDIDHTQYKFGHTKVFFKAGLLGLLEEMRDEKLAQIITRTQAVCRGFLMRVEYQKMLQRREALFCIQYNVRAFMNVKHWPWMKLFFKIKPLLKSAETEKEMATMKEEFQKTKDELAKSEAKRKELEEKMVTLLKEKNDLQLQVQSEADSLADAEERCEQLIKNKIQLEAKIKEVTERAEEEEEINAELTAKKRKLEDECSELKKDIDDLELTLAKVEKEKHATENKVKNLTEEMAGLDETIAKLSKEKKALQETHQQTLDDLQAEEDKVNILTKAKTKLEQQVDDLEGSLEQEKKLRMDLERAKRKLEGDLKLAQESTMDMENDKQQLDEKLEKKEFEISNLISKIEDEQAVEIQLQKKIKELQARIEELGEEIEAERASRAKAEKQRSDLSRELEEISERLEEAGGATSAQVELNKKREAEFQKLRRDLEEATLQHEAMVAALRKKHADSMAELGEQIDNLQRVKQKLEKEKSELKMETDDLSSNAEAISKAKGNLEKMCRSLEDQVSELKTKEEEQQRLINDLTAQRARLQTEAGEYSRQLDEKDALVSQLSRSKQASTQQIEELKHQLEEETKAKNALAHALQSSRHDCDLLREQYEEEQEGKAELQRALSKANSEVAQWRTKYETDAIQRTEELEEAKKKLAQRLQEAEEHVEAVNAKCASLEKTKQRLQNEVEDLMLDVERSNAACAALDKKQRNFDKVLSEWKQKYEETQAELEASQKESRSLSTELFKVKNVYEESLDQLETLRRENKNLQQEISDLTEQIAEGGKQIHELEKIKKQVEQEKCEIQAALEEAEASLEHEEGKILRIQLELNQVKSEVDRKIAEKDEEIDQLKRNHTRVVETMQSTLDAEIRSRNDALRVKKKMEGDLNEMEIQLNHANRLAAESLRNYRNTQGILKETQLHLDDALRGQEDLKEQLAIVERRANLLQAEIEELWATLEQTERSRKIAEQELLDASERVQLLHTQNTSLINTKKKLENDVSQLQSEVEEVIQESRNAEEKAKKAITDAAMMAEELKKEQDTSAHLERMKKNLEQTVKDLQHRLDEAEQLALKGGKKQIQKLEARVRELEGEVENEQKRNAEAVKGLRKHERRVKELTYQTEEDRKNVLRLQDLVDKLQAKVKSYKRQAEEAEGTIPMPNLILNFRKTSKHGAWEVVPLVTWF

SEQ ID NO: 887183 - protein, 91 aa, Homo sapiens
AMSASSDAEMAVFGEAAPYLRKSEKERIEAQNKPFDAKTSVFVAEPKESYVKSTIQSKEGGKVTVKTEGGAVSENREKILPILFLGSKVEA

SEQ ID NO: 887184 - protein, 184 aa, Homo sapiens
MKPDETPMFDPSLLKEVDWSQNTATFSPAISPTHPGEGLVLRPLCTADLNRGFFKVLGQLTETGVVSPEQFMKSFEHMKKSGDYYVTVVEDVTLGQIVATATLIIEHKFIHSCAKRGRVEDVVVSDECRGKQLGKLLLSTLTLLSKKLNCYKITLECLPQNVGFYKKFGYTVSEENYMCRRFLK

SEQ ID NO: 887185 - protein, 270 aa, Homo sapiens
PGRVAPWPPPPLACARPCVRGQRRGGGVGAATSGPRFPTVARAVEEEVGLALKPDPDPVLCTLVGESPTRLARSADRRASTDLTRKMKPDETPMFDPSLLKEVDWSQNTATFSPAISPTHPGEGLVLRPLCTADLNRGFFKVLGQLTETGVVSPEQFMKSFEHMKKSGDYYVTVVEDVTLGQIVATATLIIEHKFIHSCAKRGRVEDVVVSDECRGKQLGKLLLSTLTLLSKKLNCYKITLECLPQNVGFYKKFGYTVSEENYMCRRFLK

SEQ ID NO: 887186 - protein, 270 aa, Homo sapiens; identical to SEQ ID NO: 887185

SEQ ID NO: 887187 - protein, 270 aa, Homo sapiens; identical to SEQ ID NO: 887185

SEQ ID NO: 887188 - protein, 270 aa, Homo sapiens; identical to SEQ ID NO: 887185

SEQ ID NO: 887189 - protein, 207 aa, Homo sapiens
PGRVAPWPPPPLACARPCVRGQRRGGGVGAATSGPRFPTVARAVEEEVGLALKPDPDPVLCTLVGESPTRLARSADRRASTDLTRKMKPDETPMFDPSLLKEVDWSQNTATFSPAISPTHPGEGLVLRPLCTADLNRGFFKVLGQLTETGVVSPEQFMKSFEHMKKSGDYYVTVVEDVTLGQIVATATLIIEHKFIHSCAKVCAAYK

SEQ ID NO: 887190 - protein, 227 aa, Homo sapiens
PGRVAPWPPPPLACARPCVRGQRRGGGVGAATSGPRFPTVARAVEEEVGLALKPDPDPVLCTLVGESPTRLARSADRRASTDLTRKMKPDETPMFDPSLLKEVDWSQNTATFSPAISPTHPGEGLVLRPLCTADLNRGFFKVLGQLTETGVVSPEQFMKSFEHMKKSGDYYVTVVEDVTLGQIVATATLIIEHKFIHSCAKYTAGIIMQCLRCARPAGGGGGWWGGG

SEQ ID NO: 887191 - protein, 270 aa, Homo sapiens; identical to SEQ ID NO: 887185

SEQ ID NO: 887192 - protein, 270 aa, Homo sapiens; identical to SEQ ID NO: 887185

SEQ ID NO: 887193 - protein, 270 aa, Homo sapiens; identical to SEQ ID NO: 887185

SEQ ID NO: 887194 - protein, 115 aa, Homo sapiens
MRATAPGPHFLKRHCPTPSPRLESSGVIIAHCILQFLGSSHPSCLSLPSSWNYRCVPSHLALHFSVGSYYIAQAGLKLLSSSDPLPQPPEYLGLHMSATVSGRSHLWPLFACEKV

SEQ ID NO: 887195 - protein, 270 aa, Homo sapiens; identical to SEQ ID NO: 887185

SEQ ID NO: 887196 - protein, 546 aa, Homo sapiens
MGSRNSSSAGSGSGDPSEGLPRRGAGLRRSEEEEEEDEDVDLAQVLAYLLRRGQVRLVQGGGAANLQFIQALLDSEEENDRAWDGRLGDRYNPPVDATPDTRELEFNEIKTQVELATGQLGLRRAAQKHSFPRMLHQRERGLCHRGSFSLGEQSRVISHFLPNDLGFTDSYSQKAFCGIYSKDGQIFMSACQDQTIRLYDCRYGRFRKFKSIKARDVGWSVLDVAFTPDGNHFLYSSWSDYIHICNIYGEGDTHTALDLRPDERRFAVFSIAVSSDGREVLGGANDGCLYVFDREQNRRTLQIESHEDDVNAVAFADISSQILFSGGDDAICKVWDRRTMREDDPKPVGALAGHQDGITFIDSKGDARYLISNSKDQTIKLWDIRRFSSREGMEASRQAATQQNWDYRWQQVPKKAWRKLKLPGDSSLMTYRGHGVLHTLIRCRFSPIHSTGQQFIYSGCSTGKVVVYDLLSGHIVKKLTNHKACVRDVSWHPFEEKIVSSSWDGNLRLWQYRQAEYFQDDMPESEECASAPAPVPQSSTPFSSPQ

SEQ ID NO: 887197 - protein, 546 aa, Homo sapiens; identical to SEQ ID NO: 887196

SEQ ID NO: 887198 - protein, 546 aa, Homo sapiens; identical to SEQ ID NO: 887196

SEQ ID NO: 887199 - protein, 546 aa, Homo sapiens; identical to SEQ ID NO: 887196

SEQ ID NO: 887200 - protein, 500 aa, Homo sapiens
MWIWPRGQVRLVQGGGAANLQFIQALLDSEEENDRAWDGRLGDRYNPPVDATPDTRELEFNEIKTQVELATGQLGLRRAAQKHSFPRMLHQRERGLCHRGSFSLGEQSRVISHFLPNDLGFTDSYSQKAFCGIYSKDGQIFMSACQDQTIRLYDCRYGRFRKFKSIKARDVGWSVLDVAFTPDGNHFLYSSWSDYIHICNIYGEGDTHTALDLRPDERRFAVFSIAVSSDGREVLGGANDGCLYVFDREQNRRTLQIESHEDDVNAVAFADISSQILFSGGDDAICKVWDRRTMREDDPKPVGALAGHQDGITFIDSKGDARYLISNSKDQTIKLWDIRRFSSREGMEASRQAATQQNWDYRWQQVPKKAWRKLKLPGDSSLMTYRGHGVLHTLIRCRFSPIHSTGQQFIYSGCSTGKVVVYDLLSGHIVKKLTNHKACVRDVSWHPFEEKIVSSSWDGNLRLWQYRQAEYFQDDMPESEECASAPAPVPQSSTPFSSPQ

SEQ ID NO: 887201 - protein, 413 aa, Homo sapiens
MLHQRERGLCHRGSFSLGEQSRVISHFLPNDLGFTDSYSQKAFCGIYSKDGQIFMSACQDQTIRLYDCRYGRFRKFKSIKARDVGWSVLDVAFTPDGNHFLYSSWSDYIHICNIYGEGDTHTALDLRPDERRFAVFSIAVSSDGREVLGGANDGCLYVFDREQNRRTLQIESHEDDVNAVAFADISSQILFSGGDDAICKVWDRRTMREDDPKPVGALAGHQDGITFIDSKGDARYLISNSKDQTIKLWDIRRFSSREGMEASRQAATQQNWDYRWQQVPKKAWRKLKLPGDSSLMTYRGHGVLHTLIRCRFSPIHSTGQQFIYSGCSTGKVVVYDLLSGHIVKKLTNHKACVRDVSWHPFEEKIVSSSWDGNLRLWQYRQAEYFQDDMPESEECASAPAPVPQSSTPFSSPQ

SEQ ID NO: 887202 - protein, 546 aa, Homo sapiens; identical to SEQ ID NO: 887196

SEQ ID NO: 887203 - protein, 359 aa, Homo sapiens
MSACQDQTIRLYDCRYGRFRKFKSIKARDVGWSVLDVAFTPDGNHFLYSSWSDYIHICNIYGEGDTHTALDLRPDERRFAVFSIAVSSDGREVLGGANDGCLYVFDREQNRRTLQIESHEDDVNAVAFADISSQILFSGGDDAICKVWDRRTMREDDPKPVGALAGHQDGITFIDSKGDARYLISNSKDQTIKLWDIRRFSSREGMEASRQAATQQNWDYRWQQVPKKAWRKLKLPGDSSLMTYRGHGVLHTLIRCRFSPIHSTGQQFIYSGCSTGKVVVYDLLSGHIVKKLTNHKACVRDVSWHPFEEKIVSSSWDGNLRLWQYRQAEYFQDDMPESEECASAPAPVPQSSTPFSSPQ

SEQ ID NO: 887204 - protein, 525 aa, Homo sapiens [sequence omitted]

SEQ ID NO: 887205 - protein, 455 aa, Homo sapiens
MGSRNSSSAGSGSGDPSEGLPRRGAGLRRSEEEEEEDEDVDLAQVLAYLLRRGQVRLVQGGGAANLQFIQALLDSEEENDRAWDGRLGDRYNPPVDATPDTRELEFNEIKTQVELATGQLGLRRAAQKHSFPRMLHQRERGLCHRGSFSLGEQSRVISHFLPNDLGFTDSYSQKAFCGIYSKDGQIFMSACQDQTIRLYDCRYGRFRKFKSIKARDVGWSVLDVAFTPDGNHFLYSSWSDYIHICNIYGEGDTHTALDLRPDERRFAVFSIAVSSDGREVLGGANDGCLYVFDREQNRRTLQIESHEDDVNAVAFADISSQILFSGGDDAICKVWDRRTMREDDPKPVGALAGHQDGITFIDSKGDARYLISNSKDQTIKLWDIRRFSSREGMEASRQAATQQNWDYRWQQVPKKAGATECCTPSSAAGSPPFIALASSSSTVAAPLAKWLCTTF

SEQ ID NO: 887206 - protein, 546 aa, Homo sapiens; identical to SEQ ID NO: 887196

SEQ ID NO: 887207 - protein, 277 aa, Homo sapiens
PGLQEFGTWKYYDGANDGCLYVFDREQNRRTLQIESHEDDVNAVAFADISSQILFSGGDDAICKVWDRRTMREDDPKPVGALAGHQDGITFIDSKGDARYLISNSKDQTIKLWDIRRFSSREGMEASRQAATQQNWDYRWQQVPKKAWRKLKLPGDSSLMTYRGHGVLHTLIRCRFSPIHSTGQQFIYSGCSTGKVVVYDLLSGHIVKKLTNHKACVRDVSWHPFEEKIVSSSWDGNLRLWQYRQAEYFQDDMPESEECASAPAPVPQSSTPFSSPQ

SEQ ID NO: 887208 - protein, 546 aa, Homo sapiens; identical to SEQ ID NO: 887196

SEQ ID NO: 887209 - protein, 457 aa, Homo sapiens
MGSRNSSSAGSGSGDPSEGLPRRGAGLRRSEEEEEEDEDVDLAQVLAYLLRRGQVRLVQGGGAANLQFIQALLDSEEENDRAWDGRLGDRYNPPVDATPDTRELEFNEIKTQVELATGQLGLRRAAQKHSFPRMLHQRERGLCHRGSFSLGEQSRVISHFLPNDLGFTDSYSQKAFCGIYSKDGQIFMSACQDQTIRLYDCRYGRFRKFKSIKARDVGWSVLDVAFTPDGNHFLYSSWSDYIHICNIYGEGDTHTALDLRPDERRFAVFSIAVSSDGREVLGGANDGCLYVFDREQNRRTLQIESHEDDVNAVAFADISSQILFSGGDDAICKVWDRRTMREDDPKPVGALAGHQDGITFIDSKGDARYLISNSKDQTIKLWDIRRFSSREGMEASRQAATQQNWDYRWQQVPKKAWRKLKLPGDSSLMTYCQPGLPGLHVEDSTGQSQDRCPGLSS

SEQ ID NO: 887210 - protein, 488 aa, Homo sapiens [sequence omitted]

SEQ ID NO: 887211 - protein, 472 aa, Homo sapiens
MGSRNSSSAGSGSGDPSEGLPRRGAGLRRSEEEEEEDEDVDLAQVLAYLLRRGQVRLVQGGGAANLQFIQALLDSEEENDRAWDGRLGDRYNPPVDATPDTRELEFNEIKTQVELATGQLGLRRAAQKHSFPRMLHQRERGLCHRGSFSLGEQSRVISHFLPNDLGFTDSYSQKAFCGIYSKDGQIFMSACQDQTIRLYDCRYGRFRKFKSIKARDVGWSVLDVAFTPDGNHFLYSSWSDYIHICNIYGEGDTHTALDLRPDERRFAVFSIAVSSDGREVLGGANDGCLYVFDREQNRRTLQIESHEDDVNAVAFADISSQILFSGGDDAICKVWDRRTMREDDPKPVGALAGHQDGITFIDSKVGQKSGLYSQAAKVLVAQEGMKADWCGNLTSSLLTKVCKSWSLGKGLKPGNMNSICTHQSSRSRAGLSVQEKWKTGQVQRLTPVILALWEAEVGGSLELRRSRPACET

SEQ ID NO: 887212 - protein, 283 aa, Homo sapiens
MGSRNSSSAGSGSGDPSEGLPRRGAGLRRSEEEEEEDEDVDLAQVLAYLLRRGQVRLVQGGGAANLQFIQALLDSEEENDRAWDGRLGDRYNPPVDATPDTRELEFNEIKTQVELATGQLGLRRAAQKHSFPRMLHQRERGLCHRGSFSLGEQSRVISHFLPNDLGFTDSYSQKAFCGIYSKDGQIFMSACQDQTIRLYDCRYGRFRKFKSIKARDVGWSVLDVAFTPDGNHFLYSSWSDYIHICNIYGEGDTHTALDLRPDERRFAVFSIAVSSDGREVLGG

SEQ ID NO: 887213 - protein, 159 aa, Homo sapiens
MGSRNSSSAGSGSGDPSEGLPRRGAGLRRSEEEEEEDEDVDLAQVLAYLLRRGQVRLVQGGGAANLQFIQALLDSEEENDRAWDGRLGDRYNPPVDATPDTRELEFNEIKTQVELATGQLGLRRAAQKHSFPRMLHQRERGLCHRGSFSLGEQSRVISQ

SEQ ID NO: 887214 - protein, 208 aa, Homo sapiens
MGSRNSSSAGSGSGDPSEGLPRRGAGLRRSEEEEEEDEDVDLAQVLAYLLRRGQVRLVQGGGAANLQFIQALLDSEEENDRAWDGRLGDRYNPPVDATPDTRELEFNEIKTQVELATGQLGLRRAAQKHSFPRMLHQRERGLCHRGSFSLGEQSRVISHFLPNDLGFTDSYSQKAFCGIYSKDGQIFMSACQEQNPIFRRRRRIQAQR

SEQ ID NO: 887215 - protein, 228 aa, Homo sapiens
MWIWPRGQVRLVQGGGAANLQFIQALLDSEEENDRAWDGRLGDRYNPPVDATPDTRELEFNEIKTQVELATGQLGLRRAAQKHSFPRMLHQRERGLCHRGSFSLGEQSRVISHFLPNDLGFTDSYSQKAFCGIYSKDGQIFMSACQEPKIDLYMRNRRSIIQSLRPEVANVGFAYPREPPTPSGICCIRGGPPPLQNAGSVLRKKARFSTPNSKGVPGTGHARPAPQP

SEQ ID NO: 887216 - protein, 546 aa, Homo sapiens; identical to SEQ ID NO: 887196

SEQ ID NO: 887217 - protein, 546 aa, Homo sapiens; identical to SEQ ID NO: 887196

SEQ ID NO: 887218 - protein, 413 aa, Homo sapiens; identical to SEQ ID NO: 887201

SEQ ID NO: 887219 - protein, 500 aa, Homo sapiens; identical to SEQ ID NO: 887200

SEQ ID NO: 887220 - protein, 546 aa, Homo sapiens; identical to SEQ ID NO: 887196

SEQ ID NO: 887221 - protein, 125 aa, Homo sapiens
GDCPLTIRWRKSHHLKIGKAFVSGHRTLLRTGGTKQSQSRFPNLGFTLHPYPAWRKLKLPGDSSLMTYRGHGVLHTLIRCRFSPIHSTGQQFIYSGCSTGKVVGKDCVRTGGLRKGRNDSLPFHL

SEQ ID NO: 887222 - protein, 73 aa, Homo sapiens
AVTSPTGRLERARRADGTCSLFRLSPGRVMWLRHRRPRYVCHFQFSESIDCNLAAYMYLCLYSILGTQPPGQK

SEQ ID NO: 887223 - protein, 336 aa, Homo sapiens
MSFFGFGQSVEVEILLNDAESRKRAEHKTEDGKKEKYFLFYDGETVSGKVSLALKNPNKRLEHQGIKIEFIGQIELYYDRGNHHEFVSLVKDLARPGEITQSQAFDFEFTHVEKPYESYTGQNVKLRYFLRATISRRLNDVVKEMDIVVHTLSTYPELNSSIKMEVGIEDCLHIEFEYNKSKYHLKDVIVGKIYFLLVRIKIKHMEIDIIKRETTGTGPNVYHENDTIAKYEIMDGAPVRGESIPIRLFLAGYELTPTMRDINKKFSVRYYLNLVLIDEEERRYFKQQEVVLWRKGDIVRKSMSHQAAIASQRFEGTTSLGEVRTPSQLSDNNCRQ

SEQ ID NO: 887224 - protein, 472 aa, Homo sapiens
MSFFGFGQSVEVEILLNDAESRKRAEHKTEDGKKEKYFLFYDGETVSGKVSLALKNPNKRLEHQGIKIEFIGQIELYYDRGNHHEFVSLVKDLARPGEITQSQAFDFEFTHVEKPYESYTGQNVKLRGFVFKRLYGRKKGVETSIAVPQKIKTELPYDLAIPLLDPEADPKEWKTGSRTDICTPIFTAALFAITKRKKQPKCPSVGKWTQEMCFVRTVDCYTAFKRKDILSYATTWVNLKDIVLRERSLSQKDKYCLIPYDMSYFLRATISRRLNDVVKEMDIVVHTLSTYPELNSSIKMEVGIEDCLHIEFEYNKSKYHLKDVIVGKIYFLLVRIKIKHMEIDIIKRETTGTGPNVYHENDTIAKYEIMDGAPVRGESIPIRLFLAGYELTPTMRDINKKFSVRYYLNLVLIDEEERRYFKQQEVVLWRKGDIVRKSMSHQAAIASQRFEGTTSLGEVRTPSQLSDNNCRQ

SEQ ID NO: 887225 - protein, 129 aa, Homo sapiens
MHSSGISAVVRVTWYKGEGITLPPVLTPGPPPTGESIPIRLFLAGYELTPTMRDINKKFSVRYYLNLVLIDEEERRYFKQQEVVLWRKGDIVRKSMSHQAAIASQRFEGTTSLGEVRTPSQLSDNNCRQ

SEQ ID NO: 887226 - protein, 104 aa, Homo sapiens
YIEDAHLRGESIPIRLFLAGYELTPTMRDINKKFSVRYYLNLVLIDEEERRYFKQQEVVLWRKGDIVRKSMSHQAAIASQRFEGTTSLGEVRTPSQLSDNNCRQ

SEQ ID NO: 887227 - protein, 336 aa, Homo sapiens; identical to SEQ ID NO: 887223

SEQ ID NO: 887228 - protein, 336 aa, Homo sapiens; identical to SEQ ID NO: 887223

SEQ ID NO: 887229 - protein, 229 aa, Homo sapiens
MSFFGFGQSVEVEILLNDAESRKRAEHKTEDGKKEKYFLFYDGETVSGKVSLALKNPNKRLEHQGIKIEFIGQIELYYDRGNHHEFVSLVKDLARPGEITQSQAFDFEFTHVEKPYESYTGQNVKLRYFLRATISRRLNDVVKEMDIVVHTLSTYPELNSSIKMEVGIEDCLHIEFEYNKSNFSCFPLLLRTISEYHSIIMCSLHLCLQKSKRRNQILAMICCFLPELK

SEQ ID NO: 887230 - protein, 88 aa, Homo sapiens
MSFFGFGQSVEVEILLNDAESRKRAEHKTEDGKKEKYFLFYDGETVSGKVSLALKNPNKRLEHQGIKIEFIGQIGESTPGTPSPSADS

SEQ ID NO: 887231 - protein, 479 aa, Homo sapiens
EHAGSASVRCTAGGWAARSAARRWTPPGRRRPPTPGSVRLPPAALHGRPSPAHCHRPRDWLGLARPRALLLGALLLGRRSPQPPASPGRAPPPWSRLSVGAHCPAAAAEPGSPAAAERARASGPLAFFKGKKKGKKRELKKERKGGAKKLLGLGKKVEVEKIIKEKKKRDEKKKEEGKKKKILEKGETVSGKVSLALKNPNKRLEHQGIKIEFIGQIELYYDRGNHHEFVSLVKDLARPGEITQSQAFDFEFTHVEKPYESYTGQNVKLRYFLRATISRRLNDVVKEMDIVVHTLSTYPELNSSIKMEVGIEDCLHIEFEYNKSKYHLKDVIVGKIYFLLVRIKIKHMEIDIIKRETTGTGPNVYHENDTIAKYEIMDGAPVRGESIPIRLFLAGYELTPTMRDINKKFSVRYYLNLVLIDEEERRYFKQQEVVLWRKGDIVRKSMSHQAAIASQRFEGTTSLGEVRTPSQLSDNNCRQ

SEQ ID NO: 887232 - protein, 336 aa, Homo sapiens; identical to SEQ ID NO: 887223

SEQ ID NO: 887233 - protein, 77 aa, Homo sapiens
YPARKSRIGMDSPPLVLIDEEERRYFKQQEVVLWRKGDIVRKSMSHQAAIASQRFEGTTSLGEVRTPSQLSDNNCRQ

SEQ ID NO: 887234 - protein, 336 aa, Homo sapiens; identical to SEQ ID NO: 887223

SEQ ID NO: 887235 - protein, 127 aa, Homo sapiens
MSFFGFGQSVEVEILLNDAESRKRAEHKTEDGKKEKYFLFYDGETVSGKVSLALKNPNKRLEHQGIKIEFIGQIELYYDRGNHHEFVSLVKDLARPGEITQSQAFDFEFTHVEKPYESYTGQNVKLR

SEQ ID NO: 887236 - protein, 1290 aa, Homo sapiens
MEKYHVLEMIGEGSFGRVYKGRRKYSAQVVALKFIPKLGRSEKELRNLQREIEIMRGLRHPNIVHMLDSFETDKEVVVVTDYAEGELFQILEDDGKLPEDQVQAIAAQLVSALYYLHSHRILHRDMKPQNILLAKGGGIKLCDFGFARAMSTNTMVLTSIKGTPLYMSPELVEERPYDHTADLWSVGCILYELAVGTPPFYATSIFQLVSLILKDPVRWPSTISPCFKNFLQGLLTKDPRQRLSWPDLLYHPFIAGHVTIITEPAGPDLGTPFTSRLPPELQVLKDEQAHRLAPKGNQSRILTQAYKRMAEEAMQKKHQNTGPALEQEDKTSKVAPGTAPLPRLGATPQESSLLAGILASELKSSWAKSGTGEVPSAPRENRTTPDCERAFPEERPEVLGQRSTDVVDLENEEPDSDNEWQHLLETTEPVPIQLKAPLTLLCNPDFCQRIQSQLHEAGGQILKGILEGASHILPAFRVLSSLLSSCSDSVALYSFCREAGLPGLLLSLLRHSQESNSLQQQSWYGTFLQDLMAVIQAYFACTFNLERSQTSDSLQVFQEAANLFLDLLGKLLAQPDDSEQTLRRDSLMCFTVLCEAMDGNSRAISKAFYSSLLTTQQVVLDGLLHGLTVPQLPVHTPQGAPQVSQPLREQSEDIPGAISSALAAICTAPVGLPDCWDAKEQVCWHLANQLTEDSSQLRPSLISGLQHPILCLHLLKVLYSCCLVSEGLCRLLGQEPLALESLFMLIQGKVKVVDWEESTEVTLYFLSLLVFRLQNLPCGMEKLGSDVATLFTHSHVVSLVSAAACLLGQLGQQGVTFDLQPMEWMAAATHALSAPAEQGKASLIRDMSSSEMWTVLWHRFSMVLRLPEEASAQEGELSLSSPPSPEPDWTLISPQGMAALLSLAMATFTQEPQLCLSCLSQHGSILMSILKHLLCPSFLNQLRQAPHGSEFLPVVVLSVCQLLCFPFALDMDADLLIGVLADLRDSEVAAHLLQVCCYHLPLMQVELPISLLTRLALMDPTSLNQFVNTVSASPRTIVSFLSVALLSDQPLLTSDLLSLLAHTARVLSPSHLSFIQELLAGSDESYRPLRSLLGHPENSVRAHTYRLLGHLLQHSMALRGALQSQSGLLSLLLLGLGDKDPVVRCSASFAVGNAAYQAGPLGPALAAAVPSMTQLLGDPQAGIRRNVASALGNLGPEGLGEELLQCEVPQRLLEMACGDPQPNVKEAALIALRSLQQEPGIHQVLVSLGASEKLSLLSLGNQSLPHSSPRPASAKHCRKLIHLLRPAHSM

SEQ ID NO: 887237 - protein, 137 aa, Homo sapiens
HGFLIQLHLFSGDHHLYCIPSFRIIHPLVAIDSNLGSNGLVNTSTSPTTALSIMNSFGWHTTVATPPIIIQGLTTVCPPVTAVPPSLSTPGSGERMTDGIFFLSVELPAGTAHQRPTAATVLARPLISPLYCWSCHQ

SEQ ID NO: 887238 - protein, 1315 aa, Homo sapiens
MEKYHVLEMIGEGSFGRVYKGRRKYSAQVVALKFIPKLGRSEKELRNLQREIEIMRGLRHPNIVHMLDSFETDKEVVVVTDYAEGELFQILEDDGKLPEDQVQAIAAQLVSALYYLHSHRILHRDMKPQNILLAKGGGIKLCDFGFARAMSTNTMVLTSIKGTPLYMSPELVEERPYDHTADLWSVGCILYELAVGTPPFYATSIFQLVSLILKDPVRWPSTISPCFKNFLQGLLTKDPRQRLSWPDLLYHPFIAGHVTIITEPAGPDLGTPFTSRLPPELQVLKDEQAHRLAPKGNQSRILTQAYKRMAEEAMQKKHQNTGPALEQEDKTSKVAPGTAPLPRLGATPQESSLLAGILASELKSSWAKSGTGEVPSAPRENRTTPDCERAFPEERPEVLGQRSTDVVDLENEEPDSDNEWQHLLETTEPVPIQLKAPLTLLCNPDFCQRIQSQLHEAGGQILKGILEGASHILPAFRVLSSLLSSCSDSVALYSFCREAGLPGLLLSLLRHSQESNSLQQQSWYGTFLQDLMAVIQAYFACTFNLERSQTSDSLQVFQEAANLFLDLLGKLLAQPDDSEQTLRRDSLMCFTVLCEAMDGNSRAISKAFYSSLLTTQQVVLDGLLHGLTVPQLPVHTPQGAPQVSQPLREQSEDIPGAISSALAAICTAPVGLPDCWDAKEQVCWHLANQLTEDSSQLRPSLISGLQHPILCLHLLKVLYSCCLVSEGLCRLLGQEPLALESLFMLIQGKVKVVDWEESTEVTLYFLSLLVFRLQNLPCGMEKLGSDVATLFTHSHVVSLVSAAACLLGQLGQQGVTFDLQPMEWMAAATHALSAPAEVRLTPPGSCGFYDGLLILLLQLLTEQGKASLIRDMSSSEMWTVLWHRFSMVLRLPEEASAQEGELSLSSPPSPEPDWTLISPQGMAALLSLAMATFTQEPQLCLSCLSQHGSILMSILKHLLCPSFLNQLRQAPHGSEFLPVVVLSVCQLLCFPFALDMDADLLIGVLADLRDSEVAAHLLQVCCYHLPLMQVELPISLLTRLALMDPTSLNQFVNTVSASPRTIVSFLSVALLSDQPLLTSDLLSLLAHTARVLSPSHLSFIQELLAGSDESYRPLRSLLGHPENSVRAHTYRLLGHLLQHSMALRGALQSQSGLLSLLLLGLGDKDPVVRCSASFAVGNAAYQAGPLGPALAAAVPSMTQLLGDPQAGIRRNVASALGNLGPEGLGEELLQCEVPQRLLEMACGDPQPNVKEAALIALRSLQQEPGIHQVLVSLGASEKLSLLSLGNQSLPHSSPRPASAKHCRKLIHLLRPAHSM

SEQ ID NO: 887239 - protein, 1315 aa, Homo sapiens; identical to SEQ ID NO: 887238

SEQ ID NO: 887240 - protein, 1299 aa, Homo sapiens
MEKYHVLEMIGEGSFGRVYKGRRKYSAQVVALKFIPKLGRSEKELRNLQREIEIMRGLRHPNIVHMLDSFETDKEVVVVTDYAEGELFQILEDDGKLPEDQVQAIAAQLVSALYYLHSHRILHRDMKPQNILLAKGGGIKLCDFGFARAMSTNTMVLTSIKGTPLYMSPELVEERPYDHTADLWSVGCILYELAVGTPPFYATSIFQLVSLILKDPVRWPSTISPCFKNFLQGLLTKDPRQRLSWPDLLYHPFIAGHVTIITEPAGPDLGTPFTSRLPPELQVLKDEQAHRLAPKGNQSRILTQAYKRMAEEAMQKKHQNTGPALEQEDKTSKVAPGTAPLPRLGATPQESSLLAGILASELKSSWAKSGTGEVPSAPRENRTTPDCERAFPEERPEVLGQRSTDVVDLENEEPDSDNEWQHLLETTEPVPIQLKAPLTLLCNPDFCQRIQSQLHEAGGQILKGILEGASHILPAFRVLSSLLSSCSDSVALYSFCREAGLPGLLLSLLRHSQESNSLQQQSWYGTFLQDLMAVIQAYFACTFNLERSQTSDSLQVFQEAANLFLDLLGKLLAQPDDSEQTLRRDSLMCFTVLCEAMDGNSRAISKAFYSSLLTTQQVVLDGLLHGLTVPQLPVHTPQGAPQVSQPLREQSEDIPGAISSALAAICTAPVGLPDCWDAKEQVCWHLANQLTEDSSQLRPSLISGLQHPILCLHLLKVLYSCCLVSEGLCRLLGQEPLALESLFMLIQGKVKVVDWEESTEVTLYFLSLLVFRLQNLPCGMEKLGSDVATLFTHSHVVSLVSAAACLLGQLGQQGVTFDLQPMEWMAAATHALSAPAEVRLTPPGSCGFYDGLLILLLQLLTEQGKASLIRDMSSSEMWTVLWHRFSMVLRLPEEASAQEGELSLSSPPSPEPDWTLISPQGMAALLSLAMATFTQEPQLCLSCLSQHGSILMSILKHLLCPSFLNQLLPGLLCFPFALDMDADLLIGVLADLRDSEVAAHLLQVCCYHLPLMQVELPISLLTRLALMDPTSLNQFVNTVSASPRTIVSFLSVALLSDQPLLTSDLLSLLAHTARVLSPSHLSFIQELLAGSDESYRPLRSLLGHPENSVRAHTYRLLGHLLQHSMALRGALQSQSGLLSLLLLGLGDKDPVVRCSASFAVGNAAYQAGPLGPALAAAVPSMTQLLGDPQAGIRRNVASALGNLGPEGLGEELLQCEVPQRLLEMACGDPQPNVKEAALIALRSLQQEPGIHQVLVSLGASEKLSLLSLGNQSLPHSSPRPASAKHCRKLIHLLRPAHSM

SEQ ID NO: 887241 - protein, 1188 aa, Homo sapiens
TGTEGLGEELLQCEVPQRLLEMACGDPQPNVKEAALIALRSLQQELTSIKGTPLYMSPELVEERPYDHTADLWSVGCILYELAVGTPPFYATSIFQLVSLILKDPVRWPSTISPCFKNFLQGLLTKDPRQRLSWPDLLYHPFIAGHVTIITEPAGPDLGTPFTSRLPPELQVLKDEQAHRLAPKGNQSRILTQAYKRMAEEAMQKKHQNTGPALEQEDKTSKVAPGTAPLPRLGATPQESSLLAGILASELKSSWAKSGTGEVPSAPRENRTTPDCERAFPEERPEVLGQRSTDVVDLENEEPDSDNEWQHLLETTEPVPIQLKAPLTLLCNPDFCQRIQSQLHEAGGQILKGILEGASHILPAFRVLSSLLSSCSDSVALYSFCREAGLPGLLLSLLRHSQESNSLQQQSWYGTFLQDLMAVIQAYFACTFNLERSQTSDSLQVFQEAANLFLDLLGKLLAQPDDSEQTLRRDSLMCFTVLCEAMDGNSRAISKAFYSSLLTTQQVVLDGLLHGLTVPQLPVHTPQGAPQVSQPLREQSEDIPGAISSALAAICTAPVGLPDCWDAKEQVCWHLANQLTEDSSQLRPSLISGLQHPILCLHLLKVLYSCCLVSEGLCRLLGQEPLALESLFMLIQGKVKVVDWEESTEVTLYFLSLLVFRLQNLPCGMEKLGSDVATLFTHSHVVSLVSAAACLLGQLGQQGVTFDLQPMEWMAAATHALSAPAEVRLTPPGSCGFYDGLLILLLQLLTEQGKASLIRDMSSSEMWTVLWHRFSMVLRLPEEASAQEGELSLSSPPSPEPDWTLISPQGMAALLSLAMATFTQEPQLCLSCLSQHGSILMSILKHLLCPSFLNQLLPGLLCFPFALDMDADLLIGVLADLRDSEVAAHLLQVCCYHLPLMQVELPISLLTRLALMDPTSLNQFVNTVSASPRTIVSFLSVALLSDQPLLTSDLLSLLAHTARVLSPSHLSFIQELLAGSDESYRPLRSLLGHPENSVRAHTYRLLGHLLQHSMALRGALQSQSGLLSLLLLGLGDKDPVVRCSASFAVGNAAYQAGPLGPALAAAVPSMTQLLGDPQAGIRRNVASALGNLGPEGLGEELLQCEVPQRLLEMACGDPQPNVKEAALIALRSLQQEPGIHQVLVSLGASEKLSLLSLGNQSLPHSSPRPASAKHCRKLIHLLRPAHSM

SEQ ID NO: 887242 - protein, 1150 aa, Homo sapiens
MSTNTMVLTSIKGTPLYMSPELVEERPYDHTADLWSVGCILYELAVGTPPFYATSIFQLVSLILKDPVRWPSTISPCFKNFLQGLLTKDPRQRLSWPDLLYHPFIAGHVTIITEPAGPDLGTPFTSRLPPELQVLKDEQAHRLAPKGNQSRILTQAYKRMAEEAMQKKHQNTGPALEQEDKTSKVAPGTAPLPRLGATPQESSLLAGILASELKSSWAKSGTGEVPSAPRENRTTPDCERAFPEERPEVLGQRSTDVVDLENEEPDSDNEWQHLLETTEPVPIQLKAPLTLLCNPDFCQRIQSQLHEAGGQILKGILEGASHILPAFRVLSSLLSSCSDSVALYSFCREAGLPGLLLSLLRHSQESNSLQQQSWYGTFLQDLMAVIQAYFACTFNLERSQTSDSLQVFQEAANLFLDLLGKLLAQPDDSEQTLRRDSLMCFTVLCEAMDGNSRAISKAFYSSLLTTQQVVLDGLLHGLTVPQLPVHTPQGAPQVSQPLREQSEDIPGAISSALAAICTAPVGLPDCWDAKEQVCWHLANQLTEDSSQLRPSLISGLQHPILCLHLLKVLYSCCLVSEGLCRLLGQEPLALESLFMLIQGKVKVVDWEESTEVTLYFLSLLVFRLQNLPCGMEKLGSDVATLFTHSHVVSLVSAAACLLGQLGQQGVTFDLQPMEWMAAATHALSAPAEVRLTPPGSCGFYDGLLILLLQLLTEQGKASLIRDMSSSEMWTVLWHRFSMVLRLPEEASAQEGELSLSSPPSPEPDWTLISPQGMAALLSLAMATFTQEPQLCLSCLSQHGSILMSILKHLLCPSFLNQLLPGLLCFPFALDMDADLLIGVLADLRDSEVAAHLLQVCCYHLPLMQVELPISLLTRLALMDPTSLNQFVNTVSASPRTIVSFLSVALLSDQPLLTSDLLSLLAHTARVLSPSHLSFIQELLAGSDESYRPLRSLLGHPENSVRAHTYRLLGHLLQHSMALRGALQSQSGLLSLLLLGLGDKDPVVRCSASFAVGNAAYQAGPLGPALAAAVPSMTQLLGDPQAGIRRNVASALGNLGPEGLGEELLQCEVPQRLLEMACGDPQPNVKEAALIALRSLQQEPGIHQVLVSLGASEKLSLLSLGNQSLPHSSPRPASAKHCRKLIHLLRPAHSM

SEQ ID NO: 887243 - protein, 273 aa, Homo sapiens
MDPTSLNQFVNTVSASPRTIVSFLSVALLSDQPLLTSDLLSLLAHTARVLSPSHLSFIQELLAGSDESYRPLRSLLGHPENSVRAHTYRLLGHLLQHSMALRGALQSQSGLLSLLLLGLGDKDPVVRCSASFAVGNAAYQAGPLGPALAAAVPSMTQLLGDPQAGIRRNVASALGNLGPEGLGEELLQCEVPQRLLEMACGDPQPNVKEAALIALRSLQQEPGIHQVLVSLGASEKLSLLSLGNQSLPHSSPRPASAKHCRKLIHLLRPAHSM

SEQ ID NO: 887244 - protein, 1926 aa, Homo sapiens
LELIEKLLQNRITIVDRFLNSSNDHRFQALQDNCKKILGENAKPNYGCQVTIQSEQEKQLMKQYRREEKRIARREKKAGEDLEVSEGLMCFDPKELRIQREQALLNARSVPILSRQRDADVEKIHYPHVYDSQAEAMKTSAFIAGAKMILPEGIQRENNKLYEEVRIPYSEPMPLSFEEKPVYIQDLDEIGQLAFKGMKRLNRIQSIVFETAYNTNENMLICAPTGAGKTNIAMLTVLHEIRQHFQQGVIKKNEFKIVYVAPMKALAAEMTDYFSRRLEPLGIIVKELTGDMQLSKSEILRTQMLVTTPEKWDVVTRKSVGDVALSQIVRLLILDEVHLLHEDRGPVLESIVARTLRQVESTQSMIRILGLSATLPNYLDVATFLHVNPYIGLFFFDGRFRPVPLGQTFLGIKCANKMQQLNNMDEVCYENVLKQVKAGHQVMVFVHARNATVRTAMSLIERAKNCGHIPFFFPTQGHDYVLAEKQVQRSRNKQVRELFPDGFSIHHAGMLRQDRNLVENLFSNGHIKVLVCTATLAWGVNLPAHAVIIKGTQIYAAKRGSFVDLGILDVMQIFGRAGRPQFDKFGEGIIITTHDKLSHYLTLLTQRNPIESQFLESLADNLNAEIALGTVTNVEEAVKWISYTYLYVRMRANPLAYGISHKAYQIDPTLRKHREQLVIEVGRKLDKAQMIRFEERTGYFSSTDLGRTASHYYIKYNTIETFNELFDAHKTEGDIFAIVSKAEEFDQIKVREEEIEELDTLLSNFCELSTPGGVENSYGKINILLQTYISRGEMDSFSLISDSAYVAQNAARIVRALFEIALRKRWPTMTYRLLNLSKVIDKRLWGWASPLRQFSILPPHILTRLEEKKLTVDKLKDMRKDEIGHILHHVNIGLKVKQCVHQIPSVMMEASIQPITRTVLRVTLSIYADFTWNDQVHGTVGEPWWIWVEDPTNDHIYHSEYFLALKKQVISKEAQLLVFTIPIFEPLPSQYYIRAVSDRWLGAEAVCIINFQHLILPERHPPHTELLDLQPLPITALGCKAYEALYNFSHFNPVQTQIFHTLYHTDCNVLLGAPTGSGKTVAAELAIFRVFNKYPTSKAVYIAPLKALVRERMDDWKVRIEEKLGKKVIELTGDVTPDMKSIAKADLIVTTPEKWDGVSRSWQNRNYVQQVTILIIDEIHLLGEERGPVLEVIVSRTNFISSHTEKPVRIVGLSTALANARDLADWLNIKQMGLFNFRPSVRPVPLEVHIQGFPGQHYCPRMASMNKPAFQAIRSHSPAKPVLIFVSSRRQTRLTALELIAFLATEEDPKQWLNMDEREMENIIATVRDSNLKLTLAFGIGMHHAGLHERDRKTVEELFVNCKVQVLIATSTLAWGVNFPAHLVIIKGTEYYDGKTRRYVDFPITDVLQMMGRAGRPQFDDQGKAVILVHDIKKDFYKKFLYEPFPVESSLLGVLSDHLNAEIAGGTITSKQDALDYITWTYFFRRLIMNPSYYNLGDVSHDSVNKFLSHLIEKSLIELELSYCIEIGEDNRSIEPLTYGRIASYYYLKHQTVKMFKDRLKPECSTEELLSILSDAEEYTDLPVRHNEDHMNSELAKCLPIESNPHSFDSPHTKAHLLLQAHLSRAMLPCPDYDTDTKTVLDQALRVCQAMLDVAANQGWLVTVLNITNLIQMVIQGRWLKDSSLLTLPNIENHHLHLFKKWKPIMKGPHARGRTSIECLPELIHACGGKDHVFSSMVESELHAAKTKQAWNFLSHLPVINVGISVKGSWDDLVEGHNELSVSTLTADKRDDNKWIKLHADQEYVLQVSLQRVHFGFHKGKPESCAVTPRFPKSKDEGWFLILGEVDKRELIALKRVGYIRNHHVASLSFYTPEIPGRYIYTLYFMSDCYLGLDQQYDIYLNVTQASLSAQVNTKVSDSLTDLALK

SEQ ID NO: 887245 - protein, 1926 aa, Homo sapiens; identical to SEQ ID NO: 887244

SEQ ID NO: 887246 - protein, 326 aa, Homo sapiens
MALSGSTPAPCWEEDECLDYYGMLSLHRMFEVVGGQLTECELELLAFLLDEAPGAAGGLARARSGLELLLELERRGQCDESNLRLLGQLLRVLARHDLLPHLARKRRRPVSPERYSYGTSSSSKRTEGSCRRRRQSSSSANSQQGQWETGSPPTKRQRRSRGRPSGGARRRRRGAPAAPQQQSEPARPSSEGKVTCDIRLRVRAEYCEHGPALEQGVASRRPQALARQLDVFGQATAVLRSRDLGSVVCDIKFSELSYLDAFWGDYLSGALLQALRGVFLTEALREAVGREAVRLLVSVDEADYEAGRRRLLLMEEEGGRRPTEAS

SEQ ID NO: 887247 - protein, 326 aa, Homo sapiens; identical to SEQ ID NO: 887246

SEQ ID NO: 887248 - protein, 360 aa, Homo sapiens
AGLYAELWLRPSPRSHRTPESGRVLSLFRLPPPGMALSGSTPAPCWEEDECLDYYGMLSLHRMFEVVGGQLTECELELLAFLLDEAPGAAGGLARARSGLELLLELERRGQCDESNLRLLGQLLRVLARHDLLPHLARKRRRPVSPERYSYGTSSSSKRTEGSCRRRRQSSSSANSQQGQWETGSPPTKRQRRSRGRPSGGARRRRRGAPAAPQQQSEPARPSSEGKVTCDIRLRVRAEYCEHGPALEQGVASRRPQALARQLDVFGQATAVLRSRDLGSVVCDIKFSELSYLDAFWGDYLSGALLQALRGVFLTEALREAVGREAVRLLVSVDEADYEAGRRRLLLMEEEGGRRPTEAS

SEQ ID NO: 887249 - protein, 131 aa, Homo sapiens
MQRTRGPQGHNTRGTAATHTPWPKRGDNTRRGPLPHTHREETQNTHHRQRQDARERSTTERTPGNPDEHKQHKPRRGDRLTSTRPRPSTPPSSRGRWDTSHHSDAGNQRQIREVTDHQYEDARANIHPIRW

SEQ ID NO: 887250 - protein, 326 aa, Homo sapiens; identical to SEQ ID NO: 887246

SEQ ID NO: 887251 - protein, 326 aa, Homo sapiens; identical to SEQ ID NO: 887246

SEQ ID NO: 887252 - protein, 362 aa, Homo sapiens
MALSGSTPAPCWEEDECLDYYGMLSLHRMFEVVGGQLTECELELLAFLLDEAPGAAGGLARARSGLELLLELERRGQCDESNLRLLGQLLRVLARHDLLPHLARKRRRPVSPERYSYGTSSSSKRTEGSCRRRRQSSSSANSQQGQWETGSPPTKRQRRSRGRPSGGARRRRRGAPAAPQQQSEPARPSSEGKVTCAVQESRVAAICYLWTDHPESLQFMAGKGKGSQAGTSDIRLRVRAEYCEHGPALEQGVASRRPQALARQLDVFGQATAVLRSRDLGSVVCDIKFSELSYLDAFWGDYLSGALLQALRGVFLTEALREAVGREAVRLLVSVDEADYEAGRRRLLLMEEEGGRRPTEAS

SEQ ID NO: 887253 - protein, 131 aa, Homo sapiens; identical to SEQ ID NO: 887249

SEQ ID NO: 887254 - protein, 326 aa, Homo sapiens; identical to SEQ ID NO: 887246

SEQ ID NO: 887255 - protein, 326 aa, Homo sapiens; identical to SEQ ID NO: 887246

SEQ ID NO: 887256 - protein, 326 aa, Homo sapiens
MALSGSTPAPCWEEDECLDYYGMLSLHRMFEVVGGQLTECELELLAFLLDEAPGAAGGLARARSGLELLLELERRGQCDESNLRLLGQLLRVLARHDLLPHLARKRRRPVSPERYSYGTSSSSKRTEGSCRRRRQSSSSANSQQGQWETGSPPTKRQRRSRGRPSGGARRRRRGAPAAPQQQSEPARPSSEGKVTCDIRLRVRAEYCEHGPALEQGVASRRPQALARQLDVFGQATAVLRSRDLGSVVCDIKFSELSYLDAFWGDYLSGALLQALRGVFLTEALREAVGREAVRLLVSVDEADYEAGRRRLLLMREGRHRALSDCR

SEQ ID NO: 887257 - protein, 167 aa, Homo sapiens
MALSGSTPAPCWEEDECLDYYGMLSLHRMFEVVGGQLTECELELLAFLLDEAPGAAGGLARARSGLELLLELERRGQCDESNLRLLGQLLRVLARHDLLPHLARKRRRPVSPERYSYGTSSSSKRTEGSCRRRRQSSSLRSSLGLCPGLLPSTHFFGLRASLSGPLI

SEQ ID NO: 887258 - protein, 249 aa, Homo sapiens
MALSGSTPAPCWEEDECLDYYGMLSLHRMFEVVGGQLTECELELLAFLLDEAPGAAGGLARARSGLELLLELERRGQCDESNLRLLGQLLRVLARHDLLPHLARKRRRPVSPERYSYGTSSSSKRTEGSCRRRRQSSSSANSQQGQWETGSPPTKRQRRSRGRPSGGARRRRRGAPAAPQQQSEPARPSSEGKVTCAQPTWASATSVGTGAGVHMGPAHLAHTSPASQGPAQLQFTDLTLLTFPPAVQS

SEQ ID NO: 887259 - protein, 211 aa, Homo sapiens
MALSGSTPAPCWEEDECLDYYGMLSLHRMFEVVGGQLTECELELLAFLLDEAPGAAGGLARARSGLELLLELERRGQCDESNLRLLGQLLRVLARHDLLPHLARKRRRPVSPERYSYGTSSSSKRTEGSCRRRRQSSSSANSQQGQWETGSPPTKRQRRSRGRPSGGARRRRRGVHMGPAHLAHTSPASQGPAQLQFTDLTLLTFPPAVQS

SEQ ID NO: 887260 - protein, 216 aa, Homo sapiens
MALSGSTPAPCWEEDECLDYYGMLSLHRMFEVVGGQLTECELELLAFLLDEAPGAAGGLARARSGLELLLELERRGQCDESNLRLLGQLLRVLARHDLLPHLARKRRRPVSPERYSYGTSSSSKRTEGSCRRRRQSSSSANSQQGQWETGSPPTKRQRRSRGRPSGGARRRRRGAPAAPHIIPRPTVAHGAKTSKQPPSWKGNAKALGVMEKTFYK

SEQ ID NO: 887261 - protein, 399 aa, Homo sapiens
MAEAMDLGKDPNGPTHSSTLFVRDDGSSMSFYVRPSPAKRRLSTLILHGGGTVCRVQEPGAVLLAQPGEALAEASGDFISTQYILDCVERNERLELEAYRLGPASAADTGSEAKPGALAEGAAEPEPQRHAGRIAFTDADDVAILTYVKENARSPSSVTGNALWKAMEKSSLTQHSWQSLKDRYLKHLRGQEHKYLLGDAPVSPSSQKLKRKAEEDPEAADSGEPQNKRTPDLPEEEYVKEEIQENEEAVKKMLVEATREFEEVVVDESPPDFEIHITMCDDDPPTPEEDSETQPDEEEEEEEEKVSQPEVGAAIKIIRQLMEKFNLDLSTVTQAFLKNSGELEATSAFLASGQRADGYPIWSRQDDIDLQKDDEDTREALVKKFGAQNVARRIEFRKK

SEQ ID NO: 887262 - protein, 399 aa, Homo sapiens; identical to SEQ ID NO: 887261

SEQ ID NO: 887263 - protein, 140 aa, Homo sapiens
SVPSSTETLIHPGVEEVVVDESPPDFEIHITMCDDDPPTPEEDSETQPDEEEEEEEEKVSQPEVSISSQSWLILSSTFGRFYCIWAGYAFSTSGSHSHHPECSAVARSQLSAASISQAQAILPPQPPEKLELQECATASG

SEQ ID NO: 887264 - protein, 399 aa, Homo sapiens; identical to SEQ ID NO: 887261

SEQ ID NO: 887265 - protein, 399 aa, Homo sapiens; identical to SEQ ID NO: 887261

SEQ ID NO: 887266 - protein, 399 aa, Homo sapiens; identical to SEQ ID NO: 887261

SEQ ID NO: 887267 - protein, 399 aa, Homo sapiens; identical to SEQ ID NO: 887261

SEQ ID NO: 887268 - protein, 147 aa, Homo sapiens
MLVEATREFEEVVVDESPPDFEIHITMCDDDPPTPEEDSETQPDEEEEEEEEKVSQPEVGAAIKIIRQLMEKFNLDLSTVTQAFLKNSGELEATSAFLASGQRADGYPIWSRQDDIDLQKDDEDTREALVKKFGAQNVARRIEFRKK

SEQ ID NO: 887269 - protein, 152 aa, Homo sapiens
SVPSSTETLIHPGVEEVVVDESPPDFEIHITMCDDDPPTPEEDSETQPDEEEEEEEEKVSQPEVGAAIKIIRQLMEKFNLDLSTVTQAFLKNSGELEATSAFLASGQRADGYPIWSRQDDIDLQKDDEDTREALVKKFGAQNVARRIEFRKK

SEQ ID NO: 887270 - protein, 121 aa, Homo sapiens [sequence omitted]

SEQ ID NO: 887271 - protein, 121 aa, Homo sapiens [sequence omitted]

SEQ ID NO: 887272 - protein, 123 aa, Homo sapiens
NLSPGVEEVVVIDCVMMITTEEDEEEEEKVSQPEVGAAIKIIRQLMEKFNLDLSTVTQAFLKNSGELEATSAFLASGQRADGYPIWSRQDDIDLQKDDEDTREALVKKFGAQNVARRIEFRKK

SEQ ID NO: 887273 - protein, 121 aa, Homo sapiens [sequence omitted]

SEQ ID NO: 887274 - protein, 387 aa, Homo sapiens
MAEAMDLGKDPNGPTHSSTLFVRDDGSSMSFYVRPSPAKRRLSTLILHGGGTVCRVQEPGAVLLAQPGEALAEASGDFISTQYILDCVERNERLELEAYRLGPASAADTGSEAKPGALAEGAAEPEPQRHAGRIAFTDADDVAILTYVKENARSPSSVTGNALWKAMEKSSLTQHSWQSLKDRYLKHLRGQEHKYLLGDAPVSPSSQKLKRKAEEDPEAADSGEPQNKRTPDLPEEEYVKEEIQENEEAVKKMLVEATREFEEVVVDESPPDFEIHITMCDDDPPTPEEDSETQPDEEEEEEEEKVSQPEVSISSQSWLILSSTFGRFYCIWAGYAFSTSGSHSHHPECSAVARSQLSAASISQAQAILPPQPPEKLELQECATASG

SEQ ID NO: 887275 - protein, 277 aa, Homo sapiens
MAEAMDLGKDPNGPTHSSTLFVRDDGSSMSFYVRPSPAKRRLSTLILHGGGTVCRVQEPGAVLLAQPGEALAEASGDFISTQYILDCVERNERLELEAYRLGPASAADTGSEAKPGALAEGAAEPEPQRHAGRIAFTDADDVAILTYVKENARSPSSVTGNALWKAMEKSSLTQHSWQSLKDRYLKHLRGQEHKYLLGDAPVSPSSQKLKRKAEEDPEAADSGEPQNKRTPDLPEEECCIHFANLVFGYPALWLFFFWSPSQSSLPDVFLYLPLSFP

SEQ ID NO: 887276 - protein, 210 aa, Homo sapiens
AAVRGAGPGARPGGGGGCGDGGRVGVRSGSVRGAAMLQLRDSVDSAGTSPTAVLAAGEEVGAGGGPGGGRPGAGTPLRQTLWPLSIHDPTRRARVKEYFVFRPGSIEQAVEEIRVVVRPVEDGEIQGVWLLTEVDHWNNEKERLVLVTEQSLLICKYDFISLQCQQVVRIALNAVDTISYGEFQFPPKSLNKREGLGFEFSGTSKVVLPS

SEQ ID NO: 887277 - protein, 210 aa, Homo sapiens; identical to SEQ ID NO: 887276

SEQ ID NO: 887278 - protein, 170 aa, Homo sapiens
AAVRGAGPGARPGGGGGCGDGGRVGVRSGSVRGAAMLQLRDSVDSAGTSPTAVLAAGEEVGAGGGPGGGRPGAGTPLRQTLWPLSIHDPTRRARVKEYFVFRPGSIEQAVEEIRVVVRPVEDGEIQVVRIALNAVDTISYGEFQFPPKSLNKREGLGFEFSGTSKVVLPS

SEQ ID NO: 887279 - protein, 248 aa, Homo sapiens
RGGPRGGAGGASGWWRWLRRRRSRRRQVGVGKGCGNAATAGLGGLGRYEPHGGAGGRRGGGGRRRPGRGAAGGGDAAAPDTLASQHPRPHAPRPRQGVLRVPARQHRAGSGGDPRGGAARGGRRDPGSVAAYRARRFGIRIQWDKQSRPSFINRWNPWSTNVPYATFTEHPMAGADEKTASLCQLESFKALLIQAVKKAQKESPLPGQANGVLILERPLLIETYVGLMSFINNEAKLGYSMTRGKIGF

SEQ ID NO: 887280 - protein, 210 aa, Homo sapiens; identical to SEQ ID NO: 887276

SEQ ID NO: 887281 - protein, 217 aa, Homo sapiens
AAVRGAGPGARPGGGGGCGDGGRVGVRSGSVRGAAMLQLRDSVDSAGTSPTAVLAAGEEVGAGGGPGGGRPGAGTPLRQTLWPLSIHDPTRRARVKEYFVFRARRFGIRIQWDKQSRPSFINRWNPWSTNVPYATFTEHPMAGADEKTASLCQLESFKALLIQAVKKAQKESPLPGQANGVLILERPLLIETYVGLMSFINNEAKLGYSMTRGKIGF

SEQ ID NO: 887282 - protein, 210 aa, Homo sapiens; identical to SEQ ID NO: 887276

SEQ ID NO: 887283 - protein, 396 aa, Homo sapiens
MTNEEPLPKKVRLSETDFKVMARDELILRWKQYEAYVQALEGKYTDLNSNDVTGLRESEEKLKQQQQESARRENILVMRLATKEQEMQECTTQIQYLKQVQQPSVAQLRSTMVDPAINLFFLKMKGELEQTKDKLEQAQNELSAWKFTPDSQTGKKLMAKCRMLIQENQELGRQLSQGRIAQLEAELALQKKYSEELKSSQDELNDFIIQLDEEVEGMQSTILVLQQQLKETRQQLAQYQQQQSQASAPSTSRTTASEPVEQSEATSKDCSRLTNGPSNGSSSRQRTSGSGFHREGNTTEDDFPSSPGNGNKSSNSSEERTGRGGSGYVNQLSAGYESVDSPTGSENSLTHQSNDTDSSHDPQEEKAVSGKGNRTVGSRHVQNGLDSSVNVQGSVL

SEQ ID NO: 887284 - protein, 202 aa, Homo sapiens
AERSRAAGRGRAAGPGFLPQRHFVAARPTNKGERRGCGGTRSAAGPAAELSGCAVARGARAAGQAARPRPMRPVAPARLLPGEVGAGRLAGADAGDLRGLRADAQPPPAGKGRAGPERPHGPGAAPVSREPLYLPACGEHFRRFEAILSLSSVPKARVERGALAAGETGHSRRPEDALPGLSGGARFFLASGSPPSPPLGLS

SEQ ID NO: 887285 - protein, 151 aa, Homo sapiens
MTNEEPLPKKVRLSETDFKVMARDELILRWKQYEAYVQALEGKYTDLNSNDVTGLRESEEKLKQQQQESARRENILVMRLATKEQEMQECTTQIQYLKQVQQPSVAQLRSTMVDPAINLFFLKMKGELEQTKDKLEQAQNELSAWKFTPDR

SEQ ID NO: 887286 - protein, 151 aa, Homo sapiens; identical to SEQ ID NO: 887285

SEQ ID NO: 887287 - protein, 151 aa, Homo sapiens; identical to SEQ ID NO: 887285

SEQ ID NO: 887288 - protein, 396 aa, Homo sapiens; identical to SEQ ID NO: 887283

SEQ ID NO: 887289 - protein, 375 aa, Homo sapiens
MYGFFFIRWKQYEAYVQALEGKYTDLNSNDVTGLRESEEKLKQQQQESARRENILVMRLATKEQEMQECTTQIQYLKQVQQPSVAQLRSTMVDPAINLFFLKMKGELEQTKDKLEQAQNELSAWKFTPDSQTGKKLMAKCRMLIQENQELGRQLSQGRIAQLEAELALQKKYSEELKSSQDELNDFIIQLDEEVEGMQSTILVLQQQLKETRQQLAQYQQQQSQASAPSTSRTTASEPVEQSEATSKDCSRLTNGPSNGSSSRQRTSGSGFHREGNTTEDDFPSSPGNGNKSSNSSEERTGRGGSGYVNQLSAGYESVDSPTGSENSLTHQSNDTDSSHDPQEEKAVSGKGNRTVGSRHVQNGLDSSVNVQGSVL

SEQ ID NO: 887290 - protein, 311 aa, Homo sapiens
MRIKFQTQIQYLKQVQQPSVAQLRSTMVDPAINLFFLKMKGELEQTKDKLEQAQNELSAWKFTPDSQTGKKLMAKCRMLIQENQELGRQLSQGRIAQLEAELALQKKYSEELKSSQDELNDFIIQLDEEVEGMQSTILVLQQQLKETRQQLAQYQQQQSQASAPSTSRTTASEPVEQSEATSKDCSRLTNGPSNGSSSRQRTSGSGFHREGNTTEDDFPSSPGNGNKSSNSSEERTGRGGSGYVNQLSAGYESVDSPTGSENSLTHQSNDTDSSHDPQEEKAVSGKGNRTVGSRHVQNGLDSSVNVQGSVL

SEQ ID NO: 887291 - protein, 277 aa, Homo sapiens [sequence omitted]

SEQ ID NO: 887292 - protein, 396 aa, Homo sapiens; identical to SEQ ID NO: 887283

SEQ ID NO: 887293 - protein, 336 aa, Homo sapiens
MTNEEPLPKKVRLSETDFKVMARDELILRWKQYEAYVQALEGKYTDLNSNDVTGLRESEEKLKQQQQESARRENILVMRLATKEQEMQECTTQIQYLKQVQQPSVAQLRSTMVDPAINLFFLKMKGELEQTKDKLEQAQNELSAWKFTPDSQTGKKLMAKCRMLIQENQELGRQLSQGRIAQLEAELALQKKYSEELKSSQDELNDFIIQLDEEVEGMQSTILVLQQQLKETRQQLAQYQQQQSQASAPSTSRTTASEPVEQSEATSKDCSRLTNGPSNGSSSRQRTSGSGFQHRGTPPRTMTNDGQQPSVNDLQHTSSRGDNLRKVEAATKAIGK

SEQ ID NO: 887294 - protein, 235 aa, Homo sapiens
MTNEEPLPKKVRLSETDFKVMARDELILRWKQYEAYVQALEGKYTDLNSNDVTGLRESEEKLKQQQQESARRENILVMRLATKEQEMQECTTQIQYLKQVQQPSVAQLRSTMVDPAINLFFLKMKGELEQTKDKLEQAQNELSAWKFTPDSQTGKKLMAKCRMLIQENQELGRQLSQGRIAQLEAELALQKKYSEELKSSQDGKGFVSFWNVVSTLHWLFKTASHEYYRLDSVHC

SEQ ID NO: 887295 - protein, 159 aa, Homo sapiens [sequence omitted]

SEQ ID NO: 887296 - protein, 151 aa, Homo sapiens; identical to SEQ ID NO: 887285

SEQ ID NO: 887297 - protein, 86 aa, Homo sapiens
AERSRAAGRGRAAGPGFLPQRHFVAARPTNKGERRGCGGTRSAAGPAAELSGCAVARGARAAGQAARPRPMRPVAPARLLPGEDSR

SEQ ID NO: 887298 - protein, 151 aa, Homo sapiens; identical to SEQ ID NO: 887285

SEQ ID NO: 887299 - protein, 151 aa, Homo sapiens; identical to SEQ ID NO: 887285

SEQ ID NO: 887300 - protein, 361 aa, Homo sapiens
FDGDSLRQYTDLNSNDVTGLRESEEKLKQQQQESARRENILVMRLATKEQEMQECTTQIQYLKQVQQPSVAQLRSTMVDPAINLFFLKMKGELEQTKDKLEQAQNELSAWKFTPDSQTGKKLMAKCRMLIQENQELGRQLSQGRIAQLEAELALQKKYSEELKSSQDELNDFIIQLDEEVEGMQSTILVLQQQLKETRQQLAQYQQQQSQASAPSTSRTTASEPVEQSEATSKDCSRLTNGPSNGSSSRQRTSGSGFHREGNTTEDDFPSSPGNGNKSSNSSEERTGRGGSGYVNQLSAGYESVDSPTGSENSLTHQSNDTDSSHDPQEEKAVSGKGNRTVGSRHVQNGLDSSVNVQGSVL

SEQ ID NO: 887301 - protein, 163 aa, Homo sapiens
RRQYPRVARLGGVTNEEALPKKVRLSETDFKVMARDELILRWKQYEAYVQALEGKYTDLNSNDVTGLRESEEKLKQQQQESARRENILVMRLATKEQEMQECTTQIQYLKQVQQPSVAQLRSTMVDPAINLFFLKMKGELEQTKDKLEQAQNELSAWKFTPDR

SEQ ID NO: 887302 - protein, 396 aa, Homo sapiens; identical to SEQ ID NO: 887283

SEQ ID NO: 887303 - protein, 170 aa, Homo sapiens
MTNEEPLPKKVRLSETDFKVMARDELILRWKQYEAYVQALEGKYTDLNSNDVTGLRESEEKLKQQQQESARRENILVMRLATKEQEMQECTTQIQYLKQVQQPSVAQLRSTMVDPAINLFFLKMKGELEQTKDKLEQAQNELSAWKFTPDRGLMASDYSEEVATSEKFPF

SEQ ID NO: 887304 - protein, 159 aa, Homo sapiens [sequence omitted]

SEQ ID NO: 887305 - protein, 347 aa, Homo sapiens
SCQRKQQRISTWQMVLSTSVKTKFHGFLDAQPGVVSEGPPGNWEQKPVSRHLLSVEAVLSRLLPVGVQLRKERGSQARSLPGLPLRPLGRVLLRRQLQGRIQAGGASSEKRGAAPNYAEAGTPTLHTSPRPHLRPCTHTHTRTPTPPRCKAGFKRTSLRFLPAPHHRTREEEAGEKQNFFPLSCPFLRTCSEAEEPVLEEMVMGLGVLLLVFVLGLGLTPPTLAQDNSRYTHFLTQHYDAKPQGRDDRYCESIMRRRGLTSPCKDINTFIHGNKRSIKAICENKNGNPHRENLRISKSSFQVTTCKLHGGSPWPPCQYRATAGFRNVVVACENGLPVHLDQSIFRRP

SEQ ID NO: 887306 - protein, 184 aa, Homo sapiens
WRGLQVHTTGTHLQEQTAGTHLPLKGNCQIFEPVLEEMVMGLGVLLLVFVLGLGLTPPTLAQDNSRYTHFLTQHYDAKPQGRDDRYCESIMRRRGLTSPCKDINTFIHGNKRSIKAICENKNGNPHRENLRISKSSFQVTTCKLHGGSPWPPCQYRATAGFRNVVVACENGLPVHLDQSIFRRP

SEQ ID NO: 887307 - protein, 147 aa, Homo sapiens
MVMGLGVLLLVFVLGLGLTPPTLAQDNSRYTHFLTQHYDAKPQGRDDRYCESIMRRRGLTSPCKDINTFIHGNKRSIKAICENKNGNPHRENLRISKSSFQVTTCKLHGGSPWPPCQYRATAGFRNVVVACENGLPVHLDQSIFRRP

SEQ ID NO: 887308 - protein, 147 aa, Homo sapiens
MALQRTHSLLLLLLLTLLGLGLVQPSYGQDGMYQRFLRQHVHPEETGGSDRYCNLMMQRRKMTLYHCKRFNTFIHEDIWNIRSICSTTNIQCKNGKMNCHEGVVKVTDCRDTGSSRAPNCRYRAIASTRRVVIACEGNPQVPVHFDG

SEQ ID NO: 887309 - protein, 147 aa, Homo sapiens; identical to SEQ ID NO: 887307

SEQ ID NO: 887310 - protein, 184 aa, Homo sapiens; identical to SEQ ID NO: 887306

SEQ ID NO: 887311 - protein, 147 aa, Homo sapiens; identical to SEQ ID NO: 887308

SEQ ID NO: 887312 - protein, 147 aa, Homo sapiens; identical to SEQ ID NO: 887308

SEQ ID NO: 887313 - protein, 190 aa, Homo sapiens
WRGLQVHTTGTHLQEQTAGTHLPLKGNCQIFVRFFLLGTSKILMALQRTHSLLLLLLLTLLGLGLVQPSYGQDGMYQRFLRQHVHPEETGGSDRYCNLMMQRRKMTLYHCKRFNTFIHEDIWNIRSICSTTNIQCKNGKMNCHEGVVKVTDCRDTGSSRAPNCRYRAIASTRRVVIACEGNPQVPVHFDG

SEQ ID NO: 887314 - protein, 347 aa, Homo sapiens; identical to SEQ ID NO: 887305

SEQ ID NO: 887315 - protein, 147 aa, Homo sapiens; identical to SEQ ID NO: 887307

SEQ ID NO: 887316 - protein, 347 aa, Homo sapiens; identical to SEQ ID NO: 887305

SEQ ID NO: 887317 - protein, 184 aa, Homo sapiens; identical to SEQ ID NO: 887306

SEQ ID NO: 887318 - protein, 147 aa, Homo sapiens; identical to SEQ ID NO: 887307

SEQ ID NO: 887319 - protein, 147 aa, Homo sapiens; identical to SEQ ID NO: 887307

SEQ ID NO: 887320 - protein, 113 aa, Homo sapiens
MVMGLGVLLLVFVLGLGLTPPTLAQDNSRYTHFLTQHYDAKPQGRDDRYCESIMRRRGLTSPCKDINTFIHGNKRSIKAICENKNGNPHRWRFPLASMPVPSHSGVQKRCCCL

SEQ ID NO: 887321 - protein, 147 aa, Homo sapiens; identical to SEQ ID NO: 887308

SEQ ID NO: 887322 - protein, 196 aa, Homo sapiens
SCQRKQQRISTWQMVLSTSVKTKFHGFLDAQPGVVSEGPPGNWEQKPVSRHLLSVEAVLSRLLPVGVQLRKERGSQARSLPGLPLRPLGRVLLRRQLQGRIQAGGASSEKRGAVPTTQRLARRPSTPHHAPISVRVHTLTQGRQPHLDAKQDSKEHLCVFYRLPIIVLGRKKRVRNKTSFHCPARFCGLVLRPRHL

SEQ ID NO: 887323 - protein, 201 aa, Homo sapiens
SCQRKQQRISTWQMVLSTSVKTKFHGFLDAQPGVVSEGPPGNWEQKPVSRHLLSVEAVLSRLLPVGVQLRKERGSQARSLPGLPLRPLGRVLLRRQLQGRIQAGGASSEKRGAVPTTQRLARRPSTPHHAPISVRVHTLTQGRQPHLDAKQDSKEHLCVFYRLPIIVLGRKKRVRNKTSFHCPARFCGLVLRPRSLCWKRW

SEQ ID NO: 887324 - protein, 255 aa, Homo sapiens
MASSRASSTATKTKAPDDLVAPVVKKPHIYYGSLEEKERERLAKGESGILGKDGLKAGIEAGNINITSGEVFEIEEHISERQAEVLAEFERRKRARQINVSTDDSEVKACLRALGEPITLFGEGPAERRERLRNILSVVGTDALKKTKKDDEKSKKSKEEYQQTWYHEGPNSLKVARLWIANYSLPRAMKRLEEARLHKEIPETTRTSQMQELHKSLRVRCSQQLSHILKVLHVYLIFLLWLTSGKVEATRVIPP

SEQ ID NO: 887325 - protein, 521 aa, Homo sapiens
MASSRASSTATKTKAPDDLVAPVVKKPHIYYGSLEEKERERLAKGESGILGKDGLKAGIEAGNINITSGEVFEIEEHISERQAEVLAEFERRKRARQINVSTDDSEVKACLRALGEPITLFGEGPAERRERLRNILSVVGTDALKKTKKDDEKSKKSKEEYQQTWYHEGPNSLKVARLWIANYSLPRAMKRLEEARLHKEIPETTRTSQMQELHKSLRSLNNFCSQIGDDRPISYCHFSPNSKMLATACWSGLCKLWSVPDCNLLHTLRGHNTNVGAIVFHPKSTVSLDPKDVNLASCAADGSVKLWSLDSDEPVADIEGHTVRVARVMWHPSGRFLGTTCYDRSWRLWDLEAQEEILHQEGHSMGVYDIAFHQDGSLAGTGGLDAFGRVWDLRTGRCIMFLEGHLKEIYGINFSPNGYHIATGSGDNTCKVWDLRQRRCVYTIPAHQNLVTGVKFEPIHGNFLLTGAYDNTAKIWTHPGWSPLKTLAGHEGKVMGLDISSDGQLIATCSYDRTFKLWMAE

SEQ ID NO: 887326 - protein, 521 aa, Homo sapiens; identical to SEQ ID NO: 887325

SEQ ID NO: 887327 - protein, 333 aa, Homo sapiens [sequence omitted]

SEQ ID NO: 887328 - protein, 329 aa, Homo sapiens
MASSRASSTATKTKAPDDLVAPVVKKPHIYYGSLEEKERERLAKGESGILGKDGLKAGIEAGNINITSGEVFEIEEHISERQAEVLAEFERRKRARQINVSTDDSEVKACLRALGEPITLFGEGPAERRERLRNILSVVGTDALKKTKKDDEKSKKSKEEYQQTWYHEGPNSLKVARLWIANYSLPRAMKRLEEARLHKEIPETTRTSQMQELHKSLRSLNNFCSQIGDDRPISYCHFSPNSKMLATACWSGLCKLWSVPDCNLLHTLRGHNTNVGAIVFHPKSTVSLDPKDVNLASCAADGSVKLWSLDSDEPVADIEGHELCRHCFY

SEQ ID NO: 887329 - protein, 311 aa, Homo sapiens [sequence omitted]

SEQ ID NO: 887330 - protein, 521 aa, Homo sapiens; identical to SEQ ID NO: 887325

SEQ ID NO: 887331 - protein, 539 aa, Homo sapiens
RSLIGGSVGFAGARGSEPGWPRELFHAATKTKAPDDLVAPVVKKPHIYYGSLEEKERERLAKGESGILGKDGLKAGIEAGNINITSGEVFEIEEHISERQAEVLAEFERRKRARQINVSTDDSEVKACLRALGEPITLFGEGPAERRERLRNILSVVGTDALKKTKKDDEKSKKSKEEYQQTWYHEGPNSLKVARLWIANYSLPRAMKRLEEARLHKEIPETTRTSQMQELHKSLRSLNNFCSQIGDDRPISYCHFSPNSKMLATACWSGLCKLWSVPDCNLLHTLRGHNTNVGAIVFHPKSTVSLDPKDVNLASCAADGSVKLWSLDSDEPVADIEGHTVRVARVMWHPSGRFLGTTCYDRSWRLWDLEAQEEILHQEGHSMGVYDIAFHQDGSLAGTGGLDAFGRVWDLRTGRCIMFLEGHLKEIYGINFSPNGYHIATGSGDNTCKVWDLRQRRCVYTIPAHQNLVTGVKFEPIHGNFLLTGAYDNTAKIWTHPGWSPLKTLAGHEGKVMGLDISSDGQLIATCSYDRTFKLWMAE

SEQ ID NO: 887332 - protein, 333 aa, Homo sapiens [sequence omitted]

SEQ ID NO: 887333 - protein, 500 aa, Homo sapiens
MASSRASSTATKTKAPDDLVAPVVKKPHIYYGSLEEKERERLAKGESGILGKDGLKAGIEAGNINITSGEVFEIEEHISERQAEVLAEFERRKRARQINVSTDDSEVKACLRALGEPITLFGEGPAERRERLRNILSVVGTDALKKTKKDDEKSKKSKEEYQQTWYHEGPNSLKVARLWIANYSLPRAMKRLEEARLHKEIPETTRTSQMQELHKSLRSLNNFCSQIGDDRPISYCHFSPNSKMLATACWSGLCKLWSVPDCNLLHTLRGHNTNVGAIVFHPKSTVSLDPKDVNLASCAADGSVKLWSLDSDEPVADIEGHTVRVARVMWHPSGRFLGTTCYDRSWRLWDLEAQEEILHQEGHSMGVYDIAFHQDGSLAGTGGLDAFGRVWDLRTGRCIMFLEGHLKEIYGINFSPNGYHIATGSGDNTCKVWDLRQRRCVYTIPAHQNLVTGVKFEHFSFPWRMGCEAVDRSHADGYTVKKTSPLPIEFAWNADSIRQL

SEQ ID NO: 887334 - protein, 2028 aa, Homo sapiens
GSHRRVPLGDEASKGRIRQQYLLFCYICCSAASIGDIQANKIWNGPPANSNRPALKDLTGDQSRSLPYKLISLLNEKGQDTGATIDLVIGYDPPSAPHPNDLSGPSVPGMGGDGEEDEGDEDRLDNAVRGPGPKGPVGTVSEAQLARRLTKVKNSRRMLSNKPQDFQIRVRVIEGRQLSGNNIRPVVKVHVCGQTHRTRIKRGNNPFFDELFFYNVNMTPSELMDEIISIRVYNSHSLRADCLMGEFKIDVGFVYDEPGHAVMRKWLLLNDPEDTSSGSKGYMKVSMFVLGTGDEPPPERRDRDNDSDDVESNLLLPAGIALRWVTFLLKIYRAEDIPQMDDAFSQTVKEIFGGNADKKNLVDPFVEVSFAGKKVCTNIIEKNANPEWNQVVNLQIKFPSVCEKIKLTIYDWDRLTKNDVVGTTYLHLSKIAASGGEVEDFSSSGTGAASYTVNTGETEVGFVPTFGPCYLNLYGSPREYTGFPDPYDELNTGKGEGVAYRGRILVELATFLEKTPPDKKLEPISNDDLLVVEKYQRRRKYSLSAVFHSATMLQDVGEAIQFEVSIGNYGNKFDTTCKPLASTTQYSRAVFDGNYYYYLPWAHTKPVVTLTSYWEDISHRLDAVNTLLAMAERLQTNIEALKSGIQGKIPANQLAELWLKLIDEVIEDTRYTLPLTEGKANVTVLDTQIRKLRSRSLSQIHEAAVRMRSEATDVKSTLAEIEDWLDKLMQLTEEPQNSMPDIIIWMIRGEKRLAYARIPAHQVLYSTSGENASGKYCGKTQTIFLKYPQEKNNGPKVPVELRVNIWLGLSAVEKKFNSFAEGTFTVFAEMYENQALMFGKWGTSGLVGRHKFSDVTGKIKLKREFFLPPKGWEWEGEWIVDPERSLLTEADAGHTEFTDEVYQNESRYPGGDWKPAEDTYTDANGDKAASPSELTCPPGWEWEDDAWSYDINRAVDEKGWEYGITIPPDHKPKSWVAAEKMYHTHRRRRLVRKRKKDLTQTASSTARAMEELQDQEGWEYASLIGWKFHWKQRSSDTFRRRRWRRKMAPSETHGAAAIFKLEGALGADTTEDGDEKSLEKQKHSATTVFGANTPIVSCNFDRVYIYHLRCYVYQARNLLALDKDSFSDPYAHICFLHRSKTTEIIHSTLNPTWDQTIIFDEVEIYGEPQTVLQNPPKVIMELFDNDQVGKDEFLGRSIFSPVVKLNSEMDITPKLLWHPVMNGDKACGDVLVTAELILRGKDGSNLPILPPQRAPNLYMVPQGIRPVVQLTAIEILAWGLRNMKNFQMASITSPSLVVECGGERVESVVIKNLKKTPNFPSSVLFMKVFLPKEELYMPPLVIKVIDHRQFGRKPVVGQCTIERLDRFRCDPYAGKEDIVPQLKASLLSAPPCRDIVIEMEDTKPLLASKLTEKEEEIVDWWSKFYASSGEHEKCGQYIQKGYSKLKIYNCELENVAEFEGLTDFSDTFKLYRGKSDENEDPSVVGEFKGSFRIYPLPDDPSVPAPPRQFRELPDSVPQECTVRIYIVRGLELQPQDNNGLCDPYIKITLGKKVIEDRDHYIPNTLNPVFGRMYELSCYLPQEKDLKISVYDYDTFTRDEKVGETIIDLENRFLSRFGSHCGIPEEYCVSGVNTWRDQLRPTQLLQNVARFKGFPQPILSEDGSRIRYGGRDYSLDEFEANKILHQHLGAPEERLALHILRTQGLVPEHVETRTLHSTFQPNISQGKLQMWVDVFPKSLGPPGPPFNITPRKAKKYYLRVIIWNTKDVILDEKSITGEEMSDIYVKGWIPGNEENKQKTDVHYRSLDGEGNFNWRFVFPFDYLPAEQLCIVAKKEHFWSIDQTEFRIPPRLIIQIWDNDKFSLDDYLGFLELDLRHTIIPAKSPEKCRLDMIPDLKAMNPLKAKTASLFEQKSMKGWWPCYAEKDGARVMAGKVEMTLEILNEKEADERPAGKGRDEPNMNPKLDLPNRPETSFLWFTNPCKTMKFIVWRRFKWVIIGLLFLLILLLFVAVLLYSLPNYLSMKIVKPNV

SEQ ID NO: 887335 - protein, 2108 aa, Homo sapiens
NPPFTGRELLSGGATRSSSALGEILPSLGENFSPRAVRPGAPAPESPLRLLKLAFYQLRTMLRVIVESASNIPKTKFGKPDPIVSVIFKDEKKKTKKVDNELNPVWNEILEFDLRGIPLDFSSSLGIIVKDFETIGQNKLIGTATVALKDLTGDQSRSLPYKLISLLNEKGQDTGATIDLVIGYDPPSAPHPNDLSGPSVPGMGGDGEEDEGDEDRLDNAVRGPGPKGPVGTVSEAQLARRLTKVKNSRRMLSNKPQDFQIRVRVIEGRQLSGNNIRPVVKVHVCGQTHRTRIKRGNNPFFDELFFYNVNMTPSELMDEIISIRVYNSHSLRADCLMGEFKIDVGFVYDEPGHAVMRKWLLLNDPEDTSSGSKGYMKVSMFVLGTGDEPPPERRDRDNDSDDVESNLLLPAGIALRWVTFLLKIYRAEDIPQMDDAFSQTVKEIFGGNADKKNLVDPFVEVSFAGKKVCTNIIEKNANPEWNQVVNLQIKFPSVCEKIKLTIYDWDRLTKNDVVGTTYLHLSKIAASGGEVEVNTGETEVGFVPTFGPCYLNLYGSPREYTGFPDPYDELNTGKGEGVAYRGRILVELATFLEKTPPDKKLEPISNDDLLVVEKYQRRRKYSLSAVFHSATMLQDVGEAIQFEVSIGNYGNKFDTTCKPLASTTQYSRAVFDGNYYYYLPWAHTKPVVTLTSYWEDISHRLDAVNTLLAMAERLQTNIEALKSGIQGKIPANQLAELWLKLIDEVIEDTRYTLPLTEGKANVTVLDTQIRKLRSRSLSQIHEAAVRMRSEATDVKSTLAEIEDWLDKLMQLTEEPQNSMPDIIIWMIRGEKRLAYARIPAHQVLYSTSGENASGKYCGKTQTIFLKYPQEKNNGPKVPVELRVNIWLGLSAVEKKFNSFAEGTFTVFAEMYENQALMFGKWGTSGLVGRHKFSDVTGKIKLKREFFLPPKGWEWEGEWIVDPERSLLTEADAGHTEFTDEVYQNESRYPGGDWKPAEDTYTDANGDKAASPSELTCPPGWEWEDDAWSYDINRAVDEKGWEYGITIPPDHKPKSWVAAEKMYHTHRRRRLVRKRKKDLTQTASSTARAMEELQDQEGWEYASLIGWKFHWKQRSSDTFRRRRWRRKMAPSETHGAAAIFKLEGALGADTTEDGDEKSLEKQKHSATTVFGANTPIVSCNFDRVYIYHLRCYVYQARNLLALDKDSFSDPYAHICFLHRSKTTEIIHSTLNPTWDQTIIFDEVEIYGEPQTVLQNPPKVIMELFDNDQVGKDEFLGRSIFSPVVKLNSEMDITPKLLWHPVMNGDKACGDVLVTAELILRGKDGSNLPILPPQRAPNLYMVPQGIRPVVQLTAIEILAWGLRNMKNFQMASITSPSLVVECGGERVESVVIKNLKKTPNFPSSVLFMKVFLPKEELYMPPLVIKVIDHRQFGRKPVVGQCTIERLDRFRCDPYAGKEDIVPQLKASLLSAPPCRDIVIEMEDTKPLLASKLTEKEEEIVDWWSKFYASSGEHEKCGQYIQKGYSKLKIYNCELENVAEFEGLTDFSDTFKLYRGKSDENEDPSVVGEFKGSFRIYPLPDDPSVPAPPRQFRELPDSVPQECTVRIYIVRGLELQPQDNNGLCDPYIKITLGKKVIEDRDHYIPNTLNPVFGRMYELSCYLPQEKDLKISVYDYDTFTRDEKVGETIIDLENRFLSRFGSHCGIPEEYCVSGVNTWRDQLRPTQLLQNVARFKGFPQPILSEDGSRIRYGGRDYSLDEFEANKILHQHLGAPEERLALHILRTQGLVPEHVETRTLHSTFQPNISQGKLQMWVDVFPKSLGPPGPPFNITPRKAKKYYLRVIIWNTKDVILDEKSITGEEMSDIYVKGWIPGNEENKQKTDVHYRSLDGEGNFNWRFVFPFDYLPAEQLCIVAKKEHFWSIDQTEFRIPPRLIIQIWDNDKFSLDDYLGFLELDLRHTIIPAKSPEKCRLDMIPDLKAMNPLKAKTASLFEQKSMKGWWPCYAEKDGARVMAGKVEMTLEILNEKEADERPAGKGRDEPNMNPKLDLPNRPETSFLWFTNPCKTMKFIVWRRFKWVIIGLLFLLILLLFVAVLLYSLPNYLSMKIVKPNV

SEQ ID NO: 887336 - protein, 1947 aa, Homo sapiens
MADKTVSWKPEPLDIYRIRASLTGFLSDILGDGEEDEGDEDRLDNAVRGPGPKGPVGTVSEAQLARRLTKVKNSRRMLSNKPQDFQIRVRVIEGRQLSGNNIRPVVKVHVCGQTHRTRIKRGNNPFFDELFFYNVNMTPSELMDEIISIRVYNSHSLRADCLMGEFKIDVGFVYDEPGHAVMRKWLLLNDPEDTSSGSKGYMKVSMFVLGTGDEPPPERRDRDNDSDDVESNLLLPAGIALRWVTFLLKIYRAEDIPQMDDAFSQTVKEIFGGNADKKNLVDPFVEVSFAGKKVCTNIIEKNANPEWNQVVNLQIKFPSVCEKIKLTIYDWDRLTKNDVVGTTYLHLSKIAASGGEVEDFSSSGTGAASYTVNTGETEVGFVPTFGPCYLNLYGSPREYTGFPDPYDELNTGKGEGVAYRGRILVELATFLEKTPPDKKLEPISNDDLLVVEKYQRRRKYSLSAVFHSATMLQDVGEAIQFEVSIGNYGNKFDTTCKPLASTTQYSRAVFDGNYYYYLPWAHTKPVVTLTSYWEDISHRLDAVNTLLAMAERLQTNIEALKSGIQGKIPANQLAELWLKLIDEVIEDTRYTLPLTEGKANVTVLDTQIRKLRSRSLSQIHEAAVRMRSEATDVKSTLAEIEDWLDKLMQLTEEPQNSMPDIIIWMIRGEKRLAYARIPAHQVLYSTSGENASGKYCGKTQTIFLKYPQEKNNGPKVPVELRVNIWLGLSAVEKKFNSFAEGTFTVFAEMYENQALMFGKWGTSGLVGRHKFSDVTGKIKLKREFFLPPKGWEWEGEWIVDPERSLLTEADAGHTEFTDEVYQNESRYPGGDWKPAEDTYTDANGDKAASPSELTCPPGWEWEDDAWSYDINRAVDEKGWEYGITIPPDHKPKSWVAAEKMYHTHRRRRLVRKRKKDLTQTASSTARAMEELQDQEGWEYASLIGWKFHWKQRSSDTFRRRRWRRKMAPSETHGAAAIFKLEGALGADTTEDGDEKSLEKQKHSATTVFGANTPIVSCNFDRVYIYHLRCYVYQARNLLALDKDSFSDPYAHICFLHRSKTTEIIHSTLNPTWDQTIIFDEVEIYGEPQTVLQNPPKVIMELFDNDQVGKDEFLGRSIFSPVVKLNSEMDITPKLLWHPVMNGDKACGDVLVTAELILRGKDGSNLPILPPQRAPNLYMVPQGIRPVVQLTAIEILAWGLRNMKNFQMASITSPSLVVECGGERVESVVIKNLKKTPNFPSSVLFMKVFLPKEELYMPPLVIKVIDHRQFGRKPVVGQCTIERLDRFRCDPYAGKEDIVPQLKASLLSAPPCRDIVIEMEDTKPLLASKLTEKEEEIVDWWSKFYASSGEHEKCGQYIQKGYSKLKIYNCELENVAEFEGLTDFSDTFKLYRGKSDENEDPSVVGEFKGSFRIYPLPDDPSVPAPPRQFRELPDSVPQECTVRIYIVRGLELQPQDNNGLCDPYIKITLGKKVIEDRDHYIPNTLNPVFGRMYELSCYLPQEKDLKISVYDYDTFTRDEKVGETIIDLENRFLSRFGSHCGIPEEYCVSGVNTWRDQLRPTQLLQNVARFKGFPQPILSEDGSRIRYGGRDYSLDEFEANKILHQHLGAPEERLALHILRTQGLVPEHVETRTLHSTFQPNISQGKLQMWVDVFPKSLGPPGPPFNITPRKAKKYYLRVIIWNTKDVILDEKSITGEEMSDIYVKGWIPGNEENKQKTDVHYRSLDGEGNFNWRFVFPFDYLPAEQLCIVAKKEHFWSIDQTEFRIPPRLIIQIWDNDKFSLDDYLGFLELDLRHTIIPAKSPEKCRLDMIPDLKAMNPLKAKTASLFEQKSMKGWWPCYAEKDGARVMAGKVEMTLEILNEKEADERPAGKGRDEPNMNPKLDLPNRPETSFLWFTNPCKTMKFIVWRRFKWVIIGLLFLLILLLFVAVLLYSLPNYLSMKIVKPNV

SEQ ID NO: 887337 - protein, 2054 aa, Homo sapiens
NPPFTGRELLSGGATRSSSALGEILPSLGENFSPRAVRPGAPAPESPLRLLKLAFYQLRTMLRVIVESASNIPKTKFGKPDPIVSVIFKDEKKKTKKVDNELNPVWNEILEFDLRGIPLDFSSSLGIIVKDFETIGQNKLIGTATVALKDLTGDQSRSLPYKLISLLNEKGQDTGATIDLVIGYDPPSAPHPNDLSGPSVPGMGGDGEEDEGDEDRLDNAVRGPGPKGPVGTVSEAQLARRLTKVKNSRRMLSNKPQDFQIRVRVIEGRQLSGNNIRPVVKVHVCGQTHRTRIKRGNNPFFDELFFYNVNMTPSELMDEIISIRVYNSHSLRADCLMGEFKIDVGFVYDEPGHAVMRKWLLLNDPEDTSSGSKGYMKVSMFVLGTGDEPPPERRDRDNDSDDVESNLLLPAGIALRWVTFLLKIYRAEDIPQSMYCFNLAPELLIMCVMKCVKNQTLIVIRVPIVCFSSERASWAYFHSFWPSGKLPEQAHGTASWLLIMFLVEYLPLAHLTLSLAILYLLFILEDVKRYEQSALPTPFIPNENVNCYYQIKVFAIHYIFVFSIEKGFHHVDQDGLALLTYDPPALASQSPGITGMSHCAQPVATILMYKRTFKILPNFWELNLISADNYYLPVDDAFSQTVKEIFGGNADKKNLVDPFVEVSFAGKKVCTNIIEKNANPEWNQVVNLQIKFPSVCEKIKLTIYDWDRLTKNDVVGTTYLHLSKIAASGGEVEVNTGETEVGFVPTFGPCYLNLYGSPREYTGFPDPYDELNTGKGEGVAYRGRILVELATFLEKTPPDKKLEPISNDDLLVVEKYQRRRKYSLSAVFHSATMLQDVGEAIQFEVSIGNYGNKFDTTCKPLASTTQYSRAVFDGNYYYYLPWAHTKPVVTLTSYWEDISHRLDAVNTLLAMAERLQTNIEALKSGIQGKIPANQLAELWLKLIDEVIEDTRYTLPLTEGKANVTVLDTQIRKLRSRSLSQIHEAAVRMRSEATDVKSTLAEIEDWLDKLMQLTEEPQNSMPDIIIWMIRGEKRLAYARIPAHQVLYSTSGENASGKYCGKTQTIFLKYPQEKNNGPKVPVELRVNIWLGLSAVEKKFNSFAEGTFTVFAEMYENQALMFGKWGTSGLVGRHKFSDVTGKIKLKREFFLPPKGWEWEGEWIVDPERSLLTEADAGHTEFTDEVYQNESRYPGGDWKPAEDTYTDANGDKAASPSELTCPPGWEWEDDAWSYDINRAVDEKGWEYGITIPPDHKPKSWVAAEKMYHTHRRRRLVRKRKKDLTQTASSTARAMEELQDQEGWEYASLIGWKFHWKQRSSDTFRRRRWRRKMAPSETHGAAAIFKLEGALGADTTEDGDEKSLEKQKHSATTVFGANTPIVSCNFDRVYIYHLRCYVYQARNLLALDKDSFSDPYAHICFLHRSKTTEIIHSTLNPTWDQTIIFDEVEIYGEPQTVLQNPPKVIMELFDNDQVGKDEFLGRSIFSPVVKLNSEMDITPKLLWHPVMNGDKACGDVLVTAELILRGKDGSNLPILPPQRAPNLYMVPQGIRPVVQLTAIEILAWGLRNMKNFQMASITSPSLVVECGGERVESVVIKNLKKTPNFPSSVLFMKVFLPKEELYMPPLVIKVIDHRQFGRKPVVGQCTIERLDRFRCDPYAGKEDIVPQLKASLLSAPPCRDIVIEMEDTKPLLASKLTEKCLSSMSTALSKMASPATVHMYEKEEEIVDWWSKFYASSGEHEKCGQYIQKGYSKLKIYNCELENVAEFEGLTDFSDTFKLYRGKSDENEDPSVVGEFKGSFRIYPLPDDPSVPAPPRQFRELPDSVPQECTVRIYIVRGLELQPQDNNGLCDPYIKITLGKKVIEDRDHYIPNTLNPVFGRMYELSCYLPQEKDLKISVYDYDTFTRDEKVGETIIDLENRFLSRFGSHCGIPEEYCVSGVNTWRDQLRPTQLLQNVARFKGFPQPILSEDGSRIRYGGRDYSLDEFEANKILHQHLGAPEERLALHILRTQGLVPEHVETRTLHSTFQPNISQILPACDHLEHQGRYLGREKHHRRGNE

SEQ ID NO: 887338 - protein, 2108 aa, Homo sapiens; identical to SEQ ID NO: 887335

SEQ ID NO: 887339 - protein, 1573 aa, Homo sapiens
NPPFTGRELLSGGATRSSSALGEILPSLGENFSPRAVRPGAPAPESPLRLLKLAFYQLRTMLRVIVESASNIPKTKFGKPDPIVSVIFKDEKKKTKKVDNELNPVWNEILEFDLRGIPLDFSSSLGIIVKDFETIGQNKLIGTATVALKDLTGDQSRSLPYKLISLLNEKGQDTGATIDLVIGYDPPSAPHPNDLSGPSVPGMGGDGEEDEGDEDRLDNAVRGPGPKGPVGTVSEAQLARRLTKVKNSRRMLSNKPQDFQIRVRVIEGRQLSGNNIRPVVKVHVCGQTHRTRIKRGNNPFFDELFFYNVNMTPSELMDEIISIRVYNSHSLRADCLMGEFKIDVGFVYDEPGHAVMRKWLLLNDPEDTSSGSKGYMKVSMFVLGTGDEPPPERRDRDNDSDDVESNLLLPAGIALRWVTFLLKIYRAEDIPQMDDAFSQTVKEIFGGNADKKNLVDPFVEVSFAGKKVCTNIIEKNANPEWNQVVNLQIKFPSVCEKIKLTIYDWDRLTKNDVVGTTYLHLSKIAASGGEVEDFSSSGTGAASYTVNTGETEVGFVPTFGPCYLNLYGSPREYTGFPDPYDELNTGKGEGVAYRGRILVELATFLEKTPPDKKLEPISNDDLLVVEKYQRRRKYSLSAVFHSATMLQDVGEAIQFEVSIGNYGNKFDTTCKPLASTTQYSRAVFDGNYYYYLPWAHTKPVVTLTSYWEDISHRLDAVNTLLAMAERLQTNIEALKSGIQGKIPANQLAELWLKLIDEVIEDTRYTLPLTEGKANVTVLDTQIRKLRSRSLSQIHEAAVRMRSEATDVKSTLAEIEDWLDKLMQLTEEPQNSMPDIIIWMIRGEKRLAYARIPAHQVLYSTSGENASGKYCGKTQTIFLKYPQEKNNGPKVPVELRVNIWLGLSAVEKKFNSFAEGTFTVFAEMYENQALMFGKWGTSGLVGRHKFSDVTGKIKLKREFFLPPKGWEWEGEWIVDPERSLLTEADAGHTEFTDEVYQNESRYPGGDWKPAEDTYTDANGDKAASPSELTCPPGWEWEDDAWSYDINRAVDEKGWEYGITIPPDHKPKSWVAAEKMYHTHRRRRLVRKRKKDLTQTASSTARAMEELQDQEGWEYASLIGWKFHWKQRSSDTFRRRRWRRKMAPSETHGAAAIFKLEGALGADTTEDGDEKSLEKQKHSATTVFGANTPIVSCNFDRVYIYHLRCYVYQARNLLALDKDSFSDPYAHICFLHRSKTTEIIHSTLNPTWDQTIIFDEVEIYGEPQTVLQNPPKVIMELFDNDQVGKDEFLGRSIFSPVVKLNSEMDITPKLLWHPVMNGDKACGDVLVTAELILRGKDGSNLPILPPQRAPNLYMVPQGIRPVVQLTAIEILAWGLRNMKNFQMASITSPSLVVECGGERVESVVIKNLKKTPNFPSSVLFMKVFLPKEELYMPPLVIKVIDHRQFGRKPVVGQCTIERLDRFRCDPYAGKEDIVPQLKASLLSAPPCRDIVIEMEDTKPLLASKLTEKEEEIVDWWSKFYASSGEHEKCGQYIQKGYSKLKIYNCELENVAEFEGLTDFSDTFKLYRGKSDASAG

SEQ ID NO: 887340 - protein, 1620 aa, Homo sapiens
NPPFTGRELLSGGATRSSSALGEILPSLGENFSPRAVRPGAPAPESPLRLLKLAFYQLRTMLRVIVESASNIPKTKFGKPDPIVSVIFKDEKKKTKKVDNELNPVWNEILEFDLRGIPLDFSSSLGIIVKDFETIGQNKLIGTATVALKDLTGDQSRSLPYKLISLLNEKGQDTGATIDLVIGYDPPSAPHPNDLSGPSVPGMGGDGEEDEGDEDRLDNAVRGPGPKGPVGTVSEAQLARRLTKVKNSRRMLSNKPQDFQIRVRVIEGRQLSGNNIRPVVKVHVCGQTHRTRIKRGNNPFFDELFFYNVNMTPSELMDEIISIRVYNSHSLRADCLMGEFKIDVGFVYDEPGHAVMRKWLLLNDPEDTSSGSKGYMKVSMFVLGTGDEPPPERRDRDNDSDDVESNLLLPAGIALRWVTFLLKIYRAEDIPQMDDAFSQTVKEIFGGNADKKNLVDPFVEVSFAGKKVCTNIIEKNANPEWNQVVNLQIKFPSVCEKIKLTIYDWDRLTKNDVVGTTYLHLSKIAASGGEVEDFSSSGTGAASYTVNTGETEVGFVPTFGPCYLNLYGSPREYTGFPDPYDELNTGKGEGVAYRGRILVELATFLEKTPPDKKLEPISNDDLLVVEKYQRRRKYSLSAVFHSATMLQDVGEAIQFEVSIGNYGNKFDTTCKPLASTTQYSRAVFDGNYYYYLPWAHTKPVVTLTSYWEDISHRLDAVNTLLAMAERLQTNIEALKSGIQGKIPANQLAELWLKLIDEVIEDTRYTLPLTEGKANVTVLDTQIRKLRSRSLSQIHEAAVRMRSEATDVKSTLAEIEDWLDKLMQLTEEPQNSMPDIIIWMIRGEKRLAYARIPAHQVLYSTSGENASGKYCGKTQTIFLKYPQEKNNGPKVPVELRVNIWLGLSAVEKKFNSFAEGTFTVFAEMYENQALMFGKWGTSGLVGRHKFSDVTGKIKLKREFFLPPKGWEWEGEWIVDPERSLLTEADAGHTEFTDEVYQNESRYPGGDWKPAEDTYTDANGDKAASPSELTCPPGWEWEDDAWSYDINRAVDEKGWEYGITIPPDHKPKSWVAAEKMYHTHRRRRLVRKRKKDLTQTASSTARAMEELQDQEGWEYASLIGWKFHWKQRSSDTFRRRRWRRKMAPSETHGAAAIFKLEGALGADTTEDGDEKSLEKQKHSATTVFGANTPIVSCNFDRVYIYHLRCYVYQARNLLALDKDSFSDPYAHICFLHRSKTTEIIHSTLNPTWDQTIIFDEVEIYGEPQTVLQNPPKVIMELFDNDQVGKDEFLGRSIFSPVVKLNSEMDITPKLLWHPVMNGDKACGDVLVTAELILRGKDGSNLPILPPQRAPNLYMVPQGIRPVVQLTAIEILAWGLRNMKNFQMASITSPSLVVECGGERVESVVIKNLKKTPNFPSSVLFMKVFLPKEELYMPPLVIKVIDHRQFGRKPVVGQCTIERLDRFRCDPYAGKEDIVPQLKASLLSAPPCRDIVIEMEDTKPLLASKLTEKEEEIVDWWSKFYASSGEHEKCGQYIQKGYSKLKIYNCELENVAEFEGLTDFSDTFKLYRGKSDENEDPSVVGEFKGSFRIYPLPDDPSVPAPPRQFRELPDSVPICRGSSRSPH

SEQ ID NO: 887341 - protein, 1522 aa, Homo sapiens
NPPFTGRELLSGGATRSSSALGEILPSLGENFSPRAVRPGAPAPESPLRLLKLAFYQLRTMLRVIVESASNIPKTKFGKPDPIVSVIFKDEKKKTKKVDNELNPVWNEILEFDLRGIPLDFSSSLGIIVKDFETIGQNKLIGTATVALKDLTGDQSRSLPYKLISLLNEKGQDTGATIDLVIGYDPPSAPHPNDLSGPSVPGMGGDGEEDEGDEDRLDNAVRGPGPKGPVGTVSEAQLARRLTKVKNSRRMLSNKPQDFQIRVRVIEGRQLSGNNIRPVVKVHVCGQTHRTRIKRGNNPFFDELFFYNVNMTPSELMDEIISIRVYNSHSLRADCLMGEFKIDVGFVYDEPGHAVMRKWLLLNDPEDTSSGSKGYMKVSMFVLGTGDEPPPERRDRDNDSDDVESNLLLPAGIALRWVTFLLKIYRAEDIPQMDDAFSQTVKEIFGGNADKKNLVDPFVEVSFAGKKVCTNIIEKNANPEWNQVVNLQIKFPSVCEKIKLTIYDWDRLTKNDVVGTTYLHLSKIAASGGEVEDFSSSGTGAASYTVNTGETEVGFVPTFGPCYLNLYGSPREYTGFPDPYDELNTGKGEGVAYRGRILVELATFLEKTPPDKKLEPISNDDLLVVEKYQRRRKYSLSAVFHSATMLQDVGEAIQFEVSIGNYGNKFDTTCKPLASTTQYSRAVFDGNYYYYLPWAHTKPVVTLTSYWEDISHRLDAVNTLLAMAERLQTNIEALKSGIQGKIPANQLAELWLKLIDEVIEDTRYTLPLTEGKANVTVLDTQIRKLRSRSLSQIHEAAVRMRSEATDVKSTLAEIEDWLDKLMQLTEEPQNSMPDIIIWMIRGEKRLAYARIPAHQVLYSTSGENASGKYCGKTQTIFLKYPQEKNNGPKVPVELRVNIWLGLSAVEKKFNSFAEGTFTVFAEMYENQALMFGKWGTSGLVGRHKFSDVTGKIKLKREFFLPPKGWEWEGEWIVDPERSLLTEADAGHTEFTDEVYQNESRYPGGDWKPAEDTYTDANGDKAASPSELTCPPGWEWEDDAWSYDINRAVDEKGWEYGITIPPDHKPKSWVAAEKMYHTHRRRRLVRKRKKDLTQTASSTARAMEELQDQEGWEYASLIGWKFHWKQRSSDTFRRRRWRRKMAPSETHGAAAIFKLEGALGADTTEDGDEKSLEKQKHSATTVFGANTPIVSCNFDRVYIYHLRCYVYQARNLLALDKDSFSDPYAHICFLHRSKTTEIIHSTLNPTWDQTIIFDEVEIYGEPQTVLQNPPKVIMELFDNDQVGKDEFLGRSIFSPVVKLNSEMDITPKLLWHPVMNGDKACGDVLVTAELILRGKDGSNLPILPPQRAPNLYMVPQGIRPVVQLTAIEILAWGLRNMKNFQMASITSPSLVVECGGERVESVVIKNLKKTPNFPSSVLFMKVFLPKEELYMPPLVIKVIDHRQFGRKPVVGQCTIERLDRFRCDPYAGKEDIVPQLKASLLSAPPCRDIVIEMEDTKPLLASKLTEKELISGCCQFYLLCLDV

SEQ ID NO: 887342 - protein, 505 aa, Homo sapiens
NPPFTGRELLSGGATRSSSALGEILPSLGENFSPRAVRPGAPAPESPLRLLKLAFYQLRTMLRVIVESASNIPKTKFGKPDPIVSVIFKDEKKKTKKVDNELNPVWNEILEFDLRGIPLDFSSSLGIIVKDFETIGQNKLIGTATVALKDLTGDQSRSLPYKLISLLNEKGQDTGATIDLVIGYDPPSAPHPNDLSGPSVPGMGGDGEEDEGDEDRLDNAVRGPGPKGPVGTVSEAQLARRLTKVKNSRRMLSNKPQDFQIRVRVIEGRQLSGNNIRPVVKVHVCGQTHRTRIKRGNNPFFDELFFYNVNMTPSELMDEIISIRVYNSHSLRADCLMGEFKIDVGFVYDEPGHAVMRKWLLLNDPEDTSSGSKGYMKVSMFVLGTGDEPPPERRDRDNDSDDVESNLLLPAGIALRWVTFLLKIYRAEDIPQMDDAFSQTVKEIFGGNADKKNLVDPFVEVSFAGKKVCTNIIEKNANPEWNQVVNLQIKFPSVCEKIKLTIYDW

SEQ ID NO: 887343 - protein, 220 aa, Homo sapiens
NPPFTGRELLSGGATRSSSALGEILPSLGENFSPRAVRPGAPAPESPLRLLKLAFYQLRTMLRVIVESASNIPKTKFGKPDPIVSVIFKDEKKKTKKVDNELNPVWNEILEFDLRGIPLDFSSSLGIIVKDFETIGQNKLIGTATVALKDLTGDQSRSLPYKLISLLNEKGQDTGATIDLVIGYDPPSAPHPNDLSGPSVPGMGGKLTLLKAQPPPGGGC

SEQ ID NO: 887344 - protein, 304 aa, Homo sapiens
NPPFTGRELLSGGATRSSSALGEILPSLGENFSPRAVRPGAPAPESPLRLLKLAFYQLRTMLRVIVESASNIPKTKFGKPDPIVSVIFKGSMSQIRIEAGVSACEPGWPFCPKFHADSQAVKLNLAEIRLHRPLRPISTLRLDDSSKQSSKQKDEKKKTKKVDNELNPVWNEILEFDLRGIPLDFSSSLGIIVKDFETIGQNKLIGTATVALKDLTGDQSRSLPYKLISLLNEKGQDTGATIDLVIGYDPPSAPHPNDLSGPSVPGMGGDGEEEEGDVNTGERNKHEDVGADPARPDGGTNSMF

SEQ ID NO: 887345 - protein, 2121 aa, Homo sapiens
NPPFTGRELLSGGATRSSSALGEILPSLGENFSPRAVRPGAPAPESPLRLLKLAFYQLRTMLRVIVESASNIPKTKFGKPDPIVSVIFKDEKKKTKKVDNELNPVWNEILEFDLRGIPLDFSSSLGIIVKDFETIGQNKLIGTATVALKDLTGDQSRSLPYKLISLLNEKGQDTGATIDLVIGYDPPSAPHPNDLSGPSVPGMGGDGEEDEGDEDRLDNAVRGPGPKGPVGTVSEAQLARRLTKVKNSRRMLSNKPQDFQIRVRVIEGRQLSGNNIRPVVKVHVCGQTHRTRIKRGNNPFFDELFFYNVNMTPSELMDEIISIRVYNSHSLRADCLMGEFKIDVGFVYDEPGHAVMRKWLLLNDPEDTSSGSKGYMKVSMFVLGTGDEPPPERRDRDNDSDDVESNLLLPAGIALRWVTFLLKIYRAEDIPQMDDAFSQTVKEIFGGNADKKNLVDPFVEVSFAGKKVCTNIIEKNANPEWNQVVNLQIKFPSVCEKIKLTIYDWDRLTKNDVVGTTYLHLSKIAASGGEVEDFSSSGTGAASYTVNTGETEVGFVPTFGPCYLNLYGSPREYTGFPDPYDELNTGKGEGVAYRGRILVELATFLEKTPPDKKLEPISNDDLLVVEKYQRRRKYSLSAVFHSATMLQDVGEAIQFEVSIGNYGNKFDTTCKPLASTTQYSRAVFDGNYYYYLPWAHTKPVVTLTSYWEDISHRLDAVNTLLAMAERLQTNIEALKSGIQGKIPANQLAELWLKLIDEVIEDTRYTLPLTEGKANVTVLDTQIRKLRSRSLSQIHEAAVRMRSEATDVKSTLAEIEDWLDKLMQLTEEPQNSMPDIIIWMIRGEKRLAYARIPAHQVLYSTSGENASGKYCGKTQTIFLKYPQEKNNGPKVPVELRVNIWLGLSAVEKKFNSFAEGTFTVFAEMYENQALMFGKWGTSGLVGRHKFSDVTGKIKLKREFFLPPKGWEWEGEWIVDPERSLLTEADAGHTEFTDEVYQNESRYPGGDWKPAEDTYTDANGDKAASPSELTCPPGWEWEDDAWSYDINRAVDEKGWEYGITIPPDHKPKSWVAAEKMYHTHRRRRLVRKRKKDLTQTASSTARAMEELQDQEGWEYASLIGWKFHWKQRSSDTFRRRRWRRKMAPSETHGAAAIFKLEGALGADTTEDGDEKSLEKQKHSATTVFGANTPIVSCNFDRVYIYHLRCYVYQARNLLALDKDSFSDPYAHICFLHRSKTTEIIHSTLNPTWDQTIIFDEVEIYGEPQTVLQNPPKVIMELFDNDQVGKDEFLGRSIFSPVVKLNSEMDITPKLLWHPVMNGDKACGDVLVTAELILRGKDGSNLPILPPQRAPNLYMVPQGIRPVVQLTAIEILAWGLRNMKNFQMASITSPSLVVECGGERVESVVIKNLKKTPNFPSSVLFMKVFLPKEELYMPPLVIKVIDHRQFGRKPVVGQCTIERLDRFRCDPYAGKEDIVPQLKASLLSAPPCRDIVIEMEDTKPLLASKLTEKEEEIVDWWSKFYASSGEHEKCGQYIQKGYSKLKIYNCELENVAEFEGLTDFSDTFKLYRGKSDENEDPSVVGEFKGSFRIYPLPDDPSVPAPPRQFRELPDSVPQECTVRIYIVRGLELQPQDNNGLCDPYIKITLGKKVIEDRDHYIPNTLNPVFGRMYELSCYLPQEKDLKISVYDYDTFTRDEKVGETIIDLENRFLSRFGSHCGIPEEYCVSGVNTWRDQLRPTQLLQNVARFKGFPQPILSEDGSRIRYGGRDYSLDEFEANKILHQHLGAPEERLALHILRTQGLVPEHVETRTLHSTFQPNISQGKLQMWVDVFPKSLGPPGPPFNITPRKAKKYYLRVIIWNTKDVILDEKSITGEEMSDIYVKGWIPGNEENKQKTDVHYRSLDGEGNFNWRFVFPFDYLPAEQLCIVAKKEHFWSIDQTEFRIPPRLIIQIWDNDKFSLDDYLGFLELDLRHTIIPAKSPEKCRLDMIPDLKAMNPLKAKTASLFEQKSMKGWWPCYAEKDGARVMAGKVEMTLEILNEKEADERPAGKGRDEPNMNPKLDLPNRPETSFLWFTNPCKTMKFIVWRRFKWVIIGLLFLLILLLFVAVLLYSLPNYLSMKIVKPNV

SEQ ID NO: 887346 - protein, 2101 aa, Homo sapiens
MKHVFFNQGLMTHQTLTAPKGILFGSCLVNALLVNWLVKKSNPNMRGEEGFDDLIETLKPDPIVSVIFKDEKKKTKKVDNELNPVWNEILEFDLRGIPLDFSSSLGIIVKDFETIGQNKLIGTATVALKDLTGDQSRSLPYKLISLLNEKGQDTGATIDLVIGYDPPSAPHPNDLSGPSVPGMGGDGEEDEGDEDRLDNAVRGPGPKGPVGTVSEAQLARRLTKVKNSRRMLSNKPQDFQIRVRVIEGRQLSGNNIRPVVKVHVCGQTHRTRIKRGNNPFFDELFFYNVNMTPSELMDEIISIRVYNSHSLRADCLMGEFKIDVGFVYDEPGHAVMRKWLLLNDPEDTSSGSKGYMKVSMFVLGTGDEPPPERRDRDNDSDDVESNLLLPAGIALRWVTFLLKIYRAEDIPQMDDAFSQTVKEIFGGNADKKNLVDPFVEVSFAGKKVCTNIIEKNANPEWNQVVNLQIKFPSVCEKIKLTIYDWDRLTKNDVVGTTYLHLSKIAASGGEVEDFSSSGTGAASYTVNTGETEVGFVPTFGPCYLNLYGSPREYTGFPDPYDELNTGKGEGVAYRGRILVELATFLEKTPPDKKLEPISNDDLLVVEKYQRRRKYSLSAVFHSATMLQDVGEAIQFEVSIGNYGNKFDTTCKPLASTTQYSRAVFDGNYYYYLPWAHTKPVVTLTSYWEDISHRLDAVNTLLAMAERLQTNIEALKSGIQGKIPANQLAELWLKLIDEVIEDTRYTLPLTEGKANVTVLDTQIRKLRSRSLSQIHEAAVRMRSEATDVKSTLAEIEDWLDKLMQLTEEPQNSMPDIIIWMIRGEKRLAYARIPAHQVLYSTSGENASGKYCGKTQTIFLKYPQEKNNGPKVPVELRVNIWLGLSAVEKKFNSFAEGTFTVFAEMYENQALMFGKWGTSGLVGRHKFSDVTGKIKLKREFFLPPKGWEWEGEWIVDPERSLLTEADAGHTEFTDEVYQNESRYPGGDWKPAEDTYTDANGDKAASPSELTCPPGWEWEDDAWSYDINRAVDEKGWEYGITIPPDHKPKSWVAAEKMYHTHRRRRLVRKRKKDLTQTASSTARAMEELQDQEGWEYASLIGWKFHWKQRSSDTFRRRRWRRKMAPSETHGAAAIFKLEGALGADTTEDGDEKSLEKQKHSATTVFGANTPIVSCNFDRVYIYHLRCYVYQARNLLALDKDSFSDPYAHICFLHRSKTTEIIHSTLNPTWDQTIIFDEVEIYGEPQTVLQNPPKVIMELFDNDQVGKDEFLGRSIFSPVVKLNSEMDITPKLLWHPVMNGDKACGDVLVTAELILRGKDGSNLPILPPQRAPNLYMVPQGIRPVVQLTAIEILAWGLRNMKNFQMASITSPSLVVECGGERVESVVIKNLKKTPNFPSSVLFMKVFLPKEELYMPPLVIKVIDHRQFGRKPVVGQCTIERLDRFRCDPYAGKEDIVPQLKASLLSAPPCRDIVIEMEDTKPLLASKLTEKEEEIVDWWSKFYASSGEHEKCGQYIQKGYSKLKIYNCELENVAEFEGLTDFSDTFKLYRGKSDENEDPSVVGEFKGSFRIYPLPDDPSVPAPPRQFRELPDSVPQECTVRIYIVRGLELQPQDNNGLCDPYIKITLGKKVIEDRDHYIPNTLNPVFGRMYELSCYLPQEKDLKISVYDYDTFTRDEKVGETIIDLENRFLSRFGSHCGIPEEYCVSGVNTWRDQLRPTQLLQNVARFKGFPQPILSEDGSRIRYGGRDYSLDEFEANKILHQHLGAPEERLALHILRTQGLVPEHVETRTLHSTFQPNISQGKLQMWVDVFPKSLGPPGPPFNITPRKAKKYYLRVIIWNTKDVILDEKSITGEEMSDIYVKGWIPGNEENKQKTDVHYRSLDGEGNFNWRFVFPFDYLPAEQLCIVAKKEHFWSIDQTEFRIPPRLIIQIWDNDKFSLDDYLGFLELDLRHTIIPAKSPEKCRLDMIPDLKAMNPLKAKTASLFEQKSMKGWWPCYAEKDGARVMAGKVEMTLEILNEKEADERPAGKGRDEPNMNPKLDLPNRPETSFLWFTNPCKTMKFIVWRRFKWVIIGLLFLLILLLFVAVLLYSLPNYLSMKIVKPNV

SEQ ID NO: 887347 - protein, 1867 aa, Homo sapiens
NPPFTGRELLSGGATRSSSALGEILPSLGENFSPRAVRPGAPAPESPLRLLKLAFYQLRTMLRVIVESASNIPKTKFGKPDPIVSVIFKDEKKKTKKVDNELNPVWNEILEFDLRGIPLDFSSSLGIIVKDFETIGQNKLIGTATVALKDLTGDQSRSLPYKLISLLNEKGQDTGATIDLVIGYDPPSAPHPNDLSGPSVPGMGGDGEEDEGDEDRLDNAVRGPGPKGPVGTVSEAQLARRLTKVKNSRRMLSNKPQDFQIRVRVIEGRQLSGNNIRPVVKVHVCGQTHRTRIKRGNNPFFDELFFYNVNMTPSELMDEIISIRVYNSHSLRADCLMGEFKIDVGFVYDEPGHAVMRKWLLLNDPEDTSSGSKGYMKVSMFVLGTGDEPPPERRDRDNDSDDVESNLLLPAGIALRWVTFLLKIYRAEDIPQMDDAFSQTVKEIFGGNADKKNLVDPFVEVSFAGKKVCTNIIEKNANPEWNQVVNLQIKFPSVCEKIKLTIYDWDRLTKNDVVGTTYLHLSKIAASGGEVEDFSSSGTGAASYTVNTGETEVGFVPTFGPCYLNLYGSPREYTGFPDPYDELNTGKGEGVAYRGRILVELATFLEKTPPDKKLEPISNDDLLVVEKYQRRRKYSLSAVFHSATMLQDVGEAIQFEVSIGNYGNKFDTTCKPLASTTQYSRAVFDGNYYYYLPWAHTKPVVTLTSYWEDISHRLDAVNTLLAMAERLQTNIEALKSGIQGKIPANQLAELWLKLIDEVIEDTRYTLPLTEGKANVTVLDTQIRKLRSRSLSQIHEAAVRMRSEATDVKSTLAEIEDWLDKLMQLTEEPQNSMPDIIIWMIRGEKRLAYARIPAHQVLYSTSGENASGKYCGKTQTIFLKYPQEKNNGPKVPVELRVNIWLGLSAVEKKFNSFAEGTFTVFAEMYENQALMFGKWGTSGLVGRHKFSDVTGKIKLKREFFLPPKGWEWEGEWIVDPERSLLTEADAGHTEFTDEVYQNESRYPGGDWKPAEDTYTDANGDKAASPSELTCPPGWEWEDDAWSYDINRAVDEKGWEYGITIPPDHKPKSWVAAEKMYHTHRRRRLVRKRKKDLTQTASSTARAMEELQDQEGWEYASLIGWKFHWKQRSSDTFRRRRWRRKMAPSETHGAAAIFKLEGALGADTTEDGDEKSLEKQKHSATTVFGANTPIVSCNFDRVYIYHLRCYVYQARNLLALDKDSFSDPYAHICFLHRSKTTEIIHSTLNPTWDQTIIFDEVEIYGEPQTVLQNPPKVIMELFDNDQVGKDEFLGRSIFSPVVKLNSEMDITPKLLWHPVMNGDKACGDVLVTAELILRGKDGSNLPILPPQRAPNLYMVPQGIRPVVQLTAIEILAWGLRNMKNFQMASITSPSLVVECGGERVESVVIKNLKKTPNFPSSVLFMKVFLPKEELYMPPLVIKVIDHRQFGRKPVVGQCTIERLDRFRCDPYAGKEDIVPQLKASLLSAPPCRDIVIEMEDTKPLLASKLTEKCFKQYVNSTQQNGFSSDSACMYEKEEEIVDWWSKFYASSGEHEKCGQYIQKGYSKLKIYNCELENVAEFEGLTDFSDTFKLYRGKSDENEDPSVVGEFKGSFRIYPLPDDPSVPAPPRQFRELPDSVPQECTVRIYIVRGLELQPQDNNGLCDPYIKITLGKKVIEDRDHYIPNTLNPVFGRMYELSCYLPQEKDLKISVYDYDTFTRDEKVGETIIDLENRFLSRFGSHCGIPEEYCVSGVNTWRDQLRPTQLLQNVARFKGFPQPILSEDGSRIRYGGRDYSLDEFEANKILHQHLGAPEERLALHILRTQGLVPEHVETRTLHSTFQPNISQILPACDHLEHQGRYLGREKHHRRGNE

SEQ ID NO: 887348 - protein, 2108 aa, Homo sapiens; identical to SEQ ID NO: 887335

SEQ ID NO: 887349 - protein, 1600 aa, Homo sapiens
NPPFTGRELLSGGATRSSSALGEILPSLGENFSPRAVRPGAPAPESPLRLLKLAFYQLRTMLRVIVESASNIPKTKFGKPDPIVSVIFKDEKKKTKKVDNELNPVWNEILEFDLRGIPLDFSSSLGIIVKDFETIGQNKLIGTATVALKDLTGDQSRSLPYKLISLLNEKGQDTGATIDLVIGYDPPSAPHPNDLSGPSVPGMGGDGEEDEGDEDRLDNAVRGPGPKGPVGTVSEAQLARRLTKVKNSRRMLSNKPQDFQIRVRVIEGRQLSGNNIRPVVKVHVCGQTHRTRIKRGNNPFFDELFFYNVNMTPSELMDEIISIRVYNSHSLRADCLMGEFKIDVGFVYDEPGHAVMRKWLLLNDPEDTSSGSKGYMKVSMFVLGTGDEPPPERRDRDNDSDDVESNLLLPAGIALRWVTFLLKIYRAEDIPQMDDAFSQTVKEIFGGNADKKNLVDPFVEVSFAGKKVCTNIIEKNANPEWNQVVNLQIKFPSVCEKIKLTIYDWDRLTKNDVVGTTYLHLSKIAASGGEVEDFSSSGTGAASYTVNTGETEVGFVPTFGPCYLNLYGSPREYTGFPDPYDELNTGKGEGVAYRGRILVELATFLEKTPPDKKLEPISNDDLLVVEKYQRRRKYSLSAVFHSATMLQDVGEAIQFEVSIGNYGNKFDTTCKPLASTTQYSRAVFDGNYYYYLPWAHTKPVVTLTSYWEDISHRLDAVNTLLAMAERLQTNIEALKSGIQGKIPANQLAELWLKLIDEVIEDTRYTLPLTEGKANVTVLDTQIRKLRSRSLSQIHEAAVRMRSEATDVKSTLAEIEDWLDKLMQLTEEPQNSMPDIIIWMIRGEKRLAYARIPAHQVLYSTSGENASGKYCGKTQTIFLKYPQEKNNGPKVPVELRVNIWLGLSAVEKKFNSFAEGTFTVFAEMYENQALMFGKWGTSGLVGRHKFSDVTGKIKLKREFFLPPKGWEWEGEWIVDPERSLLTEADAGHTEFTDEVYQNESRYPGGDWKPAEDTYTDANGDKAASPSELTCPPGWEWEDDAWSYDINRAVDEKGWEYGITIPPDHKPKSWVAAEKMYHTHRRRRLVRKRKKDLTQTASSTARAMEELQDQEGWEYASLIGWKFHWKQRSSDTFRRRRWRRKMAPSETHGAAAIFKLEGALGADTTEDGDEKSLEKQKHSATTVFGANTPIVSCNFDRVYIYHLRCYVYQARNLLALDKDSFSDPYAHICFLHRSKTTEIIHSTLNPTWDQTIIFDEVEIYGEPQTVLQNPPKVIMELFDNDQVGKDEFLGRSIFSPVVKLNSEMDITPKLLWHPVMNGDKACGDVLVTAELILRGKDGSNLPILPPQRAPNLYMVPQGIRPVVQLTAIEILAWGLRNMKNFQMASITSPSLVVECGGERVESVVIKNLKKTPNFPSSVLFMKVFLPKEELYMPPLVIKVIDHRQFGRKPVVGQCTIERLDRFRCDPYAGKEDIVPQLKASLLSAPPCRDIVIEMEDTKPLLASKLTEKEEEIVDWWSKFYASSGEHEKCGQYIQKGYSKLKVPGSMLLWVENQHPLKLATGRAKRMTKRSLGWVLMSRAQENLCLPGEPSCMSFGFAKIPGT

SEQ ID NO: 887350 - protein, 1279 aa, Homo sapiens
NPPFTGRELLSGGATRSSSALGEILPSLGENFSPRAVRPGAPAPESPLRLLKLAFYQLRTMLRVIVESASNIPKTKFGKPDPIVSVIFKDEKKKTKKVDNELNPVWNEILEFDLRGIPLDFSSSLGIIVKDFETIGQNKLIGTATVALKDLTGDQSRSLPYKLISLLNEKGQDTGATIDLVIGYDPPSAPHPNDLSGPSVPGMGGDGEEDEGDEDRLDNAVRGPGPKGPVGTVSEAQLARRLTKVKNSRRMLSNKPQDFQIRVRVIEGRQLSGNNIRPVVKVHVCGQTHRTRIKRGNNPFFDELFFYNVNMTPSELMDEIISIRVYNSHSLRADCLMGEFKIDVGFVYDEPGHAVMRKWLLLNDPEDTSSGSKGYMKVSMFVLGTGDEPPPERRDRDNDSDDVESNLLLPAGIALRWVTFLLKIYRAEDIPQMDDAFSQTVKEIFGGNADKKNLVDPFVEVSFAGKKVCTNIIEKNANPEWNQVVNLQIKFPSVCEKIKLTIYDWDRLTKNDVVGTTYLHLSKIAASGGEVEDFSSSGTGAASYTVNTGETEVGFVPTFGPCYLNLYGSPREYTGFPDPYDELNTGKGEGVAYRGRILVELATFLEKTPPDKKLEPISNDDLLVVEKYQRRRKYSLSAVFHSATMLQDVGEAIQFEVSIGNYGNKFDTTCKPLASTTQYSRAVFDGNYYYYLPWAHTKPVVTLTSYWEDISHRLDAVNTLLAMAERLQTNIEALKSGIQGKIPANQLAELWLKLIDEVIEDTRYTLPLTEGKANVTVLDTQIRKLRSRSLSQIHEAAVRMRSEATDVKSTLAEIEDWLDKLMQLTEEPQNSMPDIIIWMIRGEKRLAYARIPAHQVLYSTSGENASGKYCGKTQTIFLKYPQEKNNGPKVPVELRVNIWLGLSAVEKKFNSFAEGTFTVFAEMYENQALMFGKWGTSGLVGRHKFSDVTGKIKLKREFFLPPKGWEWEGEWIVDPERSLLTEADAGHTEFTDEVYQNESRYPGGDWKPAEDTYTDANGDKAASPSELTCPPGWEWEDDAWSYDINRAVDEKGWEYGITIPPDHKPKSWVAAEKMYHTHRRRRLVRKRKKDLTQTASSTARAMEELQDQEGWEYASLIGWKFHWKQRSSDTFRRRRWRRKMAPSETHGAAAIFKLEGALGADTTEDGDEKSLEKQKHSATTVFGANTPIVSCNFDRVYIYHLRCYVYQARNLLALDKDSFSDPYAHICFLHRSKTTEIIHSTLNPTRSLQTSEFHFTFIGVCLSSCHCIGDRWWGPTGHG

SEQ ID NO: 887351 - protein, 435 aa, Homo sapiens
NPPFTGRELLSGGATRSSSALGEILPSLGENFSPRAVRPGAPAPESPLRLLKLAFYQLRTMLRVIVESASNIPKTKFGKPDPIVSVIFKDEKKKTKKVDNELNPVWNEILEFDLRGIPLDFSSSLGIIVKDFETIGQNKLIGTATVALKDLTGDQSRSLPYKLISLLNEKGQDTGATIDLVIGYDPPSAPHPNDLSGPSVPGMGGDGEEDEGDEDRLDNAVRGPGPKGPVGTVSEAQLARRLTKVKNSRRMLSNKPQDFQIRVRVIEGRQLSGNNIRPVVKVHVCGQTHRTRIKRGNNPFFDELFFYNVNMTPSELMDEIISIRVYNSHSLRADCLMGEFKIDVGFVYDEPGHAVMRKWLLLNDPEDTSSGSKGYMKVSMFVLGTGDEPPPERRDRDNDSDDVESNLLLPAGIALRWVTFLLKIYRAEDIPQSMY

SEQ ID NO: 887352 - protein, 240 aa, Homo sapiens
NPPFTGRELLSGGATRSSSALGEILPSLGENFSPRAVRPGAPAPESPLRLLKLAFYQLRTMLRVIVESASNIPKTKFGKPDPIVSVIFKDEKKKTKKVDNELNPVWNEILEFDLRGIPLDFSSSLGIIVKDFETIGQNKLIGTATVALKDLTGDQSRSLPYKLISLLNEKGQDTGATIDLVIGYDPPSAPHPNDLSGPSVPGMGGDGEEEEGDVNTGERNKHEDVGADPARPDGGTNSMF

SEQ ID NO: 887353 - protein, 110 aa, Homo sapiens
MCSEFLLLTYFFSLSLRKTTLFAAHVSGAVLTFGMGSLYMFVQTILSYQMQPKIHGKQVFWIRLLLVIWCGVSALSMLTCSSVLHSGNFGTDLEQKLHWNPEDKVRTYSL

SEQ ID NO: 887354 - protein, 266 aa, Homo sapiens
MWWFQQGLSFLPSALVIWTSAAFIFSYITAVTLHHIDPALPYISDTGTVAPEKCLFGAMLNIAAVLCIATIYVRYKQVHALSPEENVIIKLNKAGLVLGILSCLGLSIVANFQKTTLFAAHVSGAVLTFGMGSLYMFVQTILSYQMQPKIHGKQVFWIRLLLVIWCGVSALSMLTCSSVLHSGNFGTDLEQKLHWNPEDKGYVLHMITTAAEWSMSFSFFGFFLTYIRDFQKISLRVEANLHGLTLYDTAPCPINNERTRLLSRDI

SEQ ID NO: 887355 - protein, 266 aa, Homo sapiens; identical to SEQ ID NO: 887354

SEQ ID NO: 887356 - protein, 266 aa, Homo sapiens; identical to SEQ ID NO: 887354

SEQ ID NO: 887357 - protein, 266 aa, Homo sapiens; identical to SEQ ID NO: 887354

SEQ ID NO: 887358 - protein, 266 aa, Homo sapiens; identical to SEQ ID NO: 887354

SEQ ID NO: 887359 - protein, 266 aa, Homo sapiens; identical to SEQ ID NO: 887354

SEQ ID NO: 887360 - protein, 266 aa, Homo sapiens; identical to SEQ ID NO: 887354

SEQ ID NO: 887361 - protein, 215 aa, Homo sapiens
MWWFQQGLSFLPSALVIWTSAAFIFSYITAVTLHHIDPALPYISDTGTVAPEKCLFGAMLNIAAVLCIATIYVRYKQVHALSPEENVIIKLNKAGLVLGILSCLGLSIVANFQKTTLFAAHVSGAVLTFGMGSLYMFVQTILSYQMQPKIHGKQVFWIRLLLVIWCGVSALSMLTCSSVLHSGNFGTDLEQKLHWNPEDKILSKYEEHCDGRRVF

SEQ ID NO: 887362 - protein, 136 aa, Homo sapiens
MGSLYMFVQTILSYQMQPKIHGKQVFWIRLLLVIWCGVSALSMLTCSSVLHSGNFGTDLEQKLHWNPEDKGYVLHMITTAAEWSMSFSFFGFFLTYIRDFQKISLRVEANLHGLTLYDTAPCPINNERTRLLSRDI

SEQ ID NO: 887363 - protein, 122 aa, Homo sapiens
MWWFQQGLSFLPSALVIWTSAAFIFSYITAVTLHHIDPALPYISDTGTVAPEKCLFGAMLNIAAVLCIATIYVRYKQVHALSPEENVIIKLNKAGLVLGILSCLGLSIVANFQKTTLFAAHC

SEQ ID NO: 887364 - protein, 270 aa, Homo sapiens
MWWFQQGLSFLPSALVIWTSAAFIFSYITAVTLHHIDPALPYISDTGTVAPEKCLFGAMLNIAAVLCIATIYVRYKQVHALSPEENVIIKLNKAGLVLGILSCLGLSIVANFQKTTLFAAHVSGAVLTFGMGSLYMFVQTILSYQMQPKIHGKQVFWIRLLLVIWCGVSALSMLTCSSVLHSGNFGTDLEQKLHWNPEDKGYVLHMITTAAEWSMSFSFFGFFLTYIRDFQVRRHNIRFIQSDFLLLVQEGRLRELSIGNSPAFLKINCL

SEQ ID NO: 887365 - protein, 109 aa, Homo sapiens
PVTALRSLTLTPTSTPLEISPPTPADWVTDRRQHVHDTFSDCRKGEQGLNEQRRRRAPRCRERAPGPAGLLGSAPRGPALSPFSIGASAPAASASRSGKAKRSGDPQTA

SEQ ID NO: 887366 - protein, 124 aa, Homo sapiens
PVTALRSLTLTPTSTPLEISPPTPADWVTDRRQHVHDTFSDCRKGEQGLNEQRRRRAPRCRERAPGPAGLLGSAPRGPALSPFSIGASAPAASASRSGKCLMPSSVSRVFSWSQAKRSGDPQTA

SEQ ID NO: 887367 - protein, 136 aa, Homo sapiens; identical to SEQ ID NO: 887362

SEQ ID NO: 887368 - protein, 109 aa, Homo sapiens; identical to SEQ ID NO: 887365

SEQ ID NO: 887369 - protein, 215 aa, Homo sapiens; identical to SEQ ID NO: 887361

SEQ ID NO: 887370 - protein, 36 aa, Homo sapiens
MAHAHTPSCGYLTDLTIRRLHRQLSYSVDSQLTWIE

SEQ ID NO: 887371 - protein, 197 aa, Homo sapiens
MNLEKLSKPELLTLFSILEGELEARDLVIEALKAQHRDTFIEERYGKYNISDPLMALQRDFETLKEKNDGEKQPVCTNPLSILKVVMKQCKNMQERMLSQLAAAESRHRKVILDLEEERQRHAQDTAEGDDVTYMLEKERERLTQQLNLKNPSEKVWNREAPKQLEKSVRPSRFILLLVQKAPPGTEEDRSSLPGFG

SEQ ID NO: 887372 - protein, 639 aa, Homo sapiens
MNLEKLSKPELLTLFSILEGELEARDLVIEALKAQHRDTFIEERYGKYNISDPLMALQRDFETLKEKNDGEKQPVCTNPLSILKVVMKQCKNMQERMLSQLAAAESRHRKVILDLEEERQRHAQDTAEGDDVTYMLEKERERLTQQLEFEKSQVKKFEKEQKKLSSQLEEERSRHKQLSSMLVLECKKATNKAAEEGQKAGELSLKLEKEKSRVSKLEEELAAERKRGLQTEAQVEKQLSEFDIEREQLRAKLNREENRTKTLKEEMESLKKIVKDLEASHQHSSPNEQLKKPVTVSKGTATEPLMLMSVFCQTESFPAERTHGSNIAKMTNTGLPGPATPAYSYAKTNGHCDPEIQTTRELTAGNNVENQVPPREKSVALAQEKPVENGGCPVGIETPVPMPSPLSSSGSSLSPSSTASSSLTSSPCSSPVLTKRLLGSSASSPGYQSSYQVGINQRFHAARHKFQSQADQDQQASGLQSPPSRDLSPTLIDNSAAKQLARNTVTQVLSRFTSQQGPIKPVSPNSSPFGTDYRNLANTANPRGDTSHSPTPGKVSSPLSPLSPGIKSPTIPRAERGNPPPIPPKKPGLTPSPSATTPLTKTHSQAASLTTAEDLASSCSSNTVVANGKDVELLLPTSS

SEQ ID NO: 887373 - protein, 639 aa, Homo sapiens; identical to SEQ ID NO: 887372

SEQ ID NO: 887374 - protein, 505 aa, Homo sapiens [sequence omitted]

SEQ ID NO: 887375 - protein, 639 aa, Homo sapiens; identical to SEQ ID NO: 887372

SEQ ID NO: 887376 - protein, 639 aa, Homo sapiens; identical to SEQ ID NO: 887372

SEQ ID NO: 887377 - protein, 628 aa, Homo sapiens [sequence omitted]

SEQ ID NO: 887378 - protein, 339 aa, Homo sapiens
MLEKERERLTQQLEFEKSQVKKFEKEQKKLSSQLEEERSRHKQLSSMLVLECKKATNKAAEEGQKAGELSLKLEKEKSRVSKLEEELAAERKRGLQTEAQVEKQLSEFDIEREQLRAKLNREENRTKTLKEEMESLKKIVKDLEASHQHSSPNEQLKKPVTVSKGTATEPLMLMSVFCQTESFPAERTHGSNIAKMTNTGLPGPATPAYSYAKTNGHCDPEIQTTRELTAGNNVENQVPPREKSVALAQEKPVENGGCPVGIETPVPMPSPLSSSGSSLSPSSTASSSLTSSPCSSPVLTKRLLGSSASSPGYQSSYQVGINQRFHAARHKFQSSALDL

SEQ ID NO: 887379 - protein, 639 aa, Homo sapiens; identical to SEQ ID NO: 887372

SEQ ID NO: 887380 - protein, 639 aa, Homo sapiens; identical to SEQ ID NO: 887372

SEQ ID NO: 887381 - protein, 639 aa, Homo sapiens; identical to SEQ ID NO: 887372

SEQ ID NO: 887382 - protein, 639 aa, Homo sapiens; identical to SEQ ID NO: 887372

SEQ ID NO: 887383 - protein, 558 aa, Homo sapiens
MNLEKLSKPELLTLFSILEGELEARDLVIEALKAQHRDTFIEERYGKYNISDPLMALQRDFETLKEKNDGEKQPVCTNPLSILKVVMKQCKNMQERMLSQLAAAESRHRKVILDLEEERQRHAQDTAEGDDVTYMLEKERERLTQQLEFEKSQVKKFEKEQKKLSSQLEEERSRHKQLSSMLVLECKKATNKAAEEGQKAGELSLKLEKEKSRVSKLEEELAAERKRGLQTEAQVEKQLSEFDIEREQLRAKLNREENRTKTLKEEMESLKKIVKDLEASHQHSSPNEQLKKPVTVSKGTATEPLMLMSVFCQTESFPAERTHGSNIAKMTNTGLPGPATPAYSYAKTNGHCDPEIQTTRELTAGNNVENQVPPREKSVALAQEKPVENGGCPVGIETPVPMPSPLSSSGSSLSPSSTASSSLTSSPCSSPVLTKRLLGSSASSPGYQSSYQVGINQRFHAARHKFQSQADQDQQASGLQSPPSRDLSPTLIDNSAAKQLARNTVTQVLSRFTSQQGPIKPVSPNSSPFGTDYRNAASLTTAEDLASSCSSNTVVANG

SEQ ID NO: 887384 - protein, 1269 aa, Homo sapiens
MGDVKNFLYAWCGKRKMTPSYEIRAVGNKNRQKFMCEVQVEGYNYTGMGNSTNKKDAQSNAARDFVNYLVRINEIKSEEVPAFGVASPPPLTDTPDTTANAEGDLPTTMGGPLPPHLALKAENNSEVGASGYGVPGPTWDRGANLKDYYSRKEEQEVQATLESEEVDLNAGLHGNWTLENAKARLNQYFQKEKIQGEYKYTQVGPDHNRSFIAEMTIYIKQLGRRIFAREHGSNKKLAAQSCALSLVRQLYHLGVVEAYSGLTKKKEGETVEPYKVNLSQDLEHQLQNIIQELNLEILPPPEDPSVPVALNIGKLAQFEPSQRQNQVGVVPWSPPQSNWNPWTSSNIDEGPLAFATPEQISMDLKNELMYQLEQDHDLQAILQERELLPVKKFESEILEAISQNSVVIIRGATGCGKTTQVPQFILDDFIQNDRAAECNIVVTQPRRISAVSVAERVAFERGEEPGKSCGYSVRFESILPRPHASIMFCTVGVLLRKLEAGIRGISHVIVDEIHERDINTDFLLVVLRDVVQAYPEVRIVLMSATIDTSMFCEYFFNCPIIEVYGRTYPVQEYFLEDCIQMTHFVPPPKDKKKKDKDDDGGEDDDANCNLICGDEYGPETRLSMSQLNEKETPFELIEALLKYIETLNVPGAVLVFLPGWNLIYTMQKHLEMNPHFGSHRYQILPLHSQIPREEQRKVFDPVPVGVTKVILSTNIAETSITINDVVYVIDSCKQKVKLFTAHNNMTNYATVWASKTNLEQRKGRAGRVRPGFCFHLCSRARFERLETHMTPEMFRTPLHEIALSIKLLRLGGIGQFLAKAIEPPPLDAVIEAEHTLRELDALDANDELTPLGRILAKLPIEPRFGKMMIMGCIFYVGDAICTIAAATCFPEPFINEGKRLGYIHRNFAGNRFSDHVALLSVFQAWDDARMGGEEAEIRFCEHKRLNMATLRMTWEAKVQLKEILINSGFPEDCLLTQVFTNTGPDNNLDVVISLLAFGVYPNVCYHKEKRKILTTEGRNALIHKSSVNCPFSSQDMKYPSPFFVFGEKIRTRAISAKGMTLVTPLQLLLFASKKVQSDGQIVLVDDWIKLQISHEAAACITGLRAAMEALVVEVTKQPAIISQLDPVNERMLNMIRQISRPSAAGINLMIGSTRYGDGPRPPKMARYDNGSGYRRGGSSYSGGGYGGGYSSGGYGSGGYGGSANSFGQDMVQVLVEAIEEFPEVALEATLEETTEGLVEATEDLGDSSEEVVGGPMELATWTLKRRWRL

SEQ ID NO: 887385 - protein, 306 aa, Homo sapiens
MGDVKNFLYAWCGKRKMTPSYEIRAVGNKNRQKFMCEVQVEGYNYTGMGNSTNKKDAQSNAARDFVNYLVRINEIKSEEVPAFGVASPPPLTDTPDTTANAEGDLPTTMGGPLPPHLALKAENNSEVGASGYGVPGPTWDRGANLKDYYSRKEEQEVQATLESEEVDLNAGLHGNWTLENAKARLNQYFQKEKIQGEYKYTQVGPDHNRSFIAEMTIYIKQLGRRILGETMVTYELGPACGLSWSTTVHWRGELSGSKNRGTRSSKNFRFSETKSRYMPEMCLHYEDKLQECGHTWKEGKQTREKR

SEQ ID NO: 887386 - protein, 275 aa, Homo sapiens
VQAVSPASAGITGSPAAMTWQIKVLSSRDGVHHAGQAGLKLLIRTRAISAKGMTLVTPLQLLLFASKKVQSDGQIVLVDDWIKLQISHEAAACITGLRAAMEALVVEVTKQPAIISQLDPVNERMLNMIRQISRPSAAGINLMIGSTRYGDGPRPPKMARYDNGSGYRRGGSSYSGGGYGGGYSSGGYGSGGYGGSANSFRAGYGAGVGGGYRGVSRGGFRGNSGGDYRGPSGGYRGSGGFQRGGGRGAYGTGYLDIEEEVAAIKLGYVSSVCRQ

SEQ ID NO: 887387 - protein, 100 aa, Homo sapiens
MCCKNRIKRSRGNHFYQTCRIRHEMQKHLEMNHFGSHRYQILPLHSQIPREEQRKVFDPVPVGVTKVILSTNIAETSITINDVVYVIDSCKYLLSEALIM

SEQ ID NO: 887388 - protein, 1178 aa, Homo sapiens
MGDVKNFLYAWCGKRKMTPSYEIRAVGNKNRQKFMCEVQVEGYNYTGMGNSTNKKDAQSNAARDFVNYLVRINEIKSEEVPAFGVASPPPLTDTPDTTANAEGDLPTTMGGPLPPHLALKAENNSEVGASGYGVPGPTWDRGANLKDYYSRKEEQEVQATLESEEVDLNAGLHGNWTLENAKARLNQYFQKEKIQGEYKYTQVGPDHNRSFIAEMTIYIKQLGRRIFAREHGSNKKLAAQSCALSLVRQLYHLGVVEAYSGLTKKKEGETVEPYKVNLSQDLEHQLQNIIQELNLEILPPPEDPSVPVALNIGKLAQFEPSQRQNQVGVVPWSPPQSNWNPWTSSNIDEGPLAFATPEQISMDLKNELMYQLEQDHDLQAILQERELLPVKKFESEILEAISQNSVVIIRGATGCGKTTQVPQFILDDFIQNDRAAECNIVVTQPRRISAVSVAERVAFERGEEPGKSCGYSVRFESILPRPHASIMFCTVGVLLRKLEAGIRGISHVIVDEIHERDINTDFLLVVLRDVVQAYPEVRIVLMSATIDTSMFCEYFFNCPIIEVYGRTYPVQEYFLEDCIQMTHFVPPPKDKKKKDKDDDGGEDDDANCNLICGDEYGPETRLSMSQLNEKETPFELIEALLKYIETLNVPGAVLVFLPGWNLIYTMQKHLEMNPHFGSHRYQILPLHSQIPREEQRKVFDPVPVGVTKVILSTNIAETSITINDVVYVIDSCKQKVKLFTAHNNMTNYATVWASKTNLEQRKGRAGRVRPGFCFHLCSRARFERLETHMTPEMFRTPLHEIALSIKLLRLGGIGQFLAKAIEPPPLDAVIEAEHTLRELDALDANDELTPLGRILAKLPIEPRFGKMMIMGCIFYVGDAICTIAAATCFPEPFINEGKRLGYIHRNFAGNRFSDHVALLSVFQAWDDARMGGEEAEIRFCEHKRLNMATLRMTWEAKVQLKEILINSGFPEDCLLTQVFTNTGPDNNLDVVISLLAFGVYPNVCYHKEKRKILTTEGRNALIHKSSVNCPFSSQDMKYPSPFFVFGEKIRTRAISAKGMTLVTPLQLLLFASKKVQSDGQIVLVDDWIKLQISHEAAACITGLRAAMEALVVEVTKQPAIISQLDPVNERMLNMIRQISRPSAAGINLMIGSTRYGDGPRPPLLYPLPLSYRAILGST

SEQ ID NO: 887389 - protein, 1007 aa, Homo sapiens
MGDVKNFLYAWCGKRKMTPSYEIRAVGNKNRQKFMCEVQVEGYNYTGMGNSTNKKDAQSNAARDFVNYLVRINEIKSEEVPAFGVASPPPLTDTPDTTANAEGDLPTTMGGPLPPHLALKAENNSEVGASGYGVPGPTWDRGANLKDYYSRKEEQEVQATLESEEVDLNAGLHGNWTLENAKARLNQYFQKEKIQGEYKYTQVGPDHNRSFIAEMTIYIKQLGRRIFAREHGSNKKLAAQSCALSLVRQLYHLGVVEAYSGLTKKKEGETVEPYKVNLSQDLEHQLQNIIQELNLEILPPPEDPSVPVALNIGKLAQFEPSQRQNQVGVVPWSPPQSNWNPWTSSNIDEGPLAFATPEQISMDLKNELMYQLEQDHDLQAILQERELLPVKKFESEILEAISQNSVVIIRGATGCGKTTQVPQFILDDFIQNDRAAECNIVVTQPRRISAVSVAERVAFERGEEPGKSCGYSVRFESILPRPHASIMFCTVGVLLRKLEAGIRGISHVIVDEIHERDINTDFLLVVLRDVVQAYPEVRIVLMSATIDTSMFCEYFFNCPIIEVYGRTYPVQEYFLEDCIQMTHFVPPPKDKKKKDKDDDGGEDDDANCNLICGDEYGPETRLSMSQLNEKETPFELIEALLKYIETLNVPGAVLVFLPGWNLIYTMQKHLEMNPHFGSHRYQILPLHSQIPREEQRKVFDPVPVGVTKVILSTNIAETSITINDVVYVIDSCKQKVKLFTAHNNMTNYATVWASKTNLEQRKGRAGRVRPGFCFHLCSRARFERLETHMTPEMFRTPLHEIALSIKLLRLGGIGQFLAKAIEPPPLDAVIEAEHTLRELDALDANDELTPLGRILAKLPIEPRFGKMMIMGCIFYVGDAICTIAAATCFPEPFINEGKRLGYIHRNFAGNRFSDHVALLSVFQAWDDARMGGEEAEIRFCEHKRLNMATLRMTWEAKVQLKEILINSGFPEDVVAPVFLPGRYIGCVFPRLGLPGASRRGVPWGLLP

SEQ ID NO: 887390 - protein, 1269 aa, Homo sapiens; identical to SEQ ID NO: 887384

SEQ ID NO: 887391 - protein, 1326 aa, Homo sapiens
MGDVKNFLYAWCGKRKMTPSYEIRAVGNKNRQKFMCEVQVEGYNYTGMGNSTNKKDAQSNAARDFVNYLVRINEIKSEEVPAFGVASPPPLTDTPDTTANAEGDLPTTMGGPLPPHLALKAENNSEVGASGYGVPGPTWDRGANLKDYYSRKEEQEVQATLESEEVDLNAGLHGNWTLENAKARLNQYFQKEKIQGEYKYTQVGPDHNRWRRMRLSADFNLAEKHTGIDVINERVDVVPLKASGLGPLKPLCLKSFIAEMTIYIKQLGRRIFAREHGSNKKLAAQSCALSLVRQLYHLGVVEAYSGLTKKKEGETVEPYKVNLSQDLEHQLQNIIQELNLEILPPPEDPSVPVALNIGKLAQFEPSQRQNQVGVVPWSPPQSNWNPWTSSNIDEGPLAFATPEQISMDLKNELMYQLEQDHDLQAILQERELLPVKKFESEILEAISQNSVVIIRGATGCGKTTQVPQFILDDFIQNDRAAECNIVVTQPRRISAVSVAERVAFERGEEPGKSCGYSVRFESILPRPHASIMFCTVGVLLRKLEAGIRGISHVIVDEIHERDINTDFLLVVLRDVVQAYPEVRIVLMSATIDTSMFCEYFFNCPIIEVYGRTYPVQEYFLEDCIQMTHFVPPPKDKKKKDKDDDGGEDDDANCNLICGDEYGPETRLSMSQLNEKETPFELIEALLKYIETLNVPGAVLVFLPGWNLIYTMQKHLEMNPHFGSHRYQILPLHSQIPREEQRKVFDPVPVGVTKVILSTNIAETSITINDVVYVIDSCKQKVKLFTAHNNMTNYATVWASKTNLEQRKGRAGRVRPGFCFHLCSRARFERLETHMTPEMFRTPLHEIALSIKLLRLGGIGQFLAKAIEPPPLDAVIEAEHTLRELDALDANDELTPLGRILAKLPIEPRFGKMMIMGCIFYVGDAICTIAAATCFPEPFINEGKRLGYIHRNFAGNRFSDHVALLSVFQAWDDARMGGEEAEIRFCEHKRLNMATLRMTWEAKVQLKEILINSGFPEDCLLTQVFTNTGPDNNLDVVISLLAFGVYPNVCYHKEKRKILTTEGRNALIHKSSVNCPFSSQDMKYPSPFFVFGEKIRTRAISAKGMTLVTPLQLLLFASKKVQSDGQIVLVDDWIKLQISHEAAACITGLRAAMEALVVEVTKQPAIISQLDPVNERMLNMIRQISRPSAAGINLMIGSTRYGDGPRPPKMARYDNGSGYRRGGSSYSGGGYGGGYSSGGYGSGGYGGSANSFRAGYGAGVGGGYRGVSRGGFRGNSGGDYRGPSGGYRGSGGFQRGGGRGAYGTGYLDIEEEVAAIKLGYVSSVCRQ

SEQ ID NO: 887392 - protein, 897 aa, Homo sapiens
MGDVKNFLYAWCGKRKMTPSYEIRAVGNKNRQKFMCEVQVEGYNYTGMGNSTNKKDAQSNAARDFVNYLVRINEIKSEEVPAFGVASPPPLTDTPDTTANAEGDLPTTMGGPLPPHLALKAENNSEVGASGYGVPGPTWDRGANLKDYYSRKEEQEVQATLESEEVDLNAGLHGNWTLENAKARLNQYFQKEKIQGEYKYTQVGPDHNRSFIAEMTIYIKQLGRRIFAREHGSNKKLAAQSCALSLVRQLYHLGVVEAYSGLTKKKEGETVEPYKVNLSQDLEHQLQNIIQELNLEILPPPEDPSVPVALNIGKLAQFEPSQRQNQVGVVPWSPPQSNWNPWTSSNIDEGPLAFATPEQISMDLKNELMYQLEQDHDLQAILQERELLPVKKFESEILEAISQNSVVIIRGATGCGKTTQVPQFILDDFIQNDRAAECNIVVTQPRRISAVSVAERVAFERGEEPGKSCGYSVRFESILPRPHASIMFCTVGVLLRKLEAGIRGISHVIVDEIHERDINTDFLLVVLRDVVQAYPEVRIVLMSATIDTSMFCEYFFNCPIIEVYGRTYPVQEYFLEDCIQMTHFVPPPKDKKKKDKDDDGGEDDDANCNLICGDEYGPETRLSMSQLNEKETPFELIEALLKYIETLNVPGAVLVFLPGWNLIYTMQKHLEMNPHFGSHRYQILPLHSQIPREEQRKVFDPVPVGVTKVILSTNIAETSITINDVVYVIDSCKQKVKLFTAHNNMTNYATVWASKTNLEQRKGRAGRVRPGFCFHLCSRARFERLETHMTPEMFRTPLHEIALSIKLLRLGGIGQFLAKAIEPPPLDAVIEAEHTLRELDALDANDELTPLGRILAKLPIEPRFGKMMIMGCIFYVGDAICTIAAATCRFPSLMKGS

SEQ ID NO: 887393 - protein, 845 aa, Homo sapiens
MGDVKNFLYAWCGKRKMTPSYEIRAVGNKNRQKFMCEVQVEGYNYTGMGNSTNKKDAQSNAARDFVNYLVRINEIKSEEVPAFGVASPPPLTDTPDTTANAEGDLPTTMGGPLPPHLALKAENNSEVGASGYGVPGPTWDRGANLKDYYSRKEEQEVQATLESEEVDLNAGLHGNWTLENAKARLNQYFQKEKIQGEYKYTQVGPDHNRSFIAEMTIYIKQLGRRIFAREHGSNKKLAAQSCALSLVRQLYHLGVVEAYSGLTKKKEGETVEPYKVNLSQDLEHQLQNIIQELNLEILPPPEDPSVPVALNIGKLAQFEPSQRQNQVGVVPWSPPQSNWNPWTSSNIDEGPLAFATPEQISMDLKNELMYQLEQDHDLQAILQERELLPVKKFESEILEAISQNSVVIIRGATGCGKTTQVPQFILDDFIQNDRAAECNIVVTQPRRISAVSVAERVAFERGEEPGKSCGYSVRFESILPRPHASIMFCTVGVLLRKLEAGIRGISHVIVDEIHERDINTDFLLVVLRDVVQAYPEVRIVLMSATIDTSMFCEYFFNCPIIEVYGRTYPVQEYFLEDCIQMTHFVPPPKDKKKKDKDDDGGEDDDANCNLICGDEYGPETRLSMSQLNEKETPFELIEALLKYIETLNVPGAVLVFLPGWNLIYTMQKHLEMNPHFGSHRYQILPLHSQIPREEQRKVFDPVPVGVTKVILSTNIAETSITINDVVYVIDSCKQKVKLFTAHNNMTNYATVWASKTNLEQRKGRAGRVRPGFCFHLCSRARFERLETHMTPEMFRTPLHEIALSIKLLRLGGIGQFLAKAIEPPPLDAVIEAEHTLRGTYKYKPT

SEQ ID NO: 887394 - protein, 1263 aa, Homo sapiens
MGDVKNFLYAWCGKRKMTPSYEIRAVGNKNRQKFMCEVQVEGYNYTGMGNSTNKNEIKSEEVPAFGVASPPPLTDTPDTTANAEGDLPTTMGGPLPPHLALKAENNSEVGASGYGVPGPTWDRGANLKDYYSRKEEQEVQATLESEEVDLNAGLHGNWTLENAKARLNQYFQKEKIQGEYKYTQVGPDHNRSFIAEMTIYIKQLGRRIFAREHGSNKKLAAQSCALSLVRQLYHLGVVEAYSGLTKKKEGETVEPYKVNLSQDLEHQLQNIIQELNLEILPPPEDPSVPVALNIGKLAQFEPSQRQNQVGVVPWSPPQSNWNPWTSSNIDEGPLAFATPEQISMDLKNELMYQLEQDHDLQAILQERELLPVKKFESEILEAISQNSVVIIRGATGCGKTTQVPQFILDDFIQNDRAAECNIVVTQPRRISAVSVAERVAFERGEEPGKSCGYSVRFESILPRPHASIMFCTVGVLLRKLEAGIRGISHVIVDEIHERDINTDFLLVVLRDVVQAYPEVRIVLMSATIDTSMFCEYFFNCPIIEVYGRTYPVQEYFLEDCIQMTHFVPPPKDKKKKDKDDDGGEDDDANCNLICGDEYGPETRLSMSQLNEKETPFELIEALLKYIETLNVPGAVLVFLPGWNLIYTMQKHLEMNPHFGSHRYQILPLHSQIPREEQRKVFDPVPVGVTKVILSTNIAETSITINDVVYVIDSCKQKVKLFTAHNNMTNYATVWASKTNLEQRKGRAGRVRPGFCFHLCSRARFERLETHMTPEMFRTPLHEIALSIKLLRLGGIGQFLAKAIEPPPLDAVIEAEHTLRELDALDANDELTPLGRILAKLPIEPRFGKMMIMGCIFYVGDAICTIAAATCFPEPFINEGKRLGYIHRNFAGNRFSDHVALLSVFQAWDDARMGGEEAEIRFCEHKRLNMATLRMTWEAKVQLKEILINSGFPEDCLLTQVFTNTGPDNNLDVVISLLAFGVYPNVCYHKEKRKILTTEGRNALIHKSSVNCPFSSQDMKYPSPFFVFGEKIRTRAISAKGMTLVTPLQLLLFASKKVQSDGQIVLVDDWIKLQISHEAAACITGLRAAMEALVVEVTKQPAIISQLDPVNERMLNMIRQISRPSAAGINLMIGSTRYGDGPRPPKMARYDNGSGYRRGGSSYSGGGYGGGYSSGGYGSGGYGGSANSFRAGYGAGVGGGYRGVSRGGFRGNSGGDYRGPSGGYRGSGGFQRGGGRGAYGTGYLDIEEEVAAIKLGYVSSVCRQ

SEQ ID NO: 887395 - protein, 713 aa, Homo sapiens
MGDVKNFLYAWCGKRKMTPSYEIRAVGNKNRQKFMCEVQVEGYNYTGMGNSTNKKDAQSNAARDFVNYLVRINEIKSEEVPAFGVASPPPLTDTPDTTANAEGDLPTTMGGPLPPHLALKAENNSEVGASGYGVPGPTWDRGANLKDYYSRKEEQEVQATLESEEVDLNAGLHGNWTLENAKARLNQYFQKEKIQGEYKYTQVGPDHNRSFIAEMTIYIKQLGRRIFAREHGSNKKLAAQSCALSLVRQLYHLGVVEAYSGLTKKKEGETVEPYKVNLSQDLEHQLQNIIQELNLEILPPPEDPSVPVALNIGKLAQFEPSQRQNQVGVVPWSPPQSNWNPWTSSNIDEGPLAFATPEQISMDLKNELMYQLEQDHDLQAILQERELLPVKKFESEILEAISQNSVVIIRGATGCGKTTQVPQFILDDFIQNDRAAECNIVVTQPRRISAVSVAERVAFERGEEPGKSCGYSVRFESILPRPHASIMFCTVGVLLRKLEAGIRGISHVIVDEIHERDINTDFLLVVLRDVVQAYPEVRIVLMSATIDTSMFCEYFFNCPIIEVYGRTYPVQEYFLEDCIQMTHFVPPPKDKKKKDKDDDGGEDDDANCNLICGDEYGPETRLSMSQLNEKETPFELIEALLKYIETLNVPGAVLVFLPGWNLIYTMQKHLEMNPHFGSHRYQILPLHSQIPREEQRKVFDPVPVGVTKVNIKH

SEQ ID NO: 887396 - protein, 680 aa, Homo sapiens
MGDVKNFLYAWCGKRKMTPSYEIRAVGNKNRQKFMCEVQVEGYNYTGMGNSTNKKDAQSNAARDFVNYLVRINEIKSEEVPAFGVASPPPLTDTPDTTANAEGDLPTTMGGPLPPHLALKAENNSEVGASGYGVPGPTWDRGANLKDYYSRKEEQEVQATLESEEVDLNAGLHGNWTLENAKARLNQYFQKEKIQGEYKYTQVGPDHNRSFIAEMTIYIKQLGRRIFAREHGSNKKLAAQSCALSLVRQLYHLGVVEAYSGLTKKKEGETVEPYKVNLSQDLEHQLQNIIQELNLEILPPPEDPSVPVALNIGKLAQFEPSQRQNQVGVVPWSPPQSNWNPWTSSNIDEGPLAFATPEQISMDLKNELMYQLEQDHDLQAILQERELLPVKKFESEILEAISQNSVVIIRGATGCGKTTQVPQFILDDFIQNDRAAECNIVVTQPRRISAVSVAERVAFERGEEPGKSCGYSVRFESILPRPHASIMFCTVGVLLRKLEAGIRGISHVIVDEIHERDINTDFLLVVLRDVVQAYPEVRIVLMSATIDTSMFCEYFFNCPIIEVYGRTYPVQEYFLEDCIQMTHFVPPPKDKKKKDKDDDGGEDDDANCNLICGDEYGPETRLSMSQLNEKETPFELIEALLKYIETLNVPGAVLVFLPGWNLIYTMQKHLEMNPHFGMSL

SEQ ID NO: 887397 - protein, 908 aa, Homo sapiens
MDLKNELMYQLEQDHDLQAILQERELLPVKKFESEILEAISQNSVVIIRGATGCGKTTQVPQFILDDFIQNDRAAECNIVVTQPRRISAVSVAERVAFERGEEPGKSCGYSVRFESILPRPHASIMFCTVGVLLRKLEAGIRGISHVIVDEIHERDINTDFLLVVLRDVVQAYPEVRIVLMSATIDTSMFCEYFFNCPIIEVYGRTYPVQEYFLEDCIQMTHFVPPPKDKKKKDKDDDGGEDDDANCNLICGDEYGPETRLSMSQLNEKETPFELIEALLKYIETLNVPGAVLVFLPGWNLIYTMQKHLEMNPHFGSHRYQILPLHSQIPREEQRKVFDPVPVGVTKVILSTNIAETSITINDVVYVIDSCKQKVKLFTAHNNMTNYATVWASKTNLEQRKGRAGRVRPGFCFHLCSRARFERLETHMTPEMFRTPLHEIALSIKLLRLGGIGQFLAKAIEPPPLDAVIEAEHTLRELDALDANDELTPLGRILAKLPIEPRFGKMMIMGCIFYVGDAICTIAAATCFPEPFINEGKRLGYIHRNFAGNRFSDHVALLSVFQAWDDARMGGEEAEIRFCEHKRLNMATLRMTWEAKVQLKEILINSGFPEDCLLTQVFTNTGPDNNLDVVISLLAFGVYPNVCYHKEKRKILTTEGRNALIHKSSVNCPFSSQDMKYPSPFFVFGEKIRTRAISAKGMTLVTPLQLLLFASKKVQSDGQIVLVDDWIKLQISHEAAACITGLRAAMEALVVEVTKQPAIISQLDPVNERMLNMIRQISRPSAAGINLMIGSTRYGDGPRPPKMARYDNGSGYRRGGSSYSGGGYGGGYSSGGYGSGGYGGSANSFGQDMVQVLVEAIEEFPEVALEATLEETTEGLVEATEDLGDSSEEVVGGPMELATWTLKRRWRL

SEQ ID NO: 887398 - protein, 466 aa, Homo sapiens
MGDVKNFLYAWCGKRKMTPSYEIRAVGNKNRQKFMCEVQVEGYNYTGMGNSTNKKDAQSNAARDFVNYLVRINEIKSEEVPAFGVASPPPLTDTPDTTANAEGDLPTTMGGPLPPHLALKAENNSEVGASGYGVPGPTWDRGANLKDYYSRKEEQEVQATLESEEVDLNAGLHGNWTLENAKARLNQYFQKEKIQGEYKYTQVGPDHNRSFIAEMTIYIKQLGRRIFAREHGSNKKLAAQSCALSLVRQLYHLGVVEAYSGLTKKKEGETVEPYKVNLSQDLEHQLQNIIQELNLEILPPPEDPSVPVALNIGKLAQFEPSQRQNQVGVVPWSPPQSNWNPWTSSNIDEGPLAFATPEQISMDLKNELMYQLEQDHDLQAILQERELLPVKKFESEILEAISQNSVVIIRGATGCGKTTQVPQFILDDFIQNDRAAECNIVVTQVSGKPTMKYLESRLFLILSLIN

SEQ ID NO: 887399 - protein, 598 aa, Homo sapiens
SENAGVESDTDGFQNVDSFPNGVTKVILSTNIAETSITINDVVYVIDSCKQKVKLFTAHNNMTNYATVWASKTNLEQRKGRAGRVRPGFCFHLCSRARFERLETHMTPEMFRTPLHEIALSIKLLRLGGIGQFLAKAIEPPPLDAVIEAEHTLRELDALDANDELTPLGRILAKLPIEPRFGKMMIMGCIFYVGDAICTIAAATCFPEPFINEGKRLGYIHRNFAGNRFSDHVALLSVFQAWDDARMGGEEAEIRFCEHKRLNMATLRMTWEAKVQLKEILINSGFPEDCLLTQVFTNTGPDNNLDVVISLLAFGVYPNVCYHKEKRKILTTEGRNALIHKSSVNCPFSSQDMKYPSPFFVFGEKIRTRAISAKGMTLVTPLQLLLFASKKVQSDGQIVLVDDWIKLQISHEAAACITGLRAAMEALVVEVTKQPAIISQLDPVNERMLNMIRQISRPSAAGINLMIGSTRYGDGPRPPKMARYDNGSGYRRGGSSYSGGGYGGGYSSGGYGSGGYGGSANSFRAGYGAGVGGGYRGVSRGGFRGNSGGDYRGPSGGYRGSGGFQRGGGRGAYGTGYLDIEEEVAAIKLGYVSSVCRQ

SEQ ID NO: 887400 - protein, 218 aa, Homo sapiens [sequence omitted]

SEQ ID NO: 887401 - protein, 466 aa, Homo sapiens
CVGDLEDPAPTGCCDEAEHTLRELDALDANDELTPLGRILAKLPIEPRFGKMMIMGCIFYVGDAICTIAAATCFPEPFINEGKRLGYIHRNFAGNRFSDHVALLSVFQAWDDARMGGEEAEIRFCEHKRLNMATLRMTWEAKVQLKEILINSGFPEDCLLTQVFTNTGPDNNLDVVISLLAFGVYPNVCYHKEKRKILTTEGRNALIHKSSVNCPFSSQDMKYPSPFFVFGEKIRTRAISAKGMTLVTPLQLLLFASKKVQSDGQIVLVDDWIKLQISHEAAACITGLRAAMEALVVEVTKQPAIISQLDPVNERMLNMIRQISRPSAAGINLMIGSTRYGDGPRPPKMARYDNGSGYRRGGSSYSGGGYGGGYSSGGYGSGGYGGSANSFRAGYGAGVGGGYRGVSRGGFRGNSGGDYRGPSGGYRGSGGFQRGGGRGAYGTGYLDIEEEVAAIKLGYVSSVCRQ

SEQ ID NO: 887402 - protein, 428 aa, Homo sapiens
MVGLDSGGDRRELNRIGVNAGGVGDAICTIAAATCFPEPFINEGKRLGYIHRNFAGNRFSDHVALLSVFQAWDDARMGGEEAEIRFCEHKRLNMATLRMTWEAKVQLKEILINSGFPEDCLLTQVFTNTGPDNNLDVVISLLAFGVYPNVCYHKEKRKILTTEGRNALIHKSSVNCPFSSQDMKYPSPFFVFGEKIRTRAISAKGMTLVTPLQLLLFASKKVQSDGQIVLVDDWIKLQISHEAAACITGLRAAMEALVVEVTKQPAIISQLDPVNERMLNMIRQISRPSAAGINLMIGSTRYGDGPRPPKMARYDNGSGYRRGGSSYSGGGYGGGYSSGGYGSGGYGGSANSFRAGYGAGVGGGYRGVSRGGFRGNSGGDYRGPSGGYRGSGGFQRGGGRGAYGTGYLDIEEEVAAIKLGYVSSVCRQ

SEQ ID NO: 887403 - protein, 410 aa, Homo sapiens
LRSGSIVCSTQLGTPSLFPEPFINEGKRLGYIHRNFAGNRFSDHVALLSVFQAWDDARMGGEEAEIRFCEHKRLNMATLRMTWEAKVQLKEILINSGFPEDCLLTQVFTNTGPDNNLDVVISLLAFGVYPNVCYHKEKRKILTTEGRNALIHKSSVNCPFSSQDMKYPSPFFVFGEKIRTRAISAKGMTLVTPLQLLLFASKKVQSDGQIVLVDDWIKLQISHEAAACITGLRAAMEALVVEVTKQPAIISQLDPVNERMLNMIRQISRPSAAGINLMIGSTRYGDGPRPPKMARYDNGSGYRRGGSSYSGGGYGGGYSSGGYGSGGYGGSANSFRAGYGAGVGGGYRGVSRGGFRGNSGGDYRGPSGGYRGSGGFQRGGGRGAYGTGYLDIEEEVAAIKLGYVSSVCRQ

SEQ ID NO: 887404 - protein, 447 aa, Homo sapiens
MGEDTDTRKINHSFLRDHSYVTEADIISTVEFNHTGELLATGDKGGRVVIFQREPESKNAPHSQGEYDVYSTFQSHEPEFDYLKSLEIEEKINKIKWLPQQNAAHSLLSTNDKTIKLWKITERDKRPEGYNLKDEEGKLKDLSTVTSLQVPVLKPMDLMVEVSPRRIFANGHTYHINSISVNSDCETYMSADDLRINLWHLAITDRSFNIVDIKPANMEDLTEVITASEFHPHHCNLFVYSSSKGSLRLCDMRAAALCDKHSKLFEEPEDPSNRSFFSEIISSVSDVKFSHSGRYMLTRDYLTVKVWDLNMEARPIETYQVHDYLRSKLCSLYENDCIFDKFECAWNGSDSVIMTGAYNNFFRMFDRNTKRDVTLEASRESSKPRAVLKPRRVCVGGKRRRDDISVDSLDFTKKILHTAWHPAENIIAIAATNNLYIFQDKVNSDMH

SEQ ID NO: 887405 - protein, 447 aa, Homo sapiens; identical to SEQ ID NO: 887404

SEQ ID NO: 887406 - protein, 455 aa, Homo sapiens
TCKKWGLEMGLSFFSKHLPIQEGQPWALKTPADIISTVEFNHTGELLATGDKGGRVVIFQREPESKNAPHSQGEYDVYSTFQSHEPEFDYLKSLEIEEKINKIKWLPQQNAAHSLLSTNDKTIKLWKITERDKRPEGYNLKDEEGKLKDLSTVTSLQVPVLKPMDLMVEVSPRRIFANGHTYHINSISVNSDCETYMSADDLRINLWHLAITDRSFNIVDIKPANMEDLTEVITASEFHPHHCNLFVYSSSKGSLRLCDMRAAALCDKHSKLFEEPEDPSNRSFFSEIISSVSDVKFSHSGRYMLTRDYLTVKVWDLNMEARPIETYQVHDYLRSKLCSLYENDCIFDKFECAWNGSDSVIMTGAYNNFFRMFDRNTKRDVTLEASRESSKPRAVLKPRRVCVGGKRRRDDISVDSLDFTKKILHTAWHPAENIIAIAATNNLYIFQDKVNSDMH

SEQ ID NO: 887407 - protein, 433 aa, Homo sapiens
MPSHRMPSEADIISTVEFNHTGELLATGDKGGRVVIFQREPESKNAPHSQGEYDVYSTFQSHEPEFDYLKSLEIEEKINKIKWLPQQNAAHSLLSTNDKTIKLWKITERDKRPEGYNLKDEEGKLKDLSTVTSLQVPVLKPMDLMVEVSPRRIFANGHTYHINSISVNSDCETYMSADDLRINLWHLAITDRSFNIVDIKPANMEDLTEVITASEFHPHHCNLFVYSSSKGSLRLCDMRAAALCDKHSKLFEEPEDPSNRSFFSEIISSVSDVKFSHSGRYMLTRDYLTVKVWDLNMEARPIETYQVHDYLRSKLCSLYENDCIFDKFECAWNGSDSVIMTGAYNNFFRMFDRNTKRDVTLEASRESSKPRAVLKPRRVCVGGKRRRDDISVDSLDFTKKILHTAWHPAENIIAIAATNNLYIFQDKVNSDMH

SEQ ID NO: 887408 - protein, 439 aa, Homo sapiens
MREATLRPPQLMEVSADIISTVEFNHTGELLATGDKGGRVVIFQREPESKNAPHSQGEYDVYSTFQSHEPEFDYLKSLEIEEKINKIKWLPQQNAAHSLLSTNDKTIKLWKITERDKRPEGYNLKDEEGKLKDLSTVTSLQVPVLKPMDLMVEVSPRRIFANGHTYHINSISVNSDCETYMSADDLRINLWHLAITDRSFNIVDIKPANMEDLTEVITASEFHPHHCNLFVYSSSKGSLRLCDMRAAALCDKHSKLFEEPEDPSNRSFFSEIISSVSDVKFSHSGRYMLTRDYLTVKVWDLNMEARPIETYQVHDYLRSKLCSLYENDCIFDKFECAWNGSDSVIMTGAYNNFFRMFDRNTKRDVTLEASRESSKPRAVLKPRRVCVGGKRRRDDISVDSLDFTKKILHTAWHPAENIIAIAATNNLYIFQDKVNSDMH

SEQ ID NO: 887409 - protein, 319 aa, Homo sapiens
PIEAKELGKRLKDLSTVQSLQVPVLKPMDLMVEVSPRRIFANGHTYHINSISVNSDCETYMSADDLRINLWHLAITDRSFNIVDIKPANMEDLTEVITASEFHPHHCNLFVYSSSKGSLRLCDMRAAALCDKHSKLFEEPEDPSNRSFFSEIISSVSDVKFSHSGRYMLTRDYLTVKVWDLNMEARPIETYQVHDYLRSKLCSLYENDCIFDKFECAWNGSDSVIMTGAYNNFFRMFDRNTKRDVTLEASRESSKPRAVLKPRRVCVGGKRRRDDISVDSLDFTKKILHTAWHPAENIIAIAATNNLYIFQDKVNSDMH

SEQ ID NO: 887410 - protein, 387 aa, Homo sapiens
TCKKWGLEMGLSFFSKHLPIQEGQPWALKTPADIISTVEFNHTGELLATGDKGGRVVIFQREPESKNAPHSQGEYDVYSTFQSHEPEFDYLKSLEIEEKINKIKWLPQQNAAHSLLSTNDKTIKLWKITERDKRPEGYNLKDEEGKLKDLSTVTSLQVPVLKPMDLMVEVSPRRIFANGHTYHINSISVNSDCETYMSADDLRINLWHLAITDRSFNIVDIKPANMEDLTEVITASEFHPHHCNLFVYSSSKGSLRLCDMRAAALCDKHSKLFEEPEDPSNRSFFSEIISSVSDVKFSHSGRYMLTRDYLTVKVWDLNMEARPIETYQVHDYLRSKLCSLYENDCIFDKFECAWNGSDSVIMTGAYNNFFRMFARRPCCINTPARRA

SEQ ID NO: 887411 - protein, 496 aa, Homo sapiens
TCKKWGLEMGLSFFSKHLPIQEGQPWALKTPADIISTVEFNHTGELLATGDKGGRVVIFQREPESKNAPHSQGEYDVYSTFQSHEPEFDYLKSLEIEEKINKIKWLPQQNAAHSLLSTNDKTIKLWKITERDKRPEGYNLKDEEGKLKDLSTVTSLQVPVLKPMDLMVEVSPRRIFANGHTYHINSISVNSDCETYMSADDLRINLWHLAITDRSFNIVDIKPANMEDLTEVITASEFHPHHCNLFVYSSSKGSLRLCDMRAAALCDKHSKLFEEPEDPSNRSFFSEIISSVSDVKFSHSGRYMLTRDYLTVKVWDLNMEARPIETYQVHDYLRSKLCSLYENDCIFDKFECAWNGSDSVIMTGAYNNFFRMFASSVHAVSMGTVDIWAPGGREGPQISRAPKGRGGMLRVLNKEGVGTWTSGYQGMKTEVEEALGHPDSWVFLERGWGSRHLGLRGEGLGSGLLGSQERSSQDPGHTESTLQEMTGSQMFTWGSL

SEQ ID NO: 887412 - protein, 397 aa, Homo sapiens
TCKKWGLEMGLSFFSKHLPIQEGQPWALKTPADIISTVEFNHTGELLATGDKGGRVVIFQREPESKNAPHSQGEYDVYSTFQSHEPEFDYLKSLEIEEKINKIKWLPQQNAAHSLLSTNDKTIKLWKITERDKRPEGYNLKDEEGKLKDLSTVTSLQVPVLKPMDLMVEVSPRRIFANGHTYHINSISVNSDCETYMSADDLRINLWHLAITDRSFNIVDIKPANMEDLTEVITASEFHPHHCNLFVYSSSKGSLRLCDMRAAALCDKHSKLFEEPEDPSNRSFFSEIISSVSDVKFSHSGRYMLTRDYLTVKVWDLNMEARPIETYQVHDYLRSKLCSLYENDCIFDKFECAWNGSDSVIINAVRSLALLRGLRIWSCLELWYRWRMQIGSGVAGN

SEQ ID NO: 887413 - protein, 364 aa, Homo sapiens
TCKKWGLEMGLSFFSKHLPIQEGQPWALKTPADIISTVEFNHTGELLATGDKGGRVVIFQREPESKNAPHSQGEYDVYSTFQSHEPEFDYLKSLEIEEKINKIKWLPQQNAAHSLLSTNDKTIKLWKITERDKRPEGYNLKDEEGKLKDLSTVTSLQVPVLKPMDLMVEVSPRRIFANGHTYHINSISVNSDCETYMSADDLRINLWHLAITDRSFNIVDIKPANMEDLTEVITASEFHPHHCNLFVYSSSKGSLRLCDMRAAALCDKHSKLFEEPEDPSNRSFFSEIISSVSDVKFSHSGRYMLTRDYLTVKVWDLNMEARPIETYQVGTTAGDPQSRVFFPYAEIPMEGAFLARRGFHMPSM

SEQ ID NO: 887414 - protein, 567 aa, Homo sapiens
MAQPPRLSRSGASSLWDPASPAPTSGPRPRLWEGQDVLARWTDGLLYLGTIKKVDSAREVCLVQFEDDSQFLVLWKDISPAALPGEELLCCVCRSETVVPGNRLVSCEKCRHAYHQDCHVPRAPAPGEGEGTSWVCRQCVFAIATKRGGALKKGPYARAMLGMKLSLPYGLKGLDWDAGHLSNRQQSYCYCGGPGEWNLKMLQCRSCLQWFHEACTQCLSKPLLYGDRFYEFECCVCRGGPEKVRRLQLRWVDVAHLVLYHLSVCCKKKYFDFDREILPFTSENWDSLLLGELSDTPKGERSSKLLSALNSHKDRFISGREIKKRKCLFGLHARMPPPVEPPTGDGALTSFPSGQGPGGGVSRPLGKRRRPEPEPLRRRQKGKVEELGPPSAVRNQPEPQEQRERAHLQRALQASVSPPSPSPNQSYQGSSGYNFRPTDARCLPSSPIRMFASFHPSASTAGTSGDSGPPDRSPLELHIGFPTDIPKSAPHSMTASSSSVSSPSPGLPRRSAPPSPLCRSLSPGTGGGVRGGVGYLSRGDPVRVLARRVRPDGSVQYLVEWGGGGIF

SEQ ID NO: 887415 - protein, 454 aa, Homo sapiens
MAQPPRLSRSGASSLWDPASPAPTSGPRPRLWEGQDVLARWTDGLLYLGTIKKVDSAREVCLVQFEDDSQFLVLWKDISPAALPGEELLCCVCRSETVVPGNRLVSCEKCRHAYHQDCHVPRAPAPGEGEGTSWVCRQCVFAIATKRGGALKKGPYARAMLGMKLSLPYGLKGLDWDAGHLSNRQQSYCYCGGPGEWNLKMLQCRSCLQWFHEACTQCLSKPLLYGDRFYEFECCVCRGGPEKVRRLQLRWVDVAHLVLYHLSVCCKKKYFDFDREILPFTSENWDSLLLGELSDTPKGERSSKLLSALNSHKDRFISGREIKKRKCLFGLHARMPPPVEPPTGDGALTSFPSGQGPGGGVSRPLGKRRRPEPEPLRRRQKGKVEELGPPSAVRNQPEPQEQRERAHLQRALQQPHPDVCFLPPFCQHRRDLWGQWTPRQVTPGTSHWFPHRHP

SEQ ID NO: 887416 - protein, 573 aa, Homo sapiens
MVDVAAEGTPQGSLKPGASSLWDPASPAPTSGPRPRLWEGQDVLARWTDGLLYLGTIKKVDSAREVCLVQFEDDSQFLVLWKDISPAALPGEELLCCVCRSETVVPGNRLVSCEKCRHAYHQDCHVPRAPAPGEGEGTSWVCRQCVFAIATKRGGALKKGPYARAMLGMKLSLPYGLKGLDWDAGHLSNRQQSYCYCGGPGEWNLKMLQCRSCLQWFHEACTQCLSKPLLYGDRFYEFECCVCRGGPEKVRRLQLRWVDVAHLVLYHLSVCCKKKYFDFDREILPFTSENWDSLLLGELSDTPKGERSSKLLSALNSHKDRFISGREIKKRKCLFGLHARMPPPVEPPTGDGALTSFPSGQGPGGGVSRPLGKRRRPEPEPLRRRQKGKVEELGPPSAVRNQPEPQEQRERAHLQRALQASVSPPSPSPNQSYQGSSGYNFRPTDARCLPSSPIRMFASFHPSASTAGTSGDSGPPDRSPLELHIGFPTDIPKSAPHSMTASSSSVSSPSPGLPRRSAPPSPLCRSLSPGTGGGVRGGVGYLSRGDPVRVLARRVRPDGSVQYLVEWGGGGIF

SEQ ID NO: 887417 - protein, 398 aa, Homo sapiens [sequence omitted]

SEQ ID NO: 887418 - protein, 415 aa, Homo sapiens
MAQPPRLSRSGASSLWDPASPAPTSGPRPRLWEGQDVLARWTDGLLYLGTIKKVDSAREVCLVQFEDDSQFLVLWKDISPAALPGEELLCCVCRSETVVPGNRLVSCEKCRHAYHQDCHVPRAPAPGEGEGTSWVCRQCVFAIATKRGGALKKGPYARAMLGMKLSLPYGLKGLDWDAGHLSNRQQSYCYCGGPGELSNERGADCGMNDVVVDAQEMKEKEQDERRRQKGKVEELGPPSAVRNQPEPQEQRERAHLQRALQASVSPPSPSPNQSYQGSSGYNFRPTDARCLPSSPIRMFASFHPSASTAGTSGDSGPPDRSPLELHIGFPTDIPKSAPHSMTASSSSVSSPSPGLPRRSAPPSPLCRSLSPGTGGGVRGGVGYLSRGDPVRVLARRVRPDGSVQYLVEWGGGGIF

SEQ ID NO: 887419 - protein, 190 aa, Homo sapiens
LLPTHPGTAQSHQAVLSEQGPGQGPLGTGNQTPPRTASVSPPSPSPNQSYQGSSGYNFRPTDARCLPSSPIRMFASFHPSASTAGTSGDSGPPDRSPLELHIGFPTDIPKSAPHSMTASSSSVSSPSPGLPRRSAPPSPLCRSLSPGTGGGVRGGVGYLSRGDPVRVLARRVRPDGSVQYLVEWGGGGIF

SEQ ID NO: 887420 - protein, 595 aa, Homo sapiens
MAQPPRLSRSGASSLWDPASPAPTSGPRPRLWEGQDVLARWTDGLLYLGTIKKVDSAREVCLVQFEDDSQFLVLWKDISPAALPGEELLCCVCRSETVVPGNRLVSCEKCRHAYHQDCHVPRAPAPGEGEGTSWVCRQCVFAIATKRGGALKKGPYARAMLGMKLSLPYGLKGLDWDAGHLSNRQQSYCYCGGPGEWNLKMLQCRSCLQWFHEACTQCLSKPLLYGDRFYEFECCVCRGGPEKVRRLQLRWVDVAHLVLYHLSVCCKKKYFDFDREILPFTSENWDSLLLGELSDTPKGERSSKLLSALNSHKDRFISGREIKKRKCLFGLHARMPPPVEPPTGDGALTSFPSGQGPGGGVSRPLGKRRRPEPEPLRRRQKGKVEELGPPSAVRNQPEPQEQRERAHLQRALQASVSPPSPSPNQSYQGSSGYNFRPTDARCLPSSPIRMFASFHPSASTAGTSGDSGPPDRSPLELHIGFPTDIPKSAPHSMTASSSSVSSPSPGLPRRSAPPSPLMALCSTWLSGEEGASSEQPASAQLPIHTHRHFHTLTSDLTYSWDVPGEIGGSSPYCPGWNPRVGSGEEALFSTLLHDS

SEQ ID NO: 887421 - protein, 104 aa, Homo sapiens
KDYSCPNTKHTQVCNKWSTIITAAYHQDCHVPRAPAPGEGEGTSWVCRQCVFAIATKVKALPCYPSCGSLPSTASPKPFPLPTPLKPPTCPVSAEGRCPEEGPL

SEQ ID NO: 887422 - protein, 110 aa, Homo sapiens
SSCRCRCFGCCVIRPRAAGTEGLGLGTPRPPPARPPTPGRALSARGTRLGLLRLPLPGSRRPQLSPAPPGCNGAAPPAEPLWCLLTLGPSFSCSHKSGEWGRGPLLYPPS

SEQ ID NO: 887423 - protein, 609 aa, Homo sapiens
MAQPPRLSRSGASSLWDPASPAPTSGPRPRLWEGQDVLARWTDGLLYLGTIKKVDSAREVCLVQFEDDSQFLVLWKDISPAALPGEELLCCVCRSETVVPGNRLVSCEKCRHAYHQDCHVPRAPAPGEGEGTSWVCRQCVFAIATKRGGALKKGPYARAMLGMKLSLPYGLKGLDWDAGHLSNRQQSYCYCGGPGEWNLKMLQCRSCLQWFHEACTQCLSKPLLYGDRFYEFECCVCRGGPEKVRRLQLRWVDVAHLVLYHLSVCCKKKYFDFDREILPFTSENWDSLLLGELSDTPKGERSSKLLSALNSHKDRFISGREIKKRKCLFGLHARMPPPVEPPTGDGALTRSLVQGEMGEILRVLVLGGICIEMGRSWGCPGGGWGDKEASYSFPSGQGPGGGVSRPLGKRRRPEPEPLRRRQKGKVEELGPPSAVRNQPEPQEQRERAHLQRALQASVSPPSPSPNQSYQGSSGYNFRPTDARCLPSSPIRMFASFHPSASTAGTSGDSGPPDRSPLELHIGFPTDIPKSAPHSMTASSSSVSSPSPGLPRRSAPPSPLCRSLSPGTGGGVRGGVGYLSRGDPVRVLARRVRPDGSVQYLVEWGGGGIF

SEQ ID NO: 887424 - protein, 196 aa, Homo sapiens
MAQPPRLSRSGASSLWDPASPAPTSGPRPRLWEGQDVLARWTDGLLYLGTIKKVDSAREVCLVQFEDDSQFLVLWKDISPAALPGEELLCCVCRSETVVPGNRLVSCEKCRHAYHQDCHVPRAPAPGEGEGTSWVCRQCVFAIATKRGGALKKGPYARAMLGMKLSLPYGLKGLDWDAGHLSNRQQSYCYCGGPGE

SEQ ID NO: 887425 - protein, 567 aa, Homo sapiens; identical to SEQ ID NO: 887414

SEQ ID NO: 887426 - protein, 103 aa, Homo sapiens
MTASSSSVSSPSPGLPRRSAPPSPLMALCSTWLSGEEGASSEQPASAQLPIHTHRHFHTLTSDLTYSWDVPGEIGGSSPYCPGWNPRVGSGEEALFSTLLHDS

SEQ ID NO: 887427 - protein, 808 aa, Homo sapiens
MLRFPTCFPSFRVVGEKQLPQEIIFLVWSPKRDLIALANTAGEVLLHRLASFHRVWSFPPNENTGKEVTCLAWRPDGKLLAFALADTKKIVLCDVEKPESLHSFSVEAPVSCMHWMEVTVESSVLTSFYNAEDESNLLLPKLPTLPKNYSNTSKIFSEENSDEIIKLLGDVRLNILVLGGSSGFIELYAYGMFKIARVTGIAGTCLALCLSSDLKSLSVVTEVSTNGASEVSYFQLETNLLYSFLPEVTRMARKFTHISALLQYINLSLTCMCEAWEEILMQMDSRLTKFVQEKNTTTSVQDEFMHLLLWGKASAELQTLLMNQLTVKGLKKLGQSIESSYSSIQKLVISHLQSGSESLLYHLSELKGMASWKQKYEPLGLDAAGIEEAITAVGSFILKANELLQVIDSSMKNFKAFFRWLYVAMLRMTEDHVLPELNKMTQKDITFVAEFLTEHFNEAPDLYNRKGKYFNVERVGQYLKDEDDDLVSPPNTEGNQWYDFLQNSSHLKESPLLFPYYPRKSLHFVKRRMENIIDQCLQKPADVIGKSMNQAICIPLYRDTRSEDSTRRLFKFPFLWNNKTSNLHYLLFTILEDSLYKMCILRRHTDISQSVSNGLIAIKFGSFTYATTEKVRRSIYSCLDAQFYDDETVTVVLKDTVGREGRDRLLVQLPLSLVYNSEDSAEYQFTGTYSTRLDEQCSAIPTRTMHFEKHWRLLESMKAQYVAGNGFRKVSCVLSSNLRHVRVFEMDIDDEWELDESSDEEEEASNKPVKIKEEVLSESEAENQQAGAAALAPEIVIKVEKLDPELDS

SEQ ID NO: 887428 - protein, 551 aa, Homo sapiens
MLRFPTCFPSFRVVGEKQLPQEIIFLVWSPKRDLIALANTAGEVLLHRLASFHRVWSFPPNENTGKEVTCLAWRPDGKLLAFALADTKKIVLCDVEKPESLHSFSVEAPVSCMHWMEVTVESSVLTSFYNAEDESNLLLPKLPTLPKNYSNTSKIFSEENSDEIIKLLGDVRLNILVLGGSSGFIELYAYGMFKIARVTGIAGTCLALCLSSDLKSLSVVTEVSTNGASEVSYFQLETNLLYSFLPEVTRMARKFTHISALLQYINLSLTCMCEAWEEILMQMDSRLTKFVQEKNTTTSVQDEFMHLLLWGKASAELQTLLMNQLTVKGLKKLGQSIESSYSSIQKLVISHLQSGSESLLYHLSELKGMASWKQKYEPLGLDAAGIEEAITAVGSFILKANELLQVIDSSMKNFKAFFRWLYVAMLRMTEDHVLPELNKMTQKDITFVAEFLTEHFNEAPDLYNRKGKYFNVERVGQYLKDEDDDLVSPPNTEGNQWYDFLQNSSHLKESPLLFPYYPRKSLHFVKRRMENIIDQCLQKPAVSLKEMHVFV

SEQ ID NO: 887429 - protein, 414 aa, Homo sapiens
MEGPISSYSCLLIHICWKVDSEARMEPPIHTEYLRSGGAMILRRWMQSTASNAALHQRREHFNEAPDLYNRKGKYFNVERVGQYLKDEDDDLVSPPNTEGNQWYDFLQNSSHLKESPLLFPYYPRKSLHFVKRRMENIIDQCLQKPADVIGKSMNQAICIPLYRDTRSEDSTRRLFKFPFLWNNKTSNLHYLLFTILEDSLYKMCILRRHTDISQSVSNGLIAIKFGSFTYATTEKVRRSIYSCLDAQFYDDETVTVVLKDTVGREGRDRLLVQLPLSLVYNSEDSAEYQFTGTYSTRLDEQCSAIPTRTMHFEKHWRLLESMKAQYVAGNGFRKVSCVLSSNLRHVRVFEMDIDDEWELDESSDEEEEASNKPVKIKEEVLSESEAENQQAGAAALAPEIVIKVEKLDPELDS

SEQ ID NO: 887430 - protein, 405 aa, Homo sapiens
MLRFPTCFPSFRVVGEKQLPQEIIFLVWSPKRDLIALANTAGEVLLHRLASFHRVWSFPPNENTGKEVTCLAWRPDGKLLAFALADTKKIVLCDVEKPESLHSFSVEAPVSCMHWMEVTVESSVLTSFYNAEDESNLLLPKLPTLPKNYSNTSKIFSEENSDEIIKLLGDVRLNILVLGGSSGFIELYAYGMFKIARVTGIAGTCLALCLSSDLKSLSVVTEVSTNGASEVSYFQLETNLLYSFLPEVTRMARKFTHISALLQYINLSLTCMCEAWEEILMQMDSRLTKFVQEKNTTTSVQDEFMHLLLWGKASAELQTLLMNQLTVKGLKKLGQSIESSYSSIQKLVISHLQSGSESLLYHLSELKGMASWKQKYEPLGLDAAGIEEAITAVGSFILKANELLQ

SEQ ID NO: 887431 - protein, 148 aa, Homo sapiens
YRILRGYWNRTDPSGCRNSARACRAVPMLRFPTCFPSFRVVGEKQLPQEIIFLVWSPKRDLIALANTAGEVLLHRLASFHRVWSFPPNENTGKEVTCLAWRPDGKRNDNITKKICFYFHKEYSVKPIFRKDLLFLVYIRIINISLGTF

SEQ ID NO: 887432 - protein, 551 aa, Homo sapiens; identical to SEQ ID NO: 887428

SEQ ID NO: 887433 - protein, 211 aa, Homo sapiens [sequence omitted]

SEQ ID NO: 887434 - protein, 70 aa, Homo sapiens
LHFALVRARWLSGLWNISPDSPGDRGQQHSATQWDSCVPAEGVVLIPGKGMHGLTLYKRPRCWWPTYFFF

SEQ ID NO: 887435 - protein, 875 aa, Homo sapiens
CASRPTLNKKKKSKVKPKKIQQGEEEEKEFSGEIEAVPVTGTGRVNLHEGNTWCPFFLGVQSLPLDGSGAAEKDGVSSSFSSSSWKRVSSSESDFSDAEGGMQSKMRSYQAKVRQGALVCFLSTIKSIEKKVLYGYWSAFIPDTPELGSPQSVSLMTLTLKDPSPKTRACALQVLSAILEGSKQFLSVAEDTSDHRRAFTPFSVMIACSIRELHRCLLLALVAESSSQTVTQIIKCLANLVSNAPYDRLKLSLLTKVWNQIKPYIRHKDVNVRVSSLTLLGAIVSTHAPLPEVQLLLQQPCSSGLGNSNSATPHLSPPDWWKKAPAGPSLEETSVSSPKGSSEPCWLIRLCISIVVLPKEDSCSGSDAGSAAGSTYEPSPMRLEALQVLTLLARGYFSMTQAYLMELGEVICKCMGEADPSIQLHGAKLLEELGTGLIQQYKPDSTAAPDQRAPVFLVVMFWTMMLNGPLPRALQNSEHPTLQASACDALSSILPEAFSNLPNDRQMLCITVLLGLNDSKNRLVKAATSRALGVYVLFPCLRQDVIFVADAANAILMSLEDKSLNVRAKAAWSLGNLTDTLIVNMETPDPSFQEEFSGLLLLKMLRSAIEASKDKDKVKSNAVRALGNLLHFLQPSHIEKPTFAEIIEESIQALISTVLTEAAMKVRWNACYAMGNVFKNPALPLGTAPWTSQAYNALTSVVTSCKNFKVRIRSAAALSVPGKREQYGSVDQYARIWNALVTALQKSEDTIDFLEFKYCVSLRTQICQALIHLLSLASASDLPCMKETLELSGNMVQSYILQFLKSGAEGDDTGAPHSPQERDQMVRMALKHMGSIQAPTGDTARRAIMGFLEEILAVCFDSSGSQGALPGLTNQ

SEQ ID NO: 887436 - protein, 875 aa, Homo sapiens; identical to SEQ ID NO: 887435

SEQ ID NO: 887437 - protein, 579 aa, Homo sapiens
LVWPATRVPCGQTLPGVRANYQRSGAGASVRVCACVCASAVEGGDQLLHTFNTALKRESERETGDAQIPPRSPKPTVPQIIVQSPKNRNRGNEQQLNMDEGIPHLQERQLLEHRDFIGLDYSSLYMCKPKRSMKRDDTKDTYKLPHRLIEKKRRDRINECIAQLKDLLPEHLKLTTLGHLEKAVVLELTLKHLKALTALTEQQHQKIIALQNGERSLKSPIQSDLDAFHSGFQTCAKEVLQYLSRFESWTPREPRCVQLINHLHAVATQFLPTPQLLTQQVPLSKGTGAPSAAGSAAAPCLERAGQKLEPLAYCVPVIQRTQPSAELAAENDTDTDSGYGGEAEARPDREKGKGAGASRVTIKQEPPGEDSPAPKRMKLDSRGGGSGGGPGGGAAAAAAALLGPDPAAAAALLRPDAALLSSLVAFGGGGGAPFPQPAAAAAPFCLPFCFLSPSAAAAYVQPFLDKSGLEKYLYPAAAAAPFPLLYPGIPAPAAAAAAAAAAAAAAAAFPCLSSVLSPPPEKAGAAAATLLPHEVAPLGAPHPQHPHGRTHLPFAGPREPGNPESSAQEDPSQPGKEAP

SEQ ID NO: 887438 - protein, 203 aa, Homo sapiens
MKLDSRGGGSGGGPGGGAAAAAAALLGPDPAAAAALLRPDAALLSSLVAFGGGGGAPFPQPAAAAAPFCLPFCFLSPSAAAAYVQPFLDKSGLEKYLYPAAAAAPFPLLYPGIPAPAAAAAAAAAAAAAAAAFPCLSSVLSPPPEKAGAAAATLLPHEVAPLGAPHPQHPHGRTHLPFAGPREPGNPESSAQEDPSQPGKEAP

SEQ ID NO: 887439 - protein, 203 aa, Homo sapiens; identical to SEQ ID NO: 887438

SEQ ID NO: 887440 - protein, 203 aa, Homo sapiens; identical to SEQ ID NO: 887438

SEQ ID NO: 887441 - protein, 209 aa, Homo sapiens
MKLDSRGGGSGGGPGGGAAAAAAALLGPDPAAAAALLRPDAALLSSLVAFGGGGGAPFPQPAAAAAPFCLPFCFLSPSAAAAYVQPFLDKSGLEKYLYPAAAAAPFPLLYPGIPPPPPRSPACPRCCRPLPRRRAPPPRPSCRTRWRPLGRRTPSTRTAAPTCPSPGPASRGTRRALLRKIPRSQERKLPESLRPEGRRFKQSEKLKYP

SEQ ID NO: 887442 - protein, 208 aa, Homo sapiens
LVWPATRVPCGQTLPGVRANYQRSGAGASVRVCACVCASAVEGGDQLLHTFNTALKRESERETGDAQIPPRSPKPTVPQIIVQSPKNRNRGNEQQLNMDEGIPHLQERQLLEHRDFIGLDYSSLYMCKPKRSMKRDDTKDTYKLPHRLIEKKRRDRINECIAQLKDLLPEHLKLTVRCTFSFFAALQGRVNSLVRLPENIRINVNISS

SEQ ID NO: 887443 - protein, 203 aa, Homo sapiens; identical to SEQ ID NO: 887438

SEQ ID NO: 887444 - protein, 203 aa, Homo sapiens; identical to SEQ ID NO: 887438

SEQ ID NO: 887445 - protein, 208 aa, Homo sapiens; identical to SEQ ID NO: 887442

SEQ ID NO: 887446 - protein, 793 aa, Homo sapiens
MFWKFDLHSSSHIDTLLEREDVTLKELMDEEDVLQECKAQNRKLIEFLLKAECLEDLVSFIIEEPPQDMDEKIRYKYPNISCELLTSDVSQMNDRLGEDESLLMKLYSFLLNDSPLNPLLASFFSKVLSILISRKPEQIVDFLKKKHDFVDLIIKHIGTSAIMDLLLRLLTCIEPPQPRQDVLNWLNEEKIIQRLVEIVHPSQEEDRHSNASQSLCEIVRLSRDQMLQIQNSTEPDPLLATLEKQEIIEQLLSNIFHKEKNESAIVSAIQILLTLLETRRPTFEGHIEICPPGMSHSACSVNKSVLEAIRGRLGSFHELLLEPPKNMFFKYTWNNFLHTQVEICIALILASPFENTENATITDQDSTGDNLLLKHLFQKCQLIERILEAWEMNEKKQAEGGRRHGYMGHLTRIANCIVHSTDKGPNSALVQQLIKDLPDEVRERWETFCTSSLGETNKRNTVDLAFSDYQMQQMTSNFIDQFGFNDEKFADQDDIGNVSFDRVSDINFTLNTNESGNIALFEACCKERIQQFDDGGSDEEDIWEEKHIAFTPESQRRSSSGSTDSEESTDSEEEDGAKQDLFEPSSANTEDKMEVDLSEPPNWSANFDVPMETTHGAPLDSVGSDVWSTEEPMPTKETGWASFSEFTSSLSTKDSLRSNSPVEMETSTEPMDPLTPSAAALAVQPEAAGSVAMEASSDGEEDAESTDKVTETVMNGGMKETLSLTVDAKTETAVFKSEEGKLSTSQDAACKDAEECPETAEAKCAAPRPPSSSPEQRTGQPSAPGDTSVNGPV

SEQ ID NO: 887447 - protein, 844 aa, Homo sapiens
MFWKFDLHSSSHIDTLLEREDVTLKELMDEEDVLQECKAQNRKLIEFLLKAECLEDLVSFIIEEPPQDMDEKIRYKYPNISCELLTSDVSQMNDRLGEDESLLMKLYSFLLNDSPLNPLLASFFSKVLSILISRKPEQIVDFLKKKHDFVDLIIKHIGTSAIMDLLLRLLTCIEPPQPRQDVLNWLNEEKIIQRLVEIVHPSQEEDRHSNASQSLCEIVRLSRDQMLQIQNSTEPDPLLATLEKQEIIEQLLSNIFHKEKNESAIVSAIQILLTLLETRRPTFEGHIEICPPGMSHSACSVNKSVLEAIRGRLGSFHELLLEPPKKSVMKTTWGVLDPPVGNTRLNVIRLISSLLQTNTSSINGDLMELNSIGVILNMFFKYTWNNFLHTQVEICIALILASPFENTENATITDQDSTGDNLLLKHLFQKCQLIERILEAWEMNEKKQAEGGRRHGYMGHLTRIANCIVHSTDKGPNSALVQQLIKDLPDEVRERWETFCTSSLGETNKRNTVDLAFSDYQMQQMTSNFIDQFGFNDEKFADQDDIGNVSFDRVSDINFTLNTNESGNIALFEACCKERIQQFDDGGSDEEDIWEEKHIAFTPESQRRSSSGSTDSEESTDSEEEDGAKQDLFEPSSANTEDKMEVDLSEPPNWSANFDVPMETTHGAPLDSVGSDVWSTEEPMPTKETGWASFSEFTSSLSTKDSLRSNSPVEMETSTEPMDPLTPSAAALAVQPEAAGSVAMEASSDGEEDAESTDKVTETVMNGGMKETLSLTVDAKTETAVFKSEEGKLSTSQDAACKDAEECPETAEAKCAAPRPPSSSPEQRTGQPSAPGDTSVNGPV

SEQ ID NO: 887448 - protein, 827 aa, Homo sapiens
MFWKFDLHSSSHIDTLLEREDVTLKELMDEEDVLQECKAQNRKLIEFLLKAECLEDLVSFIIEEPPQDMDEKIRYKYPNISCELLTSDVSQMNDRLGEDESLLMKLYSFLLNDSPLNPLLASFFSKVLSILISRKPEQIVDFLKKKHDFVDLIIKHIGTSAIMDLLLRLLTCIEPPQPRQDVLNWLNEEKIIQRLVEIVHPSQEEDRHSNASQSLCEIVRLSRDQMLQIQNSTEPDPLLATLEKQEIIEQLLSNIFHKEKNESAIVSAIQILLTLLETRRPTFEGHIEICPPGMSHSACSVNKSVLEAIRGRLGSFHELLLEPPKKSVMKTTWGVLDPPVGNTRLNVIRLISSLLQTNTSSINGDLMELNSIGVILNMFFKYTWNNFLHTQVEICIALILASPFENTENATITDQDSTGDNLLLKHLFQKCQLIERILEAWEMNEKKQAEGGRRHGYMGHLTRIANCIVHSTDKGPNSALVQQLIKDLPDEVRERWETFCTSSLGETNKRNTVDLFGFNDEKFADQDDIGNVSFDRVSDINFTLNTNESGNIALFEACCKERIQQFDDGGSDEEDIWEEKHIAFTPESQRRSSSGSTDSEESTDSEEEDGAKQDLFEPSSANTEDKMEVDLSEPPNWSANFDVPMETTHGAPLDSVGSDVWSTEEPMPTKETGWASFSEFTSSLSTKDSLRSNSPVEMETSTEPMDPLTPSAAALAVQPEAAGSVAMEASSDGEEDAESTDKVTETVMNGGMKETLSLTVDAKTETAVFKSEEGKLSTSQDAACKDAEECPETAEAKCAAPRPPSSSPEQRTGQPSAPGDTSVNGPV

SEQ ID NO: 887449 - protein, 844 aa, Homo sapiens; identical to SEQ ID NO: 887447

SEQ ID NO: 887450 - protein, 619 aa, Homo sapiens
MLQIQNSTEPDPLLATLEKQEIIEQLLSNIFHKEKNESAIVSAIQILLTLLETRRPTFEGHIEICPPGMSHSACSVNKSVLEAIRGRLGSFHELLLEPPKKSVMKTTWGVLDPPVGNTRLNVIRLISSLLQTNTSSINGDLMELNSIGVILNMFFKYTWNNFLHTQVEICIALILASPFENTENATITDQDSTGDNLLLKHLFQKCQLIERILEAWEMNEKKQAEGGRRHGYMGHLTRIANCIVHSTDKGPNSALVQQLIKDLPDEVRERWETFCTSSLGETNKRNTVDLAFSDYQMQQMTSNFIDQFGFNDEKFADQDDIGNVSFDRVSDINFTLNTNESGNIALFEACCKERIQQFDDGGSDEEDIWEEKHIAFTPESQRRSSSGSTDSEESTDSEEEDGAKQDLFEPSSANTEDKMEVDLSEPPNWSANFDVPMETTHGAPLDSVGSDVWSTEEPMPTKETGWASFSEFTSSLSTKDSLRSNSPVEMETSTEPMDPLTPSAAALAVQPEAAGSVAMEASSDGEEDAESTDKVTETVMNGGMKETLSLTVDAKTETAVFKSEEGKLSTSQDAACKDAEECPETAEAKCAAPRPPSSSPEQRTGQPSAPGDTSVNGPV

SEQ ID NO: 887451 - protein, 631 aa, Homo sapiens
MDLLLRLLTCIEPPQPRQDVLNWLNEEKIIQRLVEIVHPSQEEDRHSNASQSLCEIVRLSRDQMLQIQNSTEPDPLLATLEKQEIIEQLLSNIFHKEKNESAIVSAIQILLTLLETRRPTFEGHIEICPPGMSHSACSVNKSVLEAIRGRLGSFHELLLEPPKNMFFKYTWNNFLHTQVEICIALILASPFENTENATITDQDSTGDNLLLKHLFQKCQLIERILEAWEMNEKKQAEGGRRHGYMGHLTRIANCIVHSTDKGPNSALVQQLIKDLPDEVRERWETFCTSSLGETNKRNTVDLAFSDYQMQQMTSNFIDQFGFNDEKFADQDDIGNVSFDRVSDINFTLNTNESGNIALFEACCKERIQQFDDGGSDEEDIWEEKHIAFTPESQRRSSSGSTDSEESTDSEEEDGAKQDLFEPSSANTEDKMEVDLSEPPNWSANFDVPMETTHGAPLDSVGSDVWSTEEPMPTKETGWASFSEFTSSLSTKDSLRSNSPVEMETSTEPMDPLTPSAAALAVQPEAAGSVAMEASSDGEEDAESTDKVTETVMNGGMKETLSLTVDAKTETAVFKSEEGKLSTSQDAACKDAEECPETAEAKCAAPRPPSSSPEQRTGQPSAPGDTSVNGPV

SEQ ID NO: 887452 - protein, 513 aa, Homo sapiens
WLNPSFPNPPVKKGPLGPWSQFNMFFKYTWNNFLHTQVEICIALILASPFENTENATITDQDSTGDNLLLKHLFQKCQLIERILEAWEMNEKKQAEGGRRHGYMGHLTRIANCIVHSTDKGPNSALVQQLIKDLPDEVRERWETFCTSSLGETNKRNTVDLVTTCHIHSSSDDEIDFKETGFSQDSSLQQMQQMTSNFIDQFGFNDEKFADQDDIGNVSFDRVSDINFTLNTNESGNIALFEACCKERIQQFDDGGSDEEDIWEEKHIAFTPESQRRSSSGSTDSEESTDSEEEDGAKQDLFEPSSANTEDKMEVDLSEPPNWSANFDVPMETTHGAPLDSVGSDVWSTEEPMPTKETGWASFSEFTSSLSTKDSLRSNSPVEMETSTEPMDPLTPSAAALAVQPEAAGSVAMEASSDGEEDAESTDKVTETVMNGGMKETLSLTVDAKTETAVFKSEEGKLSTSQDAACKDAEECPETAEAKCAAPRPPSSSPEQRTGQPSAPGDTSVNGPV

SEQ ID NO: 887453 - protein, 844 aa, Homo sapiens; identical to SEQ ID NO: 887447

SEQ ID NO: 887454 - protein, 791 aa, Homo sapiens
MFWKFDLHSSSHIDTLLEREDVTLKELMDEEDVLQECKAQNRKLIEFLLKAECLEDLVSFIIEEPPQDMDEKIRYKYPNISCELLTSDVSQMNDRLGEDESLLMKLYSFLLNDSPLNPLLASFFSKVLSILISRKPEQIVDFLKKKHDFVDLIIKHIGTSAIMDLLLRLLTCIEPPQPRQDVLNWLNEEKIIQRLVEIVHPSQEEDRHSNASQSLCEIVRLSRDQMLQIQNSTEPDPLLATLEKQEIIEQLLSNIFHKEKNESAIVSAIQILLTLLETRRPTFEGHIEICPPGMSHSACSVNKSVLEAIRGRLGSFHELLLEPPKNMFFKYTWNNFLHTQVEICIALILASPFENTENATITDQDSTGDNLLLKHLFQKCQLIERILEAWEMNEKKQAEGGRRHGYMGHLTRIANCIVHSTDKGPNSALVQQLIKDLPDEVRERWETFCTSSLGETNKRNTVDLAFSDYQMQQMTSNFIDQFGFNDEKFADQDDIGNVSFDRVSDINFTLNTNESGNIALFEACCKERIQQFDDGGSDEEDIWEEKHIAFTPESQRRSSSGSTDSEESTDSEEEDGAKQDLFEPSSANTEDKMEVDLSEPPNWSANFDVPMETTHGAPLDSVGSDVWSTEEPMPTKETGWASFSEFTSSLSTKDSLRSNSPVEMETSTEPMDPLTPSAAALAVQPEAAGSVAMEASSDGEEDAESTDKVTETVMNGGMKETLSLTVDAKTETAVFKSEEGKLSTSQDAACKDAEECPETAEAKCAAPRPPSSSPEQSGVEIPALPGQWSQQ

SEQ ID NO: 887455 - protein, 800 aa, Homo sapiens
MFWKFDLHSSSHIDTLLEREDVTLKELMDEEDVLQECKAQNRKLIEFLLKAECLEDLVSFIIEEPPQDMDEKIRYKYPNISCELLTSDVSQMNDRLGEDESLLMKLYSFLLNDSPLNPLLASFFSKVLSILISRKPEQIVDFLKKKHDFVDLIIKHIGTSAIMDLLLRLLTCIEPPQPRQDVLNWLNEEKIIQRLVEIVHPSQEEDRHSNASQSLCEIVRLSRDQMLQIQNSTEPDPLLATLEKQEIIEQLLSNIFHKEKNESAIVSAIQILLTLLETRRPTFEGHIEICPPGMSHSACSVNKSVLEAIRGRLGSFHELLLEPPKKSVMKTTWGVLDPPVGNTRLNVIRLISSLLQTNTSSINGDLMELNSIGVILNMFFKYTWNNFLHTQVEICIALILASPFENTENATITDQDSTGDNLLLKHLFQKCQLIERILEAWEMNEKKQAEGGRRHGYMGHLTRIANCIVHSTDKGPNSALVQQLIKDLPDEVRERWETFCTSSLGETNKRNTVDLVTTCHIHSSSDDEIDFKETGFSQDSSLQQFGFNDEKFADQDDIGNVSFDRVSDINFTLNTNESGNIALFEACCKERIQQFDDGGSDEEDIWEEKHIAFTPESQRRSSSGSTDSEESTDSEEEDGAKQDLFEPSSANTEDKMEVDLSEPPNWSANFDVPMETTHGAPLDSVGSDVWSTEEPMPTKETGWASFSEFTSSLSTKDSLRSNSPVEMETSTEPMDPLTPSAAALAVQPEAAGSVAMEASSDGEEDAESTDKVTETVMNGGMKETLSLTVDAKTETAVFKR

SEQ ID NO: 887456 - protein, 844 aa, Homo sapiens; identical to SEQ ID NO: 887447

SEQ ID NO: 887457 - protein, 844 aa, Homo sapiens; identical to SEQ ID NO: 887447

SEQ ID NO: 887458 - protein, 788 aa, Homo sapiens
MFWKFDLHSSSHIDTLLEREDVTLKELMDEEDVLQECKAQNRKLIEFLLKAECLEDLVSFIIEEPPQDMDEKIRYKYPNISCELLTSDVSQMNDRLGEDESLLMKLYSFLLNDSPLNPLLASFFSKVLSILISRKPEQIVDFLKKKHDFVDLIIKHIGTSAIMDLLLRLLTCIEPPQPRQDVLNWLNEEKIIQRLVEIVHPSQEEDRHSNASQSLCEIVRLSRDQMLQIQNSTEPDPLLATLEKQEIIEQLLSNIFHKEKNESAIVSAIQILLTLLETRRPTFEGHIEICPPGMSHSACSVNKSVLEAIRGRLGSFHELLLEPPKKSVMKTTWGVLDPPVGNTRLNVIRLISSLLQTNTSSINGDLMELNSIGVILNMFFKYTWNNFLHTQVEICIALILASPFENTENATITDQDSTGDNLLLKHLFQKCQLIERILEAWEMNEKKQAEGGRRHGYMGHLTRIANCIVHSTDKGPNSALVQQLIKDLPDEVRERWETFCTSSLGETNKRNTVDLAFSDYQMQQMTSNFIDQFGFNDEKFADQDDIGNVSFDRVSDINFTLNTNESGNIALFEACCKERIQQFDDGGSDEEDIWEEKHIAFTPESQRRSSSGSTDSEESTDSEEEDGAKQDLFEPSSANTEDKMEVDLSEPPNWSANFDVPMETTHGAPLDSVGSDVWSTEEPMPTKETGWASFSEFTSSLSTKDSLRSNSPVEMETSTEPMDPLTPSAAALAVQPEAAGSVAMEASSDGEEDAESTDKVTETVMNGGMKETLSLTVDAKTETAVFKR

SEQ ID NO: 887459 - protein, 842 aa, Homo sapiens
MFWKFDLHSSSHIDTLLEREDVTLKELMDEEDVLQECKAQNRKLIEFLLKAECLEDLVSFIIEEPPQDMDEKIRYKYPNISCELLTSDVSQMNDRLGEDESLLMKLYSFLLNDSPLNPLLASFFSKVLSILISRKPEQIVDFLKKKHDFVDLIIKHIGTSAIMDLLLRLLTCIEPPQPRQDVLNWLNEEKIIQRLVEIVHPSQEEDRHSNASQSLCEIVRLSRDQMLQIQNSTEPDPLLATLEKQEIIEQLLSNIFHKEKNESAIVSAIQILLTLLETRRPTFEGHIEICPPGMSHSACSVNKSVLEAIRGRLGSFHELLLEPPKKSVMKTTWGVLDPPVGNTRLNVIRLISSLLQTNTSSINGDLMELNSIGVILNMFFKYTWNNFLHTQVEICIALILASPFENTENATITDQDSTGDNLLLKHLFQKCQLIERILEAWEMNEKKQAEGGRRHGYMGHLTRIANCIVHSTDKGPNSALVQQLIKDLPDEVRERWETFCTSSLGETNKRNTVDLAFSDYQMQQMTSNFIDQFGFNDEKFADQDDIGNVSFDRVSDINFTLNTNESGNIALFEACCKERIQQFDDGGSDEEDIWEEKHIAFTPESQRRSSSGSTDSEESTDSEEEDGAKQDLFEPSSANTEDKMEVDLSEPPNWSANFDVPMETTHGAPLDSVGSDVWSTEEPMPTKETGWASFSEFTSSLSTKDSLRSNSPVEMETSTEPMDPLTPSAAALAVQPEAAGSVAMEASSDGEEDAESTDKVTETVMNGGMKETLSLTVDAKTETAVFKSEEGKLSTSQDAACKDAEECPETAEAKCAAPRPPSSSPEQSGVEIPALPGQWSQQ

SEQ ID NO: 887460 - protein, 697 aa, Homo sapiens
MDKGCKQATVCGGKQGANQIQSKWDLSVTVVSKCYFVLTSLLIPIFKLLEKIEKVQNLPSSFYEGSEIEFQNQIKIITENDQFMPLTGYWMQKSCVRYLLTGSNSVLKIIYNDELGFILEGKDGSKSEKSVSLISIYGVRQKVSHLIFFIRFHSYDMIKTLRKPVTEVNLFFFFPPLPPPSFLLLSSSFFFLLQDECSDVDLGSLQSLSPGLKPSSHLNLPSNWDWTTGTRHHAQQIYVVFFFFFVVMGFHHVAQAGLKTPELKQSTCLHLPKCWDYRCEPPRLAMNFINLVEVKYQYQNATAKLTPNEESLDAFTLRRSLKGCPFSLPVLAVLEGKGNRVIGKDQEEVIKLLFFAGGNDYYNQVSSKLVTNKNSVKLLRRNQFKKSVVFFFISSKQPEHKKQGIIPKYIKIYNYSGMILTQVSIEKSGQVETMAELSAAETSAILKLVFNAVSIQISVGFLEVTEYSENLYGKMKVPKLLRGNQKGRLKKGLALPDESRCKVTVIGTVLILVSKQVQVQCDEIEGLIMGKGEEGLVHQKEKSGKILPNLHSKTTPAGLKDNKKNMCSAFCGPGPALYTLHVVVAHGLFLGTLEDRYWDYYPCFSGEETEALELSDEAGGQSLMMVNKRNTECLFNLCAERDFCIYLICLSSIYLSVCLPIKSIICQSISNLDFFFFNTRSRSVAQAGMQWHNHSSL

SEQ ID NO: 887461 - protein, 211 aa, Homo sapiens [sequence omitted]

SEQ ID NO: 887462 - protein, 548 aa, Homo sapiens [sequence omitted]

SEQ ID NO: 887463 - protein, 430 aa, Homo sapiens
MDERLLGPPPPGGGRGGLGLVSGEPGGPGEPPGGGDPGGGSGGVPGGRGKQDIGDILQQIMTITDQSLDEAQAKKHALNCHRMKPALFSVLCEIKEKTGLSIRSSQEEEPVDPQLMRLDNMLLAEGVAGPEKGGGSAAAAAAAAASGGGVSPDNSIEHSDYRSKLAQIRHIYHSELEKYEQACNEFTTHVMNLLREQSRTRPVAPKEMERMVSIIHRKFSAIQMQLKQSTCEAVMILRSRFLDARRKRRNFSKQATEVLNEYFYSHLSNPYPSEEAKEELAKKCGITVSQVSNWFGNKRIRYKKNIGKFQEEANIYAVKTAVSVTQGGHSRTSSPTPPSSAGSGGSFNLSGSGDMFLGMPGLNGDSYSASQVESLRHSMGPGGYGDNLGGGQMYSPREMRANGSWQEAVTPSSVTSPTEGPGSVHSDTSN

SEQ ID NO: 887464 - protein, 430 aa, Homo sapiens; identical to SEQ ID NO: 887463

SEQ ID NO: 887465 - protein, 502 aa, Homo sapiens
MDERLLGPPPPGGGRGGLGLVSGEPGGPGEPPGGGDPGGGSGGVPGGRGKQDIGDILQQIMTITDQSLDEAQAKKHALNCHRMKPALFSVLCEIKEKTGMWAPPGLLNSGNRTLFIIGLECDNWGPEESKESGGLGKEPKPGNLALQEAPGGLSLGIGVSGSLSPLACMLGLSIRSSQEEEPVDPQLMRLDNMLLAEGVAGPEKGGGSAAAAAAAAASGGGVSPDNSIEHSDYRSKLAQIRHIYHSELEKYEQACNEFTTHVMNLLREQSRTRPVAPKEMERMVSIIHRKFSAIQMQLKQSTCEAVMILRSRFLDARRKRRNFSKQATEVLNEYFYSHLSNPYPSEEAKEELAKKCGITVSQVSNWFGNKRIRYKKNIGKFQEEANIYAVKTAVSVTQGGHSRTSSPTPPSSAGSGGSFNLSGSGDMFLGMPGLNGDSYSASQVESLRHSMGPGGYGDNLGGGQMYSPREMRANGSWQEAVTPSSVTSPTEGPGSVHSDTSN

SEQ ID NO: 887466 - protein, 430 aa, Homo sapiens; identical to SEQ ID NO: 887463

SEQ ID NO: 887467 - protein, 299 aa, Homo sapiens
MDERSAAAAAAAAASGGGVSPDNSIEHSDYRSKLAQIRHIYHSELEKYEQACNEFTTHVMNLLREQSRTRPVAPKEMERMVSIIHRKFSAIQMQLKQSTCEAVMILRSRFLDARRKRRNFSKQATEVLNEYFYSHLSNPYPSEEAKEELAKKCGITVSQVSNWFGNKRIRYKKNIGKFQEEANIYAVKTAVSVTQGGHSRTSSPTPPSSAGSGGSFNLSGSGDMFLGMPGLNGDSYSASQVESLRHSMGPGGYGDNLGGGQMYSPREMRANGSWQEAVTPSSVTSPTEGPGSVHSDTSN

SEQ ID NO: 887468 - protein, 430 aa, Homo sapiens; identical to SEQ ID NO: 887463

SEQ ID NO: 887469 - protein, 349 aa, Homo sapiens
MDERLLGPPPPGGGRGGLGLVSGEPGGPGEPPGGGDPGGGSGGVPGGRGKQDIGDILQQIMTITDQSLDEAQAKKHALNCHRMKPALFSVLCEIKEKTGLSIRSSQEEEPVDPQLMRLDNMLLAEGVAGPEKGGGSAAAAAAAAASGGGVSPDNSIEHSDYRSKLAQIRHIYHSELEKYEQACNEFTTHVMNLLREQSRTRPVAPKEMERMVSIIHRKFSAIQMQLKQSTCEAVMILRSRFLDARRKRRNFSKQATEVLNEYFYSHLSNPYPSEEAKEELAKKCGITVSQVSNWFGNKRIRYKKNIGKFQEEANIYAVKTAVSVTQGGHSRTSSPTPPSSAGGSHCHPS

SEQ ID NO: 887470 - protein, 123 aa, Homo sapiens
MDERLLGPPPPGGGRGGLGLVSGEPGGPGEPPGGGDPGGGSGGVPGGRGKQDIGDILQQIMTITDQSLDEAQAKWVPPLRDPTQTQQTPFTCSESSGSPPQLQGPLQDPTALFSPYSWEPIEK

SEQ ID NO: 887471 - protein, 430 aa, Homo sapiens; identical to SEQ ID NO: 887463

SEQ ID NO: 887472 - protein, 356 aa, Homo sapiens
MDERLLGPPPPGGGRGGLGLVSGEPGGPGEPPGGGDPGGGSGGVPGGRGKQDIGDILQQIMTITDQSLDEAQAKKHALNCHRMKPALFSVLCEIKEKTGLSIRSSQEEEPVDPQLMRLDNMLLAEGVAGPEKGGGSAAAAAAAAASGGGVSPDNSIEHSDYRSKLAQIRHIYHSELEKYEQACNEFTTHVMNLLREQSRTRPVAPKEMERMVSIIHRKFSAIQMQLKQSTCEAVMILRSRFLDARRKRRNFSKQATEVLNEYFYSHLSNPYPSEEAKEELAKKCGITVSQVSNWFGNKRIRYKKNIGKFQEEANIYAVKTAVSVTQGGHSRTSSPTPPSSAGGITPTLDGARGLWG

SEQ ID NO: 887473 - protein, 500 aa, Homo sapiens
SSLSLTHTPAWASSLSPAPFSPPPGAGVSCGGPSRYPRSPFSAGVNPRGSREPGADGRGLGRREQRPQGSPLTNPRPPQLWTNGRGGLGLVSGEPGGPGEPPGGGDPGGGSGGVPGGRGKQDIGDILQQIMTITDQSLDEAQAKKHALNCHRMKPALFSVLCEIKEKTGLSIRSSQEEEPVDPQLMRLDNMLLAEGVAGPEKGGGSAAAAAAAAASGGGVSPDNSIEHSDYRSKLAQIRHIYHSELEKYEQACNEFTTHVMNLLREQSRTRPVAPKEMERMVSIIHRKFSAIQMQLKQSTCEAVMILRSRFLDARRKRRNFSKQATEVLNEYFYSHLSNPYPSEEAKEELAKKCGITVSQVSNWFGNKRIRYKKNIGKFQEEANIYAVKTAVSVTQGGHSRTSSPTPPSSAGSGGSFNLSGSGDMFLGMPGLNGDSYSASQVESLRHSMGPGGYGDNLGGGQMYSPREMRANGSWQEAVTPSSVTSPTEGPGSVHSDTSN

SEQ ID NO: 887474 - protein, 430 aa, Homo sapiens; identical to SEQ ID NO: 887463

SEQ ID NO: 887475 - protein, 375 aa, Homo sapiens
MDERLLGPPPPGGGRGGLGLVSGEPGGPGEPPGGGDPGGGSGGVPGGRGKQDIGDILQQIMTITDQSLDEAQAKKHALNCHRMKPALFSVLCEIKEKTGLSIRSSQEEEPVDPQLMRLDNMLLAEGVAGPEKGGGSAAAAAAAAASGGGVSPDNSIEHSDYRSKLAQIRHIYHSELEKYEQACNEFTTHVMNLLREQSRTRPVAPKEMERMVSIIHRKFSAIQMQLKQSTCEAVMILRSRFLDARRKRRNFSKQATEVLNEYFYSHLSNPYPSEEAKEELAKKCGITVSQVSNWFGNKRIRYKKNIGKFQEEANIYAVKTAVSVTQGGHSRTSSPTPPSSAALAGLHLSGSGDCSGMLVRRSICPRDHSTSMGSG

SEQ ID NO: 887476 - protein, 70 aa, Homo sapiens
QSRTRPVAPKEMERMVSIIHRKFSAIQMQLKQSTCEAVMILRSRFLDARWAQGPQAGPQHWAPSHSSPRP

SEQ ID NO: 887477 - protein, 98 aa, Homo sapiens
HFRVTVDAMAPIPKTVGRIKLDCSLRPSCPLEVAAAPKLCKEFGPEDYGEEVKATLSFPQSCSFWSRLFEVSCAETRDGWAPDGALEALGSCSLRPCP

SEQ ID NO: 887478 - protein, 477 aa, Homo sapiens
SFPGHCRCDGADSKDCGADQARLLSTAQLPTGGRCCTQTLQGIRSRGLRRRDYLLGHLDDEGKSTGQSDRGKGAEGLGTYCGLRKSFLYPPQESEPCPQSPSASATFPSVSDSLLQVAMPQKLLVTEEEANRLAEELVAEEERMKQKAEKKRLKKKRQKERKRQERLEQYCGEPKASTTSDGDESPPSSPGNPVQGQCGEEEDSLDLSSTFVSLALRKVGDWPLSARREKGLNQEPQGRGLALQKMGQEEESPPREERPQQSPKVQASPGLLAAALQQSQELAKLGTSFAQNGFYHEAVVLFTQALKLNPQDHRLFGNRSFCHERLGQPAWALADAQVALTLRPGWPRGLFRLGKALMGLQRFREAAAVFQETLRGGSQPDAARELRSCLLHLTLTGKGARHTVMLRRVSGRIGWDCNTKPQVAKEGAGKDGWNERHGLSCLKEGSGALLSPFSAGSARRNLCTTSVTWGPPATSPC

SEQ ID NO: 887479 - protein, 542 aa, Homo sapiens
MAPIPKTVGRIKLDCSLRPSCPLEVAAAPKLCKEFGPEDYGEEDIVDFLRRLVESDPQGLHRIHVDGSSGRLQLWHHGGECRDRAQGSRLVPWEELTLRCTPLSCPFFPVSFSLLTDYLLGHLDDEGKSTGQSDRGKGAEGLGTYCGLRKSFLYPPQESEPCPQSPSASATFPSVSDSLLQVAMPQKLLVTEEEANRLAEELVAEEERMKQKAEKKRLKKKRQKERKRQERLEQYCGEPKASTTSDGDESPPSSPGNPVQGQCGEEEDSLDLSSTFVSLALRKVGDWPLSARREKGLNQEPQGRGLALQKMGQEEESPPREERPQQSPKVQASPGLLAAALQQSQELAKLGTSFAQNGFYHEAVVLFTQALKLNPQDHRLFGNRSFCHERLGQPAWALADAQVALTLRPGWPRGLFRLGKALMGLQRFREAAAVFQETLRGGSQPDAARELRSCLLHLTLTGKGARHTVMLRRVSGRIGWDCNTKPQVAKEGAGKDGWNERHGLSCLKEGSGALLSPFSAGSARRNLCTTSVTWGPPATSPC

SEQ ID NO: 887480 - protein, 518 aa, Homo sapiens
MAPIPKTVGRIKLDCSLRPSCPLEVAAAPKLCKEFGPEDYGEEDIVDFLRRLVESDPQGLHRIHVDGSSGRLQLWHHDYLLGHLDDEGKSTGQSDRGKGAEGLGTYCGLRKSFLYPPQESEPCPQSPSASATFPSVSDSLLQVAMPQKLLVTEEEANRLAEELVAEEERMKQKAEKKRLKKKRQKERKRQERLEQYCGEPKASTTSDGDESPPSSPGNPVQGQCGEEEDSLDLSSTFVSLALRKVGDWPLSARREKGLNQEPQGRGLALQKMGQEEESPPREERPQQSPKVQASPGLLAAALQQSQELAKLGTSFAQNGFYHEAVVLFTQALKLNPQDHRLFGNRSFCHERLGQPAWALADAQVALTLRPGWPRGLFRLGKALMGLQRFREAAAVFQETLRGGSQPDAARELRSCLLHLTLGQRGGICAPPLSPGALQPLPHAELAPSGLPSLRCPRSTALRSPGLSPLLHYPSCHRSHPNQPLSQTQSRRPHPLKPQDPSKGWDILGLGLQHLSQAR

SEQ ID NO: 887481 - protein, 508 aa, Homo sapiens
MAPIPKTVGRIKLDCSLRPSCPLEVAAAPKLCKEFGPEDYGEEDIVDFLRRLVESDPQGLHRIHVDGSSGRLQLWHHDYLLGHLDDEGKSTGQSDRGKGAEGLGTYCGLRKSFLYPPQESEPCPQSPSASATFPSVSDSLLQVAMPQKLLVTEEEANRLAEELVAEEERMKQKAEKKRLKKKRQKERKRQERLEQYCGEPKASTTSDGDESPPSSPGNPVQGQCGEEEDSLDLSSTFVSLALRKVGDWPLSARREKGLNQEPQGRGLALQKMGQEEESPPREERPQQSPKVQASPGLLAAALQQSQELAKLGTSFAQNGFYHEAVVLFTQALKLNPQDHRLFGNRSFCHERLGQPAWALADAQVALTLRPGWPRGLFRLGKALMGLQETLRGGSQPDAARELRSCLLHLTLGQRGGICAPPLSPGALQPLPHAELAPSGLPSLRCPRSTALRSPGLSPLLHYPSCHRSHPNQPLSQTQSRRPHPLKPQDPSKGWDILGLGLQHLSQAR

SEQ ID NO: 887482 - protein, 518 aa, Homo sapiens; identical to SEQ ID NO: 887480

SEQ ID NO: 887483 - protein, 464 aa, Homo sapiens
HFRVTVDAMAPIPKTVGRIKLDCSLRPSCPLEVAAAPKLCKEFGPEDYGEEDIVDFLRRLVESDPQGLHRIHVDGSSGRLQLWHHDYLLGHLDDEGKSTGQSDRGKGAEGLGTYCGLRKSFLYPPQESEPCPQSPSASATFPSVSDSLLQVAMPQKLLVTEEEANRLAEELVAEEERMKQKAEKKRLKKKRQKERKRQERLEQYCGEPKASTTSDGDESPPSSPGNPVQGQCGEEEDSLDLSSTFVSLALRKVGDWPLSARREKGLNQEPQGRGLALQKMGQEEESPPREERPQQSPKVQASPGLLAAALQQSQELAKLGTSFAQNGFYHEAVVLFTQALKLNPQDHRLFGNRSFCHERLGQPAWALADAQVALTLRPGWPRGLFRLGKALMGLQRFREAAAVFQETLRGGSQPDAARELRSCLLHLTLEDGSRGREPSKRGEAPAESKGTGEGFGEAETSRPA

SEQ ID NO: 887484 - protein, 87 aa, Homo sapiens
ELVAEEERMKQKAEKKRLKKKVARAWLEGAGEPKGFGRGKEETLWEQERAQDGLQWTLLPGGHKGPRDWGVSHRPSGAVVLESYCAA

SEQ ID NO: 887485 - protein, 311 aa, Homo sapiens
HFRVTVDAMAPIPKTVGRIKLDCSLRPSCPLEVAAAPKLCKEFGPEDYGEEDIVDFLRRLVESDPQGLHRIHVDGSSGRLQLWHHDYLLGHLDDEGKSTGQSDRGKGAEGLGTYCGLRKSFLYPPQESEPCPQSPSASATFPSVSDSLLQVAMPQKLLVTEEEANRLAEELVAEEERMKQKAEKKRLKKKRQKERKRQERLEQYCGEPKASTTSDGDESPPSSPGNPVQGQCGEEEDSLDLSSTFVSLALRKVGDWPLSARREKGLNQEPQGRGLALQKMGQEEESPSSHFPMLSWHPQAYLPSGALEALL

SEQ ID NO: 887486 - protein, 511 aa, Homo sapiens
HFRVTVDAMAPIPKTVGRIKLDCSLRPSCPLEVAAAPKLCKEFGPEDYGEEDIVDFLRRLVESDPQGLHRIHVDGSSGRLQLWHHDYLLGHLDDEGKSTGQSDRGKGAEGLGTYCGLRKSFLYPPQESEPCPQSPSASATFPSVSDSLLQVAMPQKLLVTEEEANRLAEELVAEEERMKQKAEKKRLKKKRQKERKRQERLEQYCGEPKASTTSDGDESPPSSPGNPVQGQCGEEEDSLDLSSTFVSLALRKVGDWPLSARREKGLNQEPQGRGLALQKMGQEEESPPREERPQQSPKVQASPGLLAAALQQSQELAKLGTSFAQNGFYHEAVVLFTQALKLNPQDHRLFGNRSFCHERLGQPAWALADAQVALTLRPGWPRGLFRLGKALMGLQRFREAAAVFQETLRGGSQPDAARELRSCLLHLTLTGKGARHTVMLRRVSGRIGWDCNTKPQVAKEGAGKDGWNERHGLSCLKEGSGALLSPFSAGSARRNLCTTSVTWGPPATSPC

SEQ ID NO: 887487 - protein, 432 aa, Homo sapiens
MPLRILDYLLGHLDDEGKSTGQSDRGKGAEGLGTYCGLRKSFLYPPQESEPCPQSPSASATFPSVSDSLLQVAMPQKLLVTEEEANRLAEELVAEEERMKQKAEKKRLKKKRQKERKRQERLEQYCGEPKASTTSDGDESPPSSPGNPVQGQCGEEEDSLDLSSTFVSLALRKVGDWPLSARREKGLNQEPQGRGLALQKMGQEEESPPREERPQQSPKVQASPGLLAAALQQSQELAKLGTSFAQNGFYHEAVVLFTQALKLNPQDHRLFGNRSFCHERLGQPAWALADAQVALTLRPGWPRGLFRLGKALMGLQRFREAAAVFQETLRGGSQPDAARELRSCLLHLTLTGKGARHTVMLRRVSGRIGWDCNTKPQVAKEGAGKDGWNERHGLSCLKEGSGALLSPFSAGSARRNLCTTSVTWGPPATSPC

SEQ ID NO: 887488 - protein, 564 aa, Homo sapiens
MAPIPKTVGRIKLDCSLRPSCPLEVAAAPKLCKEFGPEDYGEEDIVDFLRRLVESDPQGLHRIHVDGSSGRLQLWHHDYLLGHLDDEGKSTGQSDRGKGAEGLGTYCGLRKSFLYPPQESEPCPQSPSASATFPSVSDSLLQVAMPQKLLVTEEVRFSGEGFAVPQGSFNPCIPIPIFSPELVPFKILLYCLPPFMFALHFPVSLFFCHLPFVLQEANRLAEELVAEEERMKQKAEKKRLKKKRQKERKRQERLEQYCGEPKASTTSDGDESPPSSPGNPVQGQCGEEEDSLDLSSTFVSLALRKVGDWPLSARREKGLNQEPQGRGLALQKMGQEEESPPREERPQQSPKVQASPGLLAAALQQSQELAKLGTSFAQNGFYHEAVVLFTQALKLNPQDHRLFGNRSFCHERLGQPAWALADAQVALTLRPGWPRGLFRLGKALMGLQRFREAAAVFQETLRGGSQPDAARELRSCLLHLTLTGKGARHTVMLRRVSGRIGWDCNTKPQVAKEGAGKDGWNERHGLSCLKEGSGALLSPFSAGSARRNLCTTSVTWGPPATSPC

SEQ ID NO: 887489 - protein, 416 aa, Homo sapiens
HFRVTVDAMAPIPKTVGRIKLDCSLRPSCPLEVAAAPKLCKEFGPEDYGEEDIVDFLRRLVESDPQGLHRIHVDGSSGRLQLWHHDYLLGHLDDEGKSTGQSDRGKGAEGLGTYCGLRKSFLYPPQESEPCPQSPSASATFPSVSDSLLQVAMPQKLLVTEEEANRLAEELVAEEERMKQKAEKKRLKKKRQKERKRQERLEQYCGEPKASTTSDGDESPPSSPGNPVQGQCGEEEDSLDLSSTFVSLALRKVGDWPLSARREKGLNQEPQGRGLALQKMGQEEESPPREERPQQSPKVQASPGLLAAALQQSQELAKLGTSFAQNGFYHEAVVLFTQALKLNPQDHRLFGNRSFCHFLSRLLCMTLTSLVQWSGAHLLSLLEYSPRVCIWEVPYQLLLRAGRAIHVHTPNWWLSR

SEQ ID NO: 887490 - protein, 231 aa, Homo sapiens
HFRVTVDAMAPIPKTVGRIKLDCSLRPSCPLEVAAAPKLCKEFGPEDYGEEDIVDFLRRLVESDPQGLHRIHVDGSSGRLQLWHHDYLLGHLDDEGKSTGQSDRGKGAEGLGTYCGLRKSFLYPPQESEPCPQSPSASATFPSVSDSLLQVAMPQKLLVTEEEAKIAWLRELVAEDSGIVGVIQRGDFEIPQMAGMWKPQVPLVEGHLLFQTVGCEPAPSPRKVAAENIQR

SEQ ID NO: 887491 - protein, 135 aa, Homo sapiens
TGCFGPSRVPFLPGLPRAAASGSGSRLLPSGAFVPEAAGSATAPRGCRNPGAKGGLLAAMAGSQDIFDAIVMADERFHGEGYREGYEEGSSLGVMEGRQHGTLHGAKIGSEIGCYQGFAFAWKCLLHSCTTEKDR

SEQ ID NO: 887492 - protein, 112 aa, Homo sapiens
MVRWVPTRRVVVICDGTCSHTLLCTPPGSPKSPHAGSPHPSCSRKHVRKQSRRLLRGRHESTLVLKPFPNVLVDCVVLPKLPAAGAREVTPAGAAAGGSPRWLALFLFCFFF

SEQ ID NO: 887493 - protein, 196 aa, Homo sapiens
TGCFGPSRVPFLPGLPRAAASGSGSRLLPSGAFVPEAAGSATAPRGCRNPGAKGGLLAAMAGSQDIFDAIVMADERFHGEGYREGYEEGSSLGVMEGRQHGTLHGAKIGSEIGCYQGFAFAWKCLLHSCTTEKDSRKMKVLESLIGMIQKFPYDDPTYDKLHEDLDKIRGKFKQFCSLLNVQPDFKISAEGSGLSF

SEQ ID NO: 887494 - protein, 129 aa, Homo sapiens
TGCFGPSRVPFLPGLPRAAASGSGSRLLPSGAFVPEAAGSATAPRGCRNPGAKGGLLAAMAGSQDIFDAIVMADERFHGEGYREGYEEGSSLGVMEGRQHGTLHGAKIGSEQKDEGLRIIDWNDPEIPL

SEQ ID NO: 887495 - protein, 196 aa, Homo sapiens; identical to SEQ ID NO: 887493

SEQ ID NO: 887496 - protein, 157 aa, Homo sapiens
TGCFGPSRVPFLPGLPRAAASGSGSRLLPSGAFVPEAAGSATAPRGCRNPGAKGGLLAAMAGSQDIFDAIVMADERFHGEGYREGYEEGSSLGVMEGRQHGTLHGAKIGSEVSGNPHLEMKPLHLQFIIYFDIQCDGVRIVRPFKITVPDGRGDSHL

SEQ ID NO: 887497 - protein, 196 aa, Homo sapiens; identical to SEQ ID NO: 887493

SEQ ID NO: 887498 - protein, 102 aa, Homo sapiens [sequence omitted]

SEQ ID NO: 887499 - protein, 102 aa, Homo sapiens
TGCFGPSRVPFLPGLPRAAASGSGSRLLPSGAFVPEAAGSATAPRGCRNPGAKGGLLAAMAGSQDIFDAIVMADERSGATKVLLLHGNVYCTVAPLRRTAER

SEQ ID NO: 887500 - protein, 196 aa, Homo sapiens; identical to SEQ ID NO: 887493

SEQ ID NO: 887501 - protein, 103 aa, Homo sapiens [sequence omitted]

SEQ ID NO: 887502 - protein, 517 aa, Homo sapiens
MLRAAARFGPRLGRRLLSAAATQAVPAPNQQPEVFCNQIFINNEWHDAVSRKTFPTVNPSTGEVICQVAEGDKEDVDKAVKAARAAFQLGSPWRRMDASHRGRLLNRLADLIERDRTYLAALETLDNGKPYVISYLVDLDMVLKCLRYYAGWADKYHGKTIPIDGDFFSYTRHEPVGVCGQIIPWNFPLLMQAWKLGPALATGNVVVMKVAEQTPLTALYVANLIKEAGFPPGVVNIVPGFGPTAGAAIASHEDVDKVAFTGSTEIGRVIQVAAGSSNLKRVTLELGGKSPNIIMSDADMDWAVEQAHFALFFNQGQCCCAGSRTFVQEDIYDEFVERSVARAKSRVVGNPFDSKTEQGPQVDETQFKKILGYINTGKQEGAKLLCGGGIAADRGYFIQPTVFGDVQDGMTIAKEEIFGPVMQILKFKTIEEVVGRANNSTYGLAAAVFTKDLDKANYLSQALQAGTVWVNCYDVFGAQSPFGGYKMSGSGRELGEYGLQAYTEVKTVTVKVPQKNS

SEQ ID NO: 887503 - protein, 204 aa, Homo sapiens
MASWQDDDEFVERSVARAKSRVVGNPFDSKTEQGPQVDETQFKKILGYINTGKQEGAKLLCGGGIAADRGYFIQPTVFGDVQDGMTIAKEEIFGPVMQILKFKTIEEVVGRANNSTYGLAAAVFTKDLDKANYLSQALQAGTVWTTAMNTLSPVTPGGYKSPELTASWAVRAASTPEVITVHSKGPTITSSIMQAPSLTIDVTL

SEQ ID NO: 887504 - protein, 158 aa, Homo sapiens
RYRLNDPSLRRMSRLYDNHPCAGSRTFVQEDIYDEFVERSVARAKSRVVGNPFDSKTEQGPQVDETQFKKILGYINTGKQEGAKLLCGGGIAADPHSARLEGLGQVIGLVQILCEDSCGQPVRGIVGSPNNLLYGLELQDLHHWPEDLLLGDGHAILH

SEQ ID NO: 887505 - protein, 517 aa, Homo sapiens; identical to SEQ ID NO: 887502

SEQ ID NO: 887506 - protein, 569 aa, Homo sapiens
RGRLSGPETLALLSVRSLSASPLRCCALPPASGPAWAAASCQPPPPRPCLPPTSSPRSSATRIQIFDTIEIEMATSASHARKIIPHLSIPSTCERVILSGIQNRDAEDVDKALNGRPWPLFLRLELYLCDASCCDINFHELVAAQCVACNQSMCPIPESEVEALGIHIACGGALETLDNGKPYVISYLVDLDMVLKCLRYYAGWADKYHGKTIPIDGDFFSYTRHEPVGVCGQIIPWNFPLLMQAWKLGPALATGNVVVMKVAEQTPLTALYVANLIKEAGFPPGVVNIVPGFGPTAGAAIASHEDVDKVAFTGSTEIGRVIQVAAGSSNLKRVTLELGGKSPNIIMSDADMDWAVEQAHFALFFNQGQCCCAGSRTFVQEDIYDEFVERSVARAKSRVVGNPFDSKTEQGPQVDETQFKKILGYINTGKQEGAKLLCGGGIAADRGYFIQPTVFGDVQDGMTIAKEEIFGPVMQILKFKTIEEVVGRANNSTYGLAAAVFTKDLDKANYLSQALQAGTVWVNCYDVFGAQSPFGGYKMSGSGRELGEYGLQAYTEVKTVTVKVPQKNS

SEQ ID NO: 887507 - protein, 315 aa, Homo sapiens
MASPMSSPTWWIWTWSSNVSGIMPAGLISTTGKPSPLTETSSATHAIASHEDVDKVAFTGSTEIGRVIQVAAGSSNLKRVTLELGGKSPNIIMSDADMDWAVEQAHFALFFNQGQCCCAGSRTFVQEDIYDEFVERSVARAKSRVVGNPFDSKTEQGPQVDETQFKKILGYINTGKQEGAKLLCGGGIAADRGYFIQPTVFGDVQDGMTIAKEEIFGPVMQILKFKTIEEVVGRANNSTYGLAAAVFTKDLDKANYLSQALQAGTVWVNCYDVFGAQSPFGGYKMSGSGRELGEYGLQAYTEVKTVTVKVPQKNS

SEQ ID NO: 887508 - protein, 517 aa, Homo sapiens; identical to SEQ ID NO: 887502

SEQ ID NO: 887509 - protein, 220 aa, Homo sapiens
VSSASILSLMYVCTSTLRDTNTCAGSRTFVQEDIYDEFVERSVARAKSRVVGNPFDSKTEQGPQVDETQFKKILGYINTGKQEGAKLLCGGGIAADRGYFIQPTVFGDVQDGMTIAKEEIFGPVMQILKFKTIEEVVGRANNSTYGLAAAVFTKDLDKANYLSQALQAGTVWVNCYDVFGAQSPFGGYKMSGSGRELGEYGLQAYTEVKTVTVKVPQKNS

SEQ ID NO: 887510 - protein, 217 aa, Homo sapiens
MLRAAARFGPRLGRRLLSAAATQAVPAPNQQPEVFCNQIFINNEWHDAVSRKTFPTVNPSTGEVICQVAEGDKEDVDKAVKAARAAFQLGSPWRRMDASHRGRLLNRLADLIERDRTYLAALETLDNGKPYVISYLVDLMMSLWSGALPGPSLGWSGTPLIARPSRGRRWMKLSLRRSSATSTRGSKRGRSCCVVGALLLTVVTSSSPLCLEMCRMA

SEQ ID NO: 887511 - protein, 517 aa, Homo sapiens; identical to SEQ ID NO: 887502

SEQ ID NO: 887512 - protein, 534 aa, Homo sapiens
MLRAAARFGPRLGRRLLSAAATQAVPAPNQQPEVFCNQIFINNEWHDAVSRKTFPTVNPSTGEVICQVAEGDKEDVDKAVKAARAAFQLGSPWRRMDASHRGRLLNRLADLIERDRTYLAALETLDNGKPYVISYLVDLDMVLKCLRYYAGWADKYHGKTIPIDGDFFSYTRHEPVGVCGQIIPWNFPLLMQAWKLGPALATGNVVVMKVAEQTPLTALYVANLIKEAGFPPGVVNIVPGFGPTAGAAIASHEDVDKVAFTGSTEIGRVIQVAAGSSNLKRVTLELGGKSPNIIMSDADMDWAVEQAHFALFFNQGQCCCAGSRTFVQEDIYDEFVERSVARAKSRVVGNPFDSKTEQGPQVDETQFKKILGYINTGKQEGAKLLCGGGIAADRGYFIQPTVFGDVQDGMTIAKEEIFGPVMQILKFKTIEEVVGRANNSTYGLAAAVFTKDLDKANYLSQALQAGTVWVNCYDVFGAQSPFGGYKMSGSGRELGEYGLQAYTEVKTLPPSAIDGKFSKISNKTKKNDPCVLNI

SEQ ID NO: 887513 - protein, 517 aa, Homo sapiens; identical to SEQ ID NO: 887502

SEQ ID NO: 887514 - protein, 182 aa, Homo sapiens
RTRGPVLQEFGTSGNLFDSKTEQGPQVDETQFKKILGYINTGKQEGAKLLCGGGIAADRGYFIQPTVFGDVQDGMTIAKEEIFGPVMQILKFKTIEEVVGRANNSTYGLAAAVFTKDLDKANYLSQALQAGTVWVNCYDVFGAQSPFGGYKMSGSGRELGEYGLQAYTEVKTVTVKVPQKNS

SEQ ID NO: 887515 - protein, 183 aa, Homo sapiens
RGRLSGPETLALLSVRSLSASPLRCCALPPASGPAWAAASCQPPPPRPCLLCGGGIAADRGYFIQPTVFGDVQDGMTIAKEEIFGPVMQILKFKTIEEVVGRANNSTYGLAAAVFTKDLDKANYLSQALQAGTVWVNCYDVFGAQSPFGGYKMSGSGRELGEYGLQAYTEVKTVTVKVPQKNS

SEQ ID NO: 887516 - protein, 143 aa, Homo sapiens
QRIPPLLSTSLCGGGIAADRGYFIQPTVFGDVQDGMTIAKEEIFGPVMQILKFKTIEEVVGRANNSTYGLAAAVFTKDLDKANYLSQALQAGTVWVNCYDVFGAQSPFGGYKMSGSGRELGEYGLQAYTEVKTVTVKVPQKNS

SEQ ID NO: 887517 - protein, 445 aa, Homo sapiens
MLRAAARFGPRLGRRLLSAAATQAVPAPNQQPEVFCNQIFINNEWHDAVSRKTFPTVNPSTGEVICQVAEGDKEDVDKAVKAARAAFQLGSPWRRMDASHRGRLLNRLADLIERDRTYLAALETLDNGKPYVISYLVDLDMVLKCLRYYAGWADKYHGKTIPIDGDFFSYTRHEPVGVCGQIIPWNFPLLMQAWKLGPALATGNVVVMKVAEQTPLTALYVANLIKEAGFPPGVVNIVPGFGPTAGAAIASHEDVDKVAFTGSTEIGRVIQVAAGSSNLKRVTLELGGKSPNIIMSDADMDWAVEQAHFALFFNQGQCCCAGSRTFVQEDIYDEFVERSVARAKSRVVGNPFDSKTEQGPQVDETQFKKILGYINTGKQEGAKLLCGGGIAADRGYFIQPTVFGDVQDGMTIAKEEIFGPVMQILKFKTIEEVGEGGDVGEGEDV

SEQ ID NO: 887518 - protein, 328 aa, Homo sapiens
MLRAAARFGPRLGRRLLSAAATQAVPAPNQQPEVFCNQIFINNEWHDAVSRKTFPTVNPSTGEVICQVAEGDKEDVDKAVKAARAAFQLGSPWRRMDASHRGRLLNRLADLIERDRTYLAALETLDNGKPYVISYLVDLDMVLKCLRYYAGWADKYHGKTIPIDGDFFSYTRHEPVGVCGQIIPWNFPLLMQAWKLGPALATGNRGYFIQPTVFGDVQDGMTIAKEEIFGPVMQILKFKTIEEVVGRANNSTYGLAAAVFTKDLDKANYLSQALQAGTVWVNCYDVFGAQSPFGGYKMSGSGRELGEYGLQAYTEVKTVTVKVPQKNS

SEQ ID NO: 887519 - protein, 293 aa, Homo sapiens
MLRAAARFGPRLGRRLLSAAATQAVPAPNQQPEVFCNQIFINNEWHDAVSRKTFPTVNPSTGEVICQVAEGDKEDVDKAVKAARAAFQLGSPWRRMDASHRGRLLNRLADLIERDRTYLAALETLDNGKPYVISYLVDLDMVLKCLRYYAGWADKYHGKTIPIDGDFFSYTRHEPVGVCGQIIPWNFPLLMQAWKLGPALATGNVVVMKVAEQTPLTALYVANLIKELLPLCVHCADCPRLGALPALRFASGFPAPDCPLPGLWNRPNGLAGGKPHSLALLAVPPFRSPALSR

SEQ ID NO: 887520 - protein, 71 aa, Homo sapiens
QRIPPLLSTSLCGGGIAADRGYFIQPTVFGDVQDGMTIAKEEIFGPVMQILKFKTIEEVGEGGDVGEGEDV

SEQ ID NO: 887521 - protein, 512 aa, Homo sapiens
MDLAGNKAAALDIAMIKMVAPSMASRVIDRAIQIFINNEWHDAVSRKTFPTVNPSTGEVICQVAEGDKEDVDKAVKAARAAFQLGSPWRRMDASHRGRLLNRLADLIERDRTYLAALETLDNGKPYVISYLVDLDMVLKCLRYYAGWADKYHGKTIPIDGDFFSYTRHEPVGVCGQIIPWNFPLLMQAWKLGPALATGNVVVMKVAEQTPLTALYVANLIKEAGFPPGVVNIVPGFGPTAGAAIASHEDVDKVAFTGSTEIGRVIQVAAGSSNLKRVTLELGGKSPNIIMSDADMDWAVEQAHFALFFNQGQCCCAGSRTFVQEDIYDEFVERSVARAKSRVVGNPFDSKTEQGPQVDETQFKKILGYINTGKQEGAKLLCGGGIAADRGYFIQPTVFGDVQDGMTIAKEEIFGPVMQILKFKTIEEVVGRANNSTYGLAAAVFTKDLDKANYLSQALQAGTVWVNCYDVFGAQSPFGGYKMSGSGRELGEYGLQAYTEVKTVTVKVPQKNS

SEQ ID NO: 887522 - protein, 496 aa, Homo sapiens
MLRAAARFGPRLGRRLLSAAATQAVPAPNQQPEVFCNQIFINNEWHDAVSRKEDVDKAVKAARAAFQLGSPWRRMDASHRGRLLNRLADLIERDRTYLAALETLDNGKPYVISYLVDLDMVLKCLRYYAGWADKYHGKTIPIDGDFFSYTRHEPVGVCGQIIPWNFPLLMQAWKLGPALATGNVVVMKVAEQTPLTALYVANLIKEAGFPPGVVNIVPGFGPTAGAAIASHEDVDKVAFTGSTEIGRVIQVAAGSSNLKRVTLELGGKSPNIIMSDADMDWAVEQAHFALFFNQGQCCCAGSRTFVQEDIYDEFVERSVARAKSRVVGNPFDSKTEQGPQVDETQFKKILGYINTGKQEGAKLLCGGGIAADRGYFIQPTVFGDVQDGMTIAKEEIFGPVMQILKFKTIEEVVGRANNSTYGLAAAVFTKDLDKANYLSQALQAGTVWVNCYDVFGAQSPFGGYKMSGSGRELGEYGLQAYTEVKTVTVKVPQKNS

SEQ ID NO: 887523 - protein, 498 aa, Homo sapiens
MLRAAARFGPRLGRRLLSAAATQAVPAPNQQPEVFCNQIFINNEWHDAVSRKTFPTVNPSTGEVICQVAEGDKEDVDKAVKAARAAFQLGSPWRRMDASHRGRLLNRLADLIERDRTYLAALETLDNGKPYVISYLVDLDMVLKCLRYAGWADKYHGGVCGQIIPWNFPLLMQAWKLGPALATGNVVVMKVAEQTPLTALYVANLIKEAGFPPGVVNIVPGFGPTAGAAIASHEDVDKVAFTGSTEIGRVIQVAAGSSNLKRVTLELGGKSPNIIMSDADMDWAVEQAHFALFFNQGQCCCAGSRTFVQEDIYDEFVERSVARAKSRVVGNPFDSKTEQGPQVDETQFKKILGYINTGKQEGAKLLCGGGIAADRGYFIQPTVFGDVQDGMTIAKEEIFGPVMQILKFKTIEEVVGRANNSTYGLAAAVFTKDLDKANYLSQALQAGTVWVNCYDVFGAQSPFGGYKMSGSGRELGEYGLQAYTEVKTVTVKVPQKNS

SEQ ID NO: 887524 - protein, 517 aa, Homo sapiens; identical to SEQ ID NO: 887502

SEQ ID NO: 887525 - protein, 321 aa, Homo sapiens
MVITQPDEASGLLPELHNGQVLTVLRIDNTCAPISFDLGAAEEQLQTWGIQVPADQYRSLAESALLEPQVRRYIIYNSRPMRLAFAVVFYVVVWANIYSTSQMFALGNHWAGMLLVTLAAVSLTLTLVLVFERHQKKANTNTDLRLAAANGALLRHRVLLGVTDTVEGCQSVIQLWFVYFDLENCVQFLSDHVQEMKTSQESLLRSRLSQLCVVMETGVSPATAEGPENLEDAPLLPGNSCPNERPLMQTELHQLVPEAEPEEMARQLLAVFGGYYIRLLVTSQLPQAMGTRHTNSPRIPCPCQLIEAYILGTGCCPFLAR

SEQ ID NO: 887526 - protein, 205 aa, Homo sapiens
YSIPECTRLGGATKSNCKLGASQVPADQYRSLAESALLEPQVRRYIIYNSRPMRLAFAVVFYVVVWANIYSTSQMFALGNHWAGMLLVTLAAVSLTLTLVLVFERHQKKANTNTDLRLAAANGALLRHRVLLGVTDTVEGCQSVIQEMARQLLAVFGGYYIRLLVTSQLPQAMGTRHTNSPRIPCPCQLIEAYILGTGCCPFLAR

SEQ ID NO: 887527 - protein, 342 aa, Homo sapiens
MACEPQVDPGATGPLPPSSPGWSALPGGSPPGWGQELHNGQVLTVLRIDNTCAPISFDLGAAEEQLQTWGIQVPADQYRSLAESALLEPQVRRYIIYNSRPMRLAFAVVFYVVVWANIYSTSQMFALGNHWAGMLLVTLAAVSLTLTLVLVFERHQKKANTNTDLRLAAANGALLRHRVLLGVTDTVEGCQSVIQLWFVYFDLENCVQFLSDHVQEMKTSQESLLRSRLSQLCVVMETGVSPATAEGPENLEDAPLLPGNSCPNERPLMQTELHQLVPEAEPEEMARQLLAVFGGYYIRLLVTSQLPQAMGTRHTNSPRIPCPCQLIEAYILGTGCCPFLAR

SEQ ID NO: 887528 - protein, 342 aa, Homo sapiens; identical to SEQ ID NO: 887527

SEQ ID NO: 887529 - protein, 342 aa, Homo sapiens; identical to SEQ ID NO: 887527

SEQ ID NO: 887530 - protein, 342 aa, Homo sapiens; identical to SEQ ID NO: 887527

SEQ ID NO: 887531 - protein, 828 aa, Homo sapiens
NNILGLGPTFWALLASPKMEHKEVVLLLLLFLKSGQGEPLDDYVNTQGASLFSVTKKQLGAGSIEECAAKCEEDEEFTCRAFQYHSKEQQCVIMAENRKSSIIIRMRDVVLFEKKVYLSECKTGNGKNYRGTMSKTKNGITCQKWSSTSPHRPRFSPATHPSEGLEENYCRNPDNDPQGPWCYTTDPEKRYDYCDILECEEECMHCSGENYDGKISKTMSGLECQAWDSQSPHAHGYIPSKFPNKNLKKNYCRNPDRELRPWCFTTDPNKRWELCDIPRCTTPPPSSGPTYQCLKGTGENYRGNVAVTVSGHTCQHWSAQTPHTHNRTPENFPCKNLDENYCRNPDGKRAPWCHTTNSQVRWEYCKIPSCDSSPVSTEQLAPTAPPELTPVVQDCYHGDGQSYRGTSSTTTTGKKCQSWSSMTPHRHQKTPENYPNAGLTMNYCRNPDADKGPWCFTTDPSVRWEYCNLKKCSGTEASVVAPPPVVLLPDVETPSEEDCMFGNGKGYRGKRATTVTGTPCQDWAAQEPHRHSIFTPETNPRAGLEKNYCRNPDGDVGGPWCYTTNPRKLYDYCDVPQCAAPSFDCGKPQVEPKKCPGRVVGGCVAHPHSWPWQVSLRTRFGMHFCGGTLISPEWVLTAAHCLEKSPRPSSYKVILGAHQEVNLEPHVQEIEVSRLFLEPTRKDIALLKLSSPAVITDKVIPACLPSPNYVVADRTECFITGWGETQGTFGAGLLKEAQLPVIENKVCNRYEFLNGRVQSTELCAGHLAGGTDSCQGDSGGPLVCFEKDKYILQGVTSWGLGCARPNKPGVYVRVSRFVTWIEGVMRNN

SEQ ID NO: 887532 - protein, 160 aa, Homo sapiens
ISRYSGPTKNNPPRMSGNRVSRLFLSPHKKICPAKVSSPAVITDKVIPACLPSPNYVVGTFGAGLLKEAQLPVIENKVCNRYEFLNGRVQSTELCAGHLAGGTDSCQGDSGGPLVCFEKDKYILQGVTSWGLGCARPNKPGVYVRVSRFVTWIEGVMRNN

SEQ ID NO: 887533 - protein, 828 aa, Homo sapiens; identical to SEQ ID NO: 887531

SEQ ID NO: 887534 - protein, 809 aa, Homo sapiens
NNILGLGPTFWALLASPKMEHKEVVLLLLLFLKSGQGEPLDDYVNTQGASLFSVTKKQLGAGSIEECAAKCEEDEEFTCRAFQYHSKEQQCVIMAENRKSSIIIRMRDVVLFEKKVYLSECKTGNGKNYRGTMSKTKNGITCQKWSSTSPHRPRFSPATHPSEGLEENYCRNPDNDPQGPWCYTTDPEKRYDYCDILECEEECMHCSGAMTAHTLMDDIPSKFPNKNLKKNYCRNPDRELRPWCFTTDPNKRWELCDIPRCTTPPPSSGPTYQCLKGTGENYRGNVAVTVSGHTCQHWSAQTPHTHNRTPENFPCKNLDENYCRNPDGKRAPWCHTTNSQVRWEYCKIPSCDSSPVSTEQLAPTAPPELTPVVQDCYHGDGQSYRGTSSTTTTGKKCQSWSSMTPHRHQKTPENYPNAGLTMNYCRNPDADKGPWCFTTDPSVRWEYCNLKKCSGTEASVVAPPPVVLLPDVETPSEEDCMFGNGKGYRGKRATTVTGTPCQDWAAQEPHRHSIFTPETNPRAGLEKNYCRNPDGDVGGPWCYTTNPRKLYDYCDVPQCAAPSFDCGKPQVEPKKCPGRVVGGCVAHPHSWPWQVSLRTRFGMHFCGGTLISPEWVLTAAHCLEKSPRPSSYKVILGAHQEVNLEPHVQEIEVSRLFLEPTRKDIALLKLSSPAVITDKVIPACLPSPNYVVADRTECFITGWGETQGTFGAGLLKEAQLPVIENKVCNRYEFLNGRVQSTELCAGHLAGGTDSCQGDSGGPLVCFEKDKYILQGVTSWGLGCARPNKPGVYVRVSRFVTWIEGVMRNN

SEQ ID NO: 887535 - protein, 828 aa, Homo sapiens; identical to SEQ ID NO: 887531

SEQ ID NO: 887536 - protein, 810 aa, Homo sapiens
NNILGLGPTFWALLASPKMEHKEVVLLLLLFLKSGQGEPLDDYVNTQGASLFSVTKKQLGAGSIEECAAKCEEDEEFTCRAFQYHSKEQQCVIMAENRKSSIIIRMRDVVLFEKKVYLSECKTGNGKNYRGTMSKTKNGITCQKWSSTSPHRPRFSPATHPSEGLEENYCRNPDNDPQGPWCYTTDPEKRYDYCDILECEEECMHCSGENYDGKISKTMSGLECQAWDSQSPHAHGYIPSKFPNKNLKKNYCRNPDRELRPWCFTTDPNKRWELCDIPRCTTPPPSSGPTYQCLKGTGENYRGNVAVTVSGHTCQHWSAQTPHTHNRTPENFPCKNLDENYCRNPDGKIPSCDSSPVSTEQLAPTAPPELTPVVQDCYHGDGQSYRGTSSTTTTGKKCQSWSSMTPHRHQKTPENYPNAGLTMNYCRNPDADKGPWCFTTDPSVRWEYCNLKKCSGTEASVVAPPPVVLLPDVETPSEEDCMFGNGKGYRGKRATTVTGTPCQDWAAQEPHRHSIFTPETNPRAGLEKNYCRNPDGDVGGPWCYTTNPRKLYDYCDVPQCAAPSFDCGKPQVEPKKCPGRVVGGCVAHPHSWPWQVSLRTRFGMHFCGGTLISPEWVLTAAHCLEKSPRPSSYKVILGAHQEVNLEPHVQEIEVSRLFLEPTRKDIALLKLSSPAVITDKVIPACLPSPNYVVADRTECFITGWGETQGTFGAGLLKEAQLPVIENKVCNRYEFLNGRVQSTELCAGHLAGGTDSCQGDSGGPLVCFEKDKYILQGVTSWGLGCARPNKPGVYVRVSRFVTWIEGVMRNN

SEQ ID NO: 887537 - protein, 514 aa, Homo sapiens
NNILGLGPTFWALLASPKMEHKEVVLLLLLFLKSGQGEPLDDYVNTQGASLFSVTKKQLGAGSIEECAAKCEEDEEFTCRAFQYHSKEQQCVIMAENRKSSIIIRMRDVVLFEKKVYLSECKTGNGKNYRGTMSKTKNGITCQKWSSTSPHRPRFSPATHPSEGLEENYCRNPDNDPQGPWCYTTDPEKRYDYCDILECEEECMHCSGENYDGKISKTMSGLECQAWDSQSPHAHGYIPSKFPNKNLKKNYCRNPDRELRPWCFTTDPNKRWELCDIPRCTTPPPSSGPTYQCLKGTGENYRGNVAVTVSGHTCQHWSAQTPHTHNRTPENFPCKNLDENYCRNPDGKRAPWCHTTNSQVRWEYCKIPSCDSSPVSTEQLAPTAPPELTPVVQDCYHGDGQSYRGTSSTTTTGKKCQSWSSMTPHRHQKTPENYPNAPLVFYHRPQRQVGVLQPEKMLRNRSECCSTSACCPASRCRDSFRRRLYVWEWERIPRQEGDHCYWDAMPGLGCPGAP

SEQ ID NO: 887538 - protein, 694 aa, Homo sapiens
NNILGLGPTFWALLASPKMEHKEVVLLLLLFLKSGQGEPLDDYVNTQGASLFSVTKKQLGAGSIEECAAKCEEDEEFTCRAFQYHSKEQQCVIMAENRKSSIIIRMRDVVLFEKKVYLSECKTGNGKNYRGTMSKTKNGITCQKWSSTSPHRPRFSPATHPSEGLEENYCRNPDNDPQGPWCYTTDPEKRYDYCDILECEEECMHCSGENYDGKISKTMSGLECQAWDSQSPHAHGYIPSKFPNKNLKKNYCRNPDRELRPWCFTTDPNKRWELCDIPRCTTPPPSSGPTYQCLKGTGENYRGNVAVTVSGHTCQHWSAQTPHTHNRTPENFPCKNLDENYCRNPDGKRAPWCHTTNSQVRWEYCKIPSCDSSPVSTEQLAPTAPPELTPVVQDCYHGDGQSYRGTSSTTTTGKKCQSWSSMTPHRHQKTPENYPNAGLTMNYCRNPDADKGPWCFTTDPSVRWEYCNLKKCSGTEASVVAPPPVVLLPDVETPSEEDCMFGNGKGYRGKRATTVTGTPCQDWAAQEPHRHSIFTPETNPRAGLEKNYCRNPDGDVGGPWCYTTNPRKLYDYCDVPQCAAPSFDCGKPQVEPKKCPGRVVGGCVAHPHSWPWQVSLRTRFGMHFCGGTLISPEWVLTAAHCLEKSPRPSSYKVILGAHQEVNLEPHVQEIEVSRLFLEPTRNPSLSAIPKLCGR

SEQ ID NO: 887539 - protein, 329 aa, Homo sapiens
MFGNGKGYRGKRATTVTGTPCQDWAAQEPHRHSIFTPETNPRAGLEKNYCRNPDGDVGGPWCYTTNPRKLYDYCDVPQCAAPSFDCGKPQVEPKKCPGRVVGGCVAHPHSWPWQVSLRTRFGMHFCGGTLISPEWVLTAAHCLEKSPRPSSYKVILGAHQEVNLEPHVQEIEVSRLFLEPTRKDIALLKLSSPAVITDKVIPACLPSPNYVVADRTECFITGWGETQGTFGAGLLKEAQLPVIENKVCNRYEFLNGRVQSTELCAGHLAGGTDSCQGDSGGPLVCFEKDKYILQGVTSWGLGCARPNKPGVYVRVSRFVTWIEGVMRNN

SEQ ID NO: 887540 - protein, 692 aa, Homo sapiens
NNILGLGPTFWALLASPKMEHKEVVLLLLLFLKSGQGEPLDDYVNTQGASLFSVTKKQLGAGSIEECAAKCEEDEEFTCRAFQYHSKEQQCVIMAENRKSSIIIRMRDVVLFEKKVYLSECKTGNGKNYRGTMSKTKNGITCQKWSSTSPHRPRFSPATHPSEGLEENYCRNPDNDPQGPWCYTTDPEKRYDYCDILECEEECMHCSGENYDGKISKTMSGLECQAWDSQSPHAHGYIPSKFPNKNLKKNYCRNPDRELRPWCFTTDPNKRWELCDIPRCTTPPPSSGPTYQCLKGTGENYRGNVAVTVSGHTCQHWSAQTPHTHNRTPENFPCKNLDENYCRNPDGKRAPWCHTTNSQVRWEYCKIPSCDSSPVSTEQLAPTAPPELTPVVQDCYHGDGQSYRGTSSTTTTGKKCQSWSSMTPHRHQKTPENYPNAGLTMNYCRNPDADKGPWCFTTDPSVRWEYCNLKKCSGTEASVVAPPPVVLLPDVETPSEEDCMFGNGKGYRGKRATTVTGTPCQDWAAQEPHRHSIFTPETNPRAGLEKNYCRNPDGDVGGPWCYTTNPRKLYDYCDVPQCAAPSFDCGKPQVEPKKCPGRVVGGCVAHPHSWPWQVSLRTRFGMHFCGGTLISPEWVLTAAHCLEKSPGLIYKVIWVPHVEEQRATKTMCTIATQYGGTAGLTPVYICPVGEDR

SEQ ID NO: 887541 - protein, 585 aa, Homo sapiens
NNILGLGPTFWALLASPKMEHKEVVLLLLLFLKSGQGEPLDDYVNTQGASLFSVTKKQLGAGSIEECAAKCEEDEEFTCRAFQYHSKEQQCVIMAENRKSSIIIRMRDVVLFEKKVYLSECKTGNGKNYRGTMSKTKNGITCQKWSSTSPHRPRFSPATHPSEGLEENYCRNPDNDPQGPWCYTTDPEKRYDYCDILECEEECMHCSGENYDGKISKTMSGLECQAWDSQSPHAHGYIPSKFPNKNLKKNYCRNPDRELRPWCFTTDPNKRWELCDIPRCTTPPPSSGPTYQCLKGTGENYRGNVAVTVSGHTCQHWSAQTPHTHNRTPENFPCKNLDENYCRNPDGKRAPWCHTTNSQVRWEYCKIPSCDSSPVSTEQLAPTAPPELTPVVQDCYHGDGQSYRGTSSTTTTGKKCQSWSSMTPHRHQKTPENYPNAGLTMNYCRNPDADKGPWCFTTDPSVRWEYCNLKKCSGTEASVVAPPPVVLLPDVETPSEEDCMFGNGKGYRGKRATTVTGTPCQDWAAQEPHRHSIFTPETNPRAGLEKNYCRNPDGDVGGPWCYTTNPRKLYDYCDVPQCGRLPSFW

SEQ ID NO: 887542 - protein, 700 aa, Homo sapiens
NNILGLGPTFWALLASPKMEHKEVVLLLLLFLKSGQGEPLDDYVNTQGASLFSVTKKQLGAGSIEECAAKCEEDEEFTCRAFQYHSKEQQCVIMAENRKSSIIIRMRDVVLFEKKVYLSECKTGNGKNYRGTMSKTKNGITCQKWSSTSPHRPRFSPATHPSEGLEENYCRNPDNDPQGPWCYTTDPEKRYDYCDILECEEECMHCSGENYDGKISKTMSGLECQAWDSQSPHAHGYIPSKFPNKNLKKNYCRNPDRELRPWCFTTDPNKRWELCDIPRCTTPPPSSGPTYQCLKGTGENYRGNVAVTVSGHTCQHWSAQTPHTHNRTPENFPCKNLDENYCRNPDGKRAPWCHTTNSQVRWEYCKIPSCDSSPVSTEQLAPTAPPELTPVVQDCYHGDGQSYRGTSSTTTTGKKCQSWSSMTPHRHQKTPENYPNAGLTMNYCRNPDADKGPWCFTTDPSVRWEYCNLKKCSGTEASVVAPPPVVLLPDVETPSEEDCMFGNGKGYRGKRATTVTGTPCQDWAAQEPHRHSIFTPETNPRAGLEKNYCRNPDGDVGGPWCYTTNPRKLYDYCDVPQCAAPSFDCGKPQVEPKKCPGRVVGGCVAHPHSWPWQVSLRTRFGMHFCGGTLISPEWVLTAAHCLEKSPRPSSYKVILGAHQEVNLEPHVQEIEVSRLFLEPTRKDIALLKLSRTAGFCSKVT

SEQ ID NO: 887543 - protein, 579 aa, Homo sapiens
NNILGLGPTFWALLASPKMEHKEVVLLLLLFLKSGQGEPLDDYVNTQGASLFSVTKKQLGAGSIEECAAKCEEDEEFTCRAFQYHSKEQQCVIMAENRKSSIIIRMRDVVLFEKKVYLSECKTGNGKNYRGTMSKTKNGITCQKWSSTSPHRPRFSPATHPSEGLEENYCRNPDNDPQGPWCYTTDPEKRYDYCDILECEEECMHCSGENYDGKISKTMSGLECQAWDSQSPHAHGYIPSKFPNKNLKKNYCRNPDRELRPWCFTTDPNKRWELCDIPRCTTPPPSSGPTYQCLKGTGENYRGNVAVTVSGHTCQHWSAQTPHTHNRTPENFPCKNLDENYCRNPDGKRAPWCHTTNSQVRWEYCKIPSCDSSPVSTEQLAPTAPPELTPVVQDCYHGDGQSYRGTSSTTTTGKKCQSWSSMTPHRHQKTPENYPNAGLTMNYCRNPDADKGPWCFTTDPSVRWEYCNLKKCSGTEASVVAPPPVVLLPDVETPSEEDCMFGNGKGYRGKRATTVTGTPCQDWAAQEPHRHSIFTPETNPRAGLEKNYCRNPDGDVGGPWCYTTVGSLKWSRRNVLEGL

SEQ ID NO: 887544 - protein, 635 aa, Homo sapiens
NNILGLGPTFWALLASPKMEHKEVVLLLLLFLKSGQGEPLDDYVNTQGASLFSVTKKQLGAGSIEECAAKCEEDEEFTCRAFQYHSKEQQCVIMAENRKSSIIIRMRDVVLFEKKVYLSECKTGNGKNYRGTMSKTKNGITCQKWSSTSPHRPRFSPATHPSEGLEENYCRNPDNDPQGPWCYTTDPEKRYDYCDILECEEECMHCSGENYDGKISKTMSGLECQAWDSQSPHAHGYIPSKFPNKNLKKNYCRNPDRELRPWCFTTDPNKRWELCDIPRCTTPPPSSGPTYQCLKGTGENYRGNVAVTVSGHTCQHWSAQTPHTHNRTPENFPCKNLDENYCRNPDGKRAPWCHTTNSQVRWEYCKIPSCDSSPVSTEQLAPTAPPELTPVVQDCYHGDGQSYRGTSSTTTTGKKCQSWSSMTPHRHQKTPENYPNAGLTMNYCRNPDADKGPWCFTTDPSVRWEYCNLKKCSGTEASVVAPPPVVLLPDVETPSEEDCMFGNGKGYRGKRATTVTGTPCQDWAAQEPHRHSIFTPETNPRAGLEKNNPRKLYDYCDVPQCAAPSFDCGKPQVEPKKCPGRVVGGCVAHPHSWPWQVSLRTRDDSVSTYIRVVCCALRVQSYLKHLVHRVIDRVE

SEQ ID NO: 887545 - protein, 389 aa, Homo sapiens
MIQSQISFEDVAVDFTLEEWQLLNPTQKNLYRDVMLENYSNLVFLEVWLDNPKMWLRDNQDNLKSMERGHKYDVFGKIFNSSINIVHVGLRSHKCGTGEKSLKCPFDLLIPKNNCERKKIDELNKKLLFCIKPGRTHGGIKYCDCSTCRKSSNEEPWLTANHITHTGVYLCMECGRFFNKKSQLVIHQRTHTGEKPYQCSECGKAFSQKSLLTVHQRTHSGEKPHGCSECQKAFSRKSLLILHQRIHTGEKPYGCSECGKAFSRKSQLKRHQITHTIEKPYSCSECGKAFSQKLKLITHQRAHTGEKPYPCSHCGKAFFWKSQLITHQRTHTGKKPYGCGECQKAFSRNSLLIRHQRIHTGEKPYECNECGEAFIRKPQLIKHQITHTG

SEQ ID NO: 887546 - protein, 108 aa, Homo sapiens
MSLLVPPYQVWTVSGGVLHRAQEPRQSSASPRQHREEAEVWAQQTVQVHSRHSPWKGSKRTSCVWFFRRRRKLLGAGLKNKDHYYFFPFPEPPRCQFCFVFLLPVCPM

SEQ ID NO: 887547 - protein, 115 aa, Homo sapiens
MIQSQVGYRFILCFMKMIQSQVGYRFILCFMKMIQSQVGYRFILCFMKMIQSQVGYRFILCFMKMIQSQVGYRFILCFVGVMRLTEISATHRRVYIHLNKRKYKLGKEDVQRSTK

SEQ ID NO: 887548 - protein, 100 aa, Homo sapiens
VLRVHVPDRAVSAAALRGPRGNSPLEQDNSCEIRKKSPQDQGCILSLQTTDQRPLQGVRTKRSHKTADFPRAAENDPVTGPKCETGYLIMDPNRSDFDGP

SEQ ID NO: 887549 - protein, 498 aa, Homo sapiens
GLRKLEDPDDSSPGKIFSTLKRPQVETKDRIAYEYVLLDFTLQASSNPEVIKINSILDIVTKVENYYLKGYIVGAIHPVIQPVGQRKHLPASYLYRVVLLRLKLSPKNSAAPSGQRRPRLVIEECPLTSEAQTNDAAKELIEKINVAAKRGMKFVGFISQHYSPSKFCNGTNHDGDIESMLHVRHGSDENCRSWNEGTLSGQSSESGIEEELHHESGQYQMEQNGSPTSSKSRKGEASDNKLYTVFNAFDDDSTSWAYQEGILSMKVTRKGSVISTLDADWLELTTFYYKQGLSLIDSFVFWETSKGEHLPKSLEGFFIYEEEGSGVPGSSRKGNDAIVVEQWTVIEGCEIKTDYGPLLHTLAEFGWLLTSVLPTPVLRHDSEGNLATKQIVFLQRPVMWNSAAQTPDKKASRHIKGEDKNKATSRSIGLDTTSSQPAESRHLPEECRLSPSRECWTKEGRLAQHNSFSGFSSSDNVLRELDDGQFDQEDGVTQVTCM

SEQ ID NO: 887550 - protein, 225 aa, Homo sapiens
FSFSFLYELFKDLDGFMSHLVFTTLLNCTLFLTGEHLPKSLEGFFIYEEEGSGVPGSSRKGNDAIVVEQWTVIEGCEIKTDYGPLLHTLAEFGWLLTSVLPTPVLRHDSEGNLATKQIVFLQRPVMWNSAAQTPDKKASRHIKGEDKNKATSRSIGLDTTSSQPAESRHLPEECRLSPSRECWTKEGRLAQHNSFSGFSSSDNVLRELDDGQFDQEDGVTQVTCM

SEQ ID NO: 887551 - protein, 348 aa, Homo sapiens
GLRKLEDPDDSSPGKIFSTLKRPQVETKDRIAYEYVLLDFTLQASSNPEVIKINSILDIVTKVENYYLKGYIVGAIHPVIQPVGQRKHLPASYLYRVVLLRLKLSPKNSAAPSGQRRPRLVIEECPLTSEAQTNDAAKELIEKINVAAKRGMKFVGFISQHYSPSKFCNGTNHDGDIESMLHVRHGSDENCRSWNEGTLSGQSSESGIEEELHHESGQYQMEQNGSPTSSKSRKGEASDNKLYTVFNAFDDDSTSWAYQEGILSMKVTRKGSVISTLDADWLELTTFYYKQGLSLIDSFVFWETSKGEHLPKSLEGFFIYEEEGSGVPGSSRKGNDAIVVEQWTVIEF

SEQ ID NO: 887552 - protein, 176 aa, Homo sapiens
CAWRAGGRRRVGQGNSGLQSPCWGFGERLDPGFWDASGEGSTGFAFIRPKMPFFGNTFSPKKTPPRKSASLSNLHSLDRSTREVELGLEYGSPTMNLAGQSLKFENGQWIAETGVSGGVDRREVQRLRRRNQQLEEENNLLRLKVDILLDMLSESTAESHLMEKELDELRISRKRK

SEQ ID NO: 887553 - protein, 169 aa, Homo sapiens
MDKCQKHDVECEKPDANEDSLCNSVHVQWPGEGSTGFAFIRPKMPFFGNTFSPKKTPPRKSASLSNLHSLDRSTREVELGLEYGSPTMNLAGQSLKFENGQWIAETGVSGGVDRREVQRLRRRNQQLEEENNLLRLKVDILLDMLSESTAESHLMEKELDELRISRKRK

SEQ ID NO: 887554 - protein, 137 aa, Homo sapiens
AGGGQAAGGGWVKVTLGYRVLAGGSGSAWTPASGTRQLDRSTREVELGLEYGSPTMNLAGQSLKFENGQWIAETGVSGGVDRREVQRLRRRNQQLEEENNLLRLKVDILLDMLSESTAESHLMEKELDELRISRKRK

SEQ ID NO: 887555 - protein, 81 aa, Homo sapiens
NHSTRIVSSHMIKCMSSRFEDNGIRSVIQLLVPLTFSDPRRREHWLCFHQAKDAFLWEYVQSEEDTSSEVGISLQPAFCAK

SEQ ID NO: 887556 - protein, 81 aa, Homo sapiens; identical to SEQ ID NO: 887555

SEQ ID NO: 887557 - protein, 81 aa, Homo sapiens; identical to SEQ ID NO: 887555

SEQ ID NO: 887558 - protein, 203 aa, Homo sapiens
FENPMKTRDSALVFLELKILSSNANEQTITTHSCMDKCQKHDVECEKPDANEDSLCNSVHVQWPGEGSTGFAFIRPKMPFFGNTFSPKKTPPRKSASLSNLHSLDRSTREVELGLEYGSPTMNLAGQSLKFENGQWIAETGVSGGVDRREVQRLRRRNQQLEEENNLLRLKVDILLDMLSESTAESHLMEKELDELRISRKRK

SEQ ID NO: 887559 - protein, 81 aa, Homo sapiens
CAWRAGGRRRVGQGNSGLQSPCWGFGERLDPGFWDASGEGSTGFAFIRPKMPFFGNTFSPKKTPPRKSASLSNLHSVPSND

SEQ ID NO: 887560 - protein, 176 aa, Homo sapiens; identical to SEQ ID NO: 887552

SEQ ID NO: 887561 - protein, 227 aa, Homo sapiens
SGSLRPLRPLKRRRRLAQEEEVEPKLFPVPVSVRGAAAAAAAAGAAMPKGGRKGGHKGRARQYTSPEEIDAQLQAEKQKAREEEEQKEGGDGAAGDPKKEKKSLDSDESEDEEDDYQQKRKGVEGLIDIENPNRVAQTTKKVTQLDLDGPKELSRREREEIEKQKAKERYMKMHLAGKTEQAKADLARLAIIRKQREEAARKKEEERKAKDDATLSGKRMQSLSLNK

SEQ ID NO: 887562 - protein, 193 aa, Homo sapiens
RTRARNSRVTAAMPKGGRKGGHKGRARQYTSPEEIDAQLQAEKQKAREEEEQKEGGDGAAGDPKKEKKSLDSDESEDEEDDYQQKRKGVEGLIDIENPNRVAQTTKKVTQLDLDGPKELSRREREEIEKQKAKERYMKMHLAGKTEQAKADLARLAIIRKQREEAARKKEEERKAKDDATLSGKRMQSLSLNK

SEQ ID NO: 887563 - protein, 227 aa, Homo sapiens; identical to SEQ ID NO: 887561

SEQ ID NO: 887564 - protein, 227 aa, Homo sapiens; identical to SEQ ID NO: 887561

SEQ ID NO: 887565 - protein, 183 aa, Homo sapiens
KLRVSAGRKGGHKGRARQYTSPEEIDAQLQAEKQKAREEEEQKEGGDGAAGDPKKEKKSLDSDESEDEEDDYQQKRKGVEGLIDIENPNRVAQTTKKVTQLDLDGPKELSRREREEIEKQKAKERYMKMHLAGKTEQAKADLARLAIIRKQREEAARKKEEERKAKDDATLSGKRMQSLSLNK

SEQ ID NO: 887566 - protein, 227 aa, Homo sapiens; identical to SEQ ID NO: 887561

SEQ ID NO: 887567 - protein, 227 aa, Homo sapiens; identical to SEQ ID NO: 887561

SEQ ID NO: 887568 - protein, 227 aa, Homo sapiens; identical to SEQ ID NO: 887561

SEQ ID NO: 887569 - protein, 101 aa, Homo sapiens
CSQRDIEANAKSANSIKQLDLDGPKELSRREREEIEKQKAKERYMKMHLAGKTEQAKADLARLAIIRKQREEAARKKEEERKAKDDATLSGKRMQSLSLNK

SEQ ID NO: 887570 - protein, 155 aa, Homo sapiens
ILPVLTLKTCDQKNTNKCSLGWGPFLASPPRKAEPEGDNVQRELSRGEIAEGLEGHKVDGKENEEKKEKREKQKGKKRKREEGREREEIEKQKAKERYMKMHLAGKTEQAKADLARLAIIRKQREEAARKKEEERKAKDDATLSGKRMQSLSLNK

SEQ ID NO: 887571 - protein, 88 aa, Homo sapiens
LAGSLHIWDGPKELSRREREEIEKQKAKERYMKMHLAGKTEQAKADLARLAIIRKQREEAARKKEEERKAKDDATLSGKRMQSLSLNK

SEQ ID NO: 887572 - protein, 227 aa, Homo sapiens; identical to SEQ ID NO: 887561

SEQ ID NO: 887573 - protein, 94 aa, Homo sapiens
SGSLRPLRPLKRRRRLAQEEEVEPKLFPVPVSVRGAAAAAAAAGAAMPKGGRKGGHKGRARQYTSPEEIDAQLQAEKQKAREEEEQKEGGDGMG

SEQ ID NO: 887574 - protein, 162 aa, Homo sapiens
SGSLRPLRPLKRRRRLAQEEEVEPKLFPVPVSVRGAAAAAAAAGAAMPKGGRKGGHKGRARQYTSPEEIDAQLQAEKQKAREEEEQKEGGDGAAGDPKKEKKSLDSDERKERRKERRKKREKEGKEGRKERKKERKRERERKKERERERERKKERKKERKKE

SEQ ID NO: 887575 - protein, 1176 aa, Homo sapiens
MAERKGTAKVDFLKKIEKEIQQKWDTERVFEVNASNLEKQTSKGKYFVTFPYPYMNGRLHLGHTFSLSKCEFAVGYQRLKGKCCLFPFGLHCTGMPIKACADKLKREIELYGCPPDFPDEEEEEEETSVKTEDIIIKDKAKGKKSKAAAKAGSSKYQWGIMKSLGLSDEEIVKFSEAEHWLDYFPPLAIQDLKRMGLKVDWRRSFITTDVNPYYDSFVRWQFLTLRERNKIKFGKRYTIYSPKDGQPCMDHDRQTGEGVGPQEYTLLKLKVLEPYPSKLSGLKGKNIFLVAATLRPETMFGQTNCWVRPDMKYIGFETVNGDIFICTQKAARNMSYQGFTKDNGVVPVVKELMGEEILGASLSAPLTSYKVIYVLPMLTIKEDKGTGVVTSVPSDSPDDIAALRDLKKKQALRAKYGIRDDMVLPFEPVPVIEIPGFGNLSAVTICDELKIQSQNDREKLAEAKEKIYLKGFYEGIMLVDGFKGQKVQDVKKTIQKKMIDAGDALIYMEPEKQVMSRSSDECVVALCDQWYLDYGEENWKKQTSQCLKNLETFCEETRRNFEATLGWLQEHACSRTYGLGTHLPWDEQWLIESLSDSTIYMAFYTVAHLLQGGNLHGQAESPLGIRPQQMTKEVWDYVFFKEAPFPKTQIAKEKLDQLKQEFEFWYPVDLRVSGKDLVPNHLSYYLYNHVAMWPEQSDKWPTAVRANGHLLLNSEKMSKSTGNFLTLTQAIDKFSADGMRLALADAGDTVEDANFVEAMADAGILRLYTWVEWVKEMVANWDSLRSGPASTFNDRVFASELNAGIIKTDQNYEKMMFKEALKTGFFEFQAAKDKYRELAVEGMHRELVFRFIEVQTLLLAPFCPHLCEHIWTLLGKPDSIMNASWPVAGPVNEVLIHSSQYLMEVTHDLRLRLKNYMMPAKGKKTDKQPLQKPSHCTIYVAKNYPPWQHTTLSVLRKHFEANNGKLPDNKVIASELGSMPELKKYMKKVMPFVAMIKENLEKMGPRILDLQLEFDEKAVLMENIVYLTNSLELEHIEVKFASEAEDKIREDCCPGKPLNVFRIEPGVSVSLVNPQPSNGHFSTKIEIRQGDNCDSIIRRLMKMNRGIKDLSKVKLMRFDDPLLGPRRVPVLGKEYTEKTPISEHAVFNVDLMSKKIHLTENGIRVDIGDTIIYLVH

SEQ ID NO: 887576 - protein, 148 aa, Homo sapiens
MPIKACADKLKREIELYGCPPDFPDEEEEEEETSVKTEDIIIKDKAKGKKSKAAAKAGSSKYQWGIMKSLGLSDEEIVKFSEAEHWLDYFPPLAIQDLKRMGLKVDWRRSFITTDVNPYYDSFVRWQFLTLRERNKIKFGKRYSLLYL

SEQ ID NO: 887577 - protein, 1176 aa, Homo sapiens; identical to SEQ ID NO: 887575

SEQ ID NO: 887578 - protein, 1122 aa, Homo sapiens
MNGRLHLGHTFSLSKCEFAVGYQRLKGKCCLFPFGLHCTGMPIKACADKLKREIELYGCPPDFPDEEEEEEETSVKTEDIIIKDKAKGKKSKAAAKAGSSKYQWGIMKSLGLSDEEIVKFSEAEHWLDYFPPLAIQDLKRMGLKVDWRRSFITTDVNPYYDSFVRWQFLTLRERNKIKFGKRYTIYSPKDGQPCMDHDRQTGEGVGPQEYTLLKLKVLEPYPSKLSGLKGKNIFLVAATLRPETMFGQTNCWVRPDMKYIGFETVNGDIFICTQKAARNMSYQGFTKDNGVVPVVKELMGEEILGASLSAPLTSYKVIYVLPMLTIKEDKGTGVVTSVPSDSPDDIAALRDLKKKQALRAKYGIRDDMVLPFEPVPVIEIPGFGNLSAVTICDELKIQSQNDREKLAEAKEKIYLKGFYEGIMLVDGFKGQKVQDVKKTIQKKMIDAGDALIYMEPEKQVMSRSSDECVVALCDQWYLDYGEENWKKQTSQCLKNLETFCEETRRNFEATLGWLQEHACSRTYGLGTHLPWDEQWLIESLSDSTIYMAFYTVAHLLQGGNLHGQAESPLGIRPQQMTKEVWDYVFFKEAPFPKTQIAKEKLDQLKQEFEFWYPVDLRVSGKDLVPNHLSYYLYNHVAMWPEQSDKWPTAVRANGHLLLNSEKMSKSTGNFLTLTQAIDKFSADGMRLALADAGDTVEDANFVEAMADAGILRLYTWVEWVKEMVANWDSLRSGPASTFNDRVFASELNAGIIKTDQNYEKMMFKEALKTGFFEFQAAKDKYRELAVEGMHRELVFRFIEVQTLLLAPFCPHLCEHIWTLLGKPDSIMNASWPVAGPVNEVLIHSSQYLMEVTHDLRLRLKNYMMPAKGKKTDKQPLQKPSHCTIYVAKNYPPWQHTTLSVLRKHFEANNGKLPDNKVIASELGSMPELKKYMKKVMPFVAMIKENLEKMGPRILDLQLEFDEKAVLMENIVYLTNSLELEHIEVKFASEAEDKIREDCCPGKPLNVFRIEPGVSVSLVNPQPSNGHFSTKIEIRQGDNCDSIIRRLMKMNRGIKDLSKVKLMRFDDPLLGPRRVPVLGKEYTEKTPISEHAVFNVDLMSKKIHLTENGIRVDIGDTIIYLVH

SEQ ID NO: 887579 - protein, 1204 aa, Homo sapiens
EVLERPMIMLRLLLLPGGVNVIAQSVLVHGERKGTAKVDFLKKIEKEIQQKWDTERVFEVNASNLEKQTSKGKYFVTFPYPYMNGRLHLGHTFSLSKCEFAVGYQRLKGKCCLFPFGLHCTGMPIKACADKLKREIELYGCPPDFPDEEEEEEETSVKTEDIIIKDKAKGKKSKAAAKAGSSKYQWGIMKSLGLSDEEIVKFSEAEHWLDYFPPLAIQDLKRMGLKVDWRRSFITTDVNPYYDSFVRWQFLTLRERNKIKFGKRYTIYSPKDGQPCMDHDRQTGEGVGPQEYTLLKLKVLEPYPSKLSGLKGKNIFLVAATLRPETMFGQTNCWVRPDMKYIGFETVNGDIFICTQKAARNMSYQGFTKDNGVVPVVKELMGEEILGASLSAPLTSYKVIYVLPMLTIKEDKGTGVVTSVPSDSPDDIAALRDLKKKQALRAKYGIRDDMVLPFEPVPVIEIPGFGNLSAVTICDELKIQSQNDREKLAEAKEKIYLKGFYEGIMLVDGFKGQKVQDVKKTIQKKMIDAGDALIYMEPEKQVMSRSSDECVVALCDQWYLDYGEENWKKQTSQCLKNLETFCEETRRNFEATLGWLQEHACSRTYGLGTHLPWDEQWLIESLSDSTIYMAFYTVAHLLQGGNLHGQAESPLGIRPQQMTKEVWDYVFFKEAPFPKTQIAKEKLDQLKQEFEFWYPVDLRVSGKDLVPNHLSYYLYNHVAMWPEQSDKWPTAVRANGHLLLNSEKMSKSTGNFLTLTQAIDKFSADGMRLALADAGDTVEDANFVEAMADAGILRLYTWVEWVKEMVANWDSLRSGPASTFNDRVFASELNAGIIKTDQNYEKMMFKEALKTGFFEFQAAKDKYRELAVEGMHRELVFRFIEVQTLLLAPFCPHLCEHIWTLLGKPDSIMNASWPVAGPVNEVLIHSSQYLMEVTHDLRLRLKNYMMPAKGKKTDKQPLQKPSHCTIYVAKNYPPWQHTTLSVLRKHFEANNGKLPDNKVIASELGSMPELKKYMKKVMPFVAMIKENLEKMGPRILDLQLEFDEKAVLMENIVYLTNSLELEHIEVKFASEAEDKIREDCCPGKPLNVFRIEPGVSVSLVNPQPSNGHFSTKIEIRQGDNCDSIIRRLMKMNRGIKDLSKVKLMRFDDPLLGPRRVPVLGKEYTEKTPISEHAVFNVDLMSKKIHLTENGIRVDIGDTIIYLVH

SEQ ID NO: 887580 - protein, 1130 aa, Homo sapiens
MAERKGTAKVDFLKKIEKEIQQKWDTERVFEVNASNLEKQTSKGKYFVTFPYPYMNGRLHLGHTFSLSKCEFAVGYQRLKGKCCLFPFGLHCTGMPIKSKAAAKAGSSKYQWGIMKSLGLSDEEIVKFSEAEHWLDYFPPLAIQDLKRMGLKVDWRRSFITTDVNPYYDSFVRWQFLTLRERNKIKFGKRYTIYSPKDGQPCMDHDRQTGEGVGPQEYTLLKLKVLEPYPSKLSGLKGKNIFLVAATLRPETMFGQTNCWVRPDMKYIGFETVNGDIFICTQKAARNMSYQGFTKDNGVVPVVKELMGEEILGASLSAPLTSYKVIYVLPMLTIKEDKGTGVVTSVPSDSPDDIAALRDLKKKQALRAKYGIRDDMVLPFEPVPVIEIPGFGNLSAVTICDELKIQSQNDREKLAEAKEKIYLKGFYEGIMLVDGFKGQKVQDVKKTIQKKMIDAGDALIYMEPEKQVMSRSSDECVVALCDQWYLDYGEENWKKQTSQCLKNLETFCEETRRNFEATLGWLQEHACSRTYGLGTHLPWDEQWLIESLSDSTIYMAFYTVAHLLQGGNLHGQAESPLGIRPQQMTKEVWDYVFFKEAPFPKTQIAKEKLDQLKQEFEFWYPVDLRVSGKDLVPNHLSYYLYNHVAMWPEQSDKWPTAVRANGHLLLNSEKMSKSTGNFLTLTQAIDKFSADGMRLALADAGDTVEDANFVEAMADAGILRLYTWVEWVKEMVANWDSLRSGPASTFNDRVFASELNAGIIKTDQNYEKMMFKEALKTGFFEFQAAKDKYRELAVEGMHRELVFRFIEVQTLLLAPFCPHLCEHIWTLLGKPDSIMNASWPVAGPVNEVLIHSSQYLMEVTHDLRLRLKNYMMPAKGKKTDKQPLQKPSHCTIYVAKNYPPWQHTTLSVLRKHFEANNGKLPDNKVIASELGSMPELKKYMKKVMPFVAMIKENLEKMGPRILDLQLEFDEKAVLMENIVYLTNSLELEHIEVKFASEAEDKIREDCCPGKPLNVFRIEPGVSVSLVNPQPSNGHFSTKIEIRQGDNCDSIIRRLMKMNRGIKDLSKVKLMRFDDPLLGPRRVPVLGKEYTEKTPISEHAVFNVDLMSKKIHLTENGIRVDIGDTIIYLVH

SEQ ID NO: 887581 - protein, 1176 aa, Homo sapiens; identical to SEQ ID NO: 887575

SEQ ID NO: 887582 - protein, 1163 aa, Homo sapiens
MAERKGTAKVDFLKKIEKEIQQKWDTERVFEVNASNLEKQTSKGKYFVTFPYPYMNGRLHLGHTFSLSKCEFAVGYQRLKGKCCLFPFGLHCTGMPIKACADKLKREIELYGCPPDFPDEEEEEEETSVKTEDIIIKDKAKGKKSKAAAKAGSSKYQWGIMKSLGLSDEEIVKFSEAEHWLDYFPPLAIQDLKRMGLKVDWRRSFITTDVNPYYDSFVRWQFLTLRERNKIKFGKRYTIYSPKDGQPCMDHDRQTGEGVGPQEYTLLKLKVLEPYPSKLSGLKGKNIFLVAATLRPETMFGQTNCWVRPDMKYIGFETVNGDIFICTQKAARNMSYQGFTKDNGVVPVVKELMGEEILGASLSAPLTSYKVIYVLPMLTIKEDKGTGVVTSVPSDSPDDIAALRDLKKKQALRAKYGIRDDMVLPFEPVPVIEIPGFGNLSAVTICDELKIQSQNDREKLAEAKEKIYLKGFYEGIMLVDGFKGQKVQDVKKTIQKKMIDAGDALIYMEPEKQVMSRYLDYGEENWKKQTSQCLKNLETFCEETRRNFEATLGWLQEHACSRTYGLGTHLPWDEQWLIESLSDSTIYMAFYTVAHLLQGGNLHGQAESPLGIRPQQMTKEVWDYVFFKEAPFPKTQIAKEKLDQLKQEFEFWYPVDLRVSGKDLVPNHLSYYLYNHVAMWPEQSDKWPTAVRANGHLLLNSEKMSKSTGNFLTLTQAIDKFSADGMRLALADAGDTVEDANFVEAMADAGILRLYTWVEWVKEMVANWDSLRSGPASTFNDRVFASELNAGIIKTDQNYEKMMFKEALKTGFFEFQAAKDKYRELAVEGMHRELVFRFIEVQTLLLAPFCPHLCEHIWTLLGKPDSIMNASWPVAGPVNEVLIHSSQYLMEVTHDLRLRLKNYMMPAKGKKTDKQPLQKPSHCTIYVAKNYPPWQHTTLSVLRKHFEANNGKLPDNKVIASELGSMPELKKYMKKVMPFVAMIKENLEKMGPRILDLQLEFDEKAVLMENIVYLTNSLELEHIEVKFASEAEDKIREDCCPGKPLNVFRIEPGVSVSLVNPQPSNGHFSTKIEIRQGDNCDSIIRRLMKMNRGIKDLSKVKLMRFDDPLLGPRRVPVLGKEYTEKTPISEHAVFNVDLMSKKIHLTENGIRVDIGDTIIYLVH

SEQ ID NO: 887583 - protein, 987 aa, Homo sapiens
VYTPRQPLEIRTSKRTELAQGQWVEFGCAPLGPEAYVTVVLKLLGRDSVITSTGPIDLAQKFGYKLVDGVGPQEYTLLKLKVLEPYPSKLSGLKGKNIFLVAATLRPETMFGQTNCWVRPDMKYIGFETVNGDIFICTQKAARNMSYQGFTKDNGVVPVVKELMGEEILGASLSAPLTSYKVIYVLPMLTIKEDKGTGVVTSVPSDSPDDIAALRDLKKKQALRAKYGIRDDMVLPFEPVPVIEIPGFGNLSAVTICDELKIQSQNDREKLAEAKEKIYLKGFYEGIMLVDGFKGQKVQDVKKTIQKKMIDAGDALIYMEPEKQVMSRSSDECVVALCDQWYLDYGEENWKKQTSQCLKNLETFCEETRRNFEATLGWLQEHACSRTYGLGTHLPWDEQWLIESLSDSTIYMAFYTVAHLLQGGNLHGQAESPLGIRPQQMTKEVWDYVFFKEAPFPKTQIAKEKLDQLKQEFEFWYPVDLRVSGKDLVPNHLSYYLYNHVAMWPEQSDKWPTAVRANGHLLLNSEKMSKSTGNFLTLTQAIDKFSADGMRLALADAGDTVEDANFVEAMADAGILRLYTWVEWVKEMVANWDSLRSGPASTFNDRVFASELNAGIIKTDQNYEKMMFKEALKTGFFEFQAAKDKYRELAVEGMHRELVFRFIEVQTLLLAPFCPHLCEHIWTLLGKPDSIMNASWPVAGPVNEVLIHSSQYLMEVTHDLRLRLKNYMMPAKGKKTDKQPLQKPSHCTIYVAKNYPPWQHTTLSVLRKHFEANNGKLPDNKVIASELGSMPELKKYMKKVMPFVAMIKENLEKMGPRILDLQLEFDEKAVLMENIVYLTNSLELEHIEVKFASEAEDKIREDCCPGKPLNVFRIEPGVSVSLVNPQPSNGHFSTKIEIRQGDNCDSIIRRLMKMNRGIKDLSKVKLMRFDDPLLGPRRVPVLGKEYTEKTPISEHAVFNVDLMSKKIHLTENGIRVDIGDTIIYLVH

SEQ ID NO: 887584 - protein, 869 aa, Homo sapiens
QSCQLTPTVFLHLFLATLHSYHAECGSIFDQPSVDFVLAGLPAVAQGIAALKPGQHELVHLSLNYHPLLHYRWKKSKGTGVVTSVPSDSPDDIAALRDLKKKQALRAKYGIRDDMVLPFEPVPVIEIPGFGNLSAVTICDELKIQSQNDREKLAEAKEKIYLKGFYEGIMLVDGFKGQKVQDVKKTIQKKMIDAGDALIYMEPEKQVMSRSSDECVVALCDQWYLDYGEENWKKQTSQCLKNLETFCEETRRNFEATLGWLQEHACSRTYGLGTHLPWDEQWLIESLSDSTIYMAFYTVAHLLQGGNLHGQAESPLGIRPQQMTKEVWDYVFFKEAPFPKTQIAKEKLDQLKQEFEFWYPVDLRVSGKDLVPNHLSYYLYNHVAMWPEQSDKWPTAVRANGHLLLNSEKMSKSTGNFLTLTQAIDKFSADGMRLALADAGDTVEDANFVEAMADAGILRLYTWVEWVKEMVANWDSLRSGPASTFNDRVFASELNAGIIKTDQNYEKMMFKEALKTGFFEFQAAKDKYRELAVEGMHRELVFRFIEVQTLLLAPFCPHLCEHIWTLLGKPDSIMNASWPVAGPVNEVLIHSSQYLMEVTHDLRLRLKNYMMPAKGKKTDKQPLQKPSHCTIYVAKNYPPWQHTTLSVLRKHFEANNGKLPDNKVIASELGSMPELKKYMKKVMPFVAMIKENLEKMGPRILDLQLEFDEKAVLMENIVYLTNSLELEHIEVKFASEAEDKIREDCCPGKPLNVFRIEPGVSVSLVNPQPSNGHFSTKIEIRQGDNCDSIIRRLMKMNRGIKDLSKVKLMRFDDPLLGPRRVPVLGKEYTEKTPISEHAVFNVDLMSKKIHLTENGIRVDIGDTIIYLVH

SEQ ID NO: 887585 - protein, 869 aa, Homo sapiens
MAERKGTAKVDFLKKIEKEIQQKWDTERVFEVNASNLEKQTSKGKYFVTFPYPYMNGRLHLGHTFSLSKCEFAVGYQRLKGKCCLFPFGLHCTGMPIKACADKLKREIELYGCPPDFPDEEEEEEETSVKTEDIIIKDKAKGKKSKAAAKAGSSKYQWGIMKSLGLSDEEIVKFSEAEHWLDYFPPLAIQDLKRMGLKVDWRRSFITTDVNPYYDSFVRWQFLTLRERNKIKFGKRYTIYSPKDGQPCMDHDRQTGEGVGPQEYTLLKLKVLEPYPSKLSGLKGKNIFLVAATLRPETMFGQTNCWVRPDMKYIGFETVNGDIFICTQKAARNMSYQGFTKDNGVVPVVKELMGEEILGASLSAPLTSYKVIYVLPMLTIKEDKGTGVVTSVPSDSPDDIAALRDLKKKQALRAKYGIRDDMVLPFEPVPVIEIPGFGNLSAVTICDELKIQSQNDREKLAEAKEKIYLKGFYEGIMLVDGFKGQKVQDVKKTIQKKMIDAGDALIYMEPEKQVMSRSSDECVVALCDQWYLDYGEENWKKQTSQCLKNLETFCEETRRNFEATLGWLQEHACSRTYGLGTHLPWDEQWLIESLSDSTIYMAFYTVAHLLQGGNLHGQAESPLGIRPQQMTKEVWDYVFFKEAPFPKTQIAKEKLDQLKQEFEFWYPVDLRVSGKDLVPNHLSYYLYNHVAMWPEQSDKWPTAVRANGHLLLNSEKMSKSTGNFLTLTQAIDKFSADGMRLALADAGDTVEDANFVEAMADAGILRLYTWVEWVKEMVANWDSLRSGPASTFNDRVFASELNAGIIKTDQNYEKMMFKEALKTGFFEFQAAKDKYRELAVEGMQEALTLHHLCGKELSTLATYHPVCST

SEQ ID NO: 887586 - protein, 1176 aa, Homo sapiens; identical to SEQ ID NO: 887575

SEQ ID NO: 887587 - protein, 1065 aa, Homo sapiens
MAERKGTAKVDFLKKIEKEIQQKWDTERVFEVNASNLEKQTSKGKYFVTFPYPYMNGRLHLGHTFSLSKCEFAVGYQRLKGKCCLFPFGLHCTGMPIKACADKLKREIELYGCPPDFPDEEEEEEETSVKTEDIIIKDKAKGKKSKAAAKAGSSKYQWGIMKSLGLSDEEIVKFSEAEHWLDYFPPLAIQDLKRMGLKVDWRRSFITTDVNPYYDSFVRWQFLTLRERNKIKFGKRYTIYSPKDGQPCMDHDRQTGEGVGPQEYTLLKLKVLEPYPSKLSGLKGKNIFLVAATLRPETMFGQTNCWVRPDMKYIGFETVNGDIFICTQKAARNMSYQGFTKDNGVVPVVKELMGEEILGASLSAPLTSYKVIYVLPMLTIKEDKGTGVVTSVPSDSPDDIAALRDLKKKQALRAKYGIRDDMVLPFEPVPVIEIPGFGNLSAVTICDELKIQSQNDREKLAEAKEKIYLKGFYEGIMLVDGFKGQKVQDVKKTIQKKMIDAGDALIYMEPEKQVMSRSSDECVVALCDQWYLDYGEENWKKQTSQCLKNLETFCEETRRNFEATLGWLQEHACSRTYGLGTHLPWDEQWLIESLSDSTIYMAFYTVAHLLQGGNLHGQAESPLGIRPQQMTKEVWDYVFFKEAPFPKTQIAKEKLDQLKQEFEFWYPVDLRVSGKDLVPNHLSYYLYNHVAMWPEQSDKWPTAVRANGHLLLNSEKMSKSTGNFLTLTQAIDKFSADGMRLALADAGDTVEDANFVEAMADAGILRLYTWVEWVKEMVANWDSLRSGPASTFNDRVFASELNAGIIKTDQNYEKMMFKEALKTGFFEFQAAKDKYRELAVEGMHRELVFRFIEVQTLLLAPFCPHLCEHIWTLLGKPDSIMNASWPVAGPVNEVLIHSSQYLMEVTHDLRLRLKNYMMPAKGKKTDKQPLQKPSHCTIYVAKNYPPWQHTTLSVLRKHFEANNGKLPDNKVIASELGSMPELKKYMKKVMPFVAMIKENLEKMGPRILDLQLEFDEKAVLMENIVYLTNSLELEHIEVKFASEAEDKIREDCCPGKGVHREDPHF

SEQ ID NO: 887588 - protein, 182 aa, Homo sapiens
MIKENLEKMGPRILDLQLEFDEKAVLMENIVYLTNSLELEHIEVKFASEAEDKIREDCCPGKPLNVFRIEPGVSVSLVNPQPSNGHFSTKIEIRQGDNCDSIIRRLMKMNRGIKDLSKVKLMRFDDPLLGPRRVPVLGKEYTEKTPISEHAVFNVDLMSKKIHLTENGIRVDIGDTIIYLVH

SEQ ID NO: 887589 - protein, 697 aa, Homo sapiens
MAERKGTAKVDFLKKIEKEIQQKWDTERVFEVNASNLEKQTSKGKYFVTFPYPYMNGRLHLGHTFSLSKCEFAVGYQRLKGKCCLFPFGLHCTGMPIKACADKLKREIELYGCPPDFPDEEEEEEETSVKTEDIIIKDKAKGKKSKAAAKAGSSKYQWGIMKSLGLSDEEIVKFSEAEHWLDYFPPLAIQDLKRMGLKVDWRRSFITTDVNPYYDSFVRWQFLTLRERNKIKFGKRYTIYSPKDGQPCMDHDRQTGEGVGPQEYTLLKLKVLEPYPSKLSGLKGKNIFLVAATLRPETMFGQTNCWVRPDMKYIGFETVNGDIFICTQKAARNMSYQGFTKDNGVVPVVKELMGEEILGASLSAPLTSYKVIYVLPMLTIKEDKGTGVVTSVPSDSPDDIAALRDLKKKQALRAKYGIRDDMVLPFEPVPVIEIPGFGNLSAVTICDELKIQSQNDREKLAEAKEKIYLKGFYEGIMLVDGFKGQKVQDVKKTIQKKMIDAGDALIYMEPEKQVMSRSSDECVVALCDQWYLDYGEENWKKQTSQCLKNLETFCEETRRNFEATLGWLQEHACSRTYGLGTHLPWDEQWLIESLSDSTIYMAFYTVAHLLQGGNLHGQAESPLGIRPQQMTKEVWDYVFFKEAPFPKTQIAKEKLDQLKQEFEFWYPVDLRVSGKDLVPNHLSYYLYNHVAMWPEQR

SEQ ID NO: 887590 - protein, 545 aa, Homo sapiens
MAERKGTAKVDFLKKIEKEIQQKWDTERVFEVNASNLEKQTSKGKYFVTFPYPYMNGRLHLGHTFSLSKCEFAVGYQRLKGKCCLFPFGLHCTGMPIKACADKLKREIELYGCPPDFPDEEEEEEETSVKTEDIIIKDKAKGKKSKAAAKAGSSKYQWGIMKSLGLSDEEIVKFSEAEHWLDYFPPLAIQDLKRMGLKVDWRRSFITTDVNPYYDSFVRWQFLTLRERNKIKFGKRYTIYSPKDGQPCMDHDRQTGEGVGPQEYTLLKLKVLEPYPSKLSGLKGKNIFLVAATLRPETMFGQTNCWVRPDMKYIGFETVNGDIFICTQKAARNMSYQGFTKDNGVVPVVKELMGEEILGASLSAPLTSYKVIYVLPMLTIKEDKGTGVVTSVPSDSPDDIAALRDLKKKQALRAKYGIRDDMVLPFEPVPVIEIPGFGNLSAVTICDELKIQSQNDREKLAEAKEKIYLKGFYEGIMLVDGFKGQKVQDVKKTIQKKMIDAVCDRLCSEGCFRRAVNRLDSVISSEFYSRTWSYNKNIIQFCGRK

SEQ ID NO: 887591 - protein, 96 aa, Homo sapiens
CSVRITQAFSQDSKRSVIHTGVMNDEDKDLSKVKLMRFDDPLLGPRRVPVLGKEYTEKTPISEHAVFNVDLMSKKIHLTENGIRVDIGDTIIYLVH

SEQ ID NO: 887592 - protein, 145 aa, Homo sapiens
MAERKGTAKVDFLKKIEKEIQQKWDTERVFEVNASNLEKQTSKGKYFVTFPYPYMNGRLHLGHTFSLSKCEFAVGYQRLKGKCCLFPFGLHCTGMPIKACADKLKREIELYGCPPDFPDEEEEEEETSVKTEDIIIKDKAKGKKV

SEQ ID NO: 887593 - protein, 236 aa, Homo sapiens [sequence omitted]

SEQ ID NO: 887594 - protein, 460 aa, Homo sapiens
MSKSTGNFLTLTQAIDKFSADGMRLALADAGDTVEDANFVEAMADAGILRLYTWVEWVKEMVANWDSLRSGPASTFNDRVFASELNAGIIKTDQNYEKMMFKEALKTGFFEFQAAKDKYRELAVEGMHRELVFRFIEVQTLLLAPFCPHLCEHIWTLLGKPDSIMNASWPVAGPVNEVLIHSSQYLMEVTHDLRLRLKNYMMPAKGKKTDKQPLQKPSHCTIYVAKNYPPWQHTTLSVLRKHFEANNGKLPDNKVIASELGSMPELKKYMKKVMPFVAMIKENLEKMGPRILDLQLEFDEKAVLMENIVYLTNSLELEHIEVKFASEAEDKIREDCCPGKPLNVFRIEPGVSVSLVNPQPSNGHFSTKIEIRQGDNCDSIIRRLMKMNRGIKDLSKVKLMRFDDPLLGPRRVPVLGKEYTEKTPISEHAVFNVDLMSKKIHLTENGIRVDIGDTIIYLVH

SEQ ID NO: 887595 - protein, 1083 aa, Homo sapiens
MAERKGTAKVDFLKKIEKEIQQKWDTERVFEVNASNLEKQTSKGKYFVTFPYPYMNGRLHLGHTFSLSKCEFAVGYQRLKGKCCLFPFGLHCTGMPIKACADKLKREIELYGCPPDFPDEEEEEEETSVKTEDIIIKDKAKGKKSKAAAKAGSSKYQWGIMKSLGLSDEEIVKFSEAEHWLDYFPPLAIQDLKRMGLKVDWRRSFITTDVNPYYDSFVRWQFLTLRERNKIKFGKRYTIYSPKDGQPCMDHDRQTGEGVGPQEYTLLKLKVLEPYPSKLSGLKGKNIFLVAATLRPETMFGQTNCWVRPDMKYIGFETVNGDIFICTQKAARNMSYQGFTKDNGVVPVVKELMGEEILGASLSAPLTSYKVIYVLPMLTIKEDKGTGVVTSVPSDSPDDIAALRDLKKKQALRAKYGIRDDMVLPFEPVPVIEIPGFGNLSAVTICDELKIQSQNDREKLAEAKEKIYLKGFYEGIMLVDGFKGQKVQDVKKTIQKKMIDAGDALIYMEPEKQVMSRSSDECVVALCDQWYLDYGEENWKKQTSQCLKNLETFCEETRRNFEATLGWLQEHACSRTYGLGTHLPWDEQWLIESLSDSTIYMAFYTVAHLLQGGNLHGQAESPLGIRPQQMTKEVWDYVFFKEAPFPKTQIAKEKLDQLKQEFEFWYPVDLRVSGKDLVPNHLSYYLYNHVAMWPEQSDKWPTAVRANGHLLLNSEKMSKSTGNFLTLTQAIDKFSADGMRLALADAGDTVEDANFVEAMADAGILRLYTWVEWVKEMVANWDSLRSGPASTFNDRVFASELNAGIIKTDQNYEKMMFKEALKTGFFEFQAAKDKYRELAVEGMHRELVFRFIEVQTLLLAPFCPHLCEHIWTLLGKPDSIMNASWPVAGPVNEVLIHSSQYLMEVTHDLRLRLKNYMMPAKGKKTDKQPLQKPSHCTIYVAKNYPPWQHTTLSVLRKHFEANNGKLPDNKVIASELGSMPELKKYMKKVMPFVAMIKENLEKMGPRILDLQLEFDEKAVLMENIVYLTNSLELEHIEVKFASEAEDKIREDCCPGKPLNVFRIEPGVSVSLNHHVLFSLIYTL

SEQ ID NO: 887596 - protein, 759 aa, Homo sapiens
MAERKGTAKVDFLKKIEKEIQQKWDTERVFEVNASNLEKQTSKGKYFVTFPYPYMNGRLHLGHTFSLSKCEFAVGYQRLKGKCCLFPFGLHCTGMPIKACADKLKREIELYGCPPDFPDEEEEEEETSVKTEDIIIKDKAKGKKSKAAAKAGSSKYQWGIMKSLGLSDEEIVKFSEAEHWLDYFPPLAIQDLKRMGLKVDWRRSFITTDVNPYYDSFVRWQFLTLRERNKIKFGKRYTIYSPKDGQPCMDHDRQTGEGVGPQEYTLLKLKVLEPYPSKLSGLKGKNIFLVAATLRPETMFGQTNCWVRPDMKYIGFETVNGDIFICTQKAARNMSYQGFTKDNGVVPVVKELMGEEILGASLSAPLTSYKVIYVLPMLTIKEDKGTGVVTSVPSDSPDDIAALRDLKKKQALRAKYGIRDDMVLPFEPVPVIEIPGFGNLSAVTICDELKIQSQNDREKLAEAKEKIYLKGFYEGIMLVDGFKGQKVQDVKKTIQKKMIDAGDALIYMEPEKQVMSRSSDECVVALCDQWYLDYGEENWKKQTSQCLKNLETFCEETRRNFEATLGWLQEHACSRTYGLGTHLPWDEQWLIESLSDSTIYMAFYTVAHLLQGGNLHGQAESPLGIRPQQMTKEVWDYVFFKEAPFPKTQIAKEKLDQLKQEFEFWYPVDLRVSGKDLVPNHLSYYLYNHVAMWPEQSDKWQSGKRNGIASEVEKCQSRHSQHCRYDKVDKEAWNASENVTSYDGEGIMKERTSRKTYIQ

SEQ ID NO: 887597 - protein, 630 aa, Homo sapiens
MAERKGTAKVDFLKKIEKEIQQKWDTERVFEVNASNLEKQTSKGKYFVTFPYPYMNGRLHLGHTFSLSKCEFAVGYQRLKGKCCLFPFGLHCTGMPIKACADKLKREIELYGCPPDFPDEEEEEEETSVKTEDIIIKDKAKGKKSKAAAKAGSSKYQWGIMKSLGLSDEEIVKFSEAEHWLDYFPPLAIQDLKRMGLKVDWRRSFITTDVNPYYDSFVRWQFLTLRERNKIKFGKRYTIYSPKDGQPCMDHDRQTGEGVGPQEYTLLKLKVLEPYPSKLSGLKGKNIFLVAATLRPETMFGQTNCWVRPDMKYIGFETVNGDIFICTQKAARNMSYQGFTKDNGVVPVVKELMGEEILGASLSAPLTSYKVIYVLPMLTIKEDKGTGVVTSVPSDSPDDIAALRDLKKKQALRAKYGIRDDMVLPFEPVPVIEIPGFGNLSAVTICDELKIQSQNDREKLAEAKEKIYLKGFYEGIMLVDGFKGQKVQDVKKTIQKKMIDAGDALIYMEPEKQVMSRSSDECVVALCDQWYLDYGEENWKKQTSQCLKNLETFCEETRRNFEATLGWLQEHACSRTYGLGTHLPWDEQWLIESLSDSTIYMAFYTVAHLLQGGNLHGQAESPLGIRLVNR

SEQ ID NO: 887598 - protein, 472 aa, Homo sapiens
MAERKGTAKVDFLKKIEKEIQQKWDTERVFEVNASNLEKQTSKGKYFVTFPYPYMNGRLHLGHTFSLSKCEFAVGYQRLKGKCCLFPFGLHCTGMPIKACADKLKREIELYGCPPDFPDEEEEEEETSVKTEDIIIKDKAKGKKSKAAAKAGSSKYQWGIMKSLGLSDEEIVKFSEAEHWLDYFPPLAIQDLKRMGLKVDWRRSFITTDVNPYYDSFVRWQFLTLRERNKIKFGKRYTIYSPKDGQPCMDHDRQTGEGVGPQEYTLLKLKVLEPYPSKLSGLKGKNIFLVAATLRPETMFGQTNCWVRPDMKYIGFETVNGDIFICTQKAARNMSYQGFTKDNGVVPVVKELMGEEILGASLSAPLTSYKVIYVLPMLTIKEDKGTGVVTSVPSDSPDDIAALRDLKKKQALRAKYGIRDDMVLPFEPVPVIEIPGLGIAVYSYQNHLDHMRFQRSSSQCHLEDDDLMKTSR

SEQ ID NO: 887599 - protein, 188 aa, Homo sapiens
MATDVFNSKNLAVQAQKKILGKMVSKSIATTLIDDTSSEVLDELYRVTREYTQNKKEAEKIIKNLIKTVIKLAILYRNNQFNQDELALMEKFKKKVHQLAMTVVSFHQVDYTFDRNVLSRLLNECREMLHQIIQRHLTAKSHGRVNNVFDHFSDCEFLAALYNPFGNFKPHLQKLCDGINKMLDEENI

SEQ ID NO: 887600 - protein, 198 aa, Homo sapiens
MHSEAEESKEVATDVFNSKNLAVQAQKKILGKMVSKSIATTLIDDTSSEVLDELYRVTREYTQNKKEAEKIIKNLIKTVIKLAILYRNNQFNQDELALMEKFKKKVHQLAMTVVSFHQVDYTFDRNVLSRLLNECREMLHQIIQRHLTAKSHGRVNNVFDHFSDCEFLAALYNPFGNFKPHLQKLCDGINKMLDEENI

SEQ ID NO: 887601 - protein, 210 aa, Homo sapiens
MTLPRYCEVVLLIAHGEKMLKLVATDVFNSKNLAVQAQKKILGKMVSKSIATTLIDDTSSEVLDELYRVTREYTQNKKEAEKIIKNLIKTVIKLAILYRNNQFNQDELALMEKFKKKVHQLAMTVVSFHQVDYTFDRNVLSRLLNECREMLHQIIQRHLTAKSHGRVNNVFDHFSDCEFLAALYNPFGNFKPHLQKLCDGINKMLDEENI

SEQ ID NO: 887602 - protein, 238 aa, Homo sapiens
VTACVGLAVRGESWWRHQRRAAERRALLTIQPMVDSFSAPRTPSAATSVAMATDVFNSKNLAVQAQKKILGKMVSKSIATTLIDDTSSEVLDELYRVTREYTQNKKEAEKIIKNLIKTVIKLAILYRNNQFNQDELALMEKFKKKVHQLAMTVVSFHQVDYTFDRNVLSRLLNECREMLHQIIQRHLTAKSHGRVNNVFDHFSDCEFLAALYNPFGNFKPHLQKLCDGINKMLDEENI

SEQ ID NO: 887603 - protein, 198 aa, Homo sapiens; identical to SEQ ID NO: 887600

SEQ ID NO: 887604 - protein, 190 aa, Homo sapiens
MAVATDVFNSKNLAVQAQKKILGKMVSKSIATTLIDDTSSEVLDELYRVTREYTQNKKEAEKIIKNLIKTVIKLAILYRNNQFNQDELALMEKFKKKVHQLAMTVVSFHQVDYTFDRNVLSRLLNECREMLHQIIQRHLTAKSHGRVNNVFDHFSDCEFLAALYNPFGNFKPHLQKLCDGINKMLDEENI

SEQ ID NO: 887605 - protein, 198 aa, Homo sapiens; identical to SEQ ID NO: 887600

SEQ ID NO: 887606 - protein, 162 aa, Homo sapiens
GDLSGVGRLSPRERLEADGLPPVGQTPAYLAYSACRASWPGRFLSGFDFPDFLPFVCDDCSGIFCLEHRSRESHGCPEVTVINERLKTDQHTSYPCSFKDCAERELVAVICPYCEKNFCLSVTLLLLIDTVISQIMSVKNWKSQSLEWLPLRNLLKTLLVSI

SEQ ID NO: 887607 - protein, 161 aa, Homo sapiens
MAATQKLVKDIIDSKTGETASKRWKGAKNSETAAKVALMKLKMHADGDKSLPQTERIYFQVFLPKGSKEKSKPMFFCHRWSIGKAIDFAASLARLKNDNNKFTAKKLRLCHITSGEALPLDHTLETWIAKEDCPLYNGGNIILEYLNDEEQFCKNVESYLE

SEQ ID NO: 887608 - protein, 161 aa, Homo sapiens; identical to SEQ ID NO: 887607

SEQ ID NO: 887609 - protein, 161 aa, Homo sapiens; identical to SEQ ID NO: 887607

SEQ ID NO: 887610 - protein, 286 aa, Homo sapiens
DRGTVRSALRPGKRGAGEMAELDIGQHCQVEHCRQRDFLPFVCDDCSGIFCLEHRSRESHGCPEVTVINERLKTDQHTSYPCSFKDCAERELVAVICPYCEKNFCLRHRHQSDHECEKLEIPKPRMAATQKLVKDIIDSKTGETASKRWKGAKNSETAAKVALMKLKMHADGDKSLPQTERIYFQVFLPKGSKEKSKPMFFCHRWSIGKAIDFAASLARLKNDNNKFTAKKLRLCHITSGEALPLDHTLETWIAKEDCPLYNGGNIILEYLNDEEQFCKNVESYLE

SEQ ID NO: 887611 - protein, 198 aa, Homo sapiens
DRGTVRSALRPGKRGAGEMAELDIGQHCQVEHCRQRDFLPFVCDDCSGIFCLEHRSRESHGCPEVTVINERLKTDQHTSYPCSFKDCAERELVAVICPYCEKNFCLRHRHQSDHECEKLEIPKPRMAATQKLVKDIIDSKTGETASKRWKGAKNSETAAKVALMKLKMHADGDKSLPQGAKRRANQCSFATDGALERP

SEQ ID NO: 887612 - protein, 159 aa, Homo sapiens
MLKKKKNTKHKRPETRSIRHNNKAQTLHHRQQNNAGSTHTLIHHTRAAAKKPQRDDPHTRQKQRHSKDASKYTNDQDERDKTRAEEERRKAIETNTGRNTSNATNPHERPNIRWRGTTPTRADTKHSPDRQGRSASHTTQPTPAARNRTPARDERESGA

SEQ ID NO: 887613 - protein, 286 aa, Homo sapiens; identical to SEQ ID NO: 887610

SEQ ID NO: 887614 - protein, 161 aa, Homo sapiens; identical to SEQ ID NO: 887607

SEQ ID NO: 887615 - protein, 279 aa, Homo sapiens
GPGYGAECPSSWETGRRRDGGVGHRAALPDFLPFVCDDCSGIFCLEHRSRESHGCPEVTVINERLKTDQHTSYPCSFKDCAERELVAVICPYCEKNFCLRHRHQSDHECEKLEIPKPRMAATQKLVKDIIDSKTGETASKRWKGAKNSETAAKVALMKLKMHADGDKSLPQTERIYFQVFLPKGSKEKSKPMFFCHRWSIGKAIDFAASLARLKNDNNKFTAKKLRLCHITSGEALPLDHTLETWIAKEDCPLYNGGNIILEYLNDEEQFCKNVESYLE

SEQ ID NO: 887616 - protein, 161 aa, Homo sapiens; identical to SEQ ID NO: 887607

SEQ ID NO: 887617 - protein, 286 aa, Homo sapiens; identical to SEQ ID NO: 887610

SEQ ID NO: 887618 - protein, 192 aa, Homo sapiens
DRGTVRSALRPGKRGAGEMAELDIGQHCQVEHCRQRDFLPFVCDDCSGIFCLEHRSRESHGCPEVTVINERLKTDQHTSYPCSFKDCAERELVAVICPYCEKNFCLRHRHQSDHECEKLEIPKPRMAATQKLVKDIIGKYLESVFCCFPSSRAPASYIYFPIMGGIINNPSGIRINLYFDDILVTVFLMRST

SEQ ID NO: 887619 - protein, 266 aa, Homo sapiens
FSPQLAEPFAPLATAWTVSKELSPSAFCPPGCQLWLLKRLPPAAVYTASGRGKEPQTFQIASSRNKLFVAGIKMAAEPVEDNCINFVAMKFIDNTLYFIAEDDENLESDYFGKLESKLSVIRNLNDQVLFIDQGNRPLFEDMTDSDCRDNAPRTIFIISMYKDSQPRGMAVTISVKCEKISTLSCENKIISFKEMNPPDNIKDTKSDIIFFQRSVPGHDNKMQFESSSYEGYFLACEKERDLFKLILKKEDELGDRSIMFTVQNED

SEQ ID NO: 887620 - protein, 104 aa, Homo sapiens
FSPQLAEPFAPLATAWTVSKELSPSAFCPPGCQLWLLKRLPPAAVYTASGRGKEPQTFQIASSRNKLFVAGIKMAAEPVEDNCINFVAMKFIDNTLYFIAEDDG

SEQ ID NO: 887621 - protein, 104 aa, Homo sapiens; identical to SEQ ID NO: 887620

SEQ ID NO: 887622 - protein, 119 aa, Homo sapiens
FSPQLAEPFAPLATAWTVSKELSPSAFCPPGCQLWLLKRLPPAAVYTASGRGKEPQTFQIASSRNKLFVAGIKMAAEPVEDNCINFVAMKFIDNTLYFIAEDDAEDDGKVEMNLFFFAN

SEQ ID NO: 887623 - protein, 273 aa, Homo sapiens
FSPQLAEPFAPLATAWTVSKELSPSAFCPPGCQLWLLKRLPPAAVYTASGRGKEPQTFQIASSRNKLFVADGSLLSLGIKMAAEPVEDNCINFVAMKFIDNTLYFIAEDDENLESDYFGKLESKLSVIRNLNDQVLFIDQGNRPLFEDMTDSDCRDNAPRTIFIISMYKDSQPRGMAVTISVKCEKISTLSCENKIISFKEMNPPDNIKDTKSDIIFFQRSVPGHDNKMQFESSSYEGYFLACEKERDLFKLILKKEDELGDRSIMFTVQNED

SEQ ID NO: 887624 - protein, 119 aa, Homo sapiens; identical to SEQ ID NO: 887622

SEQ ID NO: 887625 - protein, 357 aa, Homo sapiens
MAAAEVADTQLMLGVGLIEKDTNGEVLWVWCYPSTTATLRNLLLRKCCLTDENKLLHPFVFGQYRRTWFYITTIEVPDSSILKKVTHFSIVLTAKDFNPEKYAAFTRILCRMYLKHGSPVKMMESYIAVLTKGICQSEENGSFLSKDFDARKAYLAGSIKDIVSQFGMETVILHTALMLKKRIVVYHPKIEAVQEFTRTLPALVWHRQDWTILHSYVHLNADELEALQMCTGYVAGFVDLEVSNRPDLYDVFVNLAESEITIAPLAKEAMAMGKLHKEMGQLIVQSAEDPEKSESHVIQDIALKTREIFTNLAPFSEVSADGEKRVLNLEALKQKRFPPATENFLYHLAAAEQMLKI

SEQ ID NO: 887626 - protein, 246 aa, Homo sapiens
MYLKHGSPVKMMESYIAVLTKGICQSEENGSFLSKDFDARKAYLAGSIKDIVSQFGMETVILHTALMLKKRIVVYHPKIEAVQEFTRTLPALVWHRQDWTILHSYVHLNADELEALQMCTGYVAGFVDLEVSNRPDLYDVFVNLAESEITIAPLAKEAMAMGKLHKEMGQLIVQSAEDPEKSESHVIQDIALKTREIFTNLAPFSEVSADGEKRVLNLEALKQKRFPPATENFLYHLAAAEQMLKI

SEQ ID NO: 887627 - protein, 396 aa, Homo sapiens
MLIVPKLRDPGVETCDGKERKLPLELRAAAAEDGCGRGGGHSADAWSRADRDHLSTVEKDTNGEVLWVWCYPSTTATLRNLLLRKCCLTDENKLLHPFVFGQYRRTWFYITTIEVPDSSILKKVTHFSIVLTAKDFNPEKYAAFTRILCRMYLKHGSPVKMMESYIAVLTKGICQSEENGSFLSKDFDARKAYLAGSIKDIVSQFGMETVILHTALMLKKRIVVYHPKIEAVQEFTRTLPALVWHRQDWTILHSYVHLNADELEALQMCTGYVAGFVDLEVSNRPDLYDVFVNLAESEITIAPLAKEAMAMGKLHKEMGQLIVQSAEDPEKSESHVIQDIALKTREIFTNLAPFSEVSADGEKRVLNLEALKQKRFPPATENFLYHLAAAEQMLKI

SEQ ID NO: 887628 - protein, 418 aa, Homo sapiens
MAAAEVADTQLMLGVGLIDGVSLLSRLECSSAITALCSLHSQAQTILPPGLRVAGTSGVHHHPINFCILCGDGIPTCCPEKDTNGEVLWVWCYPSTTATLRNLLLRKCCLTDENKLLHPFVFGQYRRTWFYITTIEVPDSSILKKVTHFSIVLTAKDFNPEKYAAFTRILCRMYLKHGSPVKMMESYIAVLTKGICQSEENGSFLSKDFDARKAYLAGSIKDIVSQFGMETVILHTALMLKKRIVVYHPKIEAVQEFTRTLPALVWHRQDWTILHSYVHLNADELEALQMCTGYVAGFVDLEVSNRPDLYDVFVNLAESEITIAPLAKEAMAMGKLHKEMGQLIVQSAEDPEKSESHVIQDIALKTREIFTNLAPFSEVSADGEKRVLNLEALKQKRFPPATENFLYHLAAAEQMLKI

SEQ ID NO: 887629 - protein, 357 aa, Homo sapiens; identical to SEQ ID NO: 887625

SEQ ID NO: 887630 - protein, 239 aa, Homo sapiens
MLIVPKLRDPGVETCDGKERKLPLELRAAAAEDGCGRGGGHSADAWSRADRDHLSTVEKDTNGEVLWVWCYPSTTATLRNLLLRKCCLTDENKLLHPFVFGQYRRTWFYITTIEVPDSSILKKVTHFSIVLTAKDFNPEKYAAFTRILCRMYLKHGSPVKMMESYIAVLTKGICQSEENGSFLSKDFDARKAYLAGSIKGLCLPWCGTDRTGPSFTLTCTSTPMSWKPCRCAQVTSLDL

SEQ ID NO: 887631 - protein, 121 aa, Homo sapiens
SSYSSKVAHVCDAGYVAGFVDLEVSNRPDLYDVFVNLAESEITIAPLAKEAMAMGKLHKEMGQLIVQSAEDPEKSESHVIQVTPSPSDLLKVLTRCRWVVCGRAVHISRVGGCGRGQRAGA

SEQ ID NO: 887632 - protein, 357 aa, Homo sapiens; identical to SEQ ID NO: 887625

SEQ ID NO: 887633 - protein, 357 aa, Homo sapiens; identical to SEQ ID NO: 887625

SEQ ID NO: 887634 - protein, 239 aa, Homo sapiens; identical to SEQ ID NO: 887630

SEQ ID NO: 887635 - protein, 159 aa, Homo sapiens
MLIVPKLRDPGVETCDGKERKLPLELRAAAAEDGCGRGGGHSADAWSRADRDHLSTVEKDTNGEVLWVWCYPSTTATLRNLLLRKCCLTDENKLLHPFVFGQYRRTWFYITTIEVPDSSILKKVTHFSIVLTAKDFNPEKYAAFTRILCRGLYKNCIKC

SEQ ID NO: 887636 - protein, 419 aa, Homo sapiens
PSIFLRLQLALNMGNTSFNEVMEAQLPSHGGPKPSAESDMGTRRDYIMAKYVEHRFARRCTPEPQRLWTAICNRDLLSVLEAFANGQDFGQPLPGPDAQAPEELVLHLAVKVANQASLPLVDFIIQNGGHLDAKAADGNTALHYAALYNQPDCLKLLLKGRALVGTVNEAGETALDIARKKHHKECEELLEQAQAGTFAFPLHVDYSWVISTEPGSDSEEDEEEKRCLLKLPAQAHWASGRLDISNKTYETVASLGAATPQGESEDCPPPLPVKNSSRTLVQGCARHASGDRSEVSSLSSEAPETPESLGSPASSSSLMSPLEPGDPSQAPPNSEEGLREPPGTSRPSLTSGTTPSEMYLPVRFSSESTRSYRRGARSPEDGPSARQPLPRRNVPVGITEGDGSRTGSLPASSVQLLQD

SEQ ID NO: 887637 - protein, 468 aa, Homo sapiens
KRKCGVKYGCLTISHSTINRPPVKLTLLTCQVRPNPEEKKCFDLVTHNRTYHFQAEDEHECEAWVSVLQNSKDEALSSAFLGEPSAGPGSWGSAGHDGEPHDLTKLLIAEVKSRPGNSQCCDCGAADPTWLSTNLGVLTCIQCSGVHRELGVRFSRMQSLTLDLLGPSELLLALNMGNTSFNEVMEAQLPSHGGPKPSAESDMGTRRDYIMAKYVEHRFARRCTPEPQRLWTAICNRDLLSVLEAFANGQDFGQPLPGPDAQAPEELVLHLAVKVANQASLPLVDFIIQNGGHLDAKAADGNTALHYAALYNQPDCLKLLLKGRALVGTVNEAGETALDIARKKHHKECEELLEQAQAGTFAFPLHVDYSWVISTEPGSDSEEDEEEKRCLLKLPAQAHWASGRLDISNKTYETVASLGAATPQGESEDCPPPLPVKNSSRTLVQGCARHASGGKERRESNRIGRAET

SEQ ID NO: 887638 - protein, 582 aa, Homo sapiens
KRKCGVKYGCLTISHSTINRPPVKLTLLTCQVRPNPEEKKCFDLVTHNRTYHFQAEDEHECEAWVSVLQNSKDEALSSAFLGEPSAGPGSWGSAGHDGEPHDLTKLLIAEVKSRPGNSQCCDCGAADPTWLSTNLGVLTCIQCSGVHRELGVRFSRMQSLTLDLLGPSELLLALNMGNTSFNEVMEAQLPSHGGPKPSAESDMGTRRDYIMAKYVEHRFARRCTPEPQRLWTAICNRDLLSVLEAFANGQDFGQPLPGPDAQAPEELVLHLAVKVANQASLPLVDFIIQNGGHLDAKAADGNTALHYAALYNQPDCLKLLLKGRALVGTVNEAGETALDIARKKHHKECEELLEQAQAGTFAFPLHVDYSWVISTEPGSDSEEDEEEKRCLLKLPAQAHWASGRLDISNKTYETVASLGAATPQGESEDCPPPLPVKNSSRTLVQGCARHASGDRSEVSSLSSEAPETPESLGSPASSSSLMSPLEPGDPSQAPPNSEEGLREPPGTSRPSLTSGTTPSEMYLPVRFSSESTRSYRRGARSPEDGPSARQPLPRRNVPVGITEGDGSRTGSLPASSVQLLQD

SEQ ID NO: 887639 - protein, 344 aa, Homo sapiens
MPHFVSTRRPRCRRTRRLFVNAQDFETKPMPCPDATRHSGMRLDLGLMAVISPETGFPGLWVDCHQSRTGGHLDAKAADGNTALHYAALYNQPDCLKLLLKGRALVGTVNEAGETALDIARKKHHKECEELLEQAQAGTFAFPLHVDYSWRCLLKLPAQAHWASGRLDISNKTYETVASLGAATPQGESEDCPPPLPVKNSSRTLVQGCARHASGDRSEVSSLSSEAPETPESLGSPASSSSLMSPLEPGDPSQAPPNSEEGLREPPGTSRPSLTSGTTPSEMYLPVRFSSESTRSYRRGARSPEDGPSARQPLPRRNVPVGITEGDGSRTGSLPASSVQLLQD

SEQ ID NO: 887640 - protein, 582 aa, Homo sapiens; identical to SEQ ID NO: 887638

SEQ ID NO: 887641 - protein, 582 aa, Homo sapiens; identical to SEQ ID NO: 887638

SEQ ID NO: 887642 - protein, 132 aa, Homo sapiens
RKKHHKECEELVRTRGGKGPLTLSLSLLSPQPSEPPSLCFWQLEQAQAGTFAFPLHVDYSWVISTEPGSDSEEDEEEKVGPSPVPQASGWQKERARLGLVCVGGGGEAGGQGYTGGTRLSSSSIFCSGSAAC

SEQ ID NO: 887643 - protein, 582 aa, Homo sapiens; identical to SEQ ID NO: 887638

SEQ ID NO: 887644 - protein, 555 aa, Homo sapiens
KRKCGVKYGCLTISHSTINRPPVKLTLLTCQVRPNPEEKKCFDLVTHNRTYHFQAEDEHECEAWVSVLQNSKDEALSSAFLGEPSAGPGSWGSAGHDGEPHDLTKLLIAEVKSRPGNSQCCDCGAADPTWLSTNLGVLTCIQCSGVHRELGVRFSRMQSLTLDLLGPSELLLALNMGNTSFNEVMEAQLPSHGGPKPSAESDMGTRRDYIMAKYVEHRFARRCTPEPQRLWTAICNRDLLSVLEAFANGQDFGQPLPGPDAQAPEELVLHLAVKVANQASLPLVDFIIQNGGHLDAKAADGNTALHYAALYNQPDCLKLLLKGRALVGTVNEAGETALDIARKKHHKECEELLEQAQAGTFAFPLHVDYSWVISTEPGSDSEEDEEEKRCLLKLPAQAHWASGRLDISNKTYETVASLGAATPQGENRSEVSSLSSEAPETPESLGSPASSSSLMSPLEPGDPSQAPPNSEEGLREPPGTSRPSLTSGTTPSEMYLPVRFSSESTRSYRRGARSPEDGPSARQPLPRRNVPVGITEGDGSRTGSLPASSVQLLQD

SEQ ID NO: 887645 - protein, 209 aa, Homo sapiens
PQASGWQKERARLGLRCLLKLPAQAHWASGRLDISNKTYETVASLGAATPQGESEDCPPPLPVKNSSRTLVQGCARHASGDRSEVSSLSSEAPETPESLGSPASSSSLMSPLEPGDPSQAPPNSEEGLREPPGTSRPSLTSGTTPSEMYLPVRFSSESTRSYRRGARSPEDGPSARQPLPRRNVPVGITEGDGSRTGSLPASSVQLLQD

SEQ ID NO: 887646 - protein, 271 aa, Homo sapiens
KRKCGVKYGCLTISHSTINRPPVKLTLLTCQVRPNPEEKKCFDLVTHNRTYHFQAEDEHECEAWVSVLQNSKDEALSSAFLGEPSAGPGSWGSAGHDGEPHDLTKLLIAEVKSRPGNSQCCDCGAADPTWLSTNLGVLTCIQCSGVHRELGVRFSRMQSLTLDLLGPSELLLALNMGNTSFNEVMEAQLPSHGGPKPSAESDMGTRRDYIMAKYVEHRFARRCTPEPQRLWTAICNRDLLSVLEAFANGQDFGQPLPGPDAQVRTPPRATY

SEQ ID NO: 887647 - protein, 1091 aa, Homo sapiens
MGNAGSMDSQQTDFRAHNVPLKLPMPEPGELEERFAIVLNAMNLPPDKARLLRQYDNEKKWELICDQERFQVKNPPHTYIQKLKGYLDPAVTRKKFRRRVQESTQVLRELEISLRTNHIGWVREFLNEENKGLDVLVEYLSFAQYAVTFDFESVESTVESSVDKSKPWSRSIEDLHRGSNLPSPVGNSVSRSGRHSALRYNTLPSRRTLKNSRLVSKKDDVHVCIMCLRAIMNYQYGFNMVMSHPHAVNEIALSLNNKNPRTKALVLELLAAVCLVRGGHEIILSAFDNFKEVCGEKQRFEKLMEHFRNEDNNIDFMVASMQFINIVVHSVEDMNFRVHLQYEFTKLGLDEYLDKLKHTESDKLQVQIQAYLDNVFDVGALLEDAETKNAALERVEELEENISHLSEKLQDTENEAMSKIVELEKQLMQRNKELDVVREIYKDANTQVHTLRKMVKEKEEAIQRQSTLEKKIHELEKQGTIKIQKKGDGDIAILPVVASGTLSMGSEVVAGNSVGPTMGAASSGPLPPPPPPLPPSSDTPETVQNGPVTPPMPPPPPPPPPPPPPPPPPPPPPLPGPAAETVPAPPLAPPLPSAPPLPGTSSPTVVFNSGLADGPIKLFSVKIKKPIKTKFRMPVFNWVALKPNQINGTVFNEIDDERILEDLNVDEFEEIFKTKAQGPAIDLSSSKQKIPQKGSNKVTLLEANRAKNLAITLRKAGKTADEICKAIHVFDLKTLPVDFVECLMRFLPTENEVKVLRLYERERKPLENLSDEDRFMMQFSKIERLMQKMTIMAFIGNFAESIQMLTPQLHAIIAASVSIKSSQKLKKILEIILALGNYMNSSKRGAVYGFKLQSLDLLLDTKSTDRKQTLLHYISNVVKEKYHQVSLFYNELHYVEKAAAVSLENVLLDVKELQRGMDLTKREYTMHDHNTLLKEFILNNEGKLKKLQDDAKIAQDAFDDVVKYFGENPKTTPPSVFFPVFVRFVKAYKQAEEENELRKKQEQALMEKLLEQEALMEQQDPKSPSHKSKRQQQELIAELRRRQVKDNRHVYEGKDGAIEDIITALKKNNITKFPNVHSRILETNHTDEPMR

SEQ ID NO: 887648 - protein, 1101 aa, Homo sapiens
MGNAGSMDSQQTDFRAHNVPLKLPMPEPGELEERFAIVLNAMNLPPDKARLLRQYDNEKKWELICDQERFQVKNPPHTYIQKLKGYLDPAVTRKKFRRRVQESTQVLRELEISLRTNHIGWVREFLNEENKGLDVLVEYLSFAQYAVTFDFESVESTVESSVDKSKPWSRSIEDLHRGSNLPSPVGNSVSRSGRHSALRYNTLPSRRTLKNSRLVSKKDDVHVCIMCLRAIMNYQYGFNMVMSHPHAVNEIALSLNNKNPRTKALVLELLAAVCLVRGGHEIILSAFDNFKEVCGEKQRFEKLMEHFRNEDNNIDFMVASMQFINIVVHSVEDMNFRVHLQYEFTKLGLDEYLDKLKHTESDKLQVQIQAYLDNVFDVGALLEDAETKNAALERVEELEENISHLSEKLQDTENEAMSKIVELEKQLMQRNKELDVVREIYKDANTQVHTLRKMVKEKEEAIQRQSTLEKKIHELEKQGTIKIQKKGDGDIAILPVVASGTLSMGSEVVAGNSVGPTMGAASSGPLPPPPPPLPPSSDTPETVQNGPVTPPMPPPPPPPPPPPPPPPPPPPPPLPGPAAETVPAPPLAPPLPSAPPLPGTSSPTVVFNSGLADGPIKLFSVKIKKPIKTKFRMPVFNWVALKPNQINGTVFNEIDDERILEDLNVDEFEEIFKTKAQGPAIDLSSSKQKIPQKGSNKVTLLEANRAKNLAITLRKAGKTADEICKAIHVFDLKTLPVDFVECLMRFLPTENEVKVLRLYERERKPLENLSDEDRFMMQFSKIERLMQKMTIMAFIGNFAESIQMLTPQLHAIIAASVSIKSSQKLKKILEIILALGNYMNSSKRGAVYGFKLQSLDLLLDTKSTDRKQTLLHYISNVVKEKYHQVSLFYNELHYVEKAAAVSLENVLLDVKELQRGMDLTKREYTMHDHNTLLKEFILNNEGKLKKLQDDAKIAQDAFDDVVKYFGENPKTTPPSVFFPVFVRFVKAYKQAEEENELRKKQEQALMEKLLEQEALMEQQDPKSPSHKSKRQQQELIAELRRRQVKDNRHVYEGKDGAIEDIITALKKNNITKFPNVHSRVRISSSTPVVEDTQSWQASLFT

SEQ ID NO: 887649 - protein, 1091 aa, Homo sapiens; identical to SEQ ID NO: 887647

SEQ ID NO: 887650 - protein, 1091 aa, Homo sapiens; identical to SEQ ID NO: 887647

SEQ ID NO: 887651 - protein, 1093 aa, Homo sapiens
MGNAGSMDSQQTDFRAHNVPLKLPMPEPGELEERFAIVLNAMNLPPDKARLLRQYDNEKKWELICDQERFQVKNPPHTYIQKLKGYLDPAVTRKKFRRRVQESTQVLRELEISLRTNHIGWVREFLNEENKGLDVLVEYLSFAQYAVTFDFESVESTVESSVDKSKPWSRSIEDLHRGSNLPSPVGNSVSRSGRHSALRYNTLPSRRTLKNSRLVSKKDDVHVCIMCLRAIMNYQYGFNMVMSHPHAVNEIALSLNNKNPRTKALVLELLAAVCLVRGGHEIILSAFDNFKEVCGEKQRFEKLMEHFRNEDNNIDFMVASMQFINIVVHSVEDMNFRVHLQYEFTKLGLDEYLDKLKHTESDKLQVQIQAYLDNVFDVGALLEDAETKNAALERVEELEENISHLSEKLQDTENEAMSKIVELEKQLMQRNKELDVVREIYKDANTQVHTLRKMVKEKEEAIQRQSTLEKKIHELEKQGTIKIQKKGDGDIAILPVVASGTLSMGSEVVAGNSVGPTMGAASSGPLPPPPPPLPPSSDTPETVQNGPVTPPMPPPPPPPPPPPPPPPPPPPPPLPGPAAETVPAPPLAPPLPSAPPLPGTSSPTVVFNSGLADGPIKLFSVKIKKPIKTKFRMPVFNWVALKPNQINGTVFNEIDDERILEDLNVDEFEEIFKTKAQGPAIDLSSSKQKIPQKGSNKVTLLEANRAKNLAITLRKAGKTADEICKAIHVFDLKTLPVDFVECLMRFLPTENEVKVLRLYERERKPLENLSDEDRFMMQFSKIERLMQKMTIMAFIGNFAESIQMLTPQLHAIIAASVSIKSSQKLKKILEIILALGNYMNSSKRGAVYGFKLQSLDLLLDTKSTDRKQTLLHYISNVVKEKYHQVSLFYNELHYVEKAAAVSLENVLLDVKELQRGMDLTKREYTMHDHNTLLKEFILNNEGKLKKLQDDAKIAQDAFDDVVKYFGENPKTTPPSVFFPVFVRFVKAYKQAEEENELRKKQEQALMEKLLEQEALMEQQDPKSPSHKSKRQQQELIAELRRRQVKDNRHVYEGKDGAIEDIITVLKTVPFTARTAKRGSRFFCEPVLTEEYHY

SEQ ID NO: 887652 - protein, 1093 aa, Homo sapiens; identical to SEQ ID NO: 887651

SEQ ID NO: 887653 - protein, 243 aa, Homo sapiens
MGNAGSMDSQQTDFRAHNVPLKLPMPEPGELEERFAIVLNAMNLPPDKARLLRQYDNEKKWELICDQERFQVKNPPHTYIQKLKGYLDPAVTRKKFRRRVQESTQVLRELEISLRTNHIGWVREFLNEENKGLDVLVEYLSFAQYAVTFDFESVESTVESSVDKSKPWSRSIEDLHRGSNLPSPVGNSVSRSGRHSALRYNTLPSRRTLKNSRLVSKKDDVHVCIMCLRAIMNYQVCWSFWFF

SEQ ID NO: 887654 - protein, 1092 aa, Homo sapiens
MGNAGSMDSQQTDFRAHNVPLKLPMPEPGELEERFAIVLNAMNLPPDKARLLRQYDNEKKWELICDQERFQVKNPPHTYIQKLKGYLDPAVTRKKFRRRVQESTQVLRELEISLRTNHIGWVREFLNEENKGLDVLVEYLSFAQYAVTFDFESVESTVESSVDKSKPWSRSIEDLHRGSNLPSPVGNSVSRSGRHSALRYNTLPSRRTLKNSRLVSKKDDVHVCIMCLRAIMNYQYGFNMVMSHPHAVNEIALSLNNKNPRTKALVLELLAAVCLVRGGHEIILSAFDNFKEVCGEKQRFEKLMEHFRNEDNNIDFMVASMQFINIVVHSVEDMNFRVHLQYEFTKLGLDEYLDKLKHTESDKLQVQIQAYLDNVFDVGALLEDAETKNAALERVEELEENISHLSEKLQDTENEAMSKIVELEKQLMQRNKELDVVREIYKDANTQVHTLRKMVKEKEEAIQRQSTLEKKIHELEKQGTIKIQKKGDGDIAILPVVASGTLSMGSEVVAGNSVGPTMGAASSGPLPPPPPPLPPSSDTPETVQNGPVTPPMPPPPPPPPPPPPPPPPPPPPPLPGPAAETVPAPPLAPPLPSAPPLPGTSSPTVVFNSGLAAVKIKKPIKTKFRMPVFNWVALKPNQINGTVFNEIDDERILEDLNVDEFEEIFKTKAQGPAIDLSSSKQKIPQKGSNKVTLLEANRAKNLAITLRKAGKTADEICKAIHVFDLKTLPVDFVECLMRFLPTENEVKVLRLYERERKPLENLSDEDRFMMQFSKIERLMQKMTIMAFIGNFAESIQMLTPQLHAIIAASVSIKSSQKLKKILEIILALGNYMNSSKRGAVYGFKLQSLDLLLDTKSTDRKQTLLHYISNVVKEKYHQVSLFYNELHYVEKAAAVSLENVLLDVKELQRGMDLTKREYTMHDHNTLLKEFILNNEGKLKKLQDDAKIAQDAFDDVVKYFGENPKTTPPSVFFPVFVRFVKAYKQAEEENELRKKQEQALMEKLLEQEALMEQQDPKSPSHKSKRQQQELIAELRRRQVKDNRHVYEGKDGAIEDIITDLRNQPYRRADAVRRSVRRRFDDQNLRSVNGAEITM

SEQ ID NO: 887655 - protein, 1094 aa, Homo sapiens
MGNAGSMDSQQTDFRAHNVPLKLPMPEPGELEERFAIVLNAMNLPPDKARLLRQYDNEKKWELICDQERFQVKNPPHTYIQKLKGYLDPAVTRKKFRRRVQESTQVLRELEISLRTNHIGWVREFLNEENKGLDVLVEYLSFAQYAVTFDFESVESTVESSVDKSKPWSRSIEDLHRGSNLPSPVGNSVSRSGRHSALRYNTLPSRRTLKNSRLVSKKDDVHVCIMCLRAIMNYQYGFNMVMSHPHAVNEIALSLNNKNPRTKALVLELLAAVCLVRGGHEIILSAFDNFKEVCGEKQRFEKLMEHFRNEDNNIDFMVASMQFINIVVHSVEDMNFRVHLQYEFTKLGLDEYLDKLKHTESDKLQVQIQAYLDNVFDVGALLEDAETKNAALERVEELEENISHLSEKLQDTENEAMSKIVELEKQLMQRNKELDVVREIYKDANTQVHTLRKMVKEKEEAIQRQSTLEKKIHELEKQGTIKIQKKGDGDIAILPVVASGTLSMGSEVVAGNSVGPTMGAASSGPLPPPPPPLPPSSDTPETVQNGPVTPPMPPPPPPPPPPPPPPPPPPPPPLPGPAAETVPAPPLAPPLPSAPPLPGTSSPTVVFNSGLADGPIKLFSVKIKKPIKTKFRMPVFNWVALKPNQINGTVFNEIDDERILEDLNVDEFEEIFKTKAQGPAIDLSSSKQKIPQKGSNKVTLLEANRAKNLAITLRKAGKTADEICKAIHVFDLKTLPVDFVECLMRFLPTENEVKVLRLYERERKPLENLSDEDRFMMQFSKIERLMQKMTIMAFIGNFAESIQMLTPQLHAIIAASVSIKSSQKLKKILEIILALGNYMNSSKRGAVYGFKLQSLDLLLDTKSTDRKQTLLHYISNVVKEKYHQVSLFYNELHYVEKAAAVSLENVLLDVKELQRGMDLTKREYTMHDHNTLLKEFILNNEGKLKKLQDDAKIAQDAFDDVVKYFGENPKTTPPSVFFPVFVRFVKAYKQAEEENELRKKQEQALMEKLLEQEALMEQQDPKSPSHKSKRQQQELIAELRRRQVKDNRHVYEGKDGAIEDIITALKKNNITKFPNVHSRVRISSSTPVVEDTQS

SEQ ID NO: 887656 - protein, 1091 aa, Homo sapiens; identical to SEQ ID NO: 887647

SEQ ID NO: 887657 - protein, 1091 aa, Homo sapiens; identical to SEQ ID NO: 887647

SEQ ID NO: 887658 - protein, 1080 aa, Homo sapiens
MGNAGSMDSQQTDFRAHNVPLKLPMPEPGELEERFAIVLNAMNLPPDKARLLRQYDNEKKWELICDQERFQVKNPPHTYIQKLKGYLDPAVTRKKFRRRVQESTQVLRELEISLRTNHIGWVREFLNEENKGLDVLVEYLSFAQYAVTFDFESVESTVESSVDKSKPWSRSIEDLHRGSNLPSPVGNSVSRSGRHSALRYNTLPSRRTLKNSRLVSKKDDVHVCIMCLRAIMNYQYGFNMVMSHPHAVNEIALSLNNKNPRTKALVLELLAAVCLVRGGHEIILSAFDNFKEVCGEKQRFEKLMEHFRNEDNNIDFMVASMQFINIVVHSVEDMNFRVHLQYEFTKLGLDEYLDKLKHTESDKLQVQIQAYLDNVFDVGALLEDAETKNAALERVEELEENISHLSEKLQDTENEAMSKIVELEKQLMQRNKELDVVREIYKDANTQVHTLRKMVKEKEEAIQRQSTLEKKIHELEKQGTIKIQKKGDGDIAILPVVASGTLSMGSEVVAGNSVGPTMGAASSGPLPPPPPPLPPSSDTPETVQNGPVTPPMPPPPPPPPPPPPPPPPPPPPPLPGPAAETVPAPPLAPPLPSAPPLPGTSSPTVVFNSGLADGPIKLFSVKIKKPIKTKFRMPVFNWVALKPNQINGTVFNEIDDERILEDLNVDEFEEIFKTKAQGPAIDLSSSKQKIPQKGSNKVTLLEANRAKNLAITLRKAGKTADEICKAIHVFDLKTLPVDFVECLMRFLPTENEVKVLRLYERERKPLENLSDEDRFMMQFSKIERLMQKMTIMAFIGNFAESIQMLTPQLHAIIAASVSIKSSQKLKKILEIILALGNYMNSSKRGAVYGFKLQSLDLLLDTKSTDRKQTLLHYISNVVKEKYHQVSLFYNELHYVEKAAAVSLENVLLDVKELQRGMDLTKREYTMHDHNTLLKEFILNNEGKLKKLQDDAKIAQDAFDDVVKYFGENPKTTPPSVFFPVFVRFVKAYKQAEEENELRKKQEQALMEKLLEQEALMEQQDPKSPSHKSKRQQQELIAELRRRQVKDNRHVYEGKDGAIEDIITGKRYFFTVAHGDPTGLT

SEQ ID NO: 887659 - protein, 324 aa, Homo sapiens
MGNAGSMDSQQTDFRAHNVPLKLPMPEPGELEERFAIVLNAMNLPPDKARLLRQYDNEKKWELICDQERFQVKNPPHTYIQKLKGYLDPAVTRKKFRRRVQESTQVLRELEISLRTNHIGWVREFLNEENKGLDVLVEYLSFAQYAVTFDFESVESTVESSVDKSKPWSRSIEDLHRGSNLPSPVGNSVSRSGRHSALRYNTLPSRRTLKNSRLVSKKDDVHVCIMCLRAIMNYQYGFNMVMSHPHAVNEIALSLNNKNPRTKALVLELLAAVCLVRGGHEIILSAFDNFKEVCGEKQRFEKLMEHFRNEDNNIDFMVSYFSIQ

SEQ ID NO: 887660 - protein, 357 aa, Homo sapiens
GGCLEHGAGAARSAHSLALSRGRLPRAGRVPPAPRHQKFLCASDGDMGVPTALEAGSWRWGSLLFALFLAASLGPVAAFKVATPYSLYVCPEGQNVTLTCRLLGPVDKGHDVTFYKTWYRSSRGEVQTCSERRPIRNLTFQDLHLHHGGHQAANTSHDLAQRHGLESASDHHGNFSITMRNLTLLDSGLYCCLVVEIRHHHSEHRVHGAMELQVQTGKDAPSNCVVYPSSSQESENITAAALATGACIVGILCLPLILLLVYKQRQAASNRRAQELVRMDSNIQGIENPGFEASPPAQGIPEAKVRHPLSYVAQRQPSESGRHLLSEPSTPLSPPGPGDVFFPSLDPVPDSPNFEVI

SEQ ID NO: 887661 - protein, 357 aa, Homo sapiens; identical to SEQ ID NO: 887660

SEQ ID NO: 887662 - protein, 139 aa, Homo sapiens
LPLPAPDHLPRISLALDDITAAALATGACIVGILCLPLILLLVYKQRQAASNRRAQELVRMDSNIQGIENPGFEASPPAQGIPEAKVRHPLSYVAQRQPSESGRHLLSEPSTPLSPPGPGDVFFPSLDPVPDSPNFEVI

SEQ ID NO: 887663 - protein, 293 aa, Homo sapiens
GGCLEHGAGAARSAHSLALSRGRLPRAGRVPPAPRHQKFLCASDGDMGVPTALEAGSWRWGSLLFALFLAASLGPVAAFKVATPYSLYVCPEGQNVTLTCRLLGPVDKGHDVTFYKTWYRSSRGEVQTCSERRPIRNLTFQDLHLHHGGHQAANTSHDLAQRHGLESASDHHGNFSITMRNLTLLDSGLYCCLVVEIRHHHSEHRVHGAMELQVQTGKDAPSNCVVYPSSSQESESKGPTSCPFWVLCFLLSSSCTQTLFGTLASSPQALRTPRSSSFSAAAHPFCFLLGAIP

SEQ ID NO: 887664 - protein, 357 aa, Homo sapiens; identical to SEQ ID NO: 887660

SEQ ID NO: 887665 - protein, 329 aa, Homo sapiens
MSSAFWEEDPGFNYLVKGNNCISSNLGGSWRWGSLLFALFLAASLGPVAAFKVATPYSLYVCPEGQNVTLTCRLLGPVDKGHDVTFYKTWYRSSRGEVQTCSERRPIRNLTFQDLHLHHGGHQAANTSHDLAQRHGLESASDHHGNFSITMRNLTLLDSGLYCCLVVEIRHHHSEHRVHGAMELQVQTGKDAPSNCVVYPSSSQESENITAAALATGACIVGILCLPLILLLVYKQRQAASNRRAQELVRMDSNIQGIENPGFEASPPAQGIPEAKVRHPLSYVAQRQPSESGRHLLSEPSTPLSPPGPGDVFFPSLDPVPDSPNFEVI

SEQ ID NO: 887666 - protein, 330 aa, Homo sapiens
GGCLEHGAGAARSAHSLALSRGRLPRAGRVPPAPRHQKFLCASDGDMGVPTALEAGSWRWGSLLFALFLAASLGPVAAFKVATPYSLYVCPEGQNVTLTCRLLGPVDKGHDVTFYKTWYRSSRGEVQTCSERRPIRNLTFQDLHLHHGGHQAANTSHDLAQRHGLESASDHHGNFSITMRNLTLLDSGLYCCLVVEIRHHHSEHRVHGAMELQVQTGKDAPSNCVVYPSSSQESENITAAALATGACIVGILCLPLILLLVYKQRQAASNRPPFWFCGSNIQGIENPGFEASPPAQGIPEAKVRHPLSYVAQRQPSECQDRCCPTHWRWC

SEQ ID NO: 887667 - protein, 207 aa, Homo sapiens
GGCLEHGAGAARSAHSLALSRGRLPRAGRVPPAPRHQKFLCASDGDMGVPTALEAGSWRWGSLLFALFLAASLGPVAAFKVATPYSLYVCPEGQNVTLTCRLLGPVDKGHDVTFYKTWYRSSRGEVQTCSERRPIRNLTFQDLHLHHGGHQAANTSHDLAQRHGLESASDHHGNFSITMRNLTLLDSGRRNPGGRRNPGGRRNPGGR

SEQ ID NO: 887668 - protein, 3052 aa, Homo sapiens
MAFSIDRALNVALGNPSSTAQHVFKVSLVSGMPFYGYHEKERHFMKIYLYNPTMVKRICELLQSGAIMNKFYQPHEAHIPYLLQLFIDYNLYGMNLINLAAVKFRKARRKSNTLHATGSCKNHLSGNSLADTLFRWEQDEIPSSLILEGVEPQSTCELEVDAVAADILNRLDIEAQIGGNPGLQAIWEDEKQRRRNRNETSQMSQPESQDHRFVPATESEKKFQKRLQEILKQNDFSVTLSGSVDYSDGSQEFSAELTLHSEVLSPEMLQCTPANMVEVHKDKESSKGHTRHKVEEALINEEAILNLMENSQTFQPLTQRLSESPVFMDSSPDEALVHLLAGLESDGYRGERNRMPSPCRSFGNNKYPQNSDDEENEPQIEKEEMELSLVMSQRWDSNIEEHCAKKRSLCRNTHRSSTEDDDSSSGEEMEWSDNSLLLASLSIPQLDGTADENSDNPLNNENSRTHSSVIATSKLSVKPSIFHKDAATLEPSSSAKITFQCKHTSALSSHVLNKEDLIEDLSQTNKNTEKGLDNSVTSFTNESTYSMKYPGSLSSTVHSENSHKENSKKEILPVSSCESSIFDYEEDIPSVTRQVPSRKYTNIRKIEKDSPFIHMHRHPNENTLGKNSFNFSDLNHSKNKVSSEGNEKGNSTALSSLFPSSFTENCELLSCSGENRTMVHSLNSTADESGLNKLKIRYEEFQEHKTEKPSLSQQAAHYMFFPSVVLSNCLTRPQKLSPVTYKLQPGNKPSRLKLNKRKLAGHQETSTKSSETGSTKDNFIQNNPCNSNPEKDNALASDLTKTTRGAFENKTPTDGFIDCHFGDGTLETEQSFGLYGNKYTLRAKRKVNYETEDSESSFVTHNSKISLPHPMEIGESLDGTLKSRKRRKMSKKLPPVIIKYIIINRFRGRKNMLVKLGKIDSKEKQVILTEEKMELYKKLAPLKDFWPKVPDSPATKYPIYPLTPKKSHRRKSKHKSAKKKTGKQQRTNNENIKRTLSFRKKRSHAILSPPSPSYNAETEDCDLNYSDVMSKLGFLSERSTSPINSSPPRCWSPTDPRAEEIMAAAEKEAMLFKGPNVYKKTVNSRIGKTSRARAQIKKSKAKLANPSIVTKKRNKRNQTNKLVDDGKKKPRAKQKTNEKGTSRKHITLKDEKIKSQSGAEVKFVLKHQNVSEFASSSGGSQLLFKQKDMPLMGSAVDHPLSASLPTGINAQQKLSGCFSSFLESKKSVDLQTFPSSRDDLHPSVVCNSIGPGVSKINVQRPHNQSAMFTLKESTLIQKNIFDLSNHLSQVAQNTQISSGMSSKIEDNANNIQRNYLSSIGKLSEYRNSLESKLDQAYTPNFLHCKDSQQQIVCIAEQSKHSETCSPGNTASEESQMPNNCFVTSLRSPIKQIAWEQKQRGFILDMSNFKPERVKPRSLSEAISQTKALSQCKNRNVSTPSAFGEGQSGLAVLKELLQKRQQKAQNANTTQDPLSNKHQPNKNISGSLEHNKANKRTRSVTSPRKPRTPRSTKQKEKIPKLLKVDSLNLQNSSQLDNSVSDDSPIFFSDPGFESCYSLEDSLSPEHNYNFDINTIGQTGFCSFYSGSQFVPADQNLPQKFLSDAVQDLFPGQAIEKNEFLSHDNQKCDEDKHHTTDSASWIRSGTLSPEIFEKSTIDSNENRRHNQWKNSFHPLTTRSNSIMDSFCVQQAEDCLSEKSRLNRSSVSKEVFLSLPQPNNSDWIQGHTRKEMGQSLDSANTSFTAILSSPDGELVDVACEDLELYVSRNNDMLTPTPDSSPRSTSSPSQSKNGSFTPRTANILKPLMSPPSREEIMATLLDHDLSETIYQEPFCSNPSDVPEKPREIGGRLLMVETRLANDLAEFEGDFSLEGLRLWKTAFSAMTQNPRPGSPLRSGQGVVNKGSSNSPKMVEDKKIVIMPCKCAPSRQLVQVWLQAKEEYERSKKLPKTKPTGVVKSAENFSSSVNPDDKPVVPPKMDVSPCILPTTAHTKEDVDNSQIALQAPTTGCSQTASESQMLPPVASASDPEKDEDDDDNYYISYSSPDSPVIPPWQQPISPDSKALNGDDRPSSPVEELPSLAFENFLKPIKDGIQKSPCSEPQEPLVISPINTRARTGKCESLCFHSTPIIQRKLLERLPEAPGLSPLSTEPKTQKLSNKKGSNTDTLRRVLLTQAKNQFAAVNTPQKETSQIDGPSLNNTYGFKVSIQNLQEAKALHEIQNLTLISVELHARTRRDLEPDPEFDPICALFYCISSDTPLPDTEKTELTGVIVIDKDKTVFSQDIRYQTPLLIRSGITGLEVTYAADEKALFHEIANIIKRYDPDILLGYEIQMHSWGYLLQRAAALSIDLCRMISRVPDDKIENRFAAERDEYGSYTMSEINIVGRITLNLWRIMRNEVALTNYTFENVSFHVLHQRFPLFTFRVLSDWFDNKTDLYRWKMVDHYVSRVRGNLQMLEQLDLIGKTSEMARLFGIQFLHVLTRGSQYRVESMMLRIAKPMNYIPVTPSVQQRSQMRAPQCVPLIMEPESRFYSNSVLVLDFQSLYPSIVIAYNYCFSTCLGHVENLGKYDEFKFGCTSLRVPPDLLYQVRHDITVSPNGVAFVKPSVRKGVLPRMLEEILKTRFMVKQSMKAYKQDRALSRMLDARQLGLKLIANVTFGYTSANFSGRMPCIEVGDSIVHKARETLERAIKLVNDTKKWGARVVYGDTDSMFVLLKGATKEQSFKIGQEIAEAVTATNPKPVKLKFEKVYLPCVLQTKKRYVGYMYETLDQKDPVFDAKGIETVRRDSCPAVSKILERSLKLLFETRDISLIKQYVQRQCMKLLEGKASIQDFIFAKEYRGSFSYKPGACVPALELTRKMLTYDRRSEPQVGERVPYVIIYGTPGVPLIQLVRRPVEVLQDPTLRLNATYYITKQILPPLARIFSLIGIDVFSWYHELPRIHKATSSSRSEPEGRKGTISQYFTTLHCPVCDDLTQHGICSKCRSQPQHVAVILNQEIRELERQQEQLVKICKNCTGCFDRHIPCVSLNCPVLFKLSRVNRELSKAPYLRQLLDQF

SEQ ID NO: 887669 - protein, 3130 aa, Homo sapiens
MFSVRIVTADYYMASPLQGLDTCQSPLTQAPVKKVPVVRVFGATPAGQKTCLHLHGIFPYLYVPYDGYGQQPESYLSQMAFSIDRALNVALGNPSSTAQHVFKVSLVSGMPFYGYHEKERHFMKIYLYNPTMVKRICELLQSGAIMNKFYQPHEAHIPYLLQLFIDYNLYGMNLINLAAVKFRKARRKSNTLHATGSCKNHLSGNSLADTLFRWEQDEIPSSLILEGVEPQSTCELEVDAVAADILNRLDIEAQIGGNPGLQAIWEDEKQRRRNRNETSQMSQPESQDHRFVPATESEKKFQKRLQEILKQNDFSVTLSGSVDYSDGSQEFSAELTLHSEVLSPEMLQCTPANMVEVHKDKESSKGHTRHKVEEALINEEAILNLMENSQTFQPLTQRLSESPVFMDSSPDEALVHLLAGLESDGYRGERNRMPSPCRSFGNNKYPQNSDDEENEPQIEKEEMELSLVMSQRWDSNIEEHCAKKRSLCRNTHRSSTEDDDSSSGEEMEWSDNSLLLASLSIPQLDGTADENSDNPLNNENSRTHSSVIATSKLSVKPSIFHKDAATLEPSSSAKITFQCKHTSALSSHVLNKEDLIEDLSQTNKNTEKGLDNSVTSFTNESTYSMKYPGSLSSTVHSENSHKENSKKEILPVSSCESSIFDYEEDIPSVTRQVPSRKYTNIRKIEKDSPFIHMHRHPNENTLGKNSFNFSDLNHSKNKVSSEGNEKGNSTALSSLFPSSFTENCELLSCSGENRTMVHSLNSTADESGLNKLKIRYEEFQEHKTEKPSLSQQAAHYMFFPSVVLSNCLTRPQKLSPVTYKLQPGNKPSRLKLNKRKLAGHQETSTKSSETGSTKDNFIQNNPCNSNPEKDNALASDLTKTTRGAFENKTPTDGFIDCHFGDGTLETEQSFGLYGNKYTLRAKRKVNYETEDSESSFVTHNSKISLPHPMEIGESLDGTLKSRKRRKMSKKLPPVIIKYIIINRFRGRKNMLVKLGKIDSKEKQVILTEEKMELYKKLAPLKDFWPKVPDSPATKYPIYPLTPKKSHRRKSKHKSAKKKTGKQQRTNNENIKRTLSFRKKRSHAILSPPSPSYNAETEDCDLNYSDVMSKLGFLSERSTSPINSSPPRCWSPTDPRAEEIMAAAEKEAMLFKGPNVYKKTVNSRIGKTSRARAQIKKSKAKLANPSIVTKKRNKRNQTNKLVDDGKKKPRAKQKTNEKGTSRKHITLKDEKIKSQSGAEVKFVLKHQNVSEFASSSGGSQLLFKQKDMPLMGSAVDHPLSASLPTGINAQQKLSGCFSSFLESKKSVDLQTFPSSRDDLHPSVVCNSIGPGVSKINVQRPHNQSAMFTLKESTLIQKNIFDLSNHLSQVAQNTQISSGMSSKIEDNANNIQRNYLSSIGKLSEYRNSLESKLDQAYTPNFLHCKDSQQQIVCIAEQSKHSETCSPGNTASEESQMPNNCFVTSLRSPIKQIAWEQKQRGFILDMSNFKPERVKPRSLSEAISQTKALSQCKNRNVSTPSAFGEGQSGLAVLKELLQKRQQKAQNANTTQDPLSNKHQPNKNISGSLEHNKANKRTRSVTSPRKPRTPRSTKQKEKIPKLLKVDSLNLQNSSQLDNSVSDDSPIFFSDPGFESCYSLEDSLSPEHNYNFDINTIGQTGFCSFYSGSQFVPADQNLPQKFLSDAVQDLFPGQAIEKNEFLSHDNQKCDEDKHHTTDSASWIRSGTLSPEIFEKSTIDSNENRRHNQWKNSFHPLTTRSNSIMDSFCVQQAEDCLSEKSRLNRSSVSKEVFLSLPQPNNSDWIQGHTRKEMGQSLDSANTSFTAILSSPDGELVDVACEDLELYVSRNNDMLTPTPDSSPRSTSSPSQSKNGSFTPRTANILKPLMSPPSREEIMATLLDHDLSETIYQEPFCSNPSDVPEKPREIGGRLLMVETRLANDLAEFEGDFSLEGLRLWKTAFSAMTQNPRPGSPLRSGQGVVNKGSSNSPKMVEDKKIVIMPCKCAPSRQLVQVWLQAKEEYERSKKLPKTKPTGVVKSAENFSSSVNPDDKPVVPPKMDVSPCILPTTAHTKEDVDNSQIALQAPTTGCSQTASESQMLPPVASASDPEKDEDDDDNYYISYSSPDSPVIPPWQQPISPDSKALNGDDRPSSPVEELPSLAFENFLKPIKDGIQKSPCSEPQEPLVISPINTRARTGKCESLCFHSTPIIQRKLLERLPEAPGLSPLSTEPKTQKLSNKKGSNTDTLRRVLLTQAKNQFAAVNTPQKETSQIDGPSLNNTYGFKVSIQNLQEAKALHEIQNLTLISVELHARTRRDLEPDPEFDPICALFYCISSDTPLPDTEKTELTGVIVIDKDKTVFSQDIRYQTPLLIRSGITGLEVTYAADEKALFHEIANIIKRYDPDILLGYEIQMHSWGYLLQRAAALSIDLCRMISRVPDDKIENRFAAERDEYGSYTMSEINIVGRITLNLWRIMRNEVALTNYTFENVSFHVLHQRFPLFTFRVLSDWFDNKTDLYRWKMVDHYVSRVRGNLQMLEQLDLIGKTSEMARLFGIQFLHVLTRGSQYRVESMMLRIAKPMNYIPVTPSVQQRSQMRAPQCVPLIMEPESRFYSNSVLVLDFQSLYPSIVIAYNYCFSTCLGHVENLGKYDEFKFGCTSLRVPPDLLYQVRHDITVSPNGVAFVKPSVRKGVLPRMLEEILKTRFMVKQSMKAYKQDRALSRMLDARQLGLKLIANVTFGYTSANFSGRMPCIEVGDSIVHKARETLERAIKLVNDTKKWGARVVYGDTDSMFVLLKGATKEQSFKIGQEIAEAVTATNPKPVKLKFEKVYLPCVLQTKKRYVGYMYETLDQKDPVFDAKGIETVRRDSCPAVSKILERSLKLLFETRDISLIKQYVQRQCMKLLEGKASIQDFIFAKEYRGSFSYKPGACVPALELTRKMLTYDRRSEPQVGERVPYVIIYGTPGVPLIQLVRRPVEVLQDPTLRLNATYYITKQILPPLARIFSLIGIDVFSWYHELPRIHKATSSSRSEPEGRKGTISQYFTTLHCPVCDDLTQHGICSKCRSQPQHVAVILNQEIRELERQQEQLVKICKNCTGCFDRHIPCVSLNCPVLFKLSRVNRELSKAPYLRQLLDQF

SEQ ID NO: 887670 - protein, 3130 aa, Homo sapiens; identical to SEQ ID NO: 887669

SEQ ID NO: 887671 - protein, 389 aa, Homo sapiens [sequence omitted]

SEQ ID NO: 887672 - protein, 2354 aa, Homo sapiens
MAFSIDRALNVALGNPSSTAQHVFKVSLVSGMPFYGYHEKERHFMKIYLYNPTMVKRICELLQSGAIMNKFYQPHEAHIPYLLQLFIDYNLYGMNLINLAAVKFRKARRKSNTLHATGSCKNHLSGNSLADTLFRWEQDEIPSSLILEGVEPQSTCELEVDAVAADILNRLDIEAQIGGNPGLQAIWEDEKQRRRNRNETSQMSQPESQDHRFVPATESEKKFQKRLQEILKQNDFSVTLSGSVDYSDGSQEFSAELTLHSEVLSPEMLQCTPANMVEVHKDKESSKGHTRHKVEEALINEEAILNLMENSQTFQPLTQRLSESPVFMDSSPDEALVHLLAGLESDGYRGERNRMPSPCRSFGNNKYPQNSDDEENEPQIEKEEMELSLVMSQRWDSNIEEHCAKKRSLCRNTHRSSTEDDDSSSGEEMEWSDNSLLLASLSIPQLDGTADENSDNPLNNENSRTHSSVIATSKLSVKPSIFHKDAATLEPSSSAKITFQCKHTSALSSHVLNKEDLIEDLSQTNKNTEKGLDNSVTSFTNESTYSMKYPGSLSSTVHSENSHKENSKKEILPVSSCESSIFDYEEDIPSVTRQVPSRKYTNIRKIEKDSPFIHMHRHPNENTLGKNSFNFSDLNHSKNKVSSEGNEKGNSTALSSLFPSSFTENCELLSCSGENRTMVHSLNSTADESGLNKLKIRYEEFQEHKTEKPSLSQQAAHYMFFPSVVLSNCLTRPQKLSPVTYKLQPGNKPSRLKLNKRKLAGHQETSTKSSETGSTKDNFIQNNPCNSNPEKDNALASDLTKTTRGAFENKTPTDGFIDCHFGDGTLETEQSFGLYGNKYTLRAKRKVNYETEDSESSFVTHNSKISLPHPMEIGESLDGTLKSRKRRKMSKKLPPVIIKYIIINRFRGRKNMLVKLGKIDSKEKQVILTEEKMELYKKLAPLKDFWPKVPDSPATKYPIYPLTPKKSHRRKSKHKSAKKKTGKQQRTNNENIKRTLSFRKKRSHAILSPPSPSYNAETEDCDLNYSDVMSKLGFLSERSTSPINSSPPRCWSPTDPRAEEIMAAAEKEAMLFKGPNVYKKTVNSRIGKTSRARAQIKKSKAKLANPSIVTKKRNKRNQTNKLVDDGKKKPRAKQKTNEKGTSRKHITLKDEKIKSQSGAEVKFVLKHQNVSEFASSSGGSQLLFKQKDMPLMGSAVDHPLSASLPTGINAQQKLSGCFSSFLESKKSVDLQTFPSSRDDLHPSVVCNSIGPGVSKINVQRPHNQSAMFTLKESTLIQKNIFDLSNHLSQVAQNTQISSGMSSKIEDNANNIQRNYLSSIGKLSEYRNSLESKLDQAYTPNFLHCKDSQQQIVCIAEQSKHSETCSPGNTASEESQMPNNCFVTSLRSPIKQIAWEQKQRGFILDMSNFKPERVKPRSLSEAISQTKALSQCKNRNVSTPSAFGEGQSGLAVLKELLQKRQQKAQNANTTQDPLSNKHQPNKNISGSLEHNKANKRTRSVTSPRKPRTPRSTKQKEKIPKLLKVDSLNLQNSSQLDNSVSDDSPIFFSDPGFESCYSLEDSLSPEHNYNFDINTIGQTGFCSFYSGSQFVPADQNLPQKFLSDAVQDLFPGQAIEKNEFLSHDNQKCDEDKHHTTDSASWIRSGTLSPEIFEKSTIDSNENRRHNQWKNSFHPLTTRSNSIMDSFCVQQAEDCLSEKSRLNRSSVSKEVFLSLPQPNNSDWIQGHTRKEMGQSLDSANTSFTAILSSPDGELVDVACEDLELYVSRNNDMLTPTPDSSPRSTSSPSQSKNGSFTPRTANILKPLMSPPSREEIMATLLDHDLSETIYQEPFCSNPSDVPEKPREIGGRLLMVETRLANDLAEFEGDFSLEGLRLWKTAFSAMTQNPRPGSPLRSGQGVVNKGSSNSPKMVEDKKIVIMPCKCAPSRQLVQVWLQAKEEYERSKKLPKTKPTGVVKSAENFSSSVNPDDKPVVPPKMDVSPCILPTTAHTKEDVDNSQIALQAPTTGCSQTASESQMLPPVASASDPEKDEDDDDNYYISYSSPDSPVIPPWQQPISPDSKALNGDDRPSSPVEELPSLAFENFLKPIKDGIQKSPCSEPQEPLVISPINTRARTGKCESLCFHSTPIIQRKLLERLPEAPGLSPLSTEPKTQKLSNKKGSNTDTLRRVLLTQAKNQFAAVNTPQKETSQIDGPSLNNTYGFKVSIQNLQEAKALHEIQNLTLISVELHARTRRDLEPDPEFDPICALFYCISSDTPLPDTEKTELTGVIVIDKDKTVFSQDIRYQTPLLIRSGITGLEVTYAADEKALFHEIANIIKRYCFVYLIFPVLFRESFHAIADNSEDKSKGRKKANPFL

SEQ ID NO: 887673 - protein, 2706 aa, Homo sapiens
MAFSIDRALNVALGNPSSTAQHVFKVSLVSGMPFYGYHEKERHFMKIYLYNPTMVKRICELLQSGAIMNKFYQPHEAHIPYLLQLFIDYNLYGMNLINLAAVKFRKARRKSNTLHATGSCKNHLSGNSLADTLFRWEQDEIPSSLILEGVEPQSTCELEVDAVAADILNRLDIEAQIGGNPGLQAIWEDEKQRRRNRNETSQMSQPESQDHRFVPATESEKKFQKRLQEILKQNDFSVTLSGSVDYSDGSQEFSAELTLHSEVLSPEMLQCTPANMVEVHKDKESSKGHTRHKVEEALINEEAILNLMENSQTFQPLTQRLSESPVFMDSSPDEALVHLLAGLESDGYRGERNRMPSPCRSFGNNKYPQNSDDEENEPQIEKEEMELSLVMSQRWDSNIEEHCAKKRSLCRNTHRSSTEDDDSSSGEEMEWSDNSLLLASLSIPQLDGTADENSDNPLNNENSRTHSSVIATSKLSVKPSIFHKDAATLEPSSSAKITFQCKHTSALSSHVLNKEDLIEDLSQTNKNTEKGLDNSVTSFTNESTYSMKYPGSLSSTVHSENSHKENSKKEILPVSSCESSIFDYEEDIPSVTRQVPSRKYTNIRKIEKDSPFIHMHRHPNENTLGKNSFNFSDLNHSKNKVSSEGNEKGNSTALSSLFPSSFTENCELLSCSGENRTMVHSLNSTADESGLNKLKIRYEEFQEHKTEKPSLSQQAAHYMFFPSVVLSNCLTRPQKLSPVTYKLQPGNKPSRLKLNKRKLAGHQETSTKSSETGSTKDNFIQNNPCNSNPEKDNALASDLTKTTRGAFENKTPTDGFIDCHFGDGTLETEQSFGLYGNKYTLRAKRKVNYETEDSESSFVTHNSKISLPHPMEIGESLDGTLKSRKRRKMSKKLPPVIIKYIIINRFRGRKNMLVKLGKIDSKEKQVILTEEKMELYKKLAPLKDFWPKVPDSPATKYPIYPLTPKKSHRRKSKHKSAKKKTGKQQRTNNENIKRTLSFRKKRSHAILSPPSPSYNAETEDCDLNYSDVMSKLGFLSERSTSPINSSPPRCWSPTDPRAEEIMAAAEKEAMLFKGPNVYKKTVNSRIGKTSRARAQIKKSKAKLANPSIVTKKRNKRNQTNKLVDDGKKKPRAKQKTNEKGTSRKHITLKDEKIKSQSGAEVKFVLKHQNVSEFASSSGGSQLLFKQKDMPLMGSAVDHPLSASLPTGINAQQKLSGCFSSFLESKKSVDLQTFPSSRDDLHPSVVCNSIGPGVSKINVQRPHNQSAMFTLKESTLIQKNIFDLSNHLSQVAQNTQISSGMSSKIEDNANNIQRNYLSSIGKLSEYRNSLESKLDQAYTPNFLHCKDSQQQIVCIAEQSKHSETCSPGNTASEESQMPNNCFVTSLRSPIKQIAWEQKQRGFILDMSNFKPERVKPRSLSEAISQTKALSQCKNRNVSTPSAFGEGQSGLAVLKELLQKRQQKAQNANTTQDPLSNKHQPNKNISGSLEHNKANKRTRSVTSPRKPRTPRSTKQKEKIPKLLKVDSLNLQNSSQLDNSVSDDSPIFFSDPGFESCYSLEDSLSPEHNYNFDINTIGQTGFCSFYSGSQFVPADQNLPQKFLSDAVQDLFPGQAIEKNEFLSHDNQKCDEDKHHTTDSASWIRSGTLSPEIFEKSTIDSNENRRHNQWKNSFHPLTTRSNSIMDSFCVQQAEDCLSEKSRLNRSSVSKEVFLSLPQPNNSDWIQGHTRKEMGQSLDSANTSFTAILSSPDGELVDVACEDLELYVSRNNDMLTPTPDSSPRSTSSPSQSKNGSFTPRTANILKPLMSPPSREEIMATLLDHDLSETIYQEPFCSNPSDVPEKPREIGGRLLMVETRLANDLAEFEGDFSLEGLRLWKTAFSAMTQNPRPGSPLRSGQGVVNKGSSNSPKMVEDKKIVIMPCKCAPSRQLVQVWLQAKEEYERSKKLPKTKPTGVVKSAENFSSSVNPDDKPVVPPKMDVSPCILPTTAHTKEDVDNSQIALQAPTTGCSQTASESQMLPPVASASDPEKDEDDDDNYYISYSSPDSPVIPPWQQPISPDSKALNGDDRPSSPVEELPSLAFENFLKPIKDGIQKSPCSEPQEPLVISPINTRARTGKCESLCFHSTPIIQRKLLERLPEAPGLSPLSTEPKTQKLSNKKGSNTDTLRRVLLTQAKNQFAAVNTPQKETSQIDGPSLNNTYGFKVSIQNLQEAKALHEIQNLTLISVELHARTRRDLEPDPEFDPICALFYCISSDTPLPDTEKTELTGVIVIDKDKTVFSQDIRYQTPLLIRSGITGLEVTYAADEKALFHEIANIIKRYDPDILLGYEIQMHSWGYLLQRAAALSIDLCRMISRVPDDKIENRFAAERDEYGSYTMSEINIVGRITLNLWRIMRNEVALTNYTFENVSFHVLHQRFPLFTFRVLSDWFDNKTDLYRWKMVDHYVSRVRGNLQMLEQLDLIGKTSEMARLFGIQFLHVLTRGSQYRVESMMLRIAKPMNYIPVTPSVQQRSQMRAPQCVPLIMEPESRFYSNSVLVLDFQSLYPSIVIAYNYCFSTCLGHVENLGKYDEFKFGCTSLRVPPDLLYQVRHDITVSPNGVAFVKPSVRKGVLPRMLEEILKTRFMVKQSMKAYKQDRALSRMLDARQLGLKLIANVTFGYTSANFSGRMPCIEVGDSIVHKARETLERAIKLVNDTKKWGARVVYGDTDR

SEQ ID NO: 887674 - protein, 1544 aa, Homo sapiens
MAFSIDRALNVALGNPSSTAQHVFKVSLVSGMPFYGYHEKERHFMKIYLYNPTMVKRICELLQSGAIMNKFYQPHEAHIPYLLQLFIDYNLYGMNLINLAAVKFRKARRKSNTLHATGSCKNHLSGNSLADTLFRWEQDEIPSSLILEGVEPQSTCELEVDAVAADILNRLDIEAQIGGNPGLQAIWEDEKQRRRNRNETSQMSQPESQDHRFVPATESEKKFQKRLQEILKQNDFSVTLSGSVDYSDGSQEFSAELTLHSEVLSPEMLQCTPANMVEVHKDKESSKGHTRHKVEEALINEEAILNLMENSQTFQPLTQRLSESPVFMDSSPDEALVHLLAGLESDGYRGERNRMPSPCRSFGNNKYPQNSDDEENEPQIEKEEMELSLVMSQRWDSNIEEHCAKKRSLCRNTHRSSTEDDDSSSGEEMEWSDNSLLLASLSIPQLDGTADENSDNPLNNENSRTHSSVIATSKLSVKPSIFHKDAATLEPSSSAKITFQCKHTSALSSHVLNKEDLIEDLSQTNKNTEKGLDNSVTSFTNESTYSMKYPGSLSSTVHSENSHKENSKKEILPVSSCESSIFDYEEDIPSVTRQVPSRKYTNIRKIEKDSPFIHMHRHPNENTLGKNSFNFSDLNHSKNKVSSEGNEKGNSTALSSLFPSSFTENCELLSCSGENRTMVHSLNSTADESGLNKLKIRYEEFQEHKTEKPSLSQQAAHYMFFPSVVLSNCLTRPQKLSPVTYKLQPGNKPSRLKLNKRKLAGHQETSTKSSETGSTKDNFIQNNPCNSNPEKDNALASDLTKTTRGAFENKTPTDGFIDCHFGDGTLETEQSFGLYGNKYTLRAKRKVNYETEDSESSFVTHNSKISLPHPMEIGESLDGTLKSRKRRKMSKKLPPVIIKYIIINRFRGRKNMLVKLGKIDSKEKQVILTEEKMELYKKLAPLKDFWPKVPDSPATKYPIYPLTPKKSHRRKSKHKSAKKKTGKQQRTNNENIKRTLSFRKKRSHAILSPPSPSYNAETEDCDLNYSDVMSKLGFLSERSTSPINSSPPRCWSPTDPRAEEIMAAAEKEAMLFKGPNVYKKTVNSRIGKTSRARAQIKKSKAKLANPSIVTKKRNKRNQTNKLVDDGKKKPRAKQKTNEKGTSRKHITLKDEKIKSQSGAEVKFVLKHQNVSEFASSSGGSQLLFKQKDMPLMGSAVDHPLSASLPTGINAQQKLSGCFSSFLESKKSVDLQTFPSSRDDLHPSVVCNSIGPGVSKINVQRPHNQSAMFTLKESTLIQKNIFDLSNHLSQVAQNTQISSGMSSKIEDNANNIQRNYLSSIGKLSEYRNSLESKLDQAYTPNFLHCKDSQQQIVCIAEQSKHSETCSPGNTASEESQMPNNCFVTSLRSPIKQIAWEQKQRGFILDMSNFKPERVKPRSLSEAISQTKALSQCKNRNVSTPSAFGEGQSGLAVLKELLQKRQQKAQNANTTQDPLSNKHQPNKNISGSLEHNKANKRTRSVTSPRKPEIFLDCEGELVDLGELSGVGVNISLFLETYSSKSSQATS

SEQ ID NO: 887675 - protein, 118 aa, Homo sapiens
MAFSIDRALNVALGNPSSTAQHVFKVSLVSGMPFYGYHEKERHFMKIYLYNPTMVKRICELLQSGAIMNKFYQPHEAHIPYLLQLFIDYNLYGMNLINLAAVKFRKARRKSKVNFQSN

SEQ ID NO: 887676 - protein, 323 aa, Homo sapiens
MTSSLPYFIFNPLSMFVLLKGATKEQSFKIGQEIAEAVTATNPKPVKLKFEKVYLPCVLQTKKRYVGYMYETLDQKDPVFDAKGIETVRRDSCPAVSKILERSLKLLFETRDISLIKQYVQRQCMKLLEGKASIQDFIFAKEYRGSFSYKPGACVPALELTRKMLTYDRRSEPQVGERVPYVIIYGTPGVPLIQLVRRPVEVLQDPTLRLNATYYITKQILPPLARIFSLIGIDVFSWYHELPRGFIAALFTIAKTWNQPKCPSMIDWIKKMWHIYTMEYYAAIKKDEFMSFAGTWMKLETIILSKLSQGQKTKHRLFSLIDP

SEQ ID NO: 887677 - protein, 3052 aa, Homo sapiens; identical to SEQ ID NO: 887668

SEQ ID NO: 887678 - protein, 3052 aa, Homo sapiens; identical to SEQ ID NO: 887668

SEQ ID NO: 887679 - protein, 2854 aa, Homo sapiens
MAFSIDRALNVALGNPSSTAQHVFKVSLVSGMPFYGYHEKERHFMKIYLYNPTMVKRICELLQSGAIMNKFYQPHEAHIPYLLQLFIDYNLYGMNLINLAAVKFRKARRKSNTLHATGSCKNHLSGNSLADTLFRWEQDEIPSSLILEGVEPQSTCELEVDAVAADILNRLDIEAQIGGNPGLQAIWEDEKQRRRNRNETSQMSQPESQDHRFVPATESEKKFQKRLQEILKQNDFSVTLSGSVDYSDGSQEFSAELTLHSEVLSPEMLQCTPANMVEVHKDKESSKGHTRHKVEEALINEEAILNLMENSQTFQPLTQRLSESPVFMDSSPDEALVHLLAGLESDGYRGERNRMPSPCRSFGNNKYPQNSDDEENEPQIEKEEMELSLVMSQRWDSNIEEHCAKKRSLCRNTHRSSTEDDDSSSGEEMEWSDNSLLLASLSIPQLDGTADENSDNPLNNENSRTHSSVIATSKLSVKPSIFHKDAATLEPSSSAKITFQCKHTSALSSHVLNKEDLIEDLSQTNKNTEKGLDNSVTSFTNESTYSMKYPGSLSSTVHSENSHKENSKKEILPVSSCESSIFDYEEDIPSVTRQVPSRKYTNIRKIEKDSPFIHMHRHPNENTLGKNSFNFSDLNHSKNKVSSEGNEKGNSTALSSLFPSSFTENCELLSCSGENRTMVHSLNSTADESGLNKLKIRYEEFQEHKTEKPSLSQQAAHYMFFPSVVLSNCLTRPQKLSPVTYKLQPGNKPSRLKLNKRKLAGHQETSTKSSETGSTKDNFIQNNPCNSNPEKDNALASDLTKTTRGAFENKTPTDGFIDCHFGDGTLETEQSFGLYGNKYTLRAKRKVNYETEDSESSFVTHNSKISLPHPMEIGESLDGTLKSRKRRKMSKKLPPVIIKYIIINRFRGRKNMLVKLGKIDSKEKQVILTEEKMELYKKLAPLKDFWPKVPDSPATKYPIYPLTPKKSHRRKSKHKSAKKKTGKQQRTNNENIKRTLSFRKKRSHAILSPPSPSYNAETEDCDLNYSDVMSKLGFLSERSTSPINSSPPRCWSPTDPRAEEIMAAAEKEAMLFKGPNVYKKTVNSRIGKTSRARAQIKKSKAKLANPSIVTKKRNKRNQTNKLVDDGKKKPRAKQKTNEKGTSRKHITLKDEKIKSQSGAEVKFVLKHQNVSEFASSSGGSQLLFKQKDMPLMGSAVDHPLSASLPTGINAQQKLSGCFSSFLESKKSVDLQTFPSSRDDLHPSVVCNSIGPGVSKINVQRPHNQSAMFTLKESTLIQKNIFDLSNHLSQVAQNTQISSGMSSKIEDNANNIQRNYLSSIGKLSEYRNSLESKLDQAYTPNFLHCKDSQQQIVCIAEQSKHSETCSPGNTASEESQMPNNCFVTSLRSPIKQIAWEQKQRGFILDMSNFKPERVKPRSLSEAISQTKALSQCKNRNVSTPSAFGEGQSGLAVLKELLQKRQQKAQNANTTQDPLSNKHQPNKNISGSLEHNKANKRTRSVTSPRKPRTPRSTKQKEKIPKLLKVDSLNLQNSSQLDNSVSDDSPIFFSDPGFESCYSLEDSLSPEHNYNFDINTIGQTGFCSFYSGSQFVPADQNLPQKFLSDAVQDLFPGQAIEKNEFLSHDNQKCDEDKHHTTDSASWIRSGTLSPEIFEKSTIDSNENRRHNQWKNSFHPLTTRSNSIMDSFCVQQAEDCLSEKSRLNRSSVSKEVFLSLPQPNNSDWIQGHTRKEMGQSLDSANTSFTAILSSPDGELVDVACEDLELYVSRNNDMLTPTPDSSPRSTSSPSQSKNGSFTPRTANILKPLMSPPSREEIMATLLDHDLSETIYQEPFCSNPSDVPEKPREIGGRLLMVETRLANDLAEFEGDFSLEGLRLWKTAFSAMTQNPRPGSPLRSGQGVVNKGSSNSPKMVEDKKIVIMPCKCAPSRQLVQVWLQAKEEYERSKKLPKTKPTGVVKSAENFSSSVNPDDKPVVPPKMDVSPCILPTTAHTKEDVDNSQIALQAPTTGCSQTASESQMLPPVASASDPEKDEDDDDNYYISYSSPDSPVIPPWQQPISPDSKALNGDDRPSSPVEELPSLAFENFLKPIKDGIQKSPCSEPQEPLVISPINTRARTGKCESLCFHSTPIIQRKLLERLPEAPGLSPLSTEPKTQKLSNKKGSNTDTLRRVLLTQAKNQFAAVNTPQKETSQIDGPSLNNTYGFKVSIQNLQEAKALHEIQNLTLISVELHARTRRDLEPDPEFDPICALFYCISSDTPLPDTEKTELTGVIVIDKDKTVFSQDIRYQTPLLIRSGITGLEVTYAADEKALFHEIANIIKRYDPDILLGYEIQMHSWGYLLQRAAALSIDLCRMISRVPDDKIENRFAAERDEYGSYTMSEINIVGRITLNLWRIMRNEVALTNYTFENVSFHVLHQRFPLFTFRVLSDWFDNKTDLYRWKMVDHYVSRVRGNLQMLEQLDLIGKTSEMARLFGIQFLHVLTRGSQYRVESMMLRIAKPMNYIPVTPSVQQRSQMRAPQCVPLIMEPESRFYSNSVLVLDFQSLYPSIVIAYNYCFSTCLGHVENLGKYDEFKFGCTSLRVPPDLLYQVRHDITVSPNGVAFVKPSVRKGVLPRMLEEILKTRFMVKQSMKAYKQDRALSRMLDARQLGLKLIANVTFGYTSANFSGRMPCIEVGDSIVHKARETLERAIKLVNDTKKWGARVVYGDTDSMFVLLKGATKEQSFKIGQEIAEAVTATNPKPVKLKFEKVYLPCVLQTKKRYVGYMYETLDQKDPVFDAKGIETVRRDSCPAVSKILERSLKLLFETRDISLIKQYVQRQCMKLLEGKASIQDFIFAKEYRGSFSYKPGACVPALELTR

SEQ ID NO: 887680 - protein, 2420 aa, Homo sapiens
MAFSIDRALNVALGNPSSTAQHVFKVSLVSGMPFYGYHEKERHFMKIYLYNPTMVKRICELLQSGAIMNKFYQPHEAHIPYLLQLFIDYNLYGMNLINLAAVKFRKARRKSNTLHATGSCKNHLSGNSLADTLFRWEQDEIPSSLILEGVEPQSTCELEVDAVAADILNRLDIEAQIGGNPGLQAIWEDEKQRRRNRNETSQMSQPESQDHRFVPATESEKKFQKRLQEILKQNDFSVTLSGSVDYSDGSQEFSAELTLHSEVLSPEMLQCTPANMVEVHKDKESSKGHTRHKVEEALINEEAILNLMENSQTFQPLTQRLSESPVFMDSSPDEALVHLLAGLESDGYRGERNRMPSPCRSFGNNKYPQNSDDEENEPQIEKEEMELSLVMSQRWDSNIEEHCAKKRSLCRNTHRSSTEDDDSSSGEEMEWSDNSLLLASLSIPQLDGTADENSDNPLNNENSRTHSSVIATSKLSVKPSIFHKDAATLEPSSSAKITFQCKHTSALSSHVLNKEDLIEDLSQTNKNTEKGLDNSVTSFTNESTYSMKYPGSLSSTVHSENSHKENSKKEILPVSSCESSIFDYEEDIPSVTRQVPSRKYTNIRKIEKDSPFIHMHRHPNENTLGKNSFNFSDLNHSKNKVSSEGNEKGNSTALSSLFPSSFTENCELLSCSGENRTMVHSLNSTADESGLNKLKIRYEEFQEHKTEKPSLSQQAAHYMFFPSVVLSNCLTRPQKLSPVTYKLQPGNKPSRLKLNKRKLAGHQETSTKSSETGSTKDNFIQNNPCNSNPEKDNALASDLTKTTRGAFENKTPTDGFIDCHFGDGTLETEQSFGLYGNKYTLRAKRKVNYETEDSESSFVTHNSKISLPHPMEIGESLDGTLKSRKRRKMSKKLPPVIIKYIIINRFRGRKNMLVKLGKIDSKEKQVILTEEKMELYKKLAPLKDFWPKVPDSPATKYPIYPLTPKKSHRRKSKHKSAKKKTGKQQRTNNENIKRTLSFRKKRSHAILSPPSPSYNAETEDCDLNYSDVMSKLGFLSERSTSPINSSPPRCWSPTDPRAEEIMAAAEKEAMLFKGPNVYKKTVNSRIGKTSRARAQIKKSKAKLANPSIVTKKRNKRNQTNKLVDDGKKKPRAKQKTNEKGTSRKHITLKDEKIKSQSGAEVKFVLKHQNVSEFASSSGGSQLLFKQKDMPLMGSAVDHPLSASLPTGINAQQKLSGCFSSFLESKKSVDLQTFPSSRDDLHPSVVCNSIGPGVSKINVQRPHNQSAMFTLKESTLIQKNIFDLSNHLSQVAQNTQISSGMSSKIEDNANNIQRNYLSSIGKLSEYRNSLESKLDQAYTPNFLHCKDSQQQIVCIAEQSKHSETCSPGNTASEESQMPNNCFVTSLRSPIKQIAWEQKQRGFILDMSNFKPERVKPRSLSEAISQTKALSQCKNRNVSTPSAFGEGQSGLAVLKELLQKRQQKAQNANTTQDPLSNKHQPNKNISGSLEHNKANKRTRSVTSPRKPRTPRSTKQKEKIPKLLKVDSLNLQNSSQLDNSVSDDSPIFFSDPGFESCYSLEDSLSPEHNYNFDINTIGQTGFCSFYSGSQFVPADQNLPQKFLSDAVQDLFPGQAIEKNEFLSHDNQKCDEDKHHTTDSASWIRSGTLSPEIFEKSTIDSNENRRHNQWKNSFHPLTTRSNSIMDSFCVQQAEDCLSEKSRLNRSSVSKEVFLSLPQPNNSDWIQGHTRKEMGQSLDSANTSFTAILSSPDGELVDVACEDLELYVSRNNDMLTPTPDSSPRSTSSPSQSKNGSFTPRTANILKPLMSPPSREEIMATLLDHDLSETIYQEPFCSNPSDVPEKPREIGGRLLMVETRLANDLAEFEGDFSLEGLRLWKTAFSAMTQNPRPGSPLRSGQGVVNKGSSNSPKMVEDKKIVIMPCKCAPSRQLVQVWLQAKEEYERSKKLPKTKPTGVVKSAENFSSSVNPDDKPVVPPKMDVSPCILPTTAHTKEDVDNSQIALQAPTTGCSQTASESQMLPPVASASDPEKDEDDDDNYYISYSSPDSPVIPPWQQPISPDSKALNGDDRPSSPVEELPSLAFENFLKPIKDGIQKSPCSEPQEPLVISPINTRARTGKCESLCFHSTPIIQRKLLERLPEAPGLSPLSTEPKTQKLSNKKGSNTDTLRRVLLTQAKNQFAAVNTPQKETSQIDGPSLNNTYGFKVSIQNLQEAKALHEIQNLTLISVELHARTRRDLEPDPEFDPICALFYCISSDTPLPDTEKTELTGVIVIDKDKTVFSQDIRYQTPLLIRSGITGLEVTYAADEKALFHEIANIIKRYDPDILLGYEIQMHSWGYLLQRAAALSIDLCRMISRVPDDKIENRFAAERDEYGSYTMSEINIVGRITLNLWRIMRNEVGDLSKMLFRNKIFGQYNDLIIIEY

SEQ ID NO: 887681 - protein, 157 aa, Homo sapiens
MAFSIDRALNVALGNPSSTAQHVFKVSLVSGMPFYGYHEKERHFMKIYLYNPTMVKRICELLQSGAIMNKFYQPHEAHIPYLLQLFIDYNLYGMNLINLAAVKFRKARRKSNTLHATGSCKNHLSGNSLADTLFRWEQDEIPRLVNVVKEMKILHIS

SEQ ID NO: 887682 - protein, 561 aa, Homo sapiens
MSTERTSWTSLSTIQKIALGLGIPASATVAYILYRRYRESREERLTFVGEDDIEIEMRVPQEAVKLIIGRQGANIKQLRKQTGARIDVDTEDVGDERVLLISGFPVQVCKAKAAIHQILTENTPVSEQLSVPQRSVGRIIGRGGETIRSICKASGAKITCDKESEGTLLLSRLIKISGTQKEVAAAKHLILEKVSEDEELRKRIAHSAETRVPRKQPISVRREDMTEPGGAGEPALWKNTSSSMEPTAPLVTPPPKGGGDMAVVVSKEGSWEKPSDDSFQKSEAQAIPEMPMFEIPSPDFSFHADEYLEVYVSASEHPNHFWIQIVGSRSLQLDKLVNEMTQHYENSVPEDLTVHVGDIVAAPLPTNGSWYRARVLGTLENGNLDLYFVDFGDNGDCPLKDLRALRSDFLSLPFQAIECSLARIAPSGDQWEEEALDEFDRLTHCADWKPLVAKISSYVQTGISTWPKIYLYDTSNGKKLDIGLELVHKGYAIELPEDIEENRAVPDMLKDMATETDASLSTLLTETKKSSGEITHTLSCLSLSEAASMSGDDNLEDDYLL

SEQ ID NO: 887683 - protein, 561 aa, Homo sapiens; identical to SEQ ID NO: 887682

SEQ ID NO: 887684 - protein, 561 aa, Homo sapiens; identical to SEQ ID NO: 887682

SEQ ID NO: 887685 - protein, 561 aa, Homo sapiens; identical to SEQ ID NO: 887682

SEQ ID NO: 887686 - protein, 296 aa, Homo sapiens
MSTERTSWTSLSTIQKIALGLGIPASATVAYILYRRYRESREERLTFVGEDDIEIEMRVPQEAVKLIIGRQGANIKQLRKQTGARIDVDTEDVGDERVLLISGFPVQVCKAKAAIHQILTENTPVSEQLSVPQRSVGRIIGRGGETIRSICKASGAKITCDKESEGTLLLSRLIKISGTQKEVAAAKHLILEKVSEDEELRKRIAHSAETRVPRKQPISVRREDMTEPGGAGEPALWKNTSSSMEPTAPLVTPPPKGGGDMAVVVSKEGSWEKPSDDSFQKSEAQAIPEMPMFESM

SEQ ID NO: 887687 - protein, 561 aa, Homo sapiens; identical to SEQ ID NO: 887682

SEQ ID NO: 887688 - protein, 516 aa, Homo sapiens
MSTERTSWTSLSTIQKIALGLGIPASATVAYILYRRYRESREERLTFVGEDDIEIEMRVPQEAVKLIIGRQGANIKQLRKQTGARIDVDTEDVGDERVLLISGFPVQASGAKITCDKESEGTLLLSRLIKISGTQKEVAAAKHLILEKVSEDEELRKRIAHSAETRVPRKQPISVRREDMTEPGGAGEPALWKNTSSSMEPTAPLVTPPPKGGGDMAVVVSKEGSWEKPSDDSFQKSEAQAIPEMPMFEIPSPDFSFHADEYLEVYVSASEHPNHFWIQIVGSRSLQLDKLVNEMTQHYENSVPEDLTVHVGDIVAAPLPTNGSWYRARVLGTLENGNLDLYFVDFGDNGDCPLKDLRALRSDFLSLPFQAIECSLARIAPSGDQWEEEALDEFDRLTHCADWKPLVAKISSYVQTGISTWPKIYLYDTSNGKKLDIGLELVHKGYAIELPEDIEENRAVPDMLKDMATETDASLSTLLTETKKSSGEITHTLSCLSLSEAASMSGDDNLEDDYLL

SEQ ID NO: 887689 - protein, 371 aa, Homo sapiens
EIRKFAMKEMGTPDVRIDTRLNKAVWAKGIRNVPYRIRVRLSRKRNEDEDSPNKLYTLVTYVPVTTFKNLQTVNVDENYSLIVRSNKVIKLQKKKAIPEMPMFEIPSPDFSFHADEYLEVYVSASEHPNHFWIQIVGSRSLQLDKLVNEMTQHYENSVPEDLTVHVGDIVAAPLPTNGSWYRARVLGTLENGNLDLYFVDFGDNGDCPLKDLRALRSDFLSLPFQAIECSLARIAPSGDQWEEEALDEFDRLTHCADWKPLVAKISSYVQTGISTWPKIYLYDTSNGKKLDIGLELVHKGYAIELPEDIEENRAVPDMLKDMATETDASLSTLLTETKKSSGEITHTLSCLSLSEAASMSGDDNLEDDYLL

SEQ ID NO: 887690 - protein, 407 aa, Homo sapiens
MSTERTSWTSLSTIQKIALGLGIPASATVAYILYRRYRESREERLTFVGEDDIEIEMRVPQEAVKLIIGRQGANIKQLRKQTGARIDVDTEDVGDERVLLISGFPVQVCKAKAAIHQILTENTPVSEQLSVPQRSVGRIIGRGGETIRSICKASGAKITCDKESEGTLLLSRLIKISGTQKEVAAAKHLILEKVSEDEELRKRIAHSAETRVPRKQPISVRREDMTEPGGAGEPALWKNTSSSMEPTAPLVTPPPKGGGDMAVVVSKEGSWEKPSDDSFQKSEAQAIPEMPMFEIPSPDFSFHADEYLEVYVSASEHPNHFWIQIVGSRSLQLDKLVNEMTQHYENSVPEDLTVHVGDIVAAPLPTNGSWYRARVLGTLENGNLDLYFVDFGDNGDCPLKDLRALRE

SEQ ID NO: 887691 - protein, 115 aa, Homo sapiens
MSPYAESYCLLGSRVALVAGADTPCGALSRYVGPCEGVRTSAPGKVVGSDNEITVELLNHLTMLDPFCFKKLNIKENLLNLDDRSPILTLLRTKATAVSFNGFDTFIPWLIETPL

SEQ ID NO: 887692 - protein, 288 aa, Homo sapiens [sequence omitted]

SEQ ID NO: 887693 - protein, 288 aa, Homo sapiens [sequence omitted]

SEQ ID NO: 887694 - protein, 309 aa, Homo sapiens [sequence omitted]

SEQ ID NO: 887695 - protein, 290 aa, Homo sapiens
WVDRGLWVDRGLWVDRGLVASLPFAILTLVNAPYKRGFYCGDDSIRYPYRPDTITHGLMAGVTITATVILVSAGEAYLVYTDRLYSRSDFNNYVAAVYKVLGTFLFGAAVSQSLTDLAKYMIGRLRPNFLAVCDPDWSRVNCSVYVQLEKVCRGNPADVTEARLSFYSGHSSFGMYCMVFLVLYVQARLCWKWARLLRPTVQFFLVAFALYVGYTRVSDYKHHWSDVLVGLLQGALVAALTVCYISDFFKARPPQHCLKEEELERKPSLSLTLTLGEADHNHYGYPHSSS

SEQ ID NO: 887696 - protein, 242 aa, Homo sapiens [sequence omitted]

SEQ ID NO: 887697 - protein, 109 aa, Homo sapiens
TWLRGRAGTRRDALGPASGVAGTMQRRWVFVLLDVLCLLVASLPFAILTLVNAPYKRGFYCGDDSIRYPYRPDTITHGLMAGVTITATVILGAAVSPAEAHPGGPSSPG

SEQ ID NO: 887698 - protein, 211 aa, Homo sapiens
MGVARGPGSRGQHPPPRQQEVCAEGPRARLHPAPPGLGASLPFAILTLVNAPYKRGFYCGDDSIRYPYRPDTITHGLMAGVTITATVILVSAGEAYLVYTDRLYSRSDFNNYVAAVYKVLGTFLFGAAVSQSLTDLAKYMIGRLRPNFLAVCDPDWSRVNCSVYVQLEKVCRGNPADVTEARWVWTSSLHSCGEWELKKALEPNHEEPAGS

SEQ ID NO: 887699 - protein, 309 aa, Homo sapiens [sequence omitted]

SEQ ID NO: 887700 - protein, 297 aa, Homo sapiens
RDSAAGPGRDGTRWDRRRGSRGPCSGASLPFAILTLVNAPYKRGFYCGDDSIRYPYRPDTITHGLMAGVTITATVILVSAGEAYLVYTDRLYSRSDFNNYVAAVYKVLGTFLFGAAVSQSLTDLAKYMIGRLRPNFLAVCDPDWSRVNCSVYVQLEKVCRGNPADVTEARLSFYSGHSSFGMYCMVFLVLYVQARLCWKWARLLRPTVQFFLVAFALYVGYTRVSDYKHHWSDVLVGLLQGALVAALTVCYISDFFKARPPQHCLKEEELERKPSLSLTLTLGEADHNHYGYPHSSS

SEQ ID NO: 887701 - protein, 113 aa, Homo sapiens
MVFLVLYVQARLCWKWARLLRPTVQFFLVAFALYVGYTRVSDYKHHWSDVLVGLLQGALVAALTVCYISDFFKARPPQHCLKEEELERKPSLSLTLTLGEADHNHYGYPHSSS

SEQ ID NO: 887702 - protein, 240 aa, Homo sapiens
MQRRWVFVLLDVLCLLVASLPFAILTLVNAPYKRGFYCGDDSIRYPYRPDTITHGLMAGVTITATVILVSAGEAYLVYTDRLYSRSDFNNYVAAVYKVLGTFLFGAAVSQSLTDLAKYMIGRLRPNFLAVCDPDWSRVNCSVYVQLEKVCRGNPADVTEARLSFYSGHSSFGMYCMVFLVLYVQARLCWKWARLLRPTVQFFLVAFALYVGYTRVSDYKHHWRCTIKHHKTRLQTGVMSV

SEQ ID NO: 887703 - protein, 190 aa, Homo sapiens
MQRRWVFVLLDVLCLLVASLPFAILTLVNAPYKRGFYCGDDSIRYPYRPDTITHGLMAGVTITATVILVSAGEAYLVYTDRLYSRSDFNNYVAAVYKVLGTFLFGAAVSQSLTDLAKYMIGRLRPNFLAVCDPDWSRVNCSVYVQLEKVCRGNPADVTEARWVWTSSLHSCGEWELKKALEPNHEEPAGS

SEQ ID NO: 887704 - protein, 215 aa, Homo sapiens
MASRGATRPNGPNTGNKICQFKLVLLGESAVGKSSLVLRFVKGQFHEFQESTIGAAFLTQTVCLDDTTVKFEIWDTAGQERYHSLAPMYYRGAQAAIVVYDITNEESFARAKNWVKELQRQASPNIVIALSGNKADLANKRAVDFQEAQSYADDNSLLFMETSAKTSMNVNEIFMAIAKKLPKNEPQNPGANSARGRGVDLTEPTQPTRNQCCSN

SEQ ID NO: 887705 - protein, 197 aa, Homo sapiens
MASRGATRPNGPNTGNNLVLRFVKGQFHEFQESTIGAAFLTQTVCLDDTTVKFEIWDTAGQERYHSLAPMYYRGAQAAIVVYDITNEESFARAKNWVKELQRQASPNIVIALSGNKADLANKRAVDFQEAQSYADDNSLLFMETSAKTSMNVNEIFMAIAKKLPKNEPQNPGANSARGRGVDLTEPTQPTRNQCCSN

SEQ ID NO: 887706 - protein, 201 aa, Homo sapiens
MASRGATRPNGPNTGNKICQFKLVLLGESAVGKSSLVLRFVKGQFHEFQESTIGVKFEIWDTAGQERYHSLAPMYYRGAQAAIVVYDITNEESFARAKNWVKELQRQASPNIVIALSGNKADLANKRAVDFQEAQSYADDNSLLFMETSAKTSMNVNEIFMAIAKKLPKNEPQNPGANSARGRGVDLTEPTQPTRNQCCSN

SEQ ID NO: 887707 - protein, 133 aa, Homo sapiens
AAYIIVYDLTTDESLAISHNWGLGTFMSDDLVVKIVSTLNRVTGPTERIEELQMAMQTLHPFGIMYQLGKSLCECVRLYRIYSTRSSVNEIFMAIAKKLPKNEPQNPGANSARGRGVDLTEPTQPTRNQCCSN

SEQ ID NO: 887708 - protein, 215 aa, Homo sapiens; identical to SEQ ID NO: 887704

SEQ ID NO: 887709 - protein, 184 aa, Homo sapiens [sequence omitted]

SEQ ID NO: 887710 - protein, 215 aa, Homo sapiens; identical to SEQ ID NO: 887704

SEQ ID NO: 887711 - protein, 215 aa, Homo sapiens; identical to SEQ ID NO: 887704

SEQ ID NO: 887712 - protein, 215 aa, Homo sapiens; identical to SEQ ID NO: 887704

SEQ ID NO: 887713 - protein, 213 aa, Homo sapiens
MASRGATRPNGPNTGNKICQFKLVLLGESAVGKSSLVLRFVKGQFHEFQESTIGAAFLTQTVCLDDTTVKFEIWDTAGQERYHSLAPMYYRGAQAAIVVYDITNEESFARAKNWVKELQRQASPNIVIALSGNKADLANKRAVDFQEAQSYADDNSLLFMETSAKTSMNVNEIFMAIAKKLPKNEPQNPGANSARGRGVDLTEPTQPTSEIPQ

SEQ ID NO: 887714 - protein, 193 aa, Homo sapiens
MASRGATRPNGPNTGNKICQFKLVLLGESAVGKSSLVLRFVKGQFHEFQESTIGAAFLTQTVCLDDTTVKFEIWDTAGQERYHSLAPMYYRGAQAAIVVYDITNEESFARAKNWVKELQRQASPNIVIALSGNKADLANKRAVDFQEAQSYADDNSLLFMETSAKTSMNVNEIFMAIAKKCPKNELLGSLDRP

SEQ ID NO: 887715 - protein, 416 aa, Homo sapiens
RIEGREPAPPEGAARFTALGPGLEGRASAMEQPGQDPTSDDVMDSFLEKFQSQPYRGGFHEDQWEKEFEKVPLFMTRAPSEIDPRENPDLACLQSIIFDEERSPEEQAKTYKDEGNDYFKEKDYKKAVISYTEGLKKKCADPDLNAVLYTNRAAAQYYLGNFRSALNDVTAARKLKPCHLKAIIRGALCHLELKHFAEAVNWCDEGLQIDAKEKKLLEMRAKADKLKRIEQRDVRKANLKEKKERNQNEALLQAIKARNIRLSEAACEDEDSASEGLGELFLDGLSTENPHGARLSLDGQGRLSWPVLFLYPEYAQSDFISAFHEDSRFIDHLMVMFGETPSWDLEQKYCPDNLEVYFEDEDRAELYRVPAKSTLLQVLQHQRYFVKALTPAFLVCVGSSPFCKNFLRGRKVYQIR

SEQ ID NO: 887716 - protein, 416 aa, Homo sapiens; identical to SEQ ID NO: 887715

SEQ ID NO: 887717 - protein, 416 aa, Homo sapiens; identical to SEQ ID NO: 887715

SEQ ID NO: 887718 - protein, 383 aa, Homo sapiens
RIEGREPAPPEGAARFTALGPGLEGRASAMEQPGQDPTSDDVMDSFLEKFQSQPYRGGFHEDQWEKEFEKVPLFMTRAPSEIDPRENPDLACLQSIIFDEERSPEEQAKTYKDEGNDYFKEKDYKKAVISYTEGLKKKCADPDLNAVLYTNRAAAQYYLGNFRSALNDVTAARKLKPCHLKAIIRGALCHLELKHFAEAVNWCDEGLQIDAKEKKLLEMRAKADKLKRIEQRDVRKANLKEKKERNQNEALLQAIKARNIRLSEAACEDEDSASEGLGELFLDGLSTENPHGARLSLDGQGRLSWPVLFLYPEYAQSDFISAFHEDSRFIDHLMVMFGETPSWDLEQKYCPDNLEVYFEDEDRAELYRVPAKSTLLQVLQHQR

SEQ ID NO: 887719 - protein, 317 aa, Homo sapiens
RIEGREPAPPEGAARFTALGPGLEGRASAMEQPGQDPTSDDVMDSFLEKFQSQPYRGGFHEDQWEKEFEKVPLFMTRAPSEIDPRENPDLACLQSIIFDEERSPEEQAKTYKDEGNDYFKEKDYKKAVISYTEGLKKKCADPDLNAVLYTNRAAAQYYLGNFRSALNDVTAARKLKPCHLKAIIRGALCHLELKHFAEAVNWCDEGLQIDAKEKKLLEMRAKADKLKRIEQRDVRKANLKEKKERNQNEALLQAIKVYFEDEDRAELYRVPAKSTLLQVLQHQRYFVKALTPAFLVCVGSSPFCKNFLRGRKVYQIR

SEQ ID NO: 887720 - protein, 253 aa, Homo sapiens
RISPDRVYINYYDMNAAMWAGTTPPSPKSRRDPRCLRWLHPGTRRTLCSRPAHPNLLVGRNKRRDALGAGCRILLICEMQLTHQLDLFPECRVTLLLFKDVKNAGDLRRKAMEGTIDGSLINPTVIVDPFQILVAANKAVHLYKLGKMKTRTLSTEIIFNLSPNNNISEALKKFGISANDTSILIVYIEEGEKQINQEYLISQVEGHQVSLKNLPEIMNITEVKKIYKLSSQEESIGTLLDAIICRMSTKDVL

SEQ ID NO: 887721 - protein, 253 aa, Homo sapiens; identical to SEQ ID NO: 887720

SEQ ID NO: 887722 - protein, 210 aa, Homo sapiens
DGDWPSLPEVVSFVSERELFRDALGAGCRILLICEMQLTHQLDLFPECRVTLLLFKDVKNAGDLRRKAMEGTIDGSLINPTVIVDPFQILVAANKAVHLYKLGKMKTRTLSTEIIFNLSPNNNISEALKKFGISANDTSILIVYIEEGEKQINQEYLISQVEGHQVSLKNLPEIMNITEVKKIYKLSSQEESIGTLLDAIICRMSTKDVL

SEQ ID NO: 887723 - protein, 130 aa, Homo sapiens
MQIVDPFQILVAANKAVHLYKLGKMKTRTLSTEIIFNLSPNNNISEALKKFGISANDTSILIVYIEEGEKQINQEYLISQVEGHQVSLKNLPEIMNITEVKKIYKLSSQEESIGTLLDAIICRMSTKDVL

SEQ ID NO: 887724 - protein, 135 aa, Homo sapiens
DGDWPSLPEVVSFVSERELFRDALGAGCRILLICEMQLTHQLDLFPECRVTLLLFKDVKNAGDLRRKAMEGTIDGSLINPTVIVDPFQILVAANKAVHLYKLGKMKTRTLSTEIIFNLSPNNNVMCTFLFLLTVS

SEQ ID NO: 887725 - protein, 199 aa, Homo sapiens
MQLTHQLDLFPECRVTLLLFKDVKNAGDLRRKAMEGTIDGSLINPTVFHSCCPGWSAMARSWLTATSASRVQAIVLPQPPELLGLQIVDPFQILVAANKAVHLYKLGKMKTRTLSTEIIFNLSPNNNISEALKKFGISANDTSILIVYIEEGEKQINQEYLISQVEGHQVSLKNLPEIMNITEVKKIYNSLHREESIGE

SEQ ID NO: 887726 - protein, 249 aa, Homo sapiens
DGDWPSLPEVVSFVSERELFRDALGAGCRILLICEMQLTHQLDLFPECRVTLLLFKDVKNAGDLRRKAMEGTIDGSLINPTVFHSCCPGWSAMARSWLTATSASRVQAIVLPQPPELLGLQIVDPFQILVAANKAVHLYKLGKMKTRTLSTEIIFNLSPNNNISEALKKFGISANDTSILIVYIEEGEKQINQEYLISQVEGHQVSLKNLPEIMNITEVKKIYKLSSQEESIGTLLDAIICRMSTKDVL

SEQ ID NO: 887727 - protein, 253 aa, Homo sapiens; identical to SEQ ID NO: 887720

SEQ ID NO: 887728 - protein, 249 aa, Homo sapiens; identical to SEQ ID NO: 887726

SEQ ID NO: 887729 - protein, 238 aa, Homo sapiens
RISPDRVYINYYDMNAAMWAGTTPPSPKSRRDPRCLRWLHPGTRRTLCSRPAHPNLLVGRNKRRDALGAGCRILLICEMQLTHQLDLFPECRVTLLLFKDVKNAGDLRRKAMEGTIDGSLINPTVIVDPFQILVAANKAVHLYKLGKMKTRTLSTEIIFNLSPNNNISEALKKFGISANDTSILIVYIEEGEKQINQEYLISQVEGHQVSLKNLPEIMNITEVKKIYNSLHREESIGE

SEQ ID NO: 887730 - protein, 210 aa, Homo sapiens; identical to SEQ ID NO: 887722

SEQ ID NO: 887731 - protein, 210 aa, Homo sapiens; identical to SEQ ID NO: 887722

SEQ ID NO: 887732 - protein, 192 aa, Homo sapiens
DGDWPSLPEVVSFVSERELFRDALGAGCRILLICEMQLTHQLDLFPECRVTLLLFKDVKNAGDLRRKAMEGTIDGSLINPTVIVDPFQILVAANKAVHLYKLGKMKTRTLSTEIIFNLSPNNNISEALKKFGISANDTSILIVYIEEGEKQINQEYLISQVEGHQVSLKNLPEIMNITEVKKVCQSIFLERV

SEQ ID NO: 887733 - protein, 189 aa, Homo sapiens
DGDWPSLPEVVSFVSERELFRDALGAGWVTLLLFKDVKNAGDLRRKAMEGTIDGSLINPTVIVDPFQILVAANKAVHLYKLGKMKTRTLSTEIIFNLSPNNNISEALKKFGISANDTSILIVYIEEGEKQINQEYLISQVEGHQVSLKNLPEIMNITEVKKIYKLSSQEESIGTLLDAIICRMSTKDVL

SEQ ID NO: 887734 - protein, 130 aa, Homo sapiens; identical to SEQ ID NO: 887723

SEQ ID NO: 887735 - protein, 253 aa, Homo sapiens; identical to SEQ ID NO: 887720

SEQ ID NO: 887736 - protein, 178 aa, Homo sapiens
RISPDRVYINYYDMNAAMWAGTTPPSPKSRRDPRCLRWLHPGTRRTLCSRPAHPNLLVGRNKRRDALGAGCRILLICEMQLTHQLDLFPECRVTLLLFKDVKNAGDLRRKAMEGTIDGSLINPTVIVDPFQILVAANKAVHLYKLGKMKTRTLSTEIIFNLSPNNNVMCTFLFLLTVS

SEQ ID NO: 887737 - protein, 335 aa, Homo sapiens
HPVWSSPAKHCQESCEAAPAMCEEEDSTALVCDNGSGLCKAGFAGDDAPRAVFPSIVGRPRHQGVMVGMGQKDSYVGDEAQSKRGILTLKYPIEHGIITNWDDMEKIWHHSFYNELRVAPEEHPTLLTEAPLNPKANREKMTQIMFETFNVPAMYVAIQAVLSLYASGRTTGIVLDSGDGVTHNVPIYEGYALPHAIMRLDLAGRDLTDYLMKILTERGYSFVTTAEREIVRDIKEKLCYVALDFENEMGPWADSVNRTRGEADYEVDLNGHRRINKPGTAHTVRRARSSRYERMALTGNARTEERQSESTQNEQQTRKAAKIDTTERTDMRHKD

SEQ ID NO: 887738 - protein, 119 aa, Homo sapiens
HPVWSSPAKHCQESCEAAPAMCEEEDSTALVCDNGSGLCKAGFAGDDAPRAVFPSIVGRPRHQGVMVGMGQKDSYVGDEAQSKRGILTLKYPIEHGIITNWDDMEKVWEVCCSLGPQDA

SEQ ID NO: 887739 - protein, 71 aa, Homo sapiens
HPVWSSPAKHCQESCEAAPAMCEEEDSTALVCDNGSGLCKAGFAGDDAPRAVFPSIVGRPRHQVRKIMIGT

SEQ ID NO: 887740 - protein, 389 aa, Homo sapiens
RPIRHEVWSSPAKHCQESCEAAPAMCEEEDSTALVCDNGSGLCKAGFAGDDAPRAVFPSIVGRPRHQGVMVGMGQKDSYVGDEAQSKRGILTLKYPIEHGIITNWDDMEKIWHHSFYNELRVAPEEHPTLLTEAPLNPKANREKMTQIMFETFNVPAMYVAIQAVLSLYASGRTTGIVLDSGDGVTHNVPIYEGYALPHAIMRLDLAGRDLTDYLMKILTERGYSFVTTAEREIVRDIKEKLCYVALDFENEMATAASSSSLEKSYELPDGQVITIGNERFRCPETLFQPSFIGMESAGIHETTYNSIMKCDIDIRKDLYANNVLSGGTTMYPGIADRMQKEITALAPSTMKIKIICPSGAQILCLDRWLHPGLSVHLPADVDQQTGIR

SEQ ID NO: 887741 - protein, 385 aa, Homo sapiens
HPVWSSPAKHCQESCEAAPAMCEEEDSTALVCDNGSGLCKAGFAGDDAPRAVFPSIVGRPRHQGVMVGMGQKDSYVGDEAQSKRGILTLKYPIEHGIITNWDDMEKIWHHSFYNELRVAPEEHPTLLTEAPLNPKANREKMTQIMFETFNVPAMYVAIQAVLSLYASGRTTGIVLDSGDGVTHNVPIYEGYALPHAIMRLDLAGRDLTDYLMKILTERGYSFVTTAEREIVRDIKEKLCYVALDFENEMATAASSSSLEKSYELPDGQVITIGNERFRCPETLFQPSFIGMESAGIHETTYNSIMKCDIDIRKDLYANNVLSGGTTMYPGIADRMQKEITALAPSTMKIKIICPSGAQILCLDRWLHPGLSVHLPADVDQQTGIR

SEQ ID NO: 887742 - protein, 365 aa, Homo sapiens
MCEEEDSTALVCDNGSGLCKAGFAGDDAPRAVFPSIVGRPRHQGVMVGMGQKDSYVGDEAQSKRGILTLKYPIEHGIITNWDDMEKIWHHSFYNELRVAPEEHPTLLTEAPLNPKANREKMTQIMFETFNVPAMYVAIQAVLSLYASGRTTGIVLDSGDGVTHNVPIYEGYALPHAIMRLDLAGRDLTDYLMKILTERGYSFVTTAEREIVRDIKEKLCYVALDFENEMATAASSSSLEKSYELPDGQVITIGNERFRCPETLFQPSFIGMESAGIHETTYNSIMKCDIDIRKDLYANNVLSGGTTMYPGIADRMQKEITALAPSTMKIKIICPSGAQILCLDRWLHPGLSVHLPADVDQQTGIR

SEQ ID NO: 887743 - protein, 516 aa, Homo sapiens
MSNICSEGCRLSPRPRGAARTHPPAPERTFGLACQGLSRSSAPLSNRGPPPATLKLPRLPLQFLSAPHAHLNVERSGLRGAPELPRLPSGVSTSHQGPRPPGASLQRLPQQPAAPRCPRAPLPPQSRTRPAPAPLCLSPGLRRESCEAAPAMCEEEDSTALVCDNGSGLCKAGFAGDDAPRAVFPSIVGRPRHQGVMVGMGQKDSYVGDEAQSKRGILTLKYPIEHGIITNWDDMEKIWHHSFYNELRVAPEEHPTLLTEAPLNPKANREKMTQIMFETFNVPAMYVAIQAVLSLYASGRTTGIVLDSGDGVTHNVPIYEGYALPHAIMRLDLAGRDLTDYLMKILTERGYSFVTTAEREIVRDIKEKLCYVALDFENEMATAASSSSLEKSYELPDGQVITIGNERFRCPETLFQPSFIGMESAGIHETTYNSIMKCDIDIRKDLYANNVLSGGTTMYPGIADRMQKEITALAPSTMKIKIICPSGAQILCLDRWLHPGLSVHLPADVDQQTGIR

SEQ ID NO: 887744 - protein, 397 aa, Homo sapiens
MPGGKNCRCSSTIRRRTTATKHCQESCEAAPAMCEEEDSTALVCDNGSGLCKAGFAGDDAPRAVFPSIVGRPRHQGVMVGMGQKDSYVGDEAQSKRGILTLKYPIEHGIITNWDDMEKIWHHSFYNELRVAPEEHPTLLTEAPLNPKANREKMTQIMFETFNVPAMYVAIQAVLSLYASGRTTGIVLDSGDGVTHNVPIYEGYALPHAIMRLDLAGRDLTDYLMKILTERGYSFVTTAEREIVRDIKEKLCYVALDFENEMATAASSSSLEKSYELPDGQVITIGNERFRCPETLFQPSFIGMESAGIHETTYNSIMKCDIDIRKDLYANNVLSGGTTMYPGIADRMQKEITALAPSTMKIKIICPSGAQILCLDRWLHPGLSVHLPADVDQQTGIR

SEQ ID NO: 887745 - protein, 320 aa, Homo sapiens
MVGMGQKDSYVGDEAQSKRGILTLKYPIEHGIITNWDDMEKIWHHSFYNELRVAPEEHPTLLTEAPLNPKANREKMTQIMFETFNVPAMYVAIQAVLSLYASGRTTGIVLDSGDGVTHNVPIYEGYALPHAIMRLDLAGRDLTDYLMKILTERGYSFVTTAEREIVRDIKEKLCYVALDFENEMATAASSSSLEKSYELPDGQVITIGNERFRCPETLFQPSFIGMESAGIHETTYNSIMKCDIDIRKDLYANNVLSGGTTMYPGIADRMQKEITALAPSTMKIKIICPSGAQILCLDRWLHPGLSVHLPADVDQQTGIR

SEQ ID NO: 887746 - protein, 320 aa, Homo sapiens; identical to SEQ ID NO: 887745

SEQ ID NO: 887747 - protein, 346 aa, Homo sapiens
MAGVAVDLRSPCRLPIARGTCERSGSSRVNVTNDSYVGDEAQSKRGILTLKYPIEHGIITNWDDMEKIWHHSFYNELRVAPEEHPTLLTEAPLNPKANREKMTQIMFETFNVPAMYVAIQAVLSLYASGRTTGIVLDSGDGVTHNVPIYEGYALPHAIMRLDLAGRDLTDYLMKILTERGYSFVTTAEREIVRDIKEKLCYVALDFENEMATAASSSSLEKSYELPDGQVITIGNERFRCPETLFQPSFIGMESAGIHETTYNSIMKCDIDIRKDLYANNVLSGGTTMYPGIADRMQKEITALAPSTMKIKIICPSGAQILCLDRWLHPGLSVHLPADVDQQTGIR

SEQ ID NO: 887748 - protein, 245 aa, Homo sapiens
MTQIMFETFNVPAMYVAIQAVLSLYASGRTTGIVLDSGDGVTHNVPIYEGYALPHAIMRLDLAGRDLTDYLMKILTERGYSFVTTAEREIVRDIKEKLCYVALDFENEMATAASSSSLEKSYELPDGQVITIGNERFRCPETLFQPSFIGMESAGIHETTYNSIMKCDIDIRKDLYANNVLSGGTTMYPGIADRMQKEITALAPSTMKIKIICPSGAQILCLDRWLHPGLSVHLPADVDQQTGIR

SEQ ID NO: 887749 - protein, 369 aa, Homo sapiens
HPVWSSPAKHCQESCEAAPAMCEEEDSTALVCDNGSGLCKAGFAGDDAPRAVFPSIVGRPRHQGVMVGMGQKDSYVGDEAQSKRGILTLKYPIEHGIITNWDDMEKIWHHSFYNELRVAPEEHPTLLTEAPLNPKANREKMTQAVLSLYASGRTTGIVLDSGDGVTHNVPIYEGYALPHAIMRLDLAGRDLTDYLMKILTERGYSFVTTAEREIVRDIKEKLCYVALDFENEMATAASSSSLEKSYELPDGQVITIGNERFRCPETLFQPSFIGMESAGIHETTYNSIMKCDIDIRKDLYANNVLSGGTTMYPGIADRMQKEITALAPSTMKIKIICPSGAQILCLDRWLHPGLSVHLPADVDQQTGIR

SEQ ID NO: 887750 - protein, 188 aa, Homo sapiens
MRLDLAGRDLTDYLMKILTERGYSFVTTAEREIVRDIKEKLCYVALDFENEMATAASSSSLEKSYELPDGQVITIGNERFRCPETLFQPSFIGMESAGIHETTYNSIMKCDIDIRKDLYANNVLSGGTTMYPGIADRMQKEITALAPSTMKIKIICPSGAQILCLDRWLHPGLSVHLPADVDQQTGIR

SEQ ID NO: 887751 - protein, 231 aa, Homo sapiens
FTGFLGILSLYASGRTTGIVLDSGDGVTHNVPIYEGYALPHAIMRLDLAGRDLTDYLMKILTERGYSFVTTAEREIVRDIKEKLCYVALDFENEMATAASSSSLEKSYELPDGQVITIGNERFRCPETLFQPSFIGMESAGIHETTYNSIMKCDIDIRKDLYANNVLSGGTTMYPGIADRMQKEITALAPSTMKIKIICPSGAQILCLDRWLHPGLSVHLPADVDQQTGIR

SEQ ID NO: 887752 - protein, 223 aa, Homo sapiens
LSDASGRTTGIVLDSGDGVTHNVPIYEGYALPHAIMRLDLAGRDLTDYLMKILTERGYSFVTTAEREIVRDIKEKLCYVALDFENEMATAASSSSLEKSYELPDGQVITIGNERFRCPETLFQPSFIGMESAGIHETTYNSIMKCDIDIRKDLYANNVLSGGTTMYPGIADRMQKEITALAPSTMKIKIICPSGAQILCLDRWLHPGLSVHLPADVDQQTGIR

SEQ ID NO: 887753 - protein, 188 aa, Homo sapiens; identical to SEQ ID NO: 887750

SEQ ID NO: 887754 - protein, 179 aa, Homo sapiens
GRYPDLLPSGLSVVFLRYYAEREIVRDIKEKLCYVALDFENEMATAASSSSLEKSYELPDGQVITIGNERFRCPETLFQPSFIGMESAGIHETTYNSIMKCDIDIRKDLYANNVLSGGTTMYPGIADRMQKEITALAPSTMKIKIICPSGAQILCLDRWLHPGLSVHLPADVDQQTGIR

SEQ ID NO: 887755 - protein, 415 aa, Homo sapiens
HPVWSSPAKHCQESCEAAPAMCEEEDSTALVCDNGSGLCKAGFAGDDAPRAVFPSIVGRPRHQGVMVGMGQKDSYVGDEAQSKRGILTLKYPIEHGIITNWDDMEKIWHHSFYNELRVAPEEHPTLLTEAPLNPKANREKMTQIMFETFNVPAMYVAIQAVLSLYASGRTTGIVLDSGDGVTHNVPIYEGYALPHAIMRLDLAGRDLTDYLMKILTERGYSFVTTAEREIVRDIKEKLCYVALDFENEMATAASSSSLEKSYELPDGQVITIGNERFRCPETLFQPSFIEMESAGIHETTYNSIMKDGCPETLFQPSFIGMESAGIHETTYNSIMKCDIDIRKDLYANNVLSGGTTMYPGIADRMQKEITALAPSTMKIKIICPSGAQILCLDRWLHPGLSVHLPADVDQQTGIR

SEQ ID NO: 887756 - protein, 173 aa, Homo sapiens
MELWNSLLLTYLEAKSRAQINREKNLCYVALDFENEMATAASSSSLEKSYELPDGQVITIGNERFRCPETLFQPSFIGMESAGIHETTYNSIMKCDIDIRKDLYANNVLSGGTTMYPGIADRMQKEITALAPSTMKIKIICPSGAQILCLDRWLHPGLSVHLPADVDQQTGIR

SEQ ID NO: 887757 - protein, 385 aa, Homo sapiens
HPVWSSPAKHCQESCEAAPAMCEEEDSTALVCDNGSGLCKAGFAGDDAPRAVFPSIVGRPRHQGVMVGMGQKDSYVGDEAQSKRGILTLKYPIEHGIITNWDDMEKIWHHSFYNELRVAPEEHPTLLTEAPLNPKANREKMTQIMFETFNVPAMYVAIQAVLSLYASGRTTGIVLDSGDGVTHNVPIYEGYALPHAIMRLDLAGRDLTDYLMKILTERGYSFVTTAEREIVRDIKEKLCYVALDFENEMATAASSSSLEKSYELPDGQVITIGNERFRCPETLFQPSFIGMESAGIHETTYNSIMKCDIDIRKDLYANNVLSGGTTMYPGIADRMQKEITALAPSTMKIKIICPSGAQILCLDRWLHPTVKYPDKHARDIARDPL

SEQ ID NO: 887758 - protein, 372 aa, Homo sapiens
HPVWSSPAKHCQESCEAAPAMCEEEDSTALVCDNGSGLCKAGFAGDDAPRAVFPSIVGRPRHQGVMVGMGQKDSYVGDEAQSKRGILTLKYPIEHGIITNWDDMEKIWHHSFYNELRVAPEEHPTLLTEAPLNPKANREKMTQIMFETFNVPAMYVAIQAVLSLYASGRTTGIVLDSGDGVTHNVPIYEGYALPHAIMRLDLAGRDLTDYLMKILTERGYSFVTTAEREIVRDIKEKLCYVALDFENEMATAASSSSLEKSYELPDGQVITIGNERFRCPETLFQPSFIGMESAGIHETTYNSIMKCDIDIRKDLYANNVLSGGTTMYPGIADRMQKEITALAPSTMKIKPGHNDNKEAAKNLAACLRLRCH

SEQ ID NO: 887759 - protein, 319 aa, Homo sapiens
HPVWSSPAKHCQESCEAAPAMCEEEDSTALVCDNGSGLCKAGFAGDDAPRAVFPSIVGRPRHQGVMVGMGQKDSYVGDEAQSKRGILTLKYPIEHGIITNWDDMEKIWHHSFYNELRVAPEEHPTLLTEAPLNPKANREKMTQIMFETFNVPAMYVAIQAVLSLYASGRTTGIVLDSGDGVTHNVPIYEGYALPHAIMRLDLAGRDLTDYLMKILTERGYSFVTTAEREIVRDIKEKLCYVALDFENEMATAASSSSLEKSYELPDGQVITIGNERFRCPETLFQPSFIGPLCPPSSRCGSANRNTMKPGLPLSNRKCF

SEQ ID NO: 887760 - protein, 136 aa, Homo sapiens
MIWKRTEGIIPQDIHSCVLETEEEQESLLEAFAVDNGRPGWMESAGIHETTYNSIMKCDIDIRKDLYANNVLSGGTTMYPGIADRMQKEITALAPSTMKIKIICPSGAQILCLDRWLHPGLSVHLPADVDQQTGIR

SEQ ID NO: 887761 - protein, 181 aa, Homo sapiens
HPVWSSPAKHCQESCEAAPAMCEEEDSTALVCDNGSGLCKAGFAGDDAPRAVFPSIVGRPRHQGVMVGMGQKDSYVGDEAQSKRGILTLKYPIEHGIITNWDDMEKIRKDLYANNVLSGGTTMYPGIADRMQKEITALAPSTMKIKIICPSGAQILCLDRWLHPGLSVHLPADVDQQTGIR

SEQ ID NO: 887762 - protein, 115 aa, Homo sapiens
LQDAVLGGFLDPSRLHPYEDGWIQGIWAAETFISDGDHLPIRKDLYANNVLSGGTTMYPGIADRMQKEITALAPSTMKIKIICPSGAQILCLDRWLHPGLSVHLPADVDQQTGIR

SEQ ID NO: 887763 - protein, 228 aa, Homo sapiens
MCEEEDSTALVCDNGSGLCKAGFAGDDAPRAVFPSIVGRPRHQGVMVGMGQKDSYVGDEAQSKRGILTLKYPIEHGIITNWDDMEKIWHHSFYNELRVAPEEHPTLLTEAPLNPKANREKMTQIMFETFNVPAMYVAIQAVLSLYASGRTTGIVLDSGDGVTHNVPIYEGYALPHAIMRLDVWIGGSILASLSTFQQMWISKQEYDEAGPSIVQPQMLLKHFPAPLCL

SEQ ID NO: 887764 - protein, 228 aa, Homo sapiens; identical to SEQ ID NO: 887763

SEQ ID NO: 887765 - protein, 106 aa, Homo sapiens
MSNICSEGCRLSPRPRGAARTHPPAPERTFGLACQGLSRSSAPLSNRGPPPATLKLPRLPLQFLSAPHAHLNVERSGLRGAPELPRLPSGVSTSHQGPRKASPPAF

SEQ ID NO: 887766 - protein, 156 aa, Homo sapiens
MESAGIHETTYNSIMKCDIDIRKDLYANNAYQGAPLCTLAGRDLTDYLMKILTERGYSFVTTAEREIVRDIKEKLCYVALDFENEMATAASSSSLEKSYELPDGQVITIGNERFRCPETLFQPSFIGPLCPPSSRCGSANRNTMKPGLPLSNRKCF

SEQ ID NO: 887767 - protein, 341 aa, Homo sapiens
MTDGILGKAATMEIPIHGNGEARQLPEDDGLEQDLQQVMVSGPNLNETSIVSGGYGGSGDGLIPTGSGRHPSHSTTPSGPGDEVARGIAGEKFDIVKKWGINTYKCTKQLLSERFGRGSRTVDLELELQIELLRETKRKYESVLQLGRALTAHLYSLLQTQHALGDAFADLSQKSPELQEEFGYNAETQKLLCKNGETLLGAVNFFVSSINTLVTKTMEDTLMTVKQYEAARLEYDAYRTDLEELSLGPRDAGTRGRLESAQATFQAHRDKYEKLRGDVAIKLKFLEENKIKVMHKQLLLFHNAVSAYFAGNQKQLEQTLQQFNIKLRPPGAEKPSWLEEQ

SEQ ID NO: 887768 - protein, 407 aa, Homo sapiens
VPFVKFVHVAGWSGPGFPGFPDLLLGSRRELEPEVPARPGPGALRGRAARPEGAGVESFTPIPFLAMTDGILGKAATMEIPIHGNGEARQLPEDDGLEQDLQQVMVSGPNLNETSIVSGGYGGSGDGLIPTGSGRHPSHSTTPSGPGDEVARGIAGEKFDIVKKWGINTYKCTKQLLSERFGRGSRTVDLELELQIELLRETKRKYESVLQLGRALTAHLYSLLQTQHALGDAFADLSQKSPELQEEFGYNAETQKLLCKNGETLLGAVNFFVSSINTLVTKTMEDTLMTVKQYEAARLEYDAYRTDLEELSLGPRDAGTRGRLESAQATFQAHRDKYEKLRGDVAIKLKFLEENKIKVMHKQLLLFHNAVSAYFAGNQKQLEQTLQQFNIKLRPPGAEKPSWLEEQ

SEQ ID NO: 887769 - protein, 362 aa, Homo sapiens
VPFVKFVHVAGWSGPGFPGFPDLLLGSRRELEPEVPARPGPGALRGRAARPEGAGVESFTPIPFLAMTDGILGKAATMEIPIHGNGEARQLPEDDGLEQDLQQVMVSGPNLNETSIVSGGYGGSGDGLIPTGSGRHPSHSTTPSGPGDEVARGIAGEKFDIVKKWGINTYKCTKQLLSERFGRGSRTVDLELELQIELLRETKRKYESVLQLGRALTAHLYSLLQTQHALGDAFADLSQKSPELQEEFGYNAETQKLLCKNGETLLGAVNFFVSSINTLVTKTMEDTLMTVKQYEAARLEYDAYRTDLEELSLGPRDAGTRGRLESAQATFQAHRDKYEKLRGDVAIKLKFLEENKVPTPPP

SEQ ID NO: 887770 - protein, 341 aa, Homo sapiens; identical to SEQ ID NO: 887767

SEQ ID NO: 887771 - protein, 360 aa, Homo sapiens
VPFVKFVHVAGWSGPGFPGFPDLLLGSRRELEPEVPARPGPGALRGRAARPEDLQQVMVSGPNLNETSIVSGGYGGSGDGLIPTGSGRHPSHSTTPSGPGDEVARGIAGEKFDIVKKWGINTYKCTKQLLSERFGRGSRTVDLELELQIELLRETKRKYESVLQLGRALTAHLYSLLQTQHALGDAFADLSQKSPELQEEFGYNAETQKLLCKNGETLLGAVNFFVSSINTLVTKTMEDTLMTVKQYEAARLEYDAYRTDLEELSLGPRDAGTRGRLESAQATFQAHRDKYEKLRGDVAIKLKFLEENKIKVMHKQLLLFHNAVSAYFAGNQKQLEQTLQQFNIKLRPPGAEKPSWLEEQ

SEQ ID NO: 887772 - protein, 432 aa, Homo sapiens
VPFVKFVHVAGWSGPGFPGFPDLLLGSRRELEPEVPARPGPGALRGRAARPEGAGVESFTPIPFLAMTDGILGKAATMEIPIHGNGEARQLPEDDGLEQDLQQVMVSGPNLNETSIVSGGYGGSGDGLIPTGSGRHPSHSTTPSGPGDEVARGIAGEKFDIVKKWGINTYKCTKQLLSERFGRGSRTVDLELELQIELLRETKRKYESVLQLGRALTAHLYSLLQTQHALGDAFADLSQKSPELQPTEENPFRVGPALPPAALTCGGSLREEFGYNAETQKLLCKNGETLLGAVNFFVSSINTLVTKTMEDTLMTVKQYEAARLEYDAYRTDLEELSLGPRDAGTRGRLESAQATFQAHRDKYEKLRGDVAIKLKFLEENKIKVMHKQLLLFHNAVSAYFAGNQKQLEQTLQQFNIKLRPPGAEKPSWLEEQ

SEQ ID NO: 887773 - protein, 472 aa, Homo sapiens
VPFVKFVHVAGWSGPGFPGFPDLLLGSRRELEPEVPARPGPGALRGRAARPEGAGVESFTPIPFLAMTDGILGKAATMEIPIHGNGEARQLPEDDGLEQDLQQVMVSGPNLNETSIVSGGYGGSGDGLIPTGGHMYIRIWFSPRKVRVPPSKQEHPVVSSISFREVNFMCSKRSMGGATEVSGVSREAGVRELDPLGSGRHPSHSTTPSGPGDEVARGIAGEKFDIVKKWGINTYKCTKQLLSERFGRGSRTVDLELELQIELLRETKRKYESVLQLGRALTAHLYSLLQTQHALGDAFADLSQKSPELQEEFGYNAETQKLLCKNGETLLGAVNFFVSSINTLVTKTMEDTLMTVKQYEAARLEYDAYRTDLEELSLGPRDAGTRGRLESAQATFQAHRDKYEKLRGDVAIKLKFLEENKIKVMHKQLLLFHNAVSAYFAGNQKQLEQTLQQFNIKLRPPGAEKPSWLEEQ

SEQ ID NO: 887774 - protein, 645 aa, Homo sapiens
VPFVKFVHVAGWSGPGFPGFPDLLLGSRRELEPEVPARPGPGALRGRAARPEGAGVESFTPIPFLAMTDGILGKAATMEIPIHGNGEARQLPEDDGLEQDLQQVMVSGPNLNETSIVSGGYGGSGDGLIPTGMNVQKQESWVEEGTGMVWGSIGYVKESLNYVWRSWELLLVGTSWTLLSPKATPSVVHPFPFCHLAPEMAHLSFPCHHLSQVKTCFTGMPPLYSLRLSWNFVKLLRIFRFYKFRGTNSPESHTKIPHGNATRFLVIMTHHPGLLLPPNSVYFLLFPLPLYTNNSLQTPPLTPKEAICISGFGSHRAKSEFLLVSRSIQLSLASPSGKSISCARREVWVGPQRCLVYLREAGVRELDPLGSGRHPSHSTTPSGPGDEVARGIAGEKFDIVKKWGINTYKCTKQLLSERFGRGSRTVDLELELQIELLRETKRKYESVLQLGRALTAHLYSLLQTQHALGDAFADLSQKSPELQEEFGYNAETQKLLCKNGETLLGAVNFFVSSINTLVTKTMEDTLMTVKQYEAARLEYDAYRTDLEELSLGPRDAGTRGRLESAQATFQAHRDKYEKLRGDVAIKLKFLEENKIKVMHKQLLLFHNAVSAYFAGNQKQLEQTLQQFNIKLRPPGAEKPSWLEEQ

SEQ ID NO: 887775 - protein, 361 aa, Homo sapiens
MFPLPLYTNNSLQTPPLTPKEAICISGFGSHRAKSEFLLVSRSIQLSLASPSGKSISCARREVWVGPQRCLVYLREAGVRELDPLGSGRHPSHSTTPSGPGDEVARGIAGEKFDIVKKWGINTYKCTKQLLSERFGRGSRTVDLELELQIELLRETKRKYESVLQLGRALTAHLYSLLQTQHALGDAFADLSQKSPELQEEFGYNAETQKLLCKNGETLLGAVNFFVSSINTLVTKTMEDTLMTVKQYEAARLEYDAYRTDLEELSLGPRDAGTRGRLESAQATFQAHRDKYEKLRGDVAIKLKFLEENKIKVMHKQLLLFHNAVSAYFAGNQKQLEQTLQQFNIKLRPPGAEKPSWLEEQ

SEQ ID NO: 887776 - protein, 124 aa, Homo sapiens
MEDTLMTVKQYEAARLEYDAYRTDLEELSLGPRDAGTRGRLESAQATFQAHRDKYEKLRGDVAIKLKFLEENKIKVMHKQLLLFHNAVSAYFAGNQKQLEQTLQQFNIKLRPPGAEKPSWLEEQ

SEQ ID NO: 887777 - protein, 325 aa, Homo sapiens
MTDGILGKAATMEIPIHGNGEARQLPEDDGLEQDLQQVMVSGPNLNETSIVSGGYGGSGDGLIPTDEVARGIAGEKFDIVKKWGINTYKCTKQLLSERFGRGSRTVDLELELQIELLRETKRKYESVLQLGRALTAHLYSLLQTQHALGDAFADLSQKSPELQEEFGYNAETQKLLCKNGETLLGAVNFFVSSINTLVTKTMEDTLMTVKQYEAARLEYDAYRTDLEELSLGPRDAGTRGRLESAQATFQAHRDKYEKLRGDVAIKLKFLEENKIKVMHKQLLLFHNAVSAYFAGNQKQLEQTLQQFNIKLRPPGAEKPSWLEEQ

SEQ ID NO: 887778 - protein, 336 aa, Homo sapiens
VPFVKFVHVAGWSGPGFPGFPDLLLGSRRELEPEVPARPGPGALRGRAARPEGAGVESFTPIPFLAMTDGILGKAATMEIPIHGNGEARQLPEDDGLEQDLQQVMVSGPNLNETSIVSGGYGGSGDGLIPTGSGRHPSHSTTPSGPGDEVARGIAGEKFDIVKKWGINTYKCTKQLLSERFGRGSRTVDLELELQIELLRETKRKYESVLQLGRALTAHLYSLLQTQHALGDAFADLSQKSPELQEEFGYNAETQKLLCKNGETLLGAVNFFVSSINTLVTKTMHTAFTTLRPYERPPAIAMHARTTLKKMTPWFPLRTVHPRSKPSGERYRARST

SEQ ID NO: 887779 - protein, 156 aa, Homo sapiens
VPFVKFVHVAGWSGPGFPGFPDLLLGSRRELEPEVPARPGPGALRGRAARPEGAGVESFTPIPFLAMTDGILGKAATMEIPIHGNGEARQLPEDDGLEQDLQQVMVSGPNLNETSIVSGGYGGSGDGLIPTGMNVQKQESWVEEGTGMVWGSIGYV

SEQ ID NO: 887780 - protein, 270 aa, Homo sapiens
VPFVKFVHVAGWSGPGFPGFPDLLLGSRRELEPEVPARPGPGALRGRAARPEGAGVESFTPIPFLAMTDGILGKAATMEIPIHGNGEARQLPEDDGLEQDLQQVMVSGPNLNETSIVSGGYGGSGDGLIPTGGHMYIRIWFSPRKVRVPPSKQEHPVVSSISFREVNFMCSKRSMGGATEVSGVSREAGVRELDPLGSGRHPSHSTTPSGPGDEVARGIAGEKFDIVKKWGINTYKVGFKHLSLPQNSLWVPFSLFLVIVISHLWLRVGA

SEQ ID NO: 887781 - protein, 822 aa, Homo sapiens
PLAARRPRRGKSLAGFESLTCSFPVVSRGFLASRSARSLSSEGGTMPDNRQPRNRQPRIRSGNEPRSAPAMEPDGRGAWAHSRAALDRLEKLLRCSRCTNILREPVCLGGCEHIFCSNCVSDCIGTGCPVCYTPAWIQDLKINRQLDSMIQLCSKLRNLLHDNELSDLKEDKPRKSLFNDAGNKKNSIKMWFSPRSKKVRYVVSKASVQTQPAIKKDASAQQDSYEFVSPSPPADVSERAKKASARSGKKQKKKTLAEINQKWNLEAEKEDGEFDSKEESKQKLVSFCSQPSVISSPQINGEIDLLASGSLTESECFGSLTEVSLPLAEQIESPDTKSRNEVVTPEKVCKNYLTSKKSLPLENNGKRGHHNRLSSPISKRCRTSILSTSGDFVKQTVPSENIPLPECSSPPSCKRKVGGTSGRKNSNMSDEFISLSPGTPPSTLSSSSYRQVMSSPSAMKLLPNMAVKRNHRGETLLHIASIKGDIPSVEYLLQNGSDPNVKDHAGWTPLHEACNHGHLKVVELLLQHKALVNTTGYQNDSPLHDAAKNGHVDIVKLLLSYGASRNAVNIFGLRPVDYTDDESMKSLLLLPEKNESSSASHCSVMNTGQRRDGPLVLIGSGLSSEQQKMLSELAVILKAKKYTEFDSTVTHVVVPGDAVQSTLKCMLGILNGCWILKFEWVKACLRRKVCEQEEKYEIPEGPRRSRLNREQLLPKLFDGCYFYLWGTFKHHPKDNLIKLVTAGGGQILSRKPKPDSDVTQTINTVAYHARPDSDQRFCTQYIIYEDLCNYHPERVRQGKVWKAPSSWFIDCVMSFELLPLDS

SEQ ID NO: 887782 - protein, 680 aa, Homo sapiens [sequence omitted]

SEQ ID NO: 887783 - protein, 117 aa, Homo sapiens
MSSKIQKLPKLFDGCYFYLWGTFKHHPKDNLIKLVTAGGGQILSRKPKPDSDVTQTINTVAYHARPDSDQRFCTQYIIYEDLCNYHPERVRQGKVWKAPSSWFIDCVMSFELLPLDS

SEQ ID NO: 887784 - protein, 837 aa, Homo sapiens
PLAARRPRRGKSLAGFESLTCSFPVVSRGFLASRSARSLSSEGGTMPDNRQPRNRQPRIRSGNEPRSAPAMEPDGRGAWAHSRAALDRLEKLLRCSRCTNILREPVCLGGCEHIFCSNCVSDCIGTGCPVCYTPAWIQDLKINRQLDSMIQLCSKLRNLLHDNELSDLKEDKPRKSLFNDAGNKKNSIKMWFSPRSKKVRYVVSKASVQTQPAIKKDASAQQDSYEFVSPSPPADVSERAKKASARSGKKQKKKTLAEINQKWNLEAEKEDGEFDSKEESKQKLVSFCSQPSVISSPQINGEIDLLASGSLTESECFGSLTEVSLPLAEQIESPDTKSRNEVVTPEKVCKNYLTSKKSLPLENNGKRGHHNRLSSPISKRCRTSILSTSGDFVKQTVPSENIPLPECSSPPSCKRKVGGTSGRKNSNMSDEFISLSPGTPPSTLSSSSYRQVMSSPSAMKLLPNMAVKRNHRGETLLHIASIKGDIPSVEYLLQNGSDPNVKDHAGWTPLHEACNHGHLKVVELLLQHKALVNTTGYQNDSPLHDAAKNGHVDIVKLLLSYGASRNAVNIFGLRPVDYTDDESMKSLLLLPEKNESSSASHCSVMNTGQRRDGPLVLIGSGLSSEQQKMLSELAVILKAKKYTEFDSTVTHVVVPGDAVQSTLKCMLGILNGCWILKFEWVKACLRRKVCEQEEKYEIPEGPRRSRLNREQLHLILKDDQMSSKIQKLPKLFDGCYFYLWGTFKHHPKDNLIKLVTAGGGQILSRKPKPDSDVTQTINTVAYHARPDSDQRFCTQYIIYEDLCNYHPERVRQGKVWKAPSSWFIDCVMSFELLPLDS

SEQ ID NO: 887785 - protein, 187 aa, Homo sapiens
AAGAQSPGRGRRDGRGRGPGWHPAGGQAGAMELLSALSLGELALSFSRVPLFPVFDLSYFIVSILYLKYEPGAVELSRRHPIASWLCAMLHCFGSYILADLLLGEPLIDYFSNNSSILLASAVWYLIFFCPLDLFYKCVCFLPVKLIFVAMKEVVRVRKIAVGIHHAHHHYHHGWFVMIATGWVKGK

SEQ ID NO: 887786 - protein, 329 aa, Homo sapiens
AAGAQSPGRGRRDGRGRGPGWHPAGGQAGAMELLSALSLGELALSFSRVPLFPVFDLSYFIVSILYLKYEPGAVELSRRHPIASWLCAMLHCFGSYILADLLLGEPLIDYFSNNSSILLASAVWYLIFFCPLDLFYKCVCFLPVKLIFVAMKEVVRVRKIAVGIHHAHHHYHHGWFVMIATGWVKGSGVALMSNFEQLLRGVWKPETNEILHMSFPTKASLYGAILFTLQQTRWLPVSKASLIFIFTLFMVSCKVFLTATHSHSSPFDALEGYICPVLFGSACGGDHHHDNHGGSHSGGGPGAQHSAMPAKSKEELSEGSRKKKAKKAD

SEQ ID NO: 887787 - protein, 159 aa, Homo sapiens
AAGAQSPGRGRRDGRGRGPGWHPAGGQAGAMELLSALSLGELALSFSRVPLFPVFDLSYFIVSILYLKYEPGAVELSRRHPIASWLCAMLHCFGSYILADLLLGEPLIDYFSNNSSILLASAVWYLIFFCPLDLFYKCVCFLPVKLIFVAMKEVEVAVS

SEQ ID NO: 887788 - protein, 232 aa, Homo sapiens
AAGAQSPGRGRRDGRGRGPGWHPAGGQAGAMELLSALSLGELALSFSRVPLFPVFDLSYFIVSILYLKYEPGAVELSRRHPIASWLCAMLHCFGSYILADLLLGEPLIDYFSNNSSILLASAVWYLIFFCPLDLFYKCVCFLPVKLIFVAMKEVVRVRKIAVGIHHAHHHYHHGWFVMIATGWVKGSGVALMSNFEQLLRGVWKPETNEILHMSFPTKASLYGAILFTLHLR

SEQ ID NO: 887789 - protein, 112 aa, Homo sapiens
MLLSGVPKTVMMMTKASIARAGFLTCSTTDMWGWIILCGGGCLVHYRMLNSTPGLHPRDASSTLVPSCDKKLSPDIAKRLLEGKMAAGENPFFSRALAIGVLNFCGPWPFCQ

SEQ ID NO: 887790 - protein, 79 aa, Homo sapiens
KVSSYHAPQWLDIFTWPESPDSCWASLDKLPGPSELGGFLRSDLSFPGLDFPICKSGSLAHPPGLTWGLRYGDEDEELL

SEQ ID NO: 887791 - protein, 78 aa, Homo sapiens
TVCPSPGTHCSLPKRYLIFFCPLDLFYKCVCFLPVKLIFVAMKEVVRVRKIAVGIHHAHHHYHHGWFVMIATGWVKGK

SEQ ID NO: 887792 - protein, 82 aa, Homo sapiens
STPDCVFFPNARSRVRREVVALRRGLACIPSVGVWRFPSVGVWRFPTVGVWRFPTVGVWHAPPSLALVAPCRCTRQEDKKMI

SEQ ID NO: 887793 - protein, 121 aa, Homo sapiens
MQHREVRVKCVKALKGLYGNRDLTARLELFTGRFKDWMVSMIVDREYSVAVEAVRLLILILNRDVNFTMVAMTGPQLLTSGDLPASTSQSAEITGLSHRAQPWHLFYQKRSTHPLKHDTGH

SEQ ID NO: 887794 - protein, 33 aa, Homo sapiens
MSLFTHSFCFSVGRYRSRLPYSSFRAFTHFTQT

SEQ ID NO: 887795 - protein, 134 aa, Homo sapiens; identical to SEQ ID NO: 847237

SEQ ID NO: 887796 - protein, 82 aa, Homo sapiens; identical to SEQ ID NO: 887792

SEQ ID NO: 887797 - protein, 134 aa, Homo sapiens; identical to SEQ ID NO: 847237

SEQ ID NO: 887798 - protein, 72 aa, Homo sapiens
RTRDPFQVKDRKKQKPHGHGSHSPPNSRLGVKGKGGCRVKEDTNEYTLSAFLWANMEGVLMDVDCESVYPIV

SEQ ID NO: 887799 - protein, 134 aa, Homo sapiens; identical to SEQ ID NO: 847237

SEQ ID NO: 887800 - protein, 134 aa, Homo sapiens; identical to SEQ ID NO: 847237

SEQ ID NO: 887801 - protein, 134 aa, Homo sapiens; identical to SEQ ID NO: 847237

SEQ ID NO: 887802 - protein, 82 aa, Homo sapiens; identical to SEQ ID NO: 887792

SEQ ID NO: 887803 - protein, 134 aa, Homo sapiens; identical to SEQ ID NO: 847237

SEQ ID NO: 887804 - protein, 134 aa, Homo sapiens; identical to SEQ ID NO: 847237

SEQ ID NO: 887805 - protein, 82 aa, Homo sapiens; identical to SEQ ID NO: 887792

SEQ ID NO: 887806 - protein, 134 aa, Homo sapiens; identical to SEQ ID NO: 847237

SEQ ID NO: 887807 - protein, 134 aa, Homo sapiens; identical to SEQ ID NO: 847237

SEQ ID NO: 887808 - protein, 171 aa, Homo sapiens
MIFSMLRKLPKVTCRDVLPEIRAICIEEIGCWMQSYSTSFLTDSYLKYIGWTLHDKHREVRVKCVKALKGLYGNRDLTARLELFTGRFKDWMVSMIVDREYSVAVEAVRLLILILKLFYPECEIRTMGGREQRQSPGAQRTFFQLLLSFFVESKLECNGAILAHCNLHLPD

SEQ ID NO: 887809 - protein, 374 aa, Homo sapiens
MAANVSGAKSCPANFLAAADDKLSGFQGDFLWPILVVEFLVAVASNGLALYRFSIRKQRPWHPAVVFSVQLAVSDLLCALTLPPLAAYLYPPKHWRYGEAACRLERFLFTCNLLGSVIFITCISLNRYLGIVHPFFARSHLRPKHAWAVSAAGWVLAALLAMPTLSFSHLKRPQQGAGNCSVARPEACIKCLGTADHGLAAYRAYSLVLAGLGCGLPLLLTLAAYGALGRAVLRSPGMTVAEKLRVAALVASGVALYASSYVPYHIMRVLNVDARRRWSTRCPSFADIAQATAALELGPYVGYQVMRGLMPLAFCVHPLLYMAAVPSLGCCCRHCPGYRDSWNPEDAKSTGQALPLNATAAPKPSEPQSRELSQ

SEQ ID NO: 887810 - protein, 135 aa, Homo sapiens
MTSCQDGRPAEMNVPGYLSHQVEETPIDMHHTPHMKPFFFCTVTGVRDYYSLQLSLALSCLTNTSFNKCRFISKKTQNNTNKKQPQGSSISGGREKTGVLERAMWPTRSLTQFLGPGGNGRPQRGRIIEPGPKSP

SEQ ID NO: 887811 - protein, 100 aa, Homo sapiens
RGRRRREAHGRPQAQTPLPSCERTAGQTPKLARQASIELPSMTASSTKSWWETGEVQAQSAAKTPSCKDIVAGDMSKKSLWEQKGGSKTSSTIKMDSVTT

SEQ ID NO: 887812 - protein, 118 aa, Homo sapiens
RGRRRREAHGRPQAQTPLPSCERTAGQTPKLARQASIELPSMTASSTKSWWETGEVQAQSAAKTPSCKDIVAGDMSKKSLWEQKGGSKTSSTIKVEPKCGWCRQEILTHFIVTRNQKT

SEQ ID NO: 887813 - protein, 83 aa, Homo sapiens
RGRRRREAHGRPQAQTPLPSCERTAGQTPKLARQASIELPSMTASSTKSWWETGEVQAQSAAKTPSCKGSRRNVRRPGRIVSQ

SEQ ID NO: 887814 - protein, 126 aa, Homo sapiens
RGRRRREAHGRPQAQTPLPSCERTAGQTPKLARQASIELPSMTASSTKSWWETGEVQAQSAAKTPSCKLQTTQGEVILASWSQPDWGEPIDMYCINEHMTVVMKDLQLSVYSLCFPDSLAVALGTG

SEQ ID NO: 887815 - protein, 79 aa, Homo sapiens
RGRRRREAHGRPQAQTPLPSCERTAGQTPKLARQASIELPSMTASSTKSWWETGEVQAQSAAKTPSCKSQLNHFSRKTY

SEQ ID NO: 887816 - protein, 128 aa, Homo sapiens
YMTSADVLLHDNTAHYSPPNNAHQDLPPRLQGSSHHLYFCSTLHLPLAQLDMPTEVNDLFDQCRLAFLSQLQTTQGEVILASWSQPDWGEPIDMYCINEHMTVVMKDLQLSVYSLCFPDSLAVALGTG

SEQ ID NO: 887817 - protein, 118 aa, Homo sapiens
RGRRRREAHGRPQAQTPLPSCERTAGQTPKLARQASIELPSMTASSTKSWWETGEVQAQSAAKTPSCKVDSQKREVSKAAREEKMACGGEQLPSHHGGPTQVPGLMGADPDARGLSHP

SEQ ID NO: 887818 - protein, 111 aa, Homo sapiens
RGRRRREAHGRPQAQTPLPSCERTAGQTPKLARQASIELPSMTASSTKSWWETGEVQAQSAAKTPSCKDIVAGDMSKKSLWEQKGGSKTSSTIKTLWQLHWVLAEFWKTGM

SEQ ID NO: 887819 - protein, 113 aa, Homo sapiens
MSKKGDSVPNTMKSMHRRFSQSRKVHRHWPHTLTFVCRCSSPPDFHQSIHSFHKHFCWGGSRAIQGVYITDRVGLYNEYKKLLAEDDKVYQERALFEITPLHSSLGNRGRFHL

SEQ ID NO: 887820 - protein, 111 aa, Homo sapiens; identical to SEQ ID NO: 887818

SEQ ID NO: 887821 - protein, 85 aa, Homo sapiens
RGRRRREAHGRPQAQTPLPSCERTAGQTPKLARQASIELPSMTASSTKSWWETGEVQAQSAAKTPSCKTLWQLHWVLAEFWKTGM

SEQ ID NO: 887822 - protein, 74 aa, Homo sapiens
RGRRRREAHGRPQAQTPLPSCERTAGQTPKLARQASIELPSMTASSTKSWWETGEVQAQSAAKTPSCKMDSVTT

SEQ ID NO: 887823 - protein, 74 aa, Homo sapiens; identical to SEQ ID NO: 887822

SEQ ID NO: 887824 - protein, 113 aa, Homo sapiens; identical to SEQ ID NO: 887819

SEQ ID NO: 887825 - protein, 100 aa, Homo sapiens; identical to SEQ ID NO: 887811

SEQ ID NO: 887826 - protein, 102 aa, Homo sapiens
MGFSLHVGRRTVWEVGSGVCLPSLTVLFLPKSRLDKGLAALVRERGADLVVIEGMGRAVHTNYHAALRCESLKLAVIKNAWLAERLGGRLFSVIFKYEVPAE

SEQ ID NO: 887827 - protein, 626 aa, Homo sapiens
MTCLIKGCNFVLKNIPHEAFVYQKDSDPEFRFQTNHPHIFPYLLVNIGSGVSIVKVETEDRFEWVGGSSIGGGTFWGLGALLTKTKKFDELLHLASRGQHSNVDMLVRDVYGGAHQTLGLSGNLIASSFGKSATADQEFSKEDMAKSLLHMISNDIGQLACLHARLHSLDRVYFGGFFIRGHPVTMRTITYSINFFSKGEVQALFLRHEGYLGAIGAFLKGAEQDNPNQYSWGENYAGSSGLMSASPELGPAQRARSGTFDLLEMDRLERPLVDLPLLLDPPSYVPDTVDLTDDALARKYWLTCFEEALDGVVKRAVASQPDSVDAAERAEKFRQKYWNKLQTLRQQPFAYGTLTVRSLLDTREHCLNEFNFPDPYSKVKQRENGVALRCFPGVVRSLDALGWEERQLALVKGLLAGNVFDWGAKAVSAVLESDPYFGFEEAKRKLQERPWLVDSYSEWLQRLKGPPHKCALIFADNSGIDIILGVFPFVRELLLRGTEVILACNSGPALNDVTHSESLIVAERIAGMDPVVHSALQEERLLLVQTGSSSPCLDLSRLDKGLAALVRERGADLVVIEGMGRAVHTNYHAALRCESLKLAVIKNAWLAERLGGRLFSVIFKYEVPAE

SEQ ID NO: 887828 - protein, 362 aa, Homo sapiens
MDRLERPLVDLPLLLDPPSYVPDTVDLTDDALARKYWLTCFEEALDGVVKRAVASQPDSVDAAERAEKFRQKYWNKLQTLRQQPFAYGTLTVRSLLDTREHCLNEFNFPDPYSKVKQRENGVALRCFPGVVRSLDALGWEERQLALVKGLLAGNVFDWGAKAVSAVLESDPYFGFEEAKRKLQERPWLVDSYSEWLQRLKGPPHKCALIFADNSGIDIILGVFPFVRELLLRGTEVILACNSGPALNDVTHSESLIVAERIAGMDPVVHSALQEERLLLVQTGSSSPCLDLSRLDKGLAALVRERGADLVVIEGMGRAVHTNYHAALRCESLKLAVIKNAWLAERLGGRLFSVIFKYEVPAE

SEQ ID NO: 887829 - protein, 584 aa, Homo sapiens
MSWPGTFKMAECGASGSGSSGDSLDKSITLPPDEIFRNLENAKRFAIDIGGSLTKLAYYSTVQHKVAKVRSFDHSGKDTEREHEPPYEISVQEEITARLHFIKFENTYIEACLDFIKDHLVNTETKVIQATGGGAYKFKDLIEEKLRLKVDKEDVMTCLIKGCNFVLKNIPHEAFVYQKDSDPEFRFQTNHPHIFPYLLVNIGSGVSIVKVETEDRFEWVGGSSIGGGTFWGLGALLTKTKKFDELLHLASRGQHSNVDMLVRDVYGGAHQTLGLSGNLIASSFGKSATADQEFSKEDMAKSLLHMISNDIGQLACLHARLHSLDRVYFGGFFIRGHPVTMRTITYSINFFSKGEVQALFLRHEGYLGAIGAFLKGAEQDNPNQYSWGENYAGSSGLMSASPELGPAQRARSGTFDLLEMDRLERPLVDLPLLLDPPSYVPDTVDLTDDALARKYWLTCFEEALDGVVKRAVASQPDSVDAAERAEKFRQKYWNKLQTLRQQPFAYGTLTVRSLLDTREHCLNEFNFPDPYSKVKQRENGVALRCFPGVVRSLDALGWEERQLALVKGLLAGNVFDWGAKAVSA

SEQ ID NO: 887830 - protein, 781 aa, Homo sapiens
MSWPGTFKMAECGASGSGSSGDSLDKSITLPPDEIFRNLENAKRFAIDIGGSLTKLAYYSTVQHKVAKVRSFDHSGKDTEREHEPPYEISVQEEITARLHFIKFENTYIEACLDFIKDHLVNTETKVIQATGGGAYKFKDLIEEKLRLKVDKEDVMTCLIKGCNFVLKNIPHEAFVYQKDSDPEFRFQTNHPHIFPYLLVNIGSGVSIVKVETEDRFEWVGGSSIGGGTFWGLGALLTKTKKFDELLHLASRGQHSNVDMLVRDVYGGAHQTLGLSGNLIASSFGKSATADQEFSKEDMAKSLLHMISNDIGQLACLHARLHSLDRVYFGGFFIRGHPVTMRTITYSINFFSKGEVQALFLRHEGYLGAIGAFLKGAEQDNPNQYSWGENYAGSSGLMSASPELGPAQRARSGTFDLLEMDRLERPLVDLPLLLDPPSYVPDTVDLTDDALARKYWLTCFEEALDGVVKRAVASQPDSVDAAERAEKFRQKYWNKLQTLRQQPFAYGTLTVRSLLDTREHCLNEFNFPDPYSKVKQRENGVALRCFPGVVRSLDALGWEERQLALVKGLLAGNVFDWGAKAVSAVLESDPYFGFEEAKRKLQERPWLVDSYSEWLQRLKGPPHKCALIFADNSGIDIILGVFPFVRELLLRGTEVILACNSGPALNDVTHSESLIVAERIAGMDPVVHSALQEERLLLVQTGSSSPCLDLSRLDKGLAALVRERGADLVVIEGMGRAVHTNYHAALRCESLKLAVIKNAWLAERLGGRLFSVIFKYEVPAE

SEQ ID NO: 887831 - protein, 927 aa, Homo sapiens
PSWVAGGRGPALPAARWEGRRNFMSSATSASGRPGSAAWLVAGLRFGVLSSGRDEDELGGKPLAEWPRKGRAFPRRGQLWPAGRTVRAQAPLSGEWTPGVVQAAVDVGPGNSCLWFKSHPCLPWPLRRPALLPWPLQGPLQTLLPDGCALSNDGGPGSVLDLFPTLLTPGHLPATSRGGTQNYSLFADEDTKPQKGGSLTKLAYYSTVQHKVAKVRSFDHSGKDTEREHEPPYEISVQEEITARLHFIKFENTYIEACLDFIKDHLVNTETKVIQATGGGAYKFKDLIEEKLRLKVDKEDVMTCLIKGCNFVLKNIPHEAFVYQKDSDPEFRFQTNHPHIFPYLLVNIGSGVSIVKVETEDRFEWVGGSSIGGGTFWGLGALLTKTKKFDELLHLASRGQHSNVDMLVRDVYGGAHQTLGLSGNLIASSFGKSATADQEFSKEDMAKSLLHMISNDIGQLACLHARLHSLDRVYFGGFFIRGHPVTMRTITYSINFFSKGEVQALFLRHEGYLGAIGAFLKGAEQDNPNQYSWGENYAGSSGLMSASPELGPAQRARSGTFDLLEMDRLERPLVDLPLLLDPPSYVPDTVDLTDDALARKYWLTCFEEALDGVVKRAVASQPDSVDAAERAEKFRQKYWNKLQTLRQQPFAYGTLTVRSLLDTREHCLNEFNFPDPYSKVKQRENGVALRCFPGVVRSLDALGWEERQLALVKGLLAGNVFDWGAKAVSAVLESDPYFGFEEAKRKLQERPWLVDSYSEWLQRLKGPPHKCALIFADNSGIDIILGVFPFVRELLLRGTEVILACNSGPALNDVTHSESLIVAERIAGMDPVVHSALQEERLLLVQTGSSSPCLDLSRLDKGLAALVRERGADLVVIEGMGRAVHTNYHAALRCESLKLAVIKNAWLAERLGGRLFSVIFKYEVPAE

SEQ ID NO: 887832 - protein, 306 aa, Homo sapiens
LRLKVDKEDVMTCLNDVTHSESLIVAERIAGMDPVVRSLLDTREHCLNEFNFPDPYSKVKQRENGVALRCFPGVVRSLDALGWEERQLALVKGLLAGNVFDWGAKAVSAVLESDPYFGFEEAKRKLQERPWLVDSYSEWLQRLKGPPHKCALIFADNSGIDIILGVFPFVRELLLRGTEVILACNSGPALNDVTHSESLIVAERIAGMDPVVHSALQEERLLLVQTGSSSPCLDLSRLDKGLAALVRERGADLVVIEGMGRAVHTNYHAALRCESLKLAVIKNAWLAERLGGRLFSVIFKYEVPAE

SEQ ID NO: 887833 - protein, 87 aa, Homo sapiens
MATVQQLEGRWRLVDSKGFDEYMKELGVGIALRKMGAMAKPDCIITCDGKNLTIKTESTLKTTQFSCTLGRKYVVATYFRKYVVGYR

SEQ ID NO: 887834 - protein, 135 aa, Homo sapiens
MATVQQLEGRWRLVDSKGFDEYMKELGVGIALRKMGAMAKPDCIITCDGKNLTIKTESTLKTTQFSCTLGEKFEETTADGRKTQTVCNFTDGALVQHQEWDGKESTITRKLKDGKLVVECVMNNVTCTRIYEKVE

SEQ ID NO: 887835 - protein, 135 aa, Homo sapiens; identical to SEQ ID NO: 887834

SEQ ID NO: 887836 - protein, 135 aa, Homo sapiens; identical to SEQ ID NO: 887834

SEQ ID NO: 887837 - protein, 157 aa, Homo sapiens
ARIQIQIRRTHQNHDSTIPWNSSLTSTALAAVSHPQSRSSGILLSSDPGVGIALRKMGAMAKPDCIITCDGKNLTIKTESTLKTTQFSCTLGEKFEETTADGRKTQTVCNFTDGALVQHQEWDGKESTITRKLKDGKLVVECVMNNVTCTRIYEKVE

SEQ ID NO: 887838 - protein, 131 aa, Homo sapiens
MCCIHTHVQEGGREMAGNTAEAGVGIALRKMGAMAKPDCIITCDGKNLTIKTESTLKTTQFSCTLGEKFEETTADGRKTQTVCNFTDGALVQHQEWDGKESTITRKLKDGKLVVECVMNNVTCTRIYEKVE

SEQ ID NO: 887839 - protein, 159 aa, Homo sapiens [sequence omitted]

SEQ ID NO: 887840 - protein, 133 aa, Homo sapiens
MATVQQLEGRWRLVDSKGFDEYMKELGVGIALRKMGAMAKPDCIITCDGKNLTIKTESTLKTTQFSCTLGEKFEETTADGRKTQVIVTCYEITEASRMIGCINNILLFIGKNLMKKLFYELNFVKLAKVSTSS

SEQ ID NO: 887841 - protein, 103 aa, Homo sapiens
MATVQQLEGRWRLVDSKGFDEYMKELGVGIALRKMGAMAKPDCIITCDGKNLTIKTESTLKTTQFSCTLGGPGPGPSLQLPDVAGGTQINESRKVNILKKVIN

SEQ ID NO: 887842 - protein, 159 aa, Homo sapiens
MATVQQLEGRWRLVDSKGFDEYMKELGVGIALRKMGAMAKPDCIITCDGKNLTIKTESTLKTTQFSCTLGEKFEETTADGRKTQTVCNFTDGALVQHQEWDGKESTITRKLKDGKLVVECVMNNVTCTRKYVVDYILPGLCPGCFLCRGLLFLPPILSC

SEQ ID NO: 887843 - protein, 88 aa, Homo sapiens
MATVQQLEGRWRLVDSKGFDEYMKELGVGIALRKMGAMAKPEISFILGQEFDEVTADDRKVKSTITLDGGVLVHVQKWDGKSTTIKRK

SEQ ID NO: 887844 - protein, 135 aa, Homo sapiens; identical to SEQ ID NO: 887834

SEQ ID NO: 887845 - protein, 135 aa, Homo sapiens; identical to SEQ ID NO: 887834

SEQ ID NO: 887846 - protein, 135 aa, Homo sapiens; identical to SEQ ID NO: 887834

SEQ ID NO: 887847 - protein, 135 aa, Homo sapiens; identical to SEQ ID NO: 887834

SEQ ID NO: 887848 - protein, 135 aa, Homo sapiens; identical to SEQ ID NO: 887834

SEQ ID NO: 887849 - protein, 183 aa, Homo sapiens
MATVQQLEGRWRLVDSKGFDEYMKELGVGIALRKMGAMAKPDCIITCDGKNLTIKTESTLKTTQFSCTLGEKFEETTADGRKTQTVCNFTDGALVQHQEWDGKESTITRKLKDGKLVVECVMNNVTCTRKYVVDYILPPFGALSPFSQFSFKDYILPNFAHGIDDQQHKDDDENHEEGVAIGH

SEQ ID NO: 887850 - protein, 66 aa, Homo sapiens
TLSLLYPTPDGRKTQTVCNFTDGALVQHQEWDGKESTITRKLKDGKLVVECVMNNVTCTRIYEKVE

SEQ ID NO: 887851 - protein, 125 aa, Homo sapiens
MGAMAKPDCIITCDGKNLTIKTESTLKTTQFSCTLGEKFEETTADGRKTQTVCNFTDGALVQHQEWDGKESTITRKLKDGKLVVECVMNNVTCTRKYVVDYILPGLCPGCFLCRGLLFLPPILSC

SEQ ID NO: 887852 - protein, 449 aa, Homo sapiens
MRLLAKIICLMLWAICVAEDCNELPPRRNTEILTGSWSDQTYPEGTQAIYKCRPGYRSLGNVIMVCRKGEWVALNPLRKCQKRPCGHPGDTPFGTFTLTGGNVFEYGVKAVYTCNEGYQLLGEINYRECDTDGWTNDIPICEVVKCLPVTAPENGKIVSSAMEPDREYHFGQAVRFVCNSGYKIEGDEEMHCSDDGFWSKEKPKCVEISCKSPDVINGSPISQKIIYKENERFQYKCNMGYEYSERGDAVCTESGWRPLPSCEEKSCDNPYIPNGDYSPLRIKHRTGDEITYQCRNGFYPATRGNTAKCTSTGWIPAPRCTLKPCDYPDIKHGGLYHENMRRPYFPVAVGKYYSYYCDEHFETPSGSYWDHIHCTQDGWSPAVPCLRKCYFPYLENGYNQNYGRKFVQGKSIDVACHPGYALPKAQTTVTCMENGWSPTPRCIRVSFTL

SEQ ID NO: 887853 - protein, 192 aa, Homo sapiens
HAKKTQGSSRSARQGPRSASSDISALVNSAEERVRYQCRSPYEMFGDEEVMCLNGNWTEPPQCKDSTGKCGPPPPIDNGDITSFPLSVYAPASSVEYQCQNLYQLEGNKRITCRNGQWSEPPKCLHPCVISREIMENYNIALRWTAKQKLYSRTGESVEFVCKRGYRLSSRSHTLRTTCWDGKLEYPTCAKR

SEQ ID NO: 887854 - protein, 1231 aa, Homo sapiens
MRLLAKIICLMLWAICVAEDCNELPPRRNTEILTGSWSDQTYPEGTQAIYKCRPGYRSLGNVIMVCRKGEWVALNPLRKCQKRPCGHPGDTPFGTFTLTGGNVFEYGVKAVYTCNEGYQLLGEINYRECDTDGWTNDIPICEVVKCLPVTAPENGKIVSSAMEPDREYHFGQAVRFVCNSGYKIEGDEEMHCSDDGFWSKEKPKCVEISCKSPDVINGSPISQKIIYKENERFQYKCNMGYEYSERGDAVCTESGWRPLPSCEEKSCDNPYIPNGDYSPLRIKHRTGDEITYQCRNGFYPATRGNTAKCTSTGWIPAPRCTLKPCDYPDIKHGGLYHENMRRPYFPVAVGKYYSYYCDEHFETPSGSYWDHIHCTQDGWSPAVPCLRKCYFPYLENGYNQNYGRKFVQGKSIDVACHPGYALPKAQTTVTCMENGWSPTPRCIRVKTCSKSSIDIENGFISESQYTYALKEKAKYQCKLGYVTADGETSGSITCGKDGWSAQPTCIKSCDIPVFMNARTKNDFTWFKLNDTLDYECHDGYESNTGSTTGSIVCGYNGWSDLPICYERECELPKIDVHLVPDRKKDQYKVGEVLKFSCKPGFTIVGPNSVQCYHFGLSPDLPICKEQVQSCGPPPELLNGNVKEKTKEEYGHSEVVEYYCNPRFLMKGPNKIQCVDGEWTTLPVCIVEESTCGDIPELEHGWAQLSSPPYYYGDSVEFNCSESFTMIGHRSITCIHGVWTQLPQCVAIDKLKKCKSSNLIILEEHLKNKKEFDHNSNIRYRCRGKEGWIHTVCINGRWDPEVNCSMAQIQLCPPPPQIPNSHNMTTTLNYRDGEKVSVLCQENYLIQEGEEITCKDGRWQSIPLCVEKIPCSQPPQIEHGTINSSRSSQESYAHGTKLSYTCEGGFRISEENETTCYMGKWSSPPQCEGLPCKSPPEISHGVVAHMSDSYQYGEEVTYKCFEGFGIDGPAIAKCLGEKWSHPPSCIKTDCLSLPSFENAIPMGEKKDVYKAGEQVTYTCATYYKMDGASNVTCINSRWTGRPTCRDTSCVNPPTVQNAYIVSRQMSKYPSGERVRYQCRSPYEMFGDEEVMCLNGNWTEPPQCKDSTGKCGPPPPIDNGDITSFPLSVYAPASSVEYQCQNLYQLEGNKRITCRNGQWSEPPKCLHPCVISREIMENYNIALRWTAKQKLYSRTGESVEFVCKRGYRLSSRSHTLRTTCWDGKLEYPTCAKR

SEQ ID NO: 887855 - protein, 1231 aa, Homo sapiens; identical to SEQ ID NO: 887854

SEQ ID NO: 887856 - protein, 1224 aa, Homo sapiens
MRLLAKIICLMLWAICVAEDCNELPPRRNTEILTGSWSDQTYPEGTQAIYKCRPGYRSLGNVIMVCRKGEWVALNPLRKCQKRPCGHPGDTPFGTFTLTGGNVFEYGVKAVYTCNEGYQLLGEINYRECDTDGWTNDIPICEVVKCLPVTAPENGKIVSSAMEPDREYHFGQAVRFVCNSGYKIEGDEEMHCSDDGFWSKEKPKCVEISCKSPDVINGSPISQKIIYKENERFQYKCNMGYEYSERGDAVCTESGWRPLPSCEEKSCDNPYIPNGDYSPLRIKHRTGDEITYQCRNGFYPATRGNTAKCTSTGWIPAPRCTYIKHGGLYHENMRRPYFPVAVGKYYSYYCDEHFETPSGSYWDHIHCTQDGWSPAVPCLRKCYFPYLENGYNQNYGRKFVQGKSIDVACHPGYALPKAQTTVTCMENGWSPTPRCIRVKTCSKSSIDIENGFISESQYTYALKEKAKYQCKLGYVTADGETSGSITCGKDGWSAQPTCIKSCDIPVFMNARTKNDFTWFKLNDTLDYECHDGYESNTGSTTGSIVCGYNGWSDLPICYERECELPKIDVHLVPDRKKDQYKVGEVLKFSCKPGFTIVGPNSVQCYHFGLSPDLPICKEQVQSCGPPPELLNGNVKEKTKEEYGHSEVVEYYCNPRFLMKGPNKIQCVDGEWTTLPVCIVEESTCGDIPELEHGWAQLSSPPYYYGDSVEFNCSESFTMIGHRSITCIHGVWTQLPQCVAIDKLKKCKSSNLIILEEHLKNKKEFDHNSNIRYRCRGKEGWIHTVCINGRWDPEVNCSMAQIQLCPPPPQIPNSHNMTTTLNYRDGEKVSVLCQENYLIQEGEEITCKDGRWQSIPLCVEKIPCSQPPQIEHGTINSSRSSQESYAHGTKLSYTCEGGFRISEENETTCYMGKWSSPPQCEGLPCKSPPEISHGVVAHMSDSYQYGEEVTYKCFEGFGIDGPAIAKCLGEKWSHPPSCIKTDCLSLPSFENAIPMGEKKDVYKAGEQVTYTCATYYKMDGASNVTCINSRWTGRPTCRDTSCVNPPTVQNAYIVSRQMSKYPSGERVRYQCRSPYEMFGDEEVMCLNGNWTEPPQCKDSTGKCGPPPPIDNGDITSFPLSVYAPASSVEYQCQNLYQLEGNKRITCRNGQWSEPPKCLHPCVISREIMENYNIALRWTAKQKLYSRTGESVEFVCKRGYRLSSRSHTLRTTCWDGKLEYPTCAKR

SEQ ID NO: 887857 - protein, 1209 aa, Homo sapiens
PRAAGASARECLHPCVISREIMENYNIALRWTAKQKLYSRTGESVEFVCKRGYRLSSRSHTLRTTCWDGKLEYPTCAKTIESIINVHTFIQNFSIKSVLKFHFFMECDTDGWTNDIPICEVVKCLPVTAPENGKIVSSAMEPDREYHFGQAVRFVCNSGYKIEGDEEMHCSDDGFWSKEKPKCVEISCKSPDVINGSPISQKIIYKENERFQYKCNMGYEYSERGDAVCTESGWRPLPSCEEKSCDNPYIPNGDYSPLRIKHRTGDEITYQCRNGFYPATRGNTAKCTSTGWIPAPRCTLKPCDYPDIKHGGLYHENMRRPYFPVAVGKYYSYYCDEHFETPSGSYWDHIHCTQDGWSPAVPCLRKCYFPYLENGYNQNYGRKFVQGKSIDVACHPGYALPKAQTTVTCMENGWSPTPRCIRVKTCSKSSIDIENGFISESQYTYALKEKAKYQCKLGYVTADGETSGSITCGKDGWSAQPTCIKSCDIPVFMNARTKNDFTWFKLNDTLDYECHDGYESNTGSTTGSIVCGYNGWSDLPICYERECELPKIDVHLVPDRKKDQYKVGEVLKFSCKPGFTIVGPNSVQCYHFGLSPDLPICKEQVQSCGPPPELLNGNVKEKTKEEYGHSEVVEYYCNPRFLMKGPNKIQCVDGEWTTLPVCIVEESTCGDIPELEHGWAQLSSPPYYYGDSVEFNCSESFTMIGHRSITCIHGVWTQLPQCVAIDKLKKCKSSNLIILEEHLKNKKEFDHNSNIRYRCRGKEGWIHTVCINGRWDPEVNCSMAQIQLCPPPPQIPNSHNMTTTLNYRDGEKVSVLCQENYLIQEGEEITCKDGRWQSIPLCVEKIPCSQPPQIEHGTINSSRSSQESYAHGTKLSYTCEGGFRISEENETTCYMGKWSSPPQCEGLPCKSPPEISHGVVAHMSDSYQYGEEVTYKCFEGFGIDGPAIAKCLGEKWSHPPSCIKTDCLSLPSFENAIPMGEKKDVYKAGEQVTYTCATYYKMDGASNVTCINSRWTGRPTCRDTSCVNPPTVQNAYIVSRQMSKYPSGERVRYQCRSPYEMFGDEEVMCLNGNWTEPPQCKDSTGKCGPPPPIDNGDITSFPLSVYAPASSVEYQCQNLYQLEGNKRITCRNGQWSEPPKCLHPCVISREIMENYNIALRWTAKQKLYSRTGESVEFVCKRGYRLSSRSHTLRTTCWDGKLEYPTCAKR

SEQ ID NO: 887858 - protein, 1167 aa, Homo sapiens
MRLLAKIICLMLWAICVAEDCNELPPRRNTEILTGSWSDQTYPEGTQAIYKCRPGYRSLGNVIMVCRKGEWVALNPLRKCQKRPCGHPGDTPFGTFTLTGGNVFEYGVKAVYTCNEGYQLLGEINYRECDTDGWTNDIPICEEISCKSPDVINGSPISQKIIYKENERFQYKCNMGYEYSERGDAVCTESGWRPLPSCEEKSCDNPYIPNGDYSPLRIKHRTGDEITYQCRNGFYPATRGNTAKCTSTGWIPAPRCTLKPCDYPDIKHGGLYHENMRRPYFPVAVGKYYSYYCDEHFETPSGSYWDHIHCTQDGWSPAVPCLRKCYFPYLENGYNQNYGRKFVQGKSIDVACHPGYALPKAQTTVTCMENGWSPTPRCIRVKTCSKSSIDIENGFISESQYTYALKEKAKYQCKLGYVTADGETSGSITCGKDGWSAQPTCIKSCDIPVFMNARTKNDFTWFKLNDTLDYECHDGYESNTGSTTGSIVCGYNGWSDLPICYERECELPKIDVHLVPDRKKDQYKVGEVLKFSCKPGFTIVGPNSVQCYHFGLSPDLPICKEQVQSCGPPPELLNGNVKEKTKEEYGHSEVVEYYCNPRFLMKGPNKIQCVDGEWTTLPVCIVEESTCGDIPELEHGWAQLSSPPYYYGDSVEFNCSESFTMIGHRSITCIHGVWTQLPQCVAIDKLKKCKSSNLIILEEHLKNKKEFDHNSNIRYRCRGKEGWIHTVCINGRWDPEVNCSMAQIQLCPPPPQIPNSHNMTTTLNYRDGEKVSVLCQENYLIQEGEEITCKDGRWQSIPLCVEKIPCSQPPQIEHGTINSSRSSQESYAHGTKLSYTCEGGFRISEENETTCYMGKWSSPPQCEGLPCKSPPEISHGVVAHMSDSYQYGEEVTYKCFEGFGIDGPAIAKCLGEKWSHPPSCIKTDCLSLPSFENAIPMGEKKDVYKAGEQVTYTCATYYKMDGASNVTCINSRWTGRPTCRDTSCVNPPTVQNAYIVSRQMSKYPSGERVRYQCRSPYEMFGDEEVMCLNGNWTEPPQCKDSTGKCGPPPPIDNGDITSFPLSVYAPASSVEYQCQNLYQLEGNKRITCRNGQWSEPPKCLHPCVISREIMENYNIALRWTAKQKLYSRTGESVEFVCKRGYRLSSRSHTLRTTCWDGKLEYPTCAKR

SEQ ID NO: 887859 - protein, 989 aa, Homo sapiens [sequence omitted]

SEQ ID NO: 887860 - protein, 989 aa, Homo sapiens [sequence omitted]

SEQ ID NO: 887861 - protein, 989 aa, Homo sapiens [sequence omitted]

SEQ ID NO: 887862 - protein, 989 aa, Homo sapiens [sequence omitted]

SEQ ID NO: 887863 - protein, 989 aa, Homo sapiens [sequence omitted]

SEQ ID NO: 887864 - protein, 989 aa, Homo sapiens [sequence omitted]

SEQ ID NO: 887865 - protein, 989 aa, Homo sapiens [sequence omitted]

SEQ ID NO: 887866 - protein, 989 aa, Homo sapiens [sequence omitted]

SEQ ID NO: 887867 - protein, 989 aa, Homo sapiens [sequence omitted]

SEQ ID NO: 887868 - protein, 1131 aa, Homo sapiens
MRLLAKIICLMLWAICVAEDCNELPPRRNTEILTGSWSDQTYPEGTQAIYKCRPGYRSLGNVIMVCRKGEWVALNPLRKCQKRPCGHPGDTPFGTFTLTGGNVFEYGVKAVYTCNEGYQLLGEINYRECDTDGWTNDIPICEVVKCLPVTAPENGKIVSSAMEPDREYHFGQAVRFVCNSGYKIEGDEEMHCSDDGFWSKEKPKCVEISCKSPDVINGSPISQKIIYKENERFQYKCNMGYEYSERGDAVCTESGWRPLPSCEEKSCDNPYIPNGDYSPLRIKHRTGDEITYQCRNGFYPATRGNTAKCTSTGWIPAPRCTLKPCDYPDIKHGGLYHENMRRPYFPVAVGKYYSYYCDEHFETPSGSYWDHIHCTQDGWSPAVPCLRKCYFPYLENGYNQNYGRKFVQGKSIDVACHPGYALPKAQTTVTCMENGWSPTPRCIRVKTCSKSSIDIENGFISESQYTYALKEKAKYQCKLGYVTADGETSGSITCGKDGWSAQPTCIKSCDIPVFMNARTKNDFTWFKLNDTLDYECHDGYESNTGSTTGSIVCGYNGWSDLPICYERECELPKIDVHLVPDRKKDQYKVGEVLKFSCKPGFTIVGPNSVQCYHFGLSPDLPICKEQVQSCGPPPELLNGNVKEKTKEEYGHSEVVEYYCNPRFLMKGPNKIQCVDGEWTTLPVCIVEESTCGDIPELEHGWAQLSSPPYYYGDSVEFNCSESFTMIGHRSITCIHGVWTQLPQCVAIDKLKKCKSSNLIILEEHLKNKKEFDHNSNIRYRCRGKEGWIHTVCINGRWDPEVNCSMAQIQLCPPPPQIPNSHNMTTTLNYRDGEKVSVLCQENYLIQEGEEITCKDGRWQSIPLCVEKIPCSQPPQIEHGTINSSRSSQESYAHGTKLSYTCEGGFRISEENETTCYMGKWSSPPQCEGLPCKSPPEISHGVVAHMSDSYQYGEEVTYKCFEGFGIDGPAIAKCLGEKWSHPPSCIKTDCLSLPSFENAIPMGEKKDVYKAGEQVTYTCATYYKMDGASNVTCINSRWTGRPTCRDTSCVNPPTVQNAYIVSRQMSKYPSGERVRYQCRSPYEMFGDEEVMCLNGNWTEPPQCKDSRCQYMLQLHQLSTNARTCINLRVTSE

SEQ ID NO: 887869 - protein, 989 aa, Homo sapiens [sequence omitted]

SEQ ID NO: 887870 - protein, 928 aa, Homo sapiens
MRLLAKIICLMLWAICVAEDCNELPPRRNTEILTGSWSDQTYPEGTQAIYKCRPGYRSLGNVIMVCRKGEWVALNPLRKCQKRPCGHPGDTPFGTFTLTGGNVFEYGVKAVYTCNEGYQLLGEINYRECDTDGWTNDIPICEVVKCLPVTAPENGKIVSSAMEPDREYHFGQAVRFVCNSGYKIEGDEEMHCSDDGFWSKEKPKCVEISCKSPDVINGSPISQKIIYKENERFQYKCNMGYEYSERGDAVCTESGWRPLPSCEEKSCDNPYIPNGDYSPLRIKHRTGDEITYQCRNGFYPATRGNTAKCTSTGWIPAPRCTLKPCDYPDIKHGGLYHENMRRPYFPVAVGKYYSYYCDEHFETPSGSYWDHIHCTQDGWSPAVPCLRKCYFPYLENGYNQNYGRKFVQGKSIDVACHPGYALPKAQTTVTCMENGWSPTPRCIRVKTCSKSSIDIENGFISESQYTYALKEKAKYQCKLGYVTADGETSGSITCGKDGWSAQPTCIKSCDIPVFMNARTKNDFTWFKLNDTLDYECHDGYESNTGSTTGSIVCGYNGWSDLPICYERECELPKIDVHLVPDRKKDQYKVGEVLKFSCKPGFTIVGPNSVQCYHFGLSPDLPICKEQVQSCGPPPELLNGNVKEKTKEEYGHSEVVEYYCNPRFLMKGPNKIQCVDGEWTTLPVCIVEESTCGDIPELEHGWAQLSSPPYYYGDSVEFNCSESFTMIGHRSITCIHGVWTQLPQCVAIDKLKKCKSSNLIILEEHLKNKKEFDHNSNIRYRCRGKEGWIHTVCINGRWDPEVNCSMAQIQLCPPPPQIPNSHNMTTTLNYRDGEKVSVLCQENYLIQEGEEITCKDGRWQSIPLCVEKIPCSQPPQIEHGTINSSRSSQESYAHGTKLSYTCEGGFRISEENETTCYMGKWSSPPQCEG

SEQ ID NO: 887871 - protein, 449 aa, Homo sapiens; identical to SEQ ID NO: 887852

SEQ ID NO: 887872 - protein, 326 aa, Homo sapiens
GSAQLVCVRVGDYRIPVLTQCEGLPCKSPPEISHGVVAHMSDSYQYGEEVTYKCFEGFGIDGPAIAKCLGEKWSHPPSCIKTDCLSLPSFENAIPMGEKKDVYKAGEQVTYTCATYYKMDGASNVTCINSRWTGRPTCRDTSCVNPPTVQNAYIVSRQMSKYPSGERVRYQCRSPYEMFGDEEVMCLNGNWTEPPQCKDSTGKCGPPPPIDNGDITSFPLSVYAPASSVEYQCQNLYQLEGNKRITCRNGQWSEPPKCLHPCVISREIMENYNIALRWTAKQKLYSRTGESVEFVCKRGYRLSSRSHTLRTTCWDGKLEYPTCAKR

SEQ ID NO: 887873 - protein, 453 aa, Homo sapiens [sequence omitted]

SEQ ID NO: 887874 - protein, 291 aa, Homo sapiens
MRLLAKIICLMLWAICVAEDCNELPPRRNTEILTGSWSDQTYPEGTQAIYKCRPGYRSLGNVIMVCRKGEWVALNPLRKCQKRPCGHPGDTPFGTFTLTGGNVFEYGVKAVYTCNEGYQLLGEINYRECDTDGWTNDIPICEVVKCLPVTAPENGKIVSSAMEPDREYHFGQAVRFVCNSGYKIEGDEEMHCSDDGFWSKEKPKCVEISCKSPDVINGSPISQKIIYKENERFQYKCNMGYEYSERGDAVCTESGWRPLPSCEGNVTFIFWIFINLSHILINSFNKSTYFN

SEQ ID NO: 887875 - protein, 385 aa, Homo sapiens [sequence omitted]

SEQ ID NO: 887876 - protein, 147 aa, Homo sapiens
MASHRLLLLCLAGLVFVSEAGPTGTGESKCPLMVKVLDAVRGSPAINVAVHVFRKAADDTWEPFASGKTSESGELHGLTTEEEFVEGIYKVEIDTKSYWKALGISPFHEHAEVVFTANDSGPRRYTIAALLSPYSYSTTAVVTNPKE

SEQ ID NO: 887877 - protein, 135 aa, Homo sapiens
FVECYGIQFPPGTAYAMYGKFLKRPTIGKLDRLRGRVEPGRTTVHSFLAGWLLIVCSSSALLDWYLCLRLALRAPVESKCPLMVKVLDAVRGSPAINVAVHVFRKAADDTWEPFASGENPVSLESCMGSQLRRNL

SEQ ID NO: 887878 - protein, 135 aa, Homo sapiens; identical to SEQ ID NO: 887877

SEQ ID NO: 887879 - protein, 147 aa, Homo sapiens; identical to SEQ ID NO: 887876

SEQ ID NO: 887880 - protein, 147 aa, Homo sapiens; identical to SEQ ID NO: 887876

SEQ ID NO: 887881 - protein, 147 aa, Homo sapiens; identical to SEQ ID NO: 887876

SEQ ID NO: 887882 - protein, 147 aa, Homo sapiens; identical to SEQ ID NO: 887876

SEQ ID NO: 887883 - protein, 131 aa, Homo sapiens
SGGRGGGGGSDVVGAGWLLIVCSSSALLDWYLCLRLALRAPVESKCPLMVKVLDAVRGSPAINVAVHVFRKAADDTWEPFASGGIYKVGNRHQIFTGKALGHLPHFHGGMQRWYSQPTTSGPRRLHHLPPC

SEQ ID NO: 887884 - protein, 149 aa, Homo sapiens
MYGKFLKRPTIGKLDRLRGRVEPGRTTVHSFLAGWLLIVCSSSALLDWYLCLRLALRAPVESKCPLMVKVLDAVRGSPAINVAVHVFRKAADDTWEPFASGGIYKVGNRHQIFTGKALGHLPHFHGGMQRWYSQPTTSGPRRLHHLPPC

SEQ ID NO: 887885 - protein, 180 aa, Homo sapiens
FVECYGIQFPPGTAYAMYGKFLKRPTIGKLDRLRGRVEPGRTTVHSFLAGWLLIVCSSSALLDWYLCLRLALRAPVESKCPLMVKVLDAVRGSPAINVAVHVFRKAADDTWEPFASGGIYKVGNRHQIFTGKALGHLPHFHGGMQRWYFTANDSGLFWFWFLLLAFQEMHSFTQCTTEMS

SEQ ID NO: 887886 - protein, 138 aa, Homo sapiens
FVECYGIQFPPGTAYAMYGKSLKRPTIGKLDRLRGRVNRVEPRVHSFLAGWLLIVCSSSALLDWYLCLRLALRAPVESKCPLMVKVLDAVRGSPAINVAVHVFRKAADDTWEPFASGVSCQRTLPQDLVLSSRLPLTW

SEQ ID NO: 887887 - protein, 147 aa, Homo sapiens; identical to SEQ ID NO: 887876

SEQ ID NO: 887888 - protein, 147 aa, Homo sapiens; identical to SEQ ID NO: 887876

SEQ ID NO: 887889 - protein, 147 aa, Homo sapiens; identical to SEQ ID NO: 887876

SEQ ID NO: 887890 - protein, 235 aa, Homo sapiens
LCLTYILSTLSQATLTLLLDHLRLVSSFHAYNRMTPQNLAVCFGPVLLPARQAPTRPRARSSGPGLASAVDFKHHIEVLHYLLQSWPGEFMPRACTTNAEPDPRLPRQSPDVAPYLRPKRQPPLHLPLADPEVVTRPRGRGGPESPPSNRYAGDWSVCGRDFLPCGRDFLSGPDYDHVTGSDSEDEDEEVGEPRVTGDFEDDFDAPFNPHLNLKDFDALILDLERELSKQINVCL

SEQ ID NO: 887891 - protein, 580 aa, Homo sapiens
RTKSPGPARRLSIKMKKLPELRRRLSLRGPRAGRERERAAPAGSVISRYHLDSSVGGPGPAAGPGGTRSPRAGYLSDGDSPERPAGPPSPTSFRPYEVGPAARAPPAALWGRLSLHLYGLGGLRPAPGATPRDLCCLLQVDGEARARTGPLRGGPDFLRLDHTFHLELEAARLLRALVLAWDPGVRRHRPCAQGTVLLPTVFRGCQAQQLAVRLEPQGLLYAKLTLSEQQEAPATAEPRVFGLPLPLLVERERPPGQVPLIIQKCVGQIERRGLRVVGLYRLCGSAAVKKELRDAFERDSAAVCLSEDLYPDINVITGILKDYLRELPTPLITQPLYKVVLEAMARDPPNRVPPTTEGTRGLLSCLPDVERATLTLLLDHLRLVSSFHAYNRMTPQNLAVCFGPVLLPARQAPTRPRARSSGPGLASAVDFKHHIEVLHYLLQSWPDPRLPRQSPDVAPYLRPKRQPPLHLPLADPEVVTRPRGRGGPESPPSNRYAGDWSVCGRDFLPCGRDFLSGPDYDHVTGSDSEDEDEEVGEPRVTGDFEDDFDAPFNPHLNLKDFDALILDLERELSKQINVCL

SEQ ID NO: 887892 - protein, 580 aa, Homo sapiens; identical to SEQ ID NO: 887891

SEQ ID NO: 887893 - protein, 580 aa, Homo sapiens; identical to SEQ ID NO: 887891

SEQ ID NO: 887894 - protein, 593 aa, Homo sapiens
RTKSPGPARRLSIKMKKLPELRRRLSLRGPRAGRERERAAPAGSVISRYHLDSSVGGPGPAAGPGGTRSPRAGYLSDGDSPERPAGPPSPTSFRPYEVGPAARAPPAALWGRLSLHLYGLGGLRPAPGATPRDLCCLLQVDGEARARTGPLRGGPDFLRLDHTFHLELEAARLLRALVLAWDPGVRRHRPCAQGTVLLPTVFRGCQAQQLAVRLEPQGLLYAKLTLSEQQEAPATAEPRVFGLPLPLLVERERPPGQVPLIIQKCVGQIERRGLRVVGLYRLCGSAAVKKELRDAFERDSAAVCLSEDLYPDINVITGILKDYLRELPTPLITQPLYKVVLEAMARDPPNRVPPTTEGTRGLLSCLPDVERATLTLLLDHLRLVSSFHAYNRMTPQNLAVCFGPVLLPARQAPTRPRARSSGPGLASAVDFKHHIEVLHYLLQSWPDPRLPRQSPDVAPYLRPKRQPPLHLPLADPEVVTRPRGRGGPESPPSNRYAGDWSVCGRDFLPCGRDFLSGPDYDHVTGSDSEDEDEEVGEPRVTGDFEDDFDAPFNPHLNLKDFDALILDLERELSKQINVCLKPRLNRGWGTPGV

SEQ ID NO: 887895 - protein, 580 aa, Homo sapiens; identical to SEQ ID NO: 887891

SEQ ID NO: 887896 - protein, 580 aa, Homo sapiens; identical to SEQ ID NO: 887891

SEQ ID NO: 887897 - protein, 102 aa, Homo sapiens
MFLCAQEWLTLGLNVPLLFYHFWRYFHCPADSSELAYDPPVVMNADTLSYCQKEAWCKLAFYLLSFFYYLYCMDLTLLVEALTKDPWHHHSGGLEGGRGALR

SEQ ID NO: 887898 - protein, 182 aa, Homo sapiens
MAFTFAAFCYMLSLVLCAALIFFAIWHIIAFDELRTDFKSPIDQCNPVHARERLRNIERICFLLRKLVLPEYSIHSLFCIMFLCAQEWLTLGLNVPLLFYHFWRYFHCPADSSELAYDPPVVMNADTLSYCQKEAWCKLAFYLLSFFYYLYCMDLTLLVEALTKDPWHHHSGGLEGGRGALR

SEQ ID NO: 887899 - protein, 191 aa, Homo sapiens
RRPAGRSHGWGRARLGAHGCAGSRVWGAGPTGPTSSRLPKDSFSRERALPGSGIWEELGGRSGTSLDTIRLRPGGAGGSGAERSSLLSGLVEKSRELFLGRMGPPPSVLRGVVASLVVLVSRGSQLGTNLQVFAADLVSSSICGRFPPATLDTRFPVFAGGPGLGSPEPAGIQRLFADPRVASLAVRPPGH

SEQ ID NO: 887900 - protein, 160 aa, Homo sapiens
MAFTFAAFCYMLSLVLCAALIFFAIWHIIAFDELRTDFKSPIDQCNPVHARERLRNIERICFLLRKLVLPEYSIHSLFCIMFLCAQEWLTLGLNVPLLFYHFWRYFHCPADSSELAYDPPVVMNADTLSYCQKEAWCKLAFYLLSFFYYLYCMIYTLVSS

SEQ ID NO: 887901 - protein, 1006 aa, Homo sapiens
MGSAEDAVKEKLLWNVKKEVKQIMEEAVTRKFVHEDSSHIIALCGAVEACLLHQLRRRAAGFLRSDKMAALFTKVGKTCPVAGEICHKVQELQQQAEGRKPSGVSQEALRRQGSASGKAPALSPQALKHVWVRTALIEKVLDKVVQYLAENCSKYYEKEALLADPVFGPILASLLVGPCALEYTKLKTADHYWTDPSADELVQRHRIRGPPTRQDSPAKRPALGIRKRHSSGSASEDRLAACARECVESLHQNSRTRLLYGKNHVLVQPKEDMEAVPGYLSLHQSAESLTLKWTPNQLMNGTLGDSELEKSVYWDYALVVPFSQVVCIHCHQQKSGGTLVLVSQDGIQRPPLHFPQGGHLLSFLSCLENGLLPRGQLEPPLWTQQGKGKVFPKLRKRSSIRSVDMEEMGTGRATDYVFRIIYPGHRHEHNAGDMIEMQGFGPSLPAWHLEPLCSQGSSCLSCSSSSSPHATPSHCSCIPDRLPLRLLCESMKRQIVSRAFYGWLAHCRHLSTVRTHLSALVHHSVIPPDRPPGASAGLTKDVWSKYQKDKKNYKELELLRQVYYGGIEHEIRKDVWPFLLGHYKFGMSKKEMEQVDAVVAARYQQVLAEWKACEVVVRQREREAHPATRTKFSSGSSIDSHVQRLIHRDSTISNDVFISVDDLEPPEPQDPEDSRPKPEQEAGPGTPGTAVVEQQHSVEFDSPDSGLPSSRNYSVASGIQSSLDEGQSVGFEEEDGGGEEGSSGPGPAAHTLREPQDPSQEKPQAGELEAGEELAAVCAAAYTIELLDTVALNLHRIDKDVQRCDRNYWYFTPPNLERLRDVMCSYVWEHLDVGYVQGMCDLLAPLLVTLDNDQLAYSCFSHLMKRMSQNFPNGGAMDTHFANMRSLIQILDSELFELMHQNGDYTHFYFCYRWFLLDFKRELLYEDVFAVWEVIWAARHISSEHFVLFIALALVEAYREIIRDNNMDFTDIIKFFNERAEHHDAQEILRIARDLVHKVQMLIENK

SEQ ID NO: 887902 - protein, 393 aa, Homo sapiens
EEEEDKLHAMLSMICSRNLTAPNPMKDAGDMIEMQGFGPSLPAWHLEPLCSQGSSCLSCSSSSSPHATPSHCSCIPDRLPLRLLCESMKRQIVSRAFYGWLAHCRHLSTVRTHLSALVHHSVIPPDRPPGASAGLTKDVWSKYQKDKKNYKELELLRQVYYGGIEHEIRKDVWPFLLGHYKFGMSKKEMEQVDADGGSHGTSRCRQRLDRPRTRTAEANRGAERTHQPPRHNGLAHKRHNDKPRAGPIERKYHNNKRQRTYTTTEPTPPGPRKTAQNNHHKTDTGTAEHGATDVKNTDKLLRRTEQPTNTGQRRQKQNNQRDEDSPTHQGGDGVNTTQPSMGKQKTREQANKDDRPQTQRKQQQQQRMQKKRTNSKRRVTKNDQPQTNDKRQT

SEQ ID NO: 887903 - protein, 1089 aa, Homo sapiens
MGSAEDAVKEKLLWNVKKEVKQIMEEAVTRKFVHEDSSHIIALCGAVEACLLHQLRRRAAGFLRSDKMAALFTKVGKTCPVAGEICHKVQELQQQAEGRKPSGVSQEALRRQGSASGKAPALSPQALKHVWVRTALIEKVLDKVVQYLAENCSKYYEKEALLADPVFGPILASLLVGPCALEYTKLKTADHYWTDPSADELVQRHRIRGPPTRQDSPAKRPALGIRKRHSSGSASEDRLAACARECVESLHQNSRTRLLYGKNHVLVQPKEDMEAVPGYLSLHQSAESLTLKWTPNQLMNGTLGDSELEKSVYWDYALVVPFSQVVCIHCHQQKSGGTLVLVSQDGIQRPPLHFPQGGHLLSFLSCLENGLLPRGQLEPPLWTQQGKGKVFPKLRKRSSIRSVDMEEMGTGRATDYVFRIIYPGHRHEHNAGDMIEMQGFGPSLPAWHLEPLCSQGSSCLSCSSSSSPHATPSHCSCIPDRLPLRLLCESMKRQIVSRAFYGWLAHCRHLSTVRTHLSALVHHSVIPPDRPPGASAGLTKDVWSKYQKDKKNYKELELLRQVYYGGIEHEIRKDVWPFLLGHYKFGMSKKEMEQVRGACSHGAMRWGAGPGDAREGTLEASAPSQPERSMAGQLHRPYPEARLESETQDPRSSAGPAPEGEGLVHASPMVVVWSEYQVDAVVAARYQQVLAEWKACEVVVRQREREAHPATRTKFSSGSSIDSHVQRLIHRDSTISNDVFISVDDLEPPEPQDPEDSRPKPEQEAGPGTPGTAVVEQQHSVEFDSPDSGLPSSRNYSVASGIQSSLDEGQSVGFEEEDGGGEEGSSGPGPAAHTLREPQDPSQEKPQAGELEAGEELAAVCAAAYTIELLDTVALNLHRIDKDVQRCDRNYWYFTPPNLERLRDVMCSYVWEHLDVGYVQGMCDLLAPLLVTLDNDQLAYSCFSHLMKRMSQNFPNGGAMDTHFANMRSLIQILDSELFELMHQNGDYTHFYFCYRWFLLDFKRELLYEDVFAVWEVIWAARHISSEHFVLFIALALVEAYREIIRDNNMDFTDIIKFFNERAEHHDAQEILRIARDLVHKVQMLIENK

SEQ ID NO: 887904 - protein, 1034 aa, Homo sapiens
MGSAEDAVKEKLLWNVKKEVKQIMEEAVTRKFVHEDSSHIIALCGAVEACLLHQLRRRAAGFLRSDKMAALFTKVGKTCPVAGEICHKVQELQQQAEGRKPSGVSQEALRRQGSASGKAPALSPQALKHVWVRTALIEKVLDKVVQYLAENCSKYYEKEALLADPVFGPILASLLGEPESTGTVGTGQVLREHRLGWLSLSSTVGPCALEYTKLKTADHYWTDPSADELVQRHRIRGPPTRQDSPAKRPALGIRKRHSSGSASEDRLAACARECVESLHQNSRTRLLYGKNHVLVQPKEDMEAVPGYLSLHQSAESLTLKWTPNQLMNGTLGDSELEKSVYWDYALVVPFSQVVCIHCHQQKSGGTLVLVSQDGIQRPPLHFPQGGHLLSFLSCLENGLLPRGQLEPPLWTQQGKGKVFPKLRKRSSIRSVDMEEMGTGRATDYVFRIIYPGHRHEHNAGDMIEMQGFGPSLPAWHLEPLCSQGSSCLSCSSSSSPHATPSHCSCIPDRLPLRLLCESMKRQIVSRAFYGWLAHCRHLSTVRTHLSALVHHSVIPPDRPPGASAGLTKDVWSKYQKDKKNYKELELLRQVYYGGIEHEIRKDVWPFLLGHYKFGMSKKEMEQVDAVVAARYQQVLAEWKACEVVVRQREREAHPATRTKFSSGSSIDSHVQRLIHRDSTISNDVFISVDDLEPPEPQDPEDSRPKPEQEAGPGTPGTAVVEQQHSVEFDSPDSGLPSSRNYSVASGIQSSLDEGQSVGFEEEDGGGEEGSSGPGPAAHTLREPQDPSQEKPQAGELEAGEELAAVCAAAYTIELLDTVALNLHRIDKDVQRCDRNYWYFTPPNLERLRDVMCSYVWEHLDVGYVQGMCDLLAPLLVTLDNDQLAYSCFSHLMKRMSQNFPNGGAMDTHFANMRSLIQILDSELFELMHQNGDYTHFYFCYRWFLLDFKRELLYEDVFAVWEVIWAARHISSEHFVLFIALALVEAYREIIRDNNMDFTDIIKFFNERAEHHDAQEILRIARDLVHKVQMLIENK

SEQ ID NO: 887905 - protein, 983 aa, Homo sapiens
MGSAEDAVKEKLLWNVKKEVKQIMEEAVTRKFVHEDSSHIIALCGAVEACLLHQLRRRAAGFLRSDKMAALFTKVGKTCPVAGEICHKVQELQQQAEGRKPSGVSQEALRRQGSASGKAPALSPQALKHVWVRTALIEKVLDKVVQYLAKTAVGPCALEYTKLKTADHYWTDPSADELVQRHRIRGPPTRQDSPAKRPALGIRKRHSSGSASEDRLAACARECVESLHQNSRTRLLYGKNHVLVQPKEDMEAVPGYLSLHQSAESLTLKWTPNQLMNGTLGDSELEKSVYWDYALVVPFSQVVCIHCHQQKSGGTLVLVSQDGIQRPPLHFPQGGHLLSFLSCLENGLLPRGQLEPPLWTQQGKGKVFPKLRKRSSIRSVDMEEMGTGRATDYVFRIIYPGHRHEHNAGDMIEMQGFGPSLPAWHLEPLCSQGSSCLSCSSSSSPHATPSHCSCIPDRLPLRLLCESMKRQIVSRAFYGWLAHCRHLSTVRTHLSALVHHSVIPPDRPPGASAGLTKDVWSKYQKDKKNYKELELLRQVYYGGIEHEIRKDVWPFLLGHYKFGMSKKEMEQVDAVVAARYQQVLAEWKACEVVVRQREREAHPATRTKFSSGSSIDSHVQRLIHRDSTISNDVFISVDDLEPPEPQDPEDSRPKPEQEAGPGTPGTAVVEQQHSVEFDSPDSGLPSSRNYSVASGIQSSLDEGQSVGFEEEDGGGEEGSSGPGPAAHTLREPQDPSQEKPQAGELEAGEELAAVCAAAYTIELLDTVALNLHRIDKDVQRCDRNYWYFTPPNLERLRDVMCSYVWEHLDVGYVQGMCDLLAPLLVTLDNDQLAYSCFSHLMKRMSQNFPNGGAMDTHFANMRSLIQILDSELFELMHQNGDYTHFYFCYRWFLLDFKRELLYEDVFAVWEVIWAARHISSEHFVLFIALALVEAYREIIRDNNMDFTDIIKFFNERAEHHDAQEILRIARDLVHKVQMLIENK

SEQ ID NO: 887906 - protein, 1053 aa, Homo sapiens
MGSAEDAVKEKLLWNVKKEVKQIMEEAVTRKFVHEDSSHIIALCGAVEACLLHQLRRRAAGFLRSDKMAALFTKVGKTCPVAGEICHKVQELQQQAEGRKPSGVSQEALRRQGSASGKAPALSPQALKHVWVRTALIEKVLDKVVQYLAENCSKYYEKEALLADPVFGPILASLLGEPESTGTVGTGQVLREHRLGWLSLSPQWDPVPWNTLSSRQPITTGLTPLLMSWSSGTASGVHLLARTPLQSAQPWGSGNGTQAAARRRTGWLPVPASVWSPCTRTHGRGCSMARTTCWCSRPSLRASQPFIVGLPVSPAEKEDMEAVPGYLSLHQSAESLTLKWTPNQLMNGTLGDSELEKSVYWDYALVVPFSQVVCIHCHQQKSGGTLVLVSQDGIQRPPLHFPQGGHLLSFLSCLENGLLPRGQLEPPLWTQQGKGKVFPKLRKRSSIRSVDMEEMGTGRATDYVFRIIYPGHRHEHNAGDMIEMQGFGPSLPAWHLEPLCSQGSSCLSCSSSSSPHATPSHCSCIPDRLPLRLLCESMKRQIVSRAFYGWLAHCRHLSTVRTHLSALVHHSVIPPDRPPGASAGLTKDVWSKYQKDKKNYKELELLRQVYYGGIEHEIRKDVWPFLLGHYKFGMSKKEMEQVDAVVAARYQQVLAEWKACEVVVRQREREAHPATRTKFSSGSSIDSHVQRLIHRDSTISNDVFISVDDLEPPEPQDPEDSRPKPEQEAGPGTPGTAVVEQQHSVEFDSPDSGLPSSRNYSVASGIQSSLDEGQSVGFEEEDGGGEEGSSGPGPAAHTLREPQDPSQEKPQAGELEAGEELAAVCAAAYTIELLDTVALNLHRIDKDVQRCDRNYWYFTPPNLERLRDVMCSYVWEHLDVGYVQGMCDLLAPLLVTLDNDQLAYSCFSHLMKRMSQNFPNGGAMDTHFANMRSLIQILDSELFELMHQNGDYTHFYFCYRWFLLDFKRELLYEDVFAVWEVIWAARHISSEHFVLFIALALVEAYREIIRDNNMDFTDIIKFFNERAEHHDAQEILRIARDLVHKVQMLIENK

SEQ ID NO: 887907 - protein, 697 aa, Homo sapiens
RQNSCVLHRQNSVVLHMTLGNRQSPPSVDHSNGNGEMCSPSLRKRSSGGHLLSFLSCLENGLLPRGQLEPPLWTQQGKGKVFPKLRKRSSIRSVDMEEMGTGRATDYVFRIIYPGHRHEHNAGDMIEMQGFGPSLPAWHLEPLCSQGSSCLSCSSSSSPHATPSHCSCIPDRLPLRLLCESMKRQIVSRAFYGWLAHCRHLSTVRTHLSALVHHSVIPPDRPPGASAGLTKDVWSKYQKDKKNYKELELLRQVYYGGIEHEIRKDVWPFLLGHYKFGMSKKEMEQVDAVVAARYQQVLAEWKACEVVVRQREREAHPATRTKFSSGSSIDSHVQRLIHRDSTISNDVFISVDDLEPPEPQDPEDSRPKPEQEAGPGTPGTAVVEQQHSVEFDSPDSGLPSSRNYSVASGIQSSLDEGQSVGFEEEDGGGEEGSSGPGPAAHTLREPQDPSQEKPQAGELEAGEELAAVCAAAYTIELLDTVALNLHRIDKDVQRCDRNYWYFTPPNLERLRDVMCSYVWEHLDVGYVQGMCDLLAPLLVTLDNDQLAYSCFSHLMKRMSQNFPNGGAMDTHFANMRSLIQILDSELFELMHQNGDYTHFYFCYRWFLLDFKRELLYEDVFAVWEVIWAARHISSEHFVLFIALALVEAYREIIRDNNMDFTDIIKFFNERAEHHDAQEILRIARDLVHKVQMLIENK

SEQ ID NO: 887908 - protein, 499 aa, Homo sapiens
FYLKAAGVPGMEPVQDSGDTLVDMAYYTGHTHKDYSPWAWAFGNTQDILDRWDRVVPAPVEHEIRKDVWPFLLGHYKFGMSKKEMEQVDAVVAARYQQVLAEWKACEVVVRQREREAHPATRTKFSSGSSIDSHVQRLIHRDSTISNDVFISVDDLEPPEPQDPEDSRPKPEQEAGPGTPGTAVVEQQHSVEFDSPDSGLPSSRNYSVASGIQSSLDEGQSVGFEEEDGGGEEGSSGPGPAAHTLREPQDPSQEKPQAGELEAGEELAAVCAAAYTIELLDTVALNLHRIDKDVQRCDRNYWYFTPPNLERLRDVMCSYVWEHLDVGYVQGMCDLLAPLLVTLDNDQLAYSCFSHLMKRMSQNFPNGGAMDTHFANMRSLIQILDSELFELMHQNGDYTHFYFCYRWFLLDFKRELLYEDVFAVWEVIWAARHISSEHFVLFIALALVEAYREIIRDNNMDFTDIIKFFNERAEHHDAQEILRIARDLVHKVQMLIENK

SEQ ID NO: 887909 - protein, 419 aa, Homo sapiens
MFGQRLVSLCLAGWVRSWLGAPWPQCWRLWWERGCEEFCIPAPFWPEEAVGCGKVLECRWSRPVFTPQVFISVDDLEPPEPQDPEDSRPKPEQEAGPGTPGTAVVEQQHSVEFDSPDSGLPSSRNYSVASGIQSSLDEGQSVGFEEEDGGGEEGSSGPGPAAHTLREPQDPSQEKPQAGELEAGEELAAVCAAAYTIELLDTVALNLHRIDKDVQRCDRNYWYFTPPNLERLRDVMCSYVWEHLDVGYVQGMCDLLAPLLVTLDNDQLAYSCFSHLMKRMSQNFPNGGAMDTHFANMRSLIQILDSELFELMHQNGDYTHFYFCYRWFLLDFKRELLYEDVFAVWEVIWAARHISSEHFVLFIALALVEAYREIIRDNNMDFTDIIKFFNERAEHHDAQEILRIARDLVHKVQMLIENK

SEQ ID NO: 887910 - protein, 1006 aa, Homo sapiens; identical to SEQ ID NO: 887901

SEQ ID NO: 887911 - protein, 168 aa, Homo sapiens
MCDLLAPLLVTLDNDQLAYSCFSHLMKRMSQNFPNGGAMDTHFANMRSLIQILDSELFELMHQNGDYTHFYFCYRWFLLDFKRELLYEDVFAVWEVIWAARHISSEHFVLFIALALVEAYREIIRDNNMDFTDIIKFFNERAEHHDAQEILRIARDLVHKVQMLIENK

SEQ ID NO: 887912 - protein, 1006 aa, Homo sapiens; identical to SEQ ID NO: 887901

SEQ ID NO: 887913 - protein, 1006 aa, Homo sapiens
MGSAEDAVKEKLLWNVKKEVKQIMEEAVTRKFVHEDSSHIIALCGAVEACLLHQLRRRAAGFLRSDKMAALFTKVGKTCPVAGEICHKVQELQQQAEGRKPSGVSQEALRRQGSASGKAPALSPQALKHVWVRTALIEKVLDKVVQYLAENCSKYYEKEALLADPVFGPILASLLVGPCALEYTKLKTADHYWTDPSADELVQRHRIRGPPTRQDSPAKRPALGIRKRHSSGSASEDRLAACARECVESLHQNSRTRLLYGKNHVLVQPKEDMEAVPGYLSLHQSAESLTLKWTPNQLMNGTLGDSELEKSVYWDYALVVPFSQVVCIHCHQQKSGGTLVLVSQDGIQRPPLHFPQGGHLLSFLSCLENGLLPRGQLEPPLWTQQGKGKVFPKLRKRSSIRSVDMEEMGTGRATDYVFRIIYPGHRHEHNAGDMIEMQGFGPSLPAWHLEPLCSQGSSCLSCSSSSSPHATPSHCSCIPDRLPLRLLCESMKRQIVSRAFYGWLAHCRHLSTVRTHLSALVHHSVIPPDRPPGASAGLTKDVWSKYQKDKKNYKELELLRQVYYGGIEHEIRKDVWPFLLGHYKFGMSKKEMEQVDAVVAARYQQVLAEWKACEVVVRQREREAHPATRTKFSSGSSIDSHVQRLIHRDSTISNDVFISVDDLEPPEPQDPEDSRPKPEQEAGPGTPGTAVVEQQHSVEFDSPDSGLPSSRNYSVASGIQSSLDEGQSVGFEEEDGGGEEGSSGPGPAAHTLREPQDPSQEKPQAGELEAGEELAAVCAAAYTIELLDTVALNLHRIDKDVQRCDRNYWYFTPPNLERLRDVMCSYVWEHLDVGYVQGMCDLLAPLLVTLDNDQLAYSCFSHLMKRMSQNFPNGGAMDTHFANMRSLIQILDSELFELMHQNGDYTHFYFCYRWFLLDFKRELLYEDVFAVWEVIWAARHISSEHFVLFIALALVEAYREIIRDNNMDFTDIIKFFNERAEHHDAQEILRIARDLVHKSLKTTCKK

SEQ ID NO: 887914 - protein, 1006 aa, Homo sapiens; identical to SEQ ID NO: 887901

SEQ ID NO: 887915 - protein, 1006 aa, Homo sapiens; identical to SEQ ID NO: 887901

SEQ ID NO: 887916 - protein, 1006 aa, Homo sapiens; identical to SEQ ID NO: 887901

SEQ ID NO: 887917 - protein, 1020 aa, Homo sapiens
MGSAEDAVKEKLLWNVKKEVKQIMEEAVTRKFVHEDSSHIIALCGAVEACLLHQLRRRAAGFLRSDKMAALFTKVGKTCPVAGEICHKVQELQQQAEGRKPSGVSQEALRRQGSASGKAPALSPQALKHVWVRTALIEKVLDKVVQYLAENCSKYYEKEALLADPVFGPILASLLVGPCALEYTKLKTADHYWTDPSADELVQRHRIRGPPTRQDSPAKRPALGIRKRHSSGSASEDRLAACARECVESLHQNSRTRLLYGKNHVLVQPKEDMEAVPGYLSLHQSAESLTLKWTPNQLMNGTLGDSELEKSVYWDYALVVPFSQVVCIHCHQQKSGGTLVLVSQDGIQRPPLHFPQGGHLLSFLSCLENGLLPRGQLEPPLWTQQGKGKVFPKLRKRSSIRSVDMEEMGTGRATDYVFRIIYPGHRHEHNAGDMIEMQGFGPSLPAWHLEPLCSQGSSCLSCSSSSSPHATPSHCSCIPDRLPLRLLCESMKRQIVSRAFYGWLAHCRHLSTVRTHLSALVHHSVIPPDRPPGASAGLTKDVWSKYQKDKKNYKELELLRQVYYGGIEHEIRKDVWPFLLGHYKFGMSKKEMEQVDAVVAARYQQVLAEWKACEVVVRQREREAHPATRTKFSSGSSIDSHVQRLIHRDSTISNDVFISVDDLEPPEPQDPEDSRPKPEQEAGPGTPGTAVVEQQHSVEFDSPDSGLPSSRNYSVASGIQSSLDEGQSVGFEEEDGGGEEGSSGPGPAAHTLREPQDPSQEKPQAGELEAGEELAAVCAAAYTIELLDTVALNLHRIDKDVQRCDRNYWYFTPPNLERLRDVMCSYVWEHLDVGYVQGMCDLLAPLLVTLDNDQLAYSCFSHLMKRMSQNFPNGGAMDTHFANMRSLIQILDSELFELMHQNGDYTHFYFCYRWFLLDFKRELLYEDVFAVWEVIWAARHISSEHFVLFIALALVEAYREIIRDNNMDFTDIIKFFNASWSSHPGCPEQRCGGPHLCPAHSWRVLRNPGGPSPKAGMSRI

SEQ ID NO: 887918 - protein, 694 aa, Homo sapiens
MGSAEDAVKEKLLWNVKKEVKQIMEEAVTRKFVHEDSSHIIALCGAVEACLLHQLRRRAAGFLRSDKMAALFTKVGKTCPVAGEICHKVQELQQQAEGRKPSGVSQEALRRQGSASGKAPALSPQALKHVWVRTALIEKVLDKVVQYLAENCSKYYEKEALLADPVFGPILASLLVGPCALEYTKLKTADHYWTDPSADELVQRHRIRGPPTRQDSPAKRPALGIRKRHSSGSASEDRLAACARECVESLHQNSRTRLLYGKNHVLVQPKEDMEAVPGYLSLHQSAESLTLKWTPNQLMNGTLGDSELEKSVYWDYALVVPFSQVVCIHCHQQKSGGTLVLVSQDGIQRPPLHFPQGGHLLSFLSCLENGLLPRGQLEPPLWTQQGKGKVFPKLRKRSSIRSVDMEEMGTGRATDYVFRIIYPGHRHEHNAGDMIEMQGFGPSLPAWHLEPLCSQGSSCLSCSSSSSPHATPSHCSCIPDRLPLRLLCESMKRQIVSRAFYGWLAHCRHLSTVRTHLSALVHHSVIPPDRPPGASAGLTKDVWSKYQKDKKNYKELELLRQVYYGGIEHEIRKDVWPFLLGHYKFGMSKKEMEQVDAVVAARYQQVLAEWKACEVVVRQREREAHPATRTKFSSGSSIDSHVQRLIHRDSTISNDVSQTGPGGLGVSGATRVLCTVVLSTSLTSGNWWGPARKA

SEQ ID NO: 887919 - protein, 111 aa, Homo sapiens
MGLTQLGHGDCGGCTVLTPRVPQNYKELELLRQVYYGGIEHEIRKDVWPFLLGHYKFGMSKKEMEQVRGACSHGADEMGSWARGRQGGDLGSLSPFPAGKKHGRAAPPSLP

SEQ ID NO: 887920 - protein, 988 aa, Homo sapiens
MGSAEDAVKEKLLWNVKKEVKQIMEEAVTRKFVHEDSSHIIALCGAVEACLLHQLRRRAAGFLRSDKMAALFTKVGKTCPVAGEICHKVQELQQQAEGRKPSGVSQEALRRQGSASGKAPALSPQALKHVWVRTALIEKVLDKVVQYLAENCSKYYEKEALLADPVFGPILASLLVGPCALEYTKLKTADHYWTDPSADELVQRHRIRGPPTRQDSPAKRPALGIRKRHSSGSASEDRLAACARECVESLHQNSRTRLLYGKNHVLVQPKEDMEAVPGYLSLHQSAESLTLKWTPNQLMNGTLGDSELEKSVYWDYALVVPFSQVVCIHCHQQKSGGTLVLVSQDGIQRPPLHFPQGGHLLSFLSCLENGLLPRGQLEPPLWTQQGKGKVFPKLRKRSSIRSVDMEEMGTGRATDYVFRIIYPGHRHEHNAGDMIEMQGFGPSLPAWHLEPLCSQGSSCLSCSSSSSPHATPSHCSCIPDRLPLRLLCESMKRQIVSRAFYGWLAHCRHLSTVRTHLSALVHHSVIPPDRPPGASAGLTKDVWSKYQKDKKNYKELELLRQVYYGGIEHEIRKDVWPFLLGHYKFGMSKKEMEQVDAVVAARYQQVLAEWKACEVVVRQREREAHPATRTKFSSGSSIDSHVQRLIHRDSTISNDVFISVDDLEPPEPQDPEDSRPKPEQEAGPGTPGTAVVEQQHSVEFDSPDSGLPSSRNYSVASGIQSSLDEGQSVGFEEEDGGGEEGSSGPGPAAHTLREPQDPSQEKPQAGELEAGEELAAVCAAAYTIELLDTVALNLHRIDKDVQRCDRNYWYFTPPNLERLRDVMCSYVWEHLDVGYVQGMCDLLAPLLVTLDNDQLAYSCFSHLMKRMSQNFPNGGAMDTHFANMRSLIQILDSELFELMHQNGDYTHFYFCYRWFLLDFKRELLYEDVFAVWEVIWAARHISSEHFVLFIALALVEAYREIIRDNNMDFTDIIKFFNADHPIVHPCCP

SEQ ID NO: 887921 - protein, 935 aa, Homo sapiens
MGSAEDAVKEKLLWNVKKEVKQIMEEAVTRKFVHEDSSHIIALCGAVEACLLHQLRRRAAGFLRSDKMAALFTKVGKTCPVAGEICHKVQELQQQAEGRKPSGVSQEALRRQGSASGKAPALSPQALKHVWVRTALIEKVLDKVVQYLAENCSKYYEKEALLADPVFGPILASLLVGPCALEYTKLKTADHYWTDPSADELVQRHRIRGPPTRQDSPAKRPALGIRKRHSSGSASEDRLAACARECVESLHQNSRTRLLYGKNHVLVQPKEDMEAVPGYLSLHQSAESLTLKWTPNQLMNGTLGDSELEKSVYWDYALVVPFSQVVCIHCHQQKSGGTLVLVSQDGIQRPPLHFPQGGHLLSFLSCLENGLLPRGQLEPPLWTQQGKGKVFPKLRKRSSIRSVDMEEMGTGRATDYVFRIIYPGHRHEHNAGDMIEMQGFGPSLPAWHLEPLCSQGSSCLSCSSSSSPHATPSHCSCIPDRLPLRLLCESMKRQIVSRAFYGWLAHCRHLSTVRTHLSALVHHSVIPPDRPPGASAGLTKDVWSKYQKDKKNYKELELLRQVYYGGIEHEIRKDVWPFLLGHYKFGMSKKEMEQVDAVVAARYQQVLAEWKACEVVVRQREREAHPATRTKFSSGSSIDSHVQRLIHRDSTISNDVFISVDDLEPPEPQDPEDSRPKPEQEAGPGTPGTAVVEQQHSVEFDSPDSGLPSSRNYSVASGIQSSLDEGQSVGFEEEDGGGEEGSSGPGPAAHTLREPQDPSQEKPQAGELEAGEELAAVCAAAYTIELLDTVALNLHRIDKDVQRCDRNYWYFTPPNLERLRDVMCSYVWEHLDVGYVQGMCDLLAPLLVTLDNDQLAYSCFSHLMKRMSQNFPNGGAMDTHFANMRSLIQILDSELFELMHQNGDYTHFYFCYRWFLLDFKRGKLLDWIMGLRSGT

SEQ ID NO: 887922 - protein, 466 aa, Homo sapiens
MKVRSAGGDGDALCVTEEDLAGDDEDMPTFPCTQKGRPGPRCSRCQKNLSLHTSVRILYLFLALLLVAVAVLASLVFRKVDSLSEDISLTQSIYDKKLVLMQKNLQGLDPKALNNCSFCHEAGQLGPEIRKLQEELEGIQKLLLAQEVQLDQTLQAQEVLSTTSRQISQEMGSCSFSIHQVNQSLGLFLAQVRGWQATTAGLDLSLKDLTQECYDVKAAVHQINFTVGQTSEWIHGIQRKTDEETLTLQKIVTDWQNYTRLFSGLRTTSTKTGEAVKNIQATLGASSQRISQNSESMHDLVLQVMGLQLQLDNISSFLDDHEENMHDLQYHTHYAQNRTVERFESLEGRMASHEIEIGTIFTNINATDNHVHSMLKYLDDVRLSCTLGFHTHAEELYYLNKSVSIMLGTTDLLRERFSLLSARLDLNVRNLSMIVEEMKAVDTQHGEILRNVTILRGHTLFSHNRI

SEQ ID NO: 887923 - protein, 606 aa, Homo sapiens
MKVRSAGGDGDALCVTEEDLAGDDEDMPTFPCTQKGRPGPRCSRCQKNLSLHTSVRILYLFLALLLVAVAVLASLVFRKVDSLSEDISLTQSIYDKKLVLMQKNLQGLDPKALNNCSFCHEAGQLGPEIRKLQEELEGIQKLLLAQEVQLDQTLQAQEVLSTTSRQISQEMGSCSFSIHQVNQSLGLFLAQVRGWQATTAGLDLSLKDLTQECYDVKAAVHQINFTVGQTSEWIHGIQRKTDEETLTLQKIVTDWQNYTRLFSGLRTTSTKTGEAVKNIQATLGASSQRISQNSESMHDLVLQVMGLQLQLDNISSFLDDHEENMHDLQYHTHYAQNRTVERFESLEGRMASHEIEIGTIFTNINATDNHVHSMLKYLDDVRLSCTLGFHTHAEELYYLNKSVSIMLGTTDLLRERFSLLSARLDLNVRNLSMIVEEMKAVDTQHGEILRNVTILRGAPGPPGPRGFKGDMGVKGPVGGRGPKGDPGSLGPLGPQGPQGQPGEAGPVGERGPVGPRGFPGLKGSKGSFGTGGPRGQPGPKGDIGPPGPEGPPGSPGPSGPQGKPGIAGKTGSPGQRGAMGPKGEPGIQGPPGLPGPPGPPGSQSFY

SEQ ID NO: 887924 - protein, 71 aa, Homo sapiens
RERFSLLSARLDLNVRNLSMIVEEMKAVDTQHGEILRNVTILRGKSWVQVGLLQSFQLRLGDLAGHRSTWF

SEQ ID NO: 887925 - protein, 128 aa, Homo sapiens
AVVSTQSRHYGRGRCFSLKMAASAARGAAALRRSINQPVAFVRRIPWTAASSQLKEHFAQFGHVRRCILPFDKETGFHRGLGWVQFSSEEGLRNALQQENHIIDGVKVQVHTRRPKLPQTSDDEKKDF

SEQ ID NO: 887926 - protein, 128 aa, Homo sapiens; identical to SEQ ID NO: 887925

SEQ ID NO: 887927 - protein, 128 aa, Homo sapiens; identical to SEQ ID NO: 887925

SEQ ID NO: 887928 - protein, 302 aa, Homo sapiens
EKHISIEEEHLRRMEEARLQLKDQLLCLETEQESILGVIGKEIDAACKTFSKDSVEKLKVFSSGPDIHYDPHRWLAESKTKLQWLCEELKERENREKNLRHQLMLCRQQLRNLTENKESELQCLFQQIERQEQLLDEIHREKRDLLEETQRKDEEMGSLQDRVIALETSTQVALDHLESVPEKLSLLEDFKDFRDSCSSSERTDGRYSKYRVRRNSLQHHQDDTKYRTKSFKGDRTFLEGSHTRGLDHSSSWQDHSRFLSSPRFSYVNSFTKRTVAPDSASNKEDATMNGTSSQPKKEEYGS

SEQ ID NO: 887929 - protein, 117 aa, Homo sapiens
AVVSTQSRHYGRGRCFSLKMAASAARGAAALRRSINQPVAFVRRIPWTAASSQLKEHFAQFGHVRRCILPFDKETGFHRGLGWVQFSSEEGLRNALQQENHIIDGVKVNLFLCQIHT

SEQ ID NO: 887930 - protein, 128 aa, Homo sapiens; identical to SEQ ID NO: 887925

SEQ ID NO: 887931 - protein, 220 aa, Homo sapiens
EKHISIEEEHLRRMEEARLQLKDQLLCLETEQESILGVIGKEIDAACKTFSKDSVEKLKVFSSGPDIHYDPHRWLAESKTKLQWLCEELKERENREKNLRHQLMLCRQQLRNLTENKESELQCLFQQIERQEQLLDEIHREKRGQLKEHFAQFGHVRRCILPFDKETGFHRGLGWVQFSSEEGLRNALQQENHIIDGVKVQVHTRRPKLPQTSDDEKKDF

SEQ ID NO: 887932 - protein, 128 aa, Homo sapiens; identical to SEQ ID NO: 887925

SEQ ID NO: 887933 - protein, 132 aa, Homo sapiens
AVVSTQSRHYGRGRCFSLKMAASAARGAAALRRSINQPVAFVRRIPWTAASSQLKEHFAQFGHVRRCILPFDKETGFHRGLGWVQFSSEEGLRNALQQENHIIDGVKVQVHTRRPKLPQTSSESKSGSRARM

SEQ ID NO: 887934 - protein, 123 aa, Homo sapiens
AVVSTQSRHYGRGRCFSLKMAASAARGAAALRRSINQPVAFVRRIPWTAASSQLKEHFAQFGHVRRCILPFDKETGFHRGLGWVQFSSEEGLRNALQQENHIIDGVKVQGSHLGRPKTLPPNI

SEQ ID NO: 887935 - protein, 129 aa, Homo sapiens
MATANGAVENGQPDRKPPALPRPIRNLEVKFTKIFINNEWHESKSGKKFATCNPSTREQICEVEEGDKPDVDKAVEAAQVAFQRGSPWRRLDALSRGRLLHQLADLVERDRATLAFEEGSSHCSHPRAS

SEQ ID NO: 887936 - protein, 103 aa, Homo sapiens [sequence omitted]

SEQ ID NO: 887937 - protein, 469 aa, Homo sapiens
MATANGAVENGQPDRKPPALPRPIRNLEVKFTKIFINNEWHESKSGKKFATCNPSTREQICEVEEGDKPDVDKAVEAAQVAFQRGSPWRRLDALSRGRLLHQLADLVERDRATLAMDNVVCFTRHEPIGVCGAITPWNFPLLMLVWKLAPALCCGNTMVLKPAEQTPLTALYLGSLIKEAGFPPGVVNIVPGFGPTVGAAISSHPQINKIAFTGSTEVGKLVKEAASRSNLKRVTLELGGKNPCIVCADADLDLAVECAHQGVFFNQGQCCTAASRVFVEEQVYSEFVRRSVEYAKKRPVGDPFDVKTEQGPQIDQKQFDKILELIESGKKEGAKLECGGSAMEDKGLFIKPTVFSEVTDNMRIAKEEIFGPVQPILKFKSIEEVIKRANSTDYGLTAAVFTKNLDKALKLASALESGTVWINCYNALYAQAPFGGFKMSGNGRELGEYALAEYTEVKTVTIKLGDKNP

SEQ ID NO: 887938 - protein, 512 aa, Homo sapiens
MATANGAVENGQPDRKPPALPRPIRNLEVKFTKIFINNEWHESKSGKKFATCNPSTREQICEVEEGDKPDVDKAVEAAQVAFQRGSPWRRLDALSRGRLLHQLADLVERDRATLAALETMDTGKPFLHAFFIDLEGCIRTLRYFAGWADKIQGKTIPTDDNVVCFTRHEPIGVCGAITPWNFPLLMLVWKLAPALCCGNTMVLKPAEQTPLTALYLGSLIKEAGFPPGVVNIVPGFGPTVGAAISSHPQINKIAFTGSTEVGKLVKEAASRSNLKRVTLELGGKNPCIVCADADLDLAVECAHQGVFFNQGQCCTAASRVFVEEQVYSEFVRRSVEYAKKRPVGDPFDVKTEQGPQIDQKQFDKILELIESGKKEGAKLECGGSAMEDKGLFIKPTVFSEVTDNMRIAKEEIFGPVQPILKFKSIEEVIKRANSTDYGLTAAVFTKNLDKALKLASALESGTVWINCYNALYAQAPFGGFKMSGNGRELGEYALAEYTEVKTVTIKLGDKNP

SEQ ID NO: 887939 - protein, 103 aa, Homo sapiens [sequence omitted]

SEQ ID NO: 887940 - protein, 512 aa, Homo sapiens; identical to SEQ ID NO: 887938

SEQ ID NO: 887941 - protein, 512 aa, Homo sapiens; identical to SEQ ID NO: 887938

SEQ ID NO: 887942 - protein, 512 aa, Homo sapiens; identical to SEQ ID NO: 887938

SEQ ID NO: 887943 - protein, 131 aa, Homo sapiens [sequence omitted]

SEQ ID NO: 887944 - protein, 249 aa, Homo sapiens
KPVRENATGMTKKTYVESILEGIKQSKQENLDIDVRYLIAVDRRGGPLVAKETVKLAEEFFLSTEGTVLGLDLSGDPTVGQAKDFLEPLLEAKKAGLKLALHLSEIPNQKKETQILLDLLPDRIGHGTFLNSGEGGSLDLVDFVRQHRIPLELCLTSNVKSQTVPSYDQHHFGFWYSIAHPSVICTDDKGVFATHLSQEYQLAAETFNLTQSQVWDLSYESINYIFASDSTRSELRKKWNHLKPRVLHI

SEQ ID NO: 887945 - protein, 249 aa, Homo sapiens; identical to SEQ ID NO: 887944

SEQ ID NO: 887946 - protein, 161 aa, Homo sapiens
KPVRENATGMTKKTYVESILEGIKQSKQENLDIDVRYLIAVDRRGGPLVAKETVKLAEEFFLSTEGTVLGLDLSGDPTVGQAKDFLEPLLEAKKAGLKLALHLSEIPNQKKETQILLDLLPDRIGHGTFLNSGEGGSLDLVDFVRQHRIPLGKAWSFRSSR

SEQ ID NO: 887947 - protein, 175 aa, Homo sapiens
STPRRENATGMTKKTYVESILEGIKQSKQENLDIDVRYLIAVDRRGGPLVAKETVKLAEEFFLSTEGTVLGLDLSGDPTVGQAKDFLEPLLEAKKAGLKLALHLSEIPNQKKETQILLDLLPDRIGHGTFLNSGEGGSLDLVDFVRQHRIPLELCLTSNVKSQTVPSYDQHHFGF

SEQ ID NO: 887948 - protein, 482 aa, Homo sapiens
MSEIRKDTLKAILLELECHFTWNLLKEDIDLFEVEDTIGQQLEFLTTKSRLALYNLLAYVKHLKGQNKDALECLEQAEEIIQQEHSDKEEVRSLVTWGNYAWVYYHMDQLEEAQKYTGKIGNVCKKLSSPSNYKLECPETDCEKGWALLKFGGKYYQKAKAAFEKALEVEPDNPEFNIGYAITVYRLDDSDREGSVKSFSLGPLRKAVTLNPDNSYIKVFLALKLQDVHAEAEGEKYIEEILDQISSQPYVLRYAAKFYRRKNSWNKALELLKKALEVTPTSSFLHHQMGLCYRAQMIQIKKATHNRPKGKDKLKVDELISSAIFHFKAAMERDSMFAFAYTDLANMYAEGGQYSNAEDIFRKALRLENITDDHKHQIHYHYGRFQEFHRKSENTAIHHYLEALKVKDRSPLRTKLTSALKKLSTKRLCHNALDVQSLSALGFVYKLEGEKRQAAEYYEKAQKIDPENAEFLTALCELRLSI

SEQ ID NO: 887949 - protein, 482 aa, Homo sapiens; identical to SEQ ID NO: 887948

SEQ ID NO: 887950 - protein, 287 aa, Homo sapiens
HLIQSPVSCSCWGWGLSFNKDTPRGRVQGLQRPGARTRTRTPTARLPAVPGAEERAIRGTAPPGRPAERCHHEVRVFLCLSSQALRRPWFQTGLLLFISSAVLRPFQGPSPSRPATGHLRWGPSPGALSRRAASEVGPAGEGGRVDASRESGPSPAPKKAGQGGGTGDAPREPVPSLASAVGTVRVCAGRRSPGRPVHPSHPTALLGSGDGDRAGSAAAASGKLVSACRAPRRCSGGSCYVPRVSLGLSRASLSSCHSLGVAYAVSPQPCRRHVRLPLPVCVSDFWV

SEQ ID NO: 887951 - protein, 496 aa, Homo sapiens
MAANCTSSWSLGESCNRPGLELPRSMASSETQLGNHDVDPEISHVNFRMFSCPKESDPIQALRKLTELCHLWLRPDLHTKEQILDMLVMEQFMISMPQELQVLVMMNGVQSCKDLEDLLRNNRRPKKWSVVTFHGKEYIVQDSDIEMAEAPSSVRDDLKDVSSQRASSVNQMRPGEGQAHRELQILPRVPALSRRQGEDFLLHKSIDVTGDPKSLRPKQTLEKDLKENREENPGLTSPEPQLPKSPTDLVRAKEGKDPPKIASVENVDADTPSACVVEREASTHSGNRGDALNLSSPKRSKPDASSISQEEPQGEATPVGNRESPGQAGMNSIHSPGPASPVSHPDGQEAKALPPFACDVCEKRFTCNSKLVIHKRSHTGERLFQCNLCGKRFMQLISLQFHQRTHTGERPYTCDVCQKQFTQKSYLKCHKRSHTGEKPFECKDCKKVFTYRGSLKEHQRIHSGEKPYKCSKCPRAFSRLKLLRRHQKTHPEATSQ

SEQ ID NO: 887952 - protein, 496 aa, Homo sapiens; identical to SEQ ID NO: 887951

SEQ ID NO: 887953 - protein, 496 aa, Homo sapiens; identical to SEQ ID NO: 887951

SEQ ID NO: 887954 - protein, 518 aa, Homo sapiens
AGGWLESASQTEKVGGRSREGDMAANCTSSWSLGESCNRPGLELPRSMASSETQLGNHDVDPEISHVNFRMFSCPKESDPIQALRKLTELCHLWLRPDLHTKEQILDMLVMEQFMISMPQELQVLVMMNGVQSCKDLEDLLRNNRRPKKWSVVTFHGKEYIVQDSDIEMAEAPSSVRDDLKDVSSQRASSVNQMRPGEGQAHRELQILPRVPALSRRQGEDFLLHKSIDVTGDPKSLRPKQTLEKDLKENREENPGLTSPEPQLPKSPTDLVRAKEGKDPPKIASVENVDADTPSACVVEREASTHSGNRGDALNLSSPKRSKPDASSISQEEPQGEATPVGNRESPGQAGMNSIHSPGPASPVSHPDGQEAKALPPFACDVCEKRFTCNSKLVIHKRSHTGERLFQCNLCGKRFMQLISLQFHQRTHTGERPYTCDVCQKQFTQKSYLKCHKRSHTGEKPFECKDCKKVFTYRGSLKEHQRIHSGEKPYKCSKCPRAFSRLKLLRRHQKTHPEATSQ

SEQ ID NO: 887955 - protein, 496 aa, Homo sapiens; identical to SEQ ID NO: 887951

SEQ ID NO: 887956 - protein, 496 aa, Homo sapiens; identical to SEQ ID NO: 887951

SEQ ID NO: 887957 - protein, 496 aa, Homo sapiens; identical to SEQ ID NO: 887951

SEQ ID NO: 887958 - protein, 366 aa, Homo sapiens
MIVRPPQPRETDSDIEMAEAPSSVRDDLKDVSSQRASSVNQMRPGEGQAHRELQILPRVPALSRRQGEDFLLHKSIDVTGDPKSLRPKQTLEKDLKENREENPGLTSPEPQLPKSPTDLVRAKEGKDPPKIASVENVDADTPSACVVEREASTHSGNRGDALNLSSPKRSKPDASSISQEEPQGEATPVGNRESPGQAGMNSIHSPGPASPVSHPDGQEAKALPPFACDVCEKRFTCNSKLVIHKRSHTGERLFQCNLCGKRFMQLISLQFHQRTHTGERPYTCDVCQKQFTQKSYLKCHKRSHTGEKPFECKDCKKVFTYRGSLKEHQRIHSGEKPYKCSKCPRAFSRLKLLRRHQKTHPEATSQ

SEQ ID NO: 887959 - protein, 229 aa, Homo sapiens
MAANCTSSWSLGESCNRPGLELPRSMASSETQLGNHDVDPEISHVNFRMFSCPKESDPIQALRKLTELCHLWLRPDLHTKEQILDMLVMEQFMISMPQELQVLVMMNGVQSCKDLEDLLRNNRRPKKWSVVTFHGKEYIVQDSDIEMAEAPSSVRDDLKDVSSQRASSVNQMRPGEGQAHRELQILPRVPALSRRQRECPRYELPGCLSKYVSSPLSFVFCFIMSIVFL

SEQ ID NO: 887960 - protein, 69 aa, Homo sapiens
FQLPVPTVHAPVNKREDLIVAEVCLSHFITGQTAVLVPTDRHHASKGAGIEYLNKQKCALCKLLHLDLL

SEQ ID NO: 887961 - protein, 260 aa, Homo sapiens
MDRHSSYIFIWLQLELCAMAVLLTKGEIRCYCDAAHCVATGYMCKSELSACFSRLLDPQNSNSPLTHGCLDSLASTTDICQAKQARNHSGTTIPTLECCHEDMCNYRGLHDVLSPPRGEASGQGNRYQHDGSRNLITKVQELTSSKELWFRAAVIAVPIAGGLILVLLIMLALRMLRSENKRLQDQRQQMLSRLHYSFHGHHSKKGQVAKLDLECMVPVSGHENCCLTCDKMRQADLSNDKILSLVHWGMYSGHGKLEFV

SEQ ID NO: 887962 - protein, 242 aa, Homo sapiens
MDRHSSYIFIWLQLELCAMAVLLTKGEIRCYCDAAHCVATGYMCKSELSACFSRLLDPQNSNSPLTHGCLDSLASTTDICQAKQARNHSGTTIPTLECCHEDMCNYRGLHDVLSPPRGEASGQGNRYQHDGSRNLITKVQELTSSKELWFRAAVIAVPIAGGLILVLLIMLALRMLRSENKRLQDQRQQMLSRLHYSFHGHHSKKGQVAKLDLECMVPVSGHENCCLTCDGMYSGHGKLEFV

SEQ ID NO: 887963 - protein, 260 aa, Homo sapiens; identical to SEQ ID NO: 887961

SEQ ID NO: 887964 - protein, 150 aa, Homo sapiens
MEFDHFLCTPLGQGNRYQHDGSRNLITKVQELTSSKELWFRAAVIAVPIAGGLILVLLIMLALRMLRSENKRLQDQRQQMLSRLHYSFHGHHSKKGQVAKLDLECMVPVSGHENCCLTCDKMRQADLSNDKILSLVHWGMYSGHGKLEFV

SEQ ID NO: 887965 - protein, 130 aa, Homo sapiens
MAVNLITKVQELTSSKELWFRAAVIAVPIAGGLILVLLIMLALRMLRSENKRLQDQRQQMLSRLHYSFHGHHSKKGQVAKLDLECMVPVSGHENCCLTCDKMRQADLSNDKILSLVHWGMYSGHGKLEFV

SEQ ID NO: 887966 - protein, 260 aa, Homo sapiens; identical to SEQ ID NO: 887961

SEQ ID NO: 887967 - protein, 260 aa, Homo sapiens; identical to SEQ ID NO: 887961

SEQ ID NO: 887968 - protein, 260 aa, Homo sapiens; identical to SEQ ID NO: 887961

SEQ ID NO: 887969 - protein, 121 aa, Homo sapiens
MDRHSSYIFIWLQLELCAMAVLLTKGEIRCYCDAAHCVATGYMCKSELSACFSRLLDPQNSNSPLTHGCLDSLASTTDICQAKQARNHSGTTIPTLECCHEDKETGISMMVAETLSPRCRS

SEQ ID NO: 887970 - protein, 66 aa, Homo sapiens
LWTQRKYVAVLSLIATIMLVQVSHMVKLTLMLLVAGAVATINLYAWRPVFDEYDHKRFREHESDEA

SEQ ID NO: 887971 - protein, 1128 aa, Homo sapiens
MPRNQGFSEPEYSAEYSAEYSVSLPSDPDRGVGRTHEISVRNSGSCLCLPRFMRLTFVPESLENLYQTYFKRQRHETLLVLVVFSSDKLAPLAVAGIGLVLDIILFVLCKKGLLPDRVTRRVLPYVLWLLITAQIFSYLGLNFARAHAASDTVGWQVFFVFSFFITLPLSLSPIVIISVVSCVVHTLVLGVTVAQQQQEELKGMQLLREILANVFLYLCAIAVGIMSYYMADRKHRKAFLEARQSLEVKMNLEEQSQQQENLMLSILPKHVADEMLKDMKKDESQKDQQQFNTMYMYRHENVSILFADIVGFTQLSSACSAQELVKLLNELFARFDKLAAKYHQLRIKILGDCYYCICGLPDYREDHAVCSILMGLAMVEAISYVREKTKTGVDMRVGVHTGTVLGGVLGQKRWQYDVWSTDVTVANKMEAGGIPGRVHISQSTMDCLKGEFDVEPGDGGSRCDYLEEKGIETYLIIASKPEVKKTATQNGLNGSALPNGAPASSKSSSPALIETKEPNGSAHSSGSTSEKPEEQDAQADNPSFPNPRRRLRLQDLADRVVDASEDEHELNQLLNEALLERESAQVVKKRNTFLLSMRFMDPEMETRYSVEKEKQSGAAFSCSCVVLLCTALVEILIDPWLMTNYVTFMVGEILLLILTICSLAAIFPRAFPKKLVAFSTWIDRTRWARNTWAMLAIFILVMANVVDMLSCLQYYTGPSNATAGMETEGSCLENPKYYNYVAVLSLIATIMLVQVSHMVKLTLMLLVAGAVATINLYAWRPVFDEYDHKRFREHDLPMVALEQMQGFNPGLNGTDRLPLVPSKYSMTVMVFLMMLSFYYFSRHVEKLARTLFLWKIEVHDQKERVYEMRRWNEALVTNMLPEHVARHFLGSKKRDEELYSQTYDEIGVMFASLPNFADFYTEESINNGGIECLRFLNEIISDFDSLLDNPKFRVITKIKTIGSTYMAASGVTPDVNTNGFASSNKEDKSERERWQHLADLADFALAMKDTLTNINNQSFNNFMLRIGMNKGGVLAGVIGARKPHYDIWGNTVNVASRMESTGVMGNIQVVEETQVILREYGFRFVRRGPIFVKGKGELLTFFLKGRDKLATFPNGPSVTLPHQVVDNS

SEQ ID NO: 887972 - protein, 1120 aa, Homo sapiens
MPRNQGFSEPEYSAEYSAEYSVSLPSDPDRGVGRTHEISVRNSGSCLCLPRFMRLTFVPESLENLYQTYFKRQRHETLLVLVVFSSDKLAPLAVAGIGLVLDIILFVLCKKGLLPDRVTRRVLPYVLWLLITAQIFSYLGLNFARAHAASDTVGWQVFFVFSFFITLPLSLSPIVIISVVSCVVHTLVLGVTVAQQQQEELKGMQLLREILANVFLYLCAIAVGIMSYYMADRKHRKAFLEARQSLEVKMNLEEQSQQQENLMLSILPKHVADEMLKDMKKDESQKDQQQFNTMYMYRHENVSILFADIVGFTQLSSACSAQELVKLLNELFARFDKLAAKYHQLRIKILGDCYYCICGLPDYREDHAVCSILMGLAMVEAISYVREKTKTGVDMRVGVHTGTVLGGVLGQKRWQYDVWSTDVTVANKMEAGGIPGRVHISQSTMDCLKGEFDVEPGDGGSRCDYLEEKGIETYLIIASKPEVKKTATQNGLNGSALPNGAPASSKSSSPALIETKEPNGSAHSSGSTSEKPEEQDAQADNPSFPNPRRRLRLQDLADRVVDASEDEHELNQLLNEALLERESAQVVKKRNTFLLSMRFMDPEMETRYSVEKEKQSGAAFSCSCVVLLCTALVEILIDPWLMTNYVTFMVGEILLLILTICSLAAIFPRAFPKKLVAFSTWIDRTRWARNTWAMLAIFILVMANVVDMLSCLQYYTGPSNATAGMETEGSCLENPKYYNYVAVLSLIATIMLVQVSHMVKLTLMLLVAGAVATINLYAWRPVFDEYDHKRFREHDLPMVALEQMQGFNPGLNGTDRLPLVPSKYSMTVMVFLMMLSFYYFSRHVEKLARTLFLWKIEVHDQKERVYEMRRWNEALVTNMLPEHVARHFLGSKKRDEELYSQTYDEIGVMFASLPNFADFYTEESINNGGIECLRFLNEIISDFDSLLDNPKFRVITKIKTIGSTYMAASGVTPDVNTNGFASSNKEDKSERERWQHLADLADFALAMKDTLTNINNQSFNNFMLRIGMNKGGVLAGVIGARKPHYDIWGNTVNVASRMESTGVMGNIQVCPVAQLARAQTRHENKTGTVLSHVPLPPTLALNSKSRGRDVGQVEKNLCNS

SEQ ID NO: 887973 - protein, 435 aa, Homo sapiens [sequence omitted]

SEQ ID NO: 887974 - protein, 1144 aa, Homo sapiens
MPRNQGFSEPEYSAEYSAEYSVSLPSDPDRGVGRTHEISVRNSGSCLCLPRFMRLTFVPESLENLYQTYFKRQRHETLLVLVVFAALFDCYVVVMCAVVFSSDKLAPLAVAGIGLVLDIILFVLCKKGLLPDRVTRRVLPYVLWLLITAQIFSYLGLNFARAHAASDTVGWQVFFVFSFFITLPLSLSPIVIISVVSCVVHTLVLGVTVAQQQQEELKGMQLLREILANVFLYLCAIAVGIMSYYMADRKHRKAFLEARQSLEVKMNLEEQSQQQENLMLSILPKHVADEMLKDMKKDESQKDQQQFNTMYMYRHENVSILFADIVGFTQLSSACSAQELVKLLNELFARFDKLAAKYHQLRIKILGDCYYCICGLPDYREDHAVCSILMGLAMVEAISYVREKTKTGVDMRVGVHTGTVLGGVLGQKRWQYDVWSTDVTVANKMEAGGIPGRVHISQSTMDCLKGEFDVEPGDGGSRCDYLEEKGIETYLIIASKPEVKKTATQNGLNGSALPNGAPASSKSSSPALIETKEPNGSAHSSGSTSEKPEEQDAQADNPSFPNPRRRLRLQDLADRVVDASEDEHELNQLLNEALLERESAQVVKKRNTFLLSMRFMDPEMETRYSVEKEKQSGAAFSCSCVVLLCTALVEILIDPWLMTNYVTFMVGEILLLILTICSLAAIFPRAFPKKLVAFSTWIDRTRWARNTWAMLAIFILVMANVVDMLSCLQYYTGPSNATAGMETEGSCLENPKYYNYVAVLSLIATIMLVQVSHMVKLTLMLLVAGAVATINLYAWRPVFDEYDHKRFREHDLPMVALEQMQGFNPGLNGTDRLPLVPSKYSMTVMVFLMMLSFYYFSRHVEKLARTLFLWKIEVHDQKERVYEMRRWNEALVTNMLPEHVARHFLGSKKRDEELYSQTYDEIGVMFASLPNFADFYTEESINNGGIECLRFLNEIISDFDSLLDNPKFRVITKIKTIGSTYMAASGVTPDVNTNGFASSNKEDKSERERWQHLADLADFALAMKDTLTNINNQSFNNFMLRIGMNKGGVLAGVIGARKPHYDIWGNTVNVASRMESTGVMGNIQVVEETQVILREYGFRFVRRGPIFVKGKGELLTFFLKGRDKLATFPNGPSVTLPHQVVDNS

SEQ ID NO: 887975 - protein, 325 aa, Homo sapiens
MTALSVAHALPSRLPLVPSKYSMTVMVFLMMLSFYYFSRHVEKLARTLFLWKIEVHDQKERVYEMRRWNEALVTNMLPEHVARHFLGSKKRDEELYSQTYDEIGVMFASLPNFADFYTEESINNGGIECLRFLNEIISDFDSLLDNPKFRVITKIKTIGSTYMAASGVTPDVNTNGFASSNKEDKSERERWQHLADLADFALAMKDTLTNINNQSFNNFMLRIGMNKGGVLAGVIGARKPHYDIWGNTVNVASRMESTGVMGNIQVVEETQVILREYGFRFVRRGPIFVKGKGELLTFFLKGRDKLATFPNGPSVTLPHQVVDNS

SEQ ID NO: 887976 - protein, 176 aa, Homo sapiens
GARYLVCFRVITKIKTIGSTYMAASGVTPDVNTNGFASSNKEDKSERERWQHLADLADFALAMKDTLTNINNQSFNNFMLRIGMNKGGVLAGVIGARKPHYDIWGNTVNVASRMESTGVMGNIQVCPVAQLARAQTRHENKTGTVLSHVPLPPTLALNSKSRGRDVGQVEKNLCNS

SEQ ID NO: 887977 - protein, 1012 aa, Homo sapiens
MPRNQGFSEPEYSAEYSAEYSVSLPSDPDRGVGRTHEISVRNSGSCLCLPRFMRLTFVPESLENLYQTYFKRQRHETLLVLVVFSSDKLAPLAVAGIGLVLDIILFVLCKKGLLPDRVTRRVLPYVLWLLITAQIFSYLGLNFARAHAASDTVGWQVFFVFSFFITLPLSLSPIVIISVVSCVVHTLVLGVTVAQQQQEELKGMQLLREILANVFLYLCAIAVGIMSYYMADRKHRKAFLEARQSLEVKMNLEEQSQQQENLMLSILPKHVADEMLKDMKKDESQKDQQQFNTMYMYRHENVSILFADIVGFTQLSSACSAQELVKLLNELFARFDKLAAKYHQLRIKILGDCYYCICGLPDYREDHAVCSILMGLAMVEAISYVREKTKTGVDMRVGVHTGTVLGGVLGQKRWQYDVWSTDVTVANKMEAGGIPGRVHISQSTMDCLKGEFDVEPGDGGSRCDYLEEKGIETYLIIASKPEVKKTATQNGLNGSALPNGAPASSKSSSPALIETKEPNGSAHSSGSTSEKPEEQDAQADNPSFPNPRRRLRLQDLADRVVDASEDEHELNQLLNEALLERESAQVVKKRNTFLLSMRFMDPEMETRYSVEKEKQSGAAFSCSCVVLLCTALVEILIDPWLMTNYVTFMVGEILLLILTICSLAAIFPRAFPKKLVAFSTWIDRTRWARNTWAMLAIFILVMANVVDMLSCLQYYTGPSNATAGMETEGSCLENPKYYNYVAVLSLIATIMLVQVSHMVKLTLMLLVAGAVATINLYAWRPVFDEYDHKRFREHDLPMVALEQMQGFNPGLNGTDRLPLVPSKYSMTVMVFLMMLSFYYFSRHVEKLARTLFLWKIEVHDQKERVYEMRRWNEALVTNMLPEHVARHFLGSKKRDEELYSQTYDEIGVMFASLPNFADFYTEESINNGGIECLRFLNEIISDFDSLLDNPKFRVITKIKTIGSTYMAASGVTPDVNTNGFASSNKVANPSSQRDEALPPRQEIGSPDLAWGK

SEQ ID NO: 887978 - protein, 1074 aa, Homo sapiens
MPRNQGFSEPEYSAEYSAEYSVSLPSDPDRGVGRTHEISVRNSGSCLCLPRFMRLTFVPESLENLYQTYFKRQRHETLLVLVVFSSDKLAPLAVAGIGLVLDIILFVLCKKGLLPDRVTRRVLPYVLWLLITAQIFSYLGLNFARAHAASDTVGWQVFFVFSFFITLPLSLSPIVIISVVSCVVHTLVLGVTVAQQQQEELKGMQLLREILANVFLYLCAIAVGIMSYYMADRKHRKAFLEARQSLEVKMNLEEQSQQQENLMLSILPKHVADEMLKDMKKDESQKDQQQFNTMYMYRHENVSILFADIVGFTQLSSACSAQELVKLLNELFARFDKLAAKYHQLRIKILGDCYYCICGLPDYREDHAVCSILMGLAMVEAISYVREKTKTGVDMRVGVHTGTVLGGVLGQKRWQYDVWSTDVTVANKMEAGGIPGRVHISQSTMDCLKGEFDVEPGDGGSRCDYLEEKGIETYLIIASKPEVKKTATQNGLNGSALPNGAPASSKSSSPALIETKEPNGSAHSSGSTSEKPEEQDAQADNPSFPNPRRRLRLQDLADRVVDASEDEHELNQLLNEALLERESAQVVKKRNTFLLSMRFMDPEMETRYSVEKEKQSGAAFSCSCVVLLCTALVEILIDPWLMTNYVTFMVGEILLLILTICSLAAIFPRAFPKKLVAFSTWIDRTRWARNTWAMLAIFILVMANVVDMLSCLQYYTGPSNATAGMETEGSCLENPKYYNYVAVLSLIATIMLVQVSHMVKLTLMLLVAGAVATINLYAWRPVFDEYDHKRFREHDLPMVALEQMQGFNPGLNGTDRLPLVPSKYSMTVMVFLMMLSFYYFSRHVEKLARTLFLWKIEVHDQKERVYEMRRWNEALVTNMLPEHVARHFLGSKKRDEELYSQTYDEIGVMFASLPNFADFYTEESINNGGIECLRFLNEIISDFDSLLDNPKFRVITKIKTIGSTYMAASGVTPDVNTNGFASSNKEDKSERERWQHLADLADFALAMKDTLTNINNQSFNNFMLRIGEHTPAGLPRSRLPSHAGAWPTTRRDMRLRTTEAIRVGRFTHSQGKET

SEQ ID NO: 887979 - protein, 715 aa, Homo sapiens
MPRNQGFSEPEYSAEYSAEYSVSLPSDPDRGVGRTHEISVRNSGSCLCLPRFMRLTFVPESLENLYQTYFKRQRHETLLVLVVFSSDKLAPLAVAGIGLVLDIILFVLCKKGLLPDRVTRRVLPYVLWLLITAQIFSYLGLNFARAHAASDTVGWQVFFVFSFFITLPLSLSPIVIISVVSCVVHTLVLGVTVAQQQQEELKGMQLLREILANVFLYLCAIAVGIMSYYMADRKHRKAFLEARQSLEVKMNLEEQSQQQENLMLSILPKHVADEMLKDMKKDESQKDQQQFNTMYMYRHENVSILFADIVGFTQLSSACSAQELVKLLNELFARFDKLAAKYHQLRIKILGDCYYCICGLPDYREDHAVCSILMGLAMVEAISYVREKTKTGVDMRVGVHTGTVLGGVLGQKRWQYDVWSTDVTVANKMEAGGIPGRVHISQSTMDCLKGEFDVEPGDGGSRCDYLEEKGIETYLIIASKPEVKKTATQNGLNGSALPNGAPASSKSSSPALIETKEPNGSAHSSGSTSEKPEEQDAQADNPSFPNPRRRLRLQDLADRVVDASEDEHELNQLLNEALLERESAQVVKKRNTFLLSMRFMDPEMETRYSVEKEKQSGAAFSCSCVVLLCTALVEILIDPWLMTNYVTFMVGEILLLILTICSLAAIFPRAFPKKLVAFSTWIDRTRWARNTWAMLAIFILVMANVVDMVSSCCPC

SEQ ID NO: 887980 - protein, 1144 aa, Homo sapiens; identical to SEQ ID NO: 887974

SEQ ID NO: 887981 - protein, 745 aa, Homo sapiens
MPRNQGFSEPEYSAEYSAEYSVSLPSDPDRGVGRTHEISVRNSGSCLCLPRFMRLTFVPESLENLYQTYFKRQRHETLLVLVVFAALFDCYVVVMCAVVFSSDKLAPLAVAGIGLVLDIILFVLCKKGLLPDRVTRRVLPYVLWLLITAQIFSYLGLNFARAHAASDTVGWQVFFVFSFFITLPLSLSPIVIISVVSCVVHTLVLGVTVAQQQQEELKGMQLLREILANVFLYLCAIAVGIMSYYMADRKHRKAFLEARQSLEVKMNLEEQSQQQENLMLSILPKHVADEMLKDMKKDESQKDQQQFNTMYMYRHENVSILFADIVGFTQLSSACSAQELVKLLNELFARFDKLAAKYHQLRIKILGDCYYCICGLPDYREDHAVCSILMGLAMVEAISYVREKTKTGVDMRVGVHTGTVLGGVLGQKRWQYDVWSTDVTVANKMEAGGIPGRVHISQSTMDCLKGEFDVEPGDGGSRCDYLEEKGIETYLIIASKPEVKKTATQNGLNGSALPNGAPASSKSSSPALIETKEPNGSAHSSGSTSEKPEEQDAQADNPSFPNPRRRLRLQDLADRVVDASEDEHELNQLLNEALLERESAQVVKKRNTFLLSMRFMDPEMETRYSVEKEKQSGAAFSCSCVVLLCTALVEILIDPWLMTNYVTFMVGEILLLILTICSLAAIFPRAFPKKLVAFSTWIDRTRWARNTWAMLAIFILVMANVVDMAHAARRRRRGHHQPLCLASRL

SEQ ID NO: 887982 - protein, 1092 aa, Homo sapiens
MPRNQGFSEPEYSAEYSAEYSVSLPSDPDRGVGRTHEISVRNSGSCLCLPRFMRLTFVPESLENLYQTYFKRQRHETLLVLVVFSSDKLAPLAVAGIGLVLDIILFVLCKKGLLPDRVTRRVLPYVLWLLITAQIFSYLGLNFARAHAASDTVGWQVFFVFSFFITLPLSLSPIVIISVVSCVVHTLVLGVTVAQQQQEELKGMQLLREILANVFLYLCAIAVGIMSYYMADRKHRKAFLEARQSLEVKMNLEEQSQQQENLMLSILPKHVADEMLKDMKKDESQKDQQQFNTMYMYRHENVSILFADIVGFTQLSSACSAQELVKLLNELFARFDKLAAKYHQLRIKILGDCYYCICGLPDYREDHAVCSILMGLAMVEAISYVREKTKTGVDMRVGVHTGTVLGGVLGQKRWQYDVWSTDVTVANKMEAGGIPGRVHISQSTMDCLKGEFDVEPGDGGSRCDYLEEKGIETYLIIASKPEVKKTATQNGLNGSALPNGAPASSKSSSPALIETKEPNGSAHSSGSTSEKPEEQDAQADNPSFPNPRRRLRLQDLADRVVDASEDEHELNQLLNEALLERESAQVVKKRNTFLLSMRFMDPEMETRYSVEKEKQSGAAFSCSCVVLLCTALVEILIDPWLMTNYVTFMVGEILLLILTICSLAAIFPRAFPKKLVAFSTWIDRTRWARNTWAMLAIFILVMANVVDMLSCLQYYTGPSNATAGMETEGSCLENPKYYNYVAVLSLIATIMLVQVSHMVKLTLMLLVAGAVATINLYAWRPVFDEYDHKRFREHDLPMVALEQMQGFNPGLNGTDRLPLVPSKYSMTVMVFLMMLSFYYFSRHVEKLARTLFLWKIEVHDQKERVYEMRRWNEALVTNMLPEHVARHFLGSKKRDEELYSQTYDEIGVMFASLPNFADFYTEESINNGGIECLRFLNEIISDFDSLLDNPKFRVITKIKTIGSTYMAASGVTPDVNTNGFASSNKEDKSERERWQHLADLADFALAMKDTLTNINNQSFNNFMLRIGMNKGGVLAGVIGARKPHYDIWGNTVNVASRMESTGVMGNIQWRLAEKLHERGKGTEEQAVAVSRW

SEQ ID NO: 887983 - protein, 404 aa, Homo sapiens
METEGSCLENPKYYNYVAVLSLIATIMLVQVSHMVKLTLMLLVAGAVATINLYAWRPVFDEYDHKRFREHDLPMVALEQMQGFNPGLNGTDRLPLVPSKYSMTVMVFLMMLSFYYFSRHVEKLARTLFLWKIEVHDQKERVYEMRRWNEALVTNMLPEHVARHFLGSKKRDEELYSQTYDEIGVMFASLPNFADFYTEESINNGGIECLRFLNEIISDFDSLLDNPKFRVITKIKTIGSTYMAASGVTPDVNTNGFASSNKEDKSERERWQHLADLADFALAMKDTLTNINNQSFNNFMLRIGMNKGGVLAGVIGARKPHYDIWGNTVNVASRMESTGVMGNIQVVEETQVILREYGFRFVRRGPIFVKGKGELLTFFLKGRDKLATFPNGPSVTLPHQVVDNS

SEQ ID NO: 887984 - protein, 295 aa, Homo sapiens
MLSFYYFSRHVEKLARTLFLWKIEVHDQKERVYEMRRWNEALVTNMLPEHVARHFLGSKKRDEELYSQTYDEIGVMFASLPNFADFYTEESINNGGIECLRFLNEIISDFDSLLDNPKFRVITKIKTIGSTYMAASGVTPDVNTNGFASSNKEDKSERERWQHLADLADFALAMKDTLTNINNQSFNNFMLRIGMNKGGVLAGVIGARKPHYDIWGNTVNVASRMESTGVMGNIQVVEETQVILREYGFRFVRRGPIFVKGKGELLTFFLKGRDKLATFPNGPSVTLPHQVVDNS

SEQ ID NO: 887985 - protein, 98 aa, Homo sapiens
QRWAASRVVSTVMTETYDLAYSDVDITQASRAARYAFRFHLQSLPSLPLRGPDHCEQEGGRAGTKLPLPLGFPGLWREHRRGSSTSDRAWWGRTWLPF

SEQ ID NO: 887986 - protein, 936 aa, Homo sapiens
MPRNQGFSEPEYSAEYSAEYSVSLPSDPDRGVGRTHEISVRNSGSCLCLPRFMRLTFVPESLENLYQTYFKRQRHETLLVLVVFSSDKLAPLAVAGIGLVLDIILFVLCKKGLLPDRVTRRVLPYVLWLLITAQIFSYLGLNFARAHAASDTVGWQVFFVFSFFITLPLSLSPIVIISVVSCVVHTLVLGVTVAQQQQEELKGMQLLREILANVFLYLCAIAVGIMSYYMADRKHRKAFLEARQSLEVKMNLEEQSQQQENLMLSILPKHVADEMLKDMKKDESQKDQQQFNTMYMYRHENVSILFADIVGFTQLSSACSAQELVKLLNELFARFDKLAAKYHQLRIKILGDCYYCICGLPDYREDHAVCSILMGLAMVEAISYVREKTKTGVDMRVGVHTGTVLGGVLGQKRWQYDVWSTDVTVANKMEAGGIPGRVHISQSTMDCLKGEFDVEPGDGGSRCDYLEEKGIETYLIIASKPEVKKTATQNGLNGSALPNGAPASSKSSSPALIETKEPNGSAHSSGSTSEKPEEQDAQADNPSFPNPRRRLRLQDLADRVVDASEDEHELNQLLNEALLERESAQVVKKRNTFLLSMRFMDPEMETRYSVEKEKQSGAAFSCSCVVLLCTALVEILIDPWLMTNYVTFMVGEILLLILTICSLAAIFPRAFPKKLVAFSTWIDRTRWARNTWAMLAIFILVMANVVDMLSCLQYYTGPSNATAGMETEGSCLENPKYYNYVAVLSLIATIMLVQVSHMVKLTLMLLVAGAVATINLYAWRPVFDEYDHKRFREHDLPMVALEQMQGFNPGLNGTDRLPLVPSKYSMTVMVFLMMLSFYYFSRHVSAACTIPALCPQPTGPPEKQPWDLRAQAPKEWGFPSPSPTREPGQATAFSIQAPSSVTQEDSSSPLPSDPLQDGEGSMGVKVGGDRVKAQTS

SEQ ID NO: 887987 - protein, 106 aa, Homo sapiens
IKSFIQLESDCGNSVNITYLRSAGTLLTHATGPHHRPGRQELEGLIIAHCTPERLLPGPVSFILKLSSKGYSKLALIPCTVPGALPHGGYFVAIAGLSLNVALGQS

SEQ ID NO: 887988 - protein, 150 aa, Homo sapiens
MSKISQQNSTPGVNGISVIHTQAHASGLQQVPQLVPAGPGGGGKAVAPSKQSKKSSPMDRNSDEYRQRRERNNMAVKKSRLKSKQKAQDTLQRVNQLKEENERLEAKIKLLTKELSVLKDLFLEHAHNLADNVQSISTENTTADGDNAGQ

SEQ ID NO: 887989 - protein, 150 aa, Homo sapiens; identical to SEQ ID NO: 887988

SEQ ID NO: 887990 - protein, 103 aa, Homo sapiens
MSKISQQNSTPGVNGISVIHTQAHASGLQQVPQLVPAGPGGGGKAVAPSKQSKKSSPMDRNSDEYRQRRERNNMAVKKSRLKSKQKAQDTLQRVNQLKEENGI

SEQ ID NO: 887991 - protein, 150 aa, Homo sapiens; identical to SEQ ID NO: 887988

SEQ ID NO: 887992 - protein, 103 aa, Homo sapiens
AWNLEKWKHCSMHGSPQASVCFEDVAMAFTQEEWEQLDLAQRTLYREVTLETWEHIVSLGLFLSKSDVISQLEQEEDLCRAEQEAPREIWRQTTCHAYRENDI

SEQ ID NO: 887993 - protein, 573 aa, Homo sapiens [sequence omitted]

SEQ ID NO: 887994 - protein, 573 aa, Homo sapiens [sequence omitted]

SEQ ID NO: 887995 - protein, 573 aa, Homo sapiens [sequence omitted]

SEQ ID NO: 887996 - protein, 756 aa, Homo sapiens
MILLALSVSAFCWASFLGGPPDWSSEDLCPLHSGLFRCREEMEARSMLVPPQASVCFEDVAMAFTQEEWEQLDLAQRTLYREVTLETWEHIVSLGLFLSKSDVISQLEQEEDLCRAEQEAPRDWKATLEENRLNSEKDRAREELSHHVEVYRSGPEEPPSLVLGKVQDQSNQLREHQENSLRFMVLTSERLFAQREHCELELGGGYSLPSTLSLLPTTLPTSTGFPKPNSQVKELKQNSAFINHEKNGADGKHCESHQCARAFCQSIYLSKLGNVETGKKNPYEYIVSGDSLNYGSSLCFHGRTFSVKKSDDCKDYGNLFSHSVSLNEQKPVHFGKSQYECDECRETCSESLCLVQTERSGPGETPFRCEERCAAFPMASSFSDCNIIQTTEKPSVCNQCGKSFSCCKLIHQRTHTGEKPFECTQCGKSFSQSYDLVIHQRTHTGEKPYECDLCGKSFTQRSKLITHQRIHTGEKPYQCIECRKSFRWNSNLIVHQRIHTGEKPYECTHCGKSFSQSYELVTHKRTHTGEKPFKCTQCGKSFSQKYDLVVHQRTHTGEKPYECNLCGKSFSQSSKLITHQRIHTGEKPYQCIECGKSFRWNSNLVIHQRIHTGEKPYDCTHCGKSFSQSYQLVAHKRTHTGEKPYECNECGKAFNRSTQLIRHLQIHTGEKPYKCNQCNKAFARSSYLVMHQRTHTGEKPFECSQCGKAFSGSSNLLSHHRIHSGEKPYECSDCGKSFRQRSQLVVHRRTHTGEKP

SEQ ID NO: 887997 - protein, 573 aa, Homo sapiens [sequence omitted]

SEQ ID NO: 887998 - protein, 101 aa, Homo sapiens
TSKMVRYEAGFGEFTVSRVRLERRTRPEPPQVIWACRRNEQGLRGVPHAARPSKGRGLMGSGSLRPQGRGRPVQSGFPCRSARLGLSLSGGSPAAELGRNL

SEQ ID NO: 887999 - protein, 101 aa, Homo sapiens; identical to SEQ ID NO: 887998

SEQ ID NO: 888000 - protein, 106 aa, Homo sapiens
MEARSMLVPPQASVCFEDVAMAFTQEEWEQLDLAQRTLYREVTLETWEHIVSLGLFLSKSDVISQLEQEEDLCRAEQEAPRGTSGLSQVTGVVADGSFRFPVWDFT

SEQ ID NO: 888001 - protein, 101 aa, Homo sapiens; identical to SEQ ID NO: 887998

SEQ ID NO: 888002 - protein, 34 aa, Homo sapiens
MRKLRPGEVKETRSESYSGRSLFSLKKLKYFVKF

SEQ ID NO: 888003 - protein, 715 aa, Homo sapiens [sequence omitted]

SEQ ID NO: 888004 - protein, 715 aa, Homo sapiens [sequence omitted]

SEQ ID NO: 888005 - protein, 573 aa, Homo sapiens [sequence omitted]

SEQ ID NO: 888006 - protein, 715 aa, Homo sapiens [sequence omitted]

SEQ ID NO: 888007 - protein, 573 aa, Homo sapiens [sequence omitted]

SEQ ID NO: 888008 - protein, 505 aa, Homo sapiens
PTYVLGTRLGVSCQSIYLSKLGNVETGKKNPYEYIVSGDSLNYGSSLCFHGRTFSVKKSDDCKDYGNLFSHSVSLNEQKPVHFGKSQYECDECRETCSESLCLVQTERSGPGETPFRCEERCAAFPMASSFSDCNIIQTTEKPSVCNQCGKSFSCCKLIHQRTHTGEKPFECTQCGKSFSQSYDLVIHQRTHTGEKPYECDLCGKSFTQRSKLITHQRIHTGEKPYQCIECRKSFRWNSNLIVHQRIHTGEKPYECTHCGKSFSQSYELVTHKRTHTGEKPFKCTQCGKSFSQKYDLVVHQRTHTGEKPYECNLCGKSFSQSSKLITHQRIHTGEKPYQCIECGKSFRWNSNLVIHQRIHTGEKPYDCTHCGKSFSQSYQLVAHKRTHTGEKPYECNECGKAFNRSTQLIRHLQIHTGEKPYKCNQCNKAFARSSYLVMHQRTHTGEKPFECSQCGKAFSGSSNLLSHHRIHSGEKPYECSDCGKSFRQRSQLVVHRRTHTGEKP

SEQ ID NO: 888009 - protein, 101 aa, Homo sapiens; identical to SEQ ID NO: 887998

SEQ ID NO: 888010 - protein, 108 aa, Homo sapiens
MEARSMLVPPQASVCFEDVAMAFTQEEWEQLDLAQRTLYREVTLETWEHIVSLAGARRGPVQGRAGGPPRNEAQQKAETVQGQKDLRECGQLEPLRSRPEGSERVWPA

SEQ ID NO: 888011 - protein, 139 aa, Homo sapiens
MEARSMLVPPQASVCFEDVAMAFTQEEWEQLDLAQRTLYREVTLETWEHIVSLGLFLSKSDVISQLEQEEDLCRAEQEAPREKGMLPGSFLGLPIEDRFSLLEGCLIQFPQQLPLAQERGPAKSRDGTGPEGSERVWPA

SEQ ID NO: 888012 - protein, 173 aa, Homo sapiens
MLPPPPRQPPPQARAARGAVRLQRPFLRSPLGVLRLLQLLAGAAFWITIATSKYQGPVHFALFVSVLFWLLTLGLYFLTLLGKHELVPVLGSRWLMVNVAHDVLAAALYGAATGIMSDQMQRHSYCNLKDYPLPCAYHAFLAAAVCGGVCHGLYLLSALYGCGRRCQGKQEVA

SEQ ID NO: 888013 - protein, 173 aa, Homo sapiens; identical to SEQ ID NO: 888012

SEQ ID NO: 888014 - protein, 173 aa, Homo sapiens; identical to SEQ ID NO: 888012

SEQ ID NO: 888015 - protein, 173 aa, Homo sapiens; identical to SEQ ID NO: 888012

SEQ ID NO: 888016 - protein, 173 aa, Homo sapiens; identical to SEQ ID NO: 888012

SEQ ID NO: 888017 - protein, 119 aa, Homo sapiens
MRPVDADEAREPREEPGSPLSPAPRAGRENLASLERERARAHWRARRKLLEIQSLLDAIKSEVEAEERGARAPAPRPRAEAEERVARLCAEAERKAAEAARMGRRIVELHQRIAGCECC

SEQ ID NO: 888018 - protein, 119 aa, Homo sapiens; identical to SEQ ID NO: 888017

SEQ ID NO: 888019 - protein, 119 aa, Homo sapiens; identical to SEQ ID NO: 888017

SEQ ID NO: 888020 - protein, 119 aa, Homo sapiens; identical to SEQ ID NO: 888017

SEQ ID NO: 888021 - protein, 119 aa, Homo sapiens; identical to SEQ ID NO: 888017

SEQ ID NO: 888022 - protein, 119 aa, Homo sapiens; identical to SEQ ID NO: 888017

SEQ ID NO: 888023 - protein, 155 aa, Homo sapiens
LLGKRLGAELAEARVVKGPQWQRPGRRLVAHFGYRPRCGKLGQPVASLVVGDSEASALAAGEQPRRAPRAGRGGGVMRPVDADEAREPREEPGSPLSPAPRAGRENLASLERERARAHLLIIALKPSLLQQYVCFSQIIFSPVPHHPSRLSVLIS

SEQ ID NO: 888024 - protein, 195 aa, Homo sapiens
LLGKRLGAELAEARVVKGPQWQRPGRRLVAHFGYRPRCGKLGQPVASLVVGDSEASALAAGEQPRRAPRAGRGGGVMRPVDADEAREPREEPGSPLSPAPRAGRENLASLERERARAHWRARRKLLEIQSLLDAIKSEVEAEERGARAPAPRPRAEAEERVARLCAEAERKAAEAARMGRRIVELHQRIAGCECC

SEQ ID NO: 888025 - protein, 119 aa, Homo sapiens; identical to SEQ ID NO: 888017

SEQ ID NO: 888026 - protein, 119 aa, Homo sapiens; identical to SEQ ID NO: 888017

SEQ ID NO: 888027 - protein, 300 aa, Homo sapiens
MAAAAGDADDEPRSGHSSSEGECAVAPEPLTDAEGLFSFADFGSALGGGGAGLSGRASGGAQSPLRYLHVLWQQDAEPRDELRCKIPAGRLRRAARPHRRLGPTGKEVHALKRLRDSANANDVETVQQLLEDGADPCAADDKGRTALHFASCNGNDQIVQLLLDHGADPNQRDGLGNTPLHLAACTNHVPVITTLLRGGARVDALDRAGRTPLHLAKSKLNILQEGHAQCLEAVRLEVKQIIHMLREYLERLGQHEQRERLDDLCTRLQMTSTKEQVDEVTDLLASFTSLSLQMQSMEKR

SEQ ID NO: 888028 - protein, 241 aa, Homo sapiens
MAAAAGDADDEPRSGHSSSEGECAVAPEPLTDAEGLFSFADFGSALGGGGAGLSGRASGGAQSPLRYLHVLWQQDAEPRDELRCKIPAGRLRRAARPHRRLGPTGKEVHALKRLRDSANANDVETVQQLLEDGADPCAADDKGRTALHFASCNGNDQIVQLLLDHGADPNQRDGLGNTPLHLAACTNHVPVITTLLRGGARVDALDRAGRTPLHLAKSKLNILQEGHAQCLEAVRLEVKQR

SEQ ID NO: 888029 - protein, 300 aa, Homo sapiens; identical to SEQ ID NO: 888027

SEQ ID NO: 888030 - protein, 300 aa, Homo sapiens; identical to SEQ ID NO: 888027

SEQ ID NO: 888031 - protein, 207 aa, Homo sapiens
METSHDSERLLVNNKMALKRLRDSANANDVETVQQLLEDGADPCAADDKGRTALHFASCNGNDQIVQLLLDHGADPNQRDGLGNTPLHLAACTNHVPVITTLLRGGARVDALDRAGRTPLHLAKSKLNILQEGHAQCLEAVRLEVKQIIHMLREYLERLGQHEQRERLDDLCTRLQMTSTKEQVDEVTDLLASFTSLSLQMQSMEKR

SEQ ID NO: 888032 - protein, 197 aa, Homo sapiens
MAAAAGDADDEPRSGHSSSEGECAVAPEPLTDAEGLFSFADFGSALGGGGAGLSGRASGGAQSPLRYLHVLWQQDAEPRDELRCKIPAGRLRRAARPHRRLGPTGKEVHVQQLLEDGADPCAADDKGRTALHFASCNGNDQIVQLLLDHGADPNQRDGLGNTPLHLAACTNHVPVITTLLRGDHPYAEGVSGAPRAT

SEQ ID NO: 888033 - protein, 145 aa, Homo sapiens
MAAAAGDADDEPRSGHSSSEGECAVAPEPLTDAEGLFSFADFGSALGGGGAGLSGRASGGAQSPLRYLHVLWQQDAEPRDELRCKIPAGRLRRAARPHRRLGHLPHGLHGALQASDPSLCSVLAMGLLQSAGVGLGGHPVARGTA

SEQ ID NO: 888034 - protein, 300 aa, Homo sapiens; identical to SEQ ID NO: 888027

SEQ ID NO: 888035 - protein, 300 aa, Homo sapiens; identical to SEQ ID NO: 888027

SEQ ID NO: 888036 - protein, 300 aa, Homo sapiens; identical to SEQ ID NO: 888027

SEQ ID NO: 888037 - protein, 300 aa, Homo sapiens; identical to SEQ ID NO: 888027

SEQ ID NO: 888038 - protein, 285 aa, Homo sapiens
MAAAAGDADDEPRSGHSSSEGECAVAPEPLTDAEGLFSFADFGSALGGGGAGLSGRASGGAQSPLRYLHVLWQQDAEPRDELRCKIPAGRLRRAARPHRRLGPTGKEVHALKRLRDSANANDVETVQQLLEDGADPCAADDKGRTALHFASCNGNDQIVQLLLDHGADPNQRDGLGNTPLHLAACTNHVPVITTLLRGGMWFLPLSVLFLPLTPRMLTSAGTWGPCRCPGPSWSHTPAPGQVKAEYPAGGPCPVPRGCASGGEAEVSTPSVWRPRHQGSTGQMLP

SEQ ID NO: 888039 - protein, 284 aa, Homo sapiens
MAAAAGDADDEPRSGHSSSEGECAVAPEPLTDAEGLFSFADFGSALGGGGAGLSGRASGGAQSPLRYLHVLWQQDAEPRDELRCKIPAGRLRRAARPHRRLGPTGKEVHVQQLLEDGADPCAADDKGRTALHFASCNGNDQIVQLLLDHGADPNQRDGLGNTPLHLAACTNHVPVITTLLRGGARVDALDRAGRTPLHLAKSKLNILQEGHAQCLEAVRLEVKQIIHMLREYLERLGQHEQRERLDDLCTRLQMTSTKEQVDEVTDLLASFTSLSLQMQSMEKR

SEQ ID NO: 888040 - protein, 708 aa, Homo sapiens
MATTAELFEEPFVADEYIERLVWRTPGGGSRGGPEAFDPKRLLEEFVNHIQELQIMDERIQRKVEKLEQQCQKEAKEFAKKVQELQKSNQVAFQHFQELDEHISYVATKVCHLGDQLEGVNTPRQRAVEAQKLMKYFNEFLDGELKSDVFTNSEKIKEAADIIQKLHLIAQELPFDRFSEVKSKIASKYHDLECQLIQEFTSAQRRGEISRMREVAAVLLHFKGYSHCVDVYIKQCQEGAYLRNDIFEDAGILCQRVNKQVGDIFSNPETVLAKLIQNVFEIKLQSFVKEQLEECRKSDAEQYLKNLYDLYTRTTNLSSKLMEFNLGTDKQTFLSKLIKSIFISYLENYIEVETGYLKSRSAMILQRYYDSKNHQKRSIGTGGIQDLKERIRQRTNLPLGPSIDTHGETFLSQEVVVNLLQETKQAFERCHRLSDPSDLPRNAFRIFTILVEFLCIEHIDYALETGLAGIPSSDSRNANLYFLDVVQQANTIFHLFDKQFNDHLMPLISSSPKLSECLQKKKEIIEQMEMKLDTGIDRTLNCMIGQMKHILAAEQKKTDFKPEDENNVLIQYTNACVKVCAYVRKQVEKIKNSMDGKNVDTVLMELGVRFHRLIYEHLQQYSYSCMGGMLAICDVAEYRKCAKDFKIPMVLHLFDTLHALCNLLVVAPDNLKQVCSGEQLANLDKNILHSFVQLRADYRSARLARHFS

SEQ ID NO: 888041 - protein, 708 aa, Homo sapiens; identical to SEQ ID NO: 888040

SEQ ID NO: 888042 - protein, 708 aa, Homo sapiens; identical to SEQ ID NO: 888040

SEQ ID NO: 888043 - protein, 708 aa, Homo sapiens; identical to SEQ ID NO: 888040

SEQ ID NO: 888044 - protein, 708 aa, Homo sapiens; identical to SEQ ID NO: 888040

SEQ ID NO: 888045 - protein, 708 aa, Homo sapiens; identical to SEQ ID NO: 888040

SEQ ID NO: 888046 - protein, 708 aa, Homo sapiens; identical to SEQ ID NO: 888040

SEQ ID NO: 888047 - protein, 156 aa, Homo sapiens
MATTAELFEEPFVADEYIERLVWRTPGGGSRGGPEAFDPKRLLEEFVNHIQELQIMDERIQRKVEKLEQQCQKEAKEFAKKVQELQKSNQVAFQHFQELDEHISYVATKVCHLGDQLEGVNTPRQRAVEAQKLMKYFNEFLDGELKSDVFTNSEKH

SEQ ID NO: 888048 - protein, 161 aa, Homo sapiens
MATTAELFEEPFVADEYIERLVWRTPGGGSRGGPEAFDPKRLLEEFVNHIQELQIMDERIQRKVEKLEQQCQKEAKEFAKKVQELQKSNQVAFQHFQELDEHISYVATKVCHLGDQLEGVNTPRQRAVEAQKLMKYFNEFLDGELKSDVFTNSEKVSAVRG

SEQ ID NO: 888049 - protein, 362 aa, Homo sapiens
MASGSAGKPTGEAASPAPASAIGGASSQPRKRLVSVCDHCKGKMQLVADLLLLSSEARPVLFEGPASSGAGAESFEQCRDTIIARTKGLSILTHDVQSQLNMGRFGEAGDSLVELGDLVVSLTECSAHAAYLAAVATPGAQPAQPGLVDRYRVTRCRHEVEQGCAVLRATPLADMTPQLLLEVSQGLSRNLKFLTDACALASDKSRDRFSREQFKLGVKCMSTSASALLACVREVKVAPSELARSRCALFSGPLVQAVSALVGFATEPQFLGRAAAVSAEGKAVQTAILGGAMSVVSACVLLTQCLRDLAQHPDGGAKMSDHRERLRNSACAVSEGCTLLSQALRERSSPRTLPPVNSNSVN

SEQ ID NO: 888050 - protein, 362 aa, Homo sapiens; identical to SEQ ID NO: 888049

SEQ ID NO: 888051 - protein, 362 aa, Homo sapiens; identical to SEQ ID NO: 888049

SEQ ID NO: 888052 - protein, 102 aa, Homo sapiens
MCAISAGSRPTLTRRGRDSAGHTLCPAAAGAASQELEAGDAPGAAARPREPAPAAVAGKCRLVGSRRLKPTCAAEPEVASSAAADSTARLSCLPRSSPRKGF

SEQ ID NO: 888053 - protein, 1415 aa, Homo sapiens
AAATIRYLKTTMAWKTLPIYLLLLLSVFVIQQVSSQDLSSCAGRCGEGYSRDATCNCDYNCQHYMECCPDFKRVCTAELSCKGRCFESFERGRECDCDAQCKKYDKCCPDYESFCAEVHNPTSPPSSKKAPPPSGASQTIKSTTKRSPKPPNKKKTKKVIESEEITEEHSVSENQESSSSSSSSSSSSTIWKIKSSKNSAANRELQKKLKVKDNKKNRTKKKPTPKPPVVDEAGSGLDNGDFKVTTPDTSTTQHNKVSTSPKITTAKPINPRPSLPPNSDTSKETSLTVNKETTVETKETTTTNKQTSTDGKEKTTSAKETQSIEKTSAKDLAPTSKVLAKPTPKAETTTKGPALTTPKEPTPTTPKEPASTTPKEPTPTTIKSAPTTPKEPAPTTTKSAPTTPKEPAPTTTKEPAPTTPKEPAPTTTKEPAPTTTKSAPTTPKEPAPTTPKKPAPTTPKEPAPTTPKEPTPTTPKEPAPTTKEPAPTTPKEPAPTAPKKPAPTTPKEPAPTTPKEPAPTTTKEPSPTTPKEPAPTTTKSAPTTTKEPAPTTTKSAPTTPKEPSPTTTKEPAPTTPKEPAPTTPKKPAPTTPKEPAPTTPKEPAPTTTKKPAPTAPKEPAPTTPKETAPTTPKKLTPTTPEKLAPTTPEKPAPTTPEELAPTTPEEPTPTTPEEPAPTTPKAAAPNTPKEPAPTTPKEPAPTTPKEPAPTTPKETAPTTPKGTAPTTLKEPAPTTPKKPAPKELAPTTTKEPTSTTSDKPAPTTPKGTAPTTPKEPAPTTPKEPAPTTPKGTAPTTLKEPAPTTPKKPAPKELAPTTTKGPTSTTSDKPAPTTPKETAPTTPKEPAPTTPKKPAPTTPETPPPTTSEVSTPTTTKEPTTIHKSPDESTPELSAEPTPKALENSPKEPGVPTTKTPAATKPEMTTTAKDKTTERDLRTTPETTTAAPKMTKETATTTEKTTESKITATTTQVTSTTTQDTTPFKITTLKTTTLAPKVTTTKKTITTTEIMNKPEETAKPKDRATNSKATTPKPQKPTKAPKKPTSTKKPKTMPRVRKPKTTPTPRKMTSTMPELNPTSRIAEAMLQTTTRPNQTPNSKLVEVNPKSEDAGGAEGETPHMLLRPHVFMPEVTPDMDYLPRVPNQGIIINPMLSDETNICNGKPVDGLTTLRNGTLVAFRGHYFWMLSPFSPPSPARRITEVWGIPSPIDTVFTRCNCEGKTFFFKDSQYWRFTNDIKDAGYPKPIFKGFGGLTGQIVAALSTAKYKNWPESVYFFKRGGSIQQYIYKQEPVQKCPGRRPALNYPVYGETTQVRRRRFERAIGPSQTHTIRIQYSPARLAYQDKGVLHNEVKVSILWRGLPNVVTSAISLPNIRKPDGYDYYAFSKDQYYNIDVPSRTARAITTRSGQTLSKVWYNCP

SEQ ID NO: 888054 - protein, 1371 aa, Homo sapiens
AAATIRYLKTTMAWKTLPIYLLLLLSVFVIQQVSSQDLSSCAGRCGEGYSRDATCNCDYNCQHYMECCPDFKRVCTAELSCKGRCFESFERGRECDCDAQCKKYDKCCPDYESFCAEVHNPTSPPSSKKAPPPSGASQTIKSTTKRSPKPPNKKKTKKVIESEEITEEHSVSENQESSSSSSSSSSSSTIWKIKSSKNSAANRELQKKLKVKDNKKNRTKKKPTPKPPVVDEAGSGLDNGDFKVTTPDTSTTQHNKVSTSPKITTAKPINPRPSLPPNSDTSKETSLTVNKETTVETKETTTTNKQTSTDGKEKTTSAKETQSIEKTSAKDLAPTSKVLAKPTPKAETTTKGPALTTPKEPTPTTPKEPASTTPKEPTPTTIKSAPTTPKEPAPTTTKSAPTTPKEPAPTTTKEPAPTTPKEPAPTTTKEPAPTTTKSAPTTPKEPAPTTPKKPAPTTPKEPAPTTPKEPTPTTPKEPAPTTKEPAPTTPKEPAPTAPKKPAPTTPKEPAPTTPKEPAPTTTKEPSPTTPKEPAPTTTKSAPTTTKEPAPTTTKSAPTTPKEPSPTTTKEPAPTTPKEPAPTTPKKPAPTTPKEPAPTTPKEPAPTTTKKPAPTAPKEPAPTTPKETAPTTPKKLTPTTPEKLAPTTPEKPAPTTPEELAPTTPEEPTPTTPEEPAPTTPKAAAPNTPKEPAPTTPKEPAPTTPKEPAPTTPKETAPTTPKGTAPTTLKEPAPTTPKKPAPKELAPTTTKEPTSTTSDKPAPTTPKGTAPTTPKEPAPTTPKEPAPTTPKGTAPTTLKEPAPTTPKKPAPKELAPTTTKGPTSTTSDKPAPTTPKETAPTTPKEPAPTTPKKPAPTTPETPPPTTSEVSTPTTTKEPTTIHKSPDESTPELSAEPTPKALENSPKEPGVPTTKTPAATKPEMTTTAKDKTTERDLRTTPETTTAAPKMTKETATTTEKTTESKITATTTQVTSTTTQDTTPFKITTLKTTTLAPKVTTTKKTITTTEIMNKPEETAKPKDRATNSKATTPKPQKPTKAPKKPTSTKKPKTMPRVRKPKTTPTPRKMTSTMPELNPTSRIAEAMLQTTTRPNQTPNSKLVEVNPKSEDAGGAEGETPHMLLRPHVFMPEVTPDMDYLPRVPNQGIIINPMLSDETNICNGKPVDGLTTLRNGTLVAFRGHYFWMLSPFSPPSPARRITEVWGIPSPIDTVFTRCNCEGKTFFFKDSQYWRFTNDIKDAGYPKPIFKGFGGLTGQIVAALSTAKYKNWPESVYFFKRGGSIQQYIYKQEPVQKCPGRRPALNYPVYGETTQVRRRRFERAIGPSQTHTIRIQYSPARLAYQDKGNIFIVLKKSLNISRCNTVSYTVRLMKYGY

SEQ ID NO: 888055 - protein, 911 aa, Homo sapiens
AAATIRYLKTTMAWKTLPIYLLLLLSVFVIQQVSSQDLSSCAGRCGEGYSRDATCNCDYNCQHYMECCPDFKRVCTAELSCKGRCFESFERGRECDCDAQCKKYDKCCPDYESFCAEVHNPTSPPSSKKAPPPSGASQTIKSTTKRSPKPPNKKKTKKVIESEEITEEHSVSENQESSSSSSSSSSSSTIWKIKSSKNSAANRELQKKLKVKDNKKNRTKKKPTPKPPVVDEAGSGLDNGDFKVTTPDTSTTQHNKVSTSPKITTAKPINPRPSLPPNSDTSKETSLTVNKETTVETKETTTTNKQTSTDGKEKTTSAKETQSIEKTSAKDLAPTSKVLAKPTPKAETTTKGPALTTPKEPTPTTPKEPASTTPKEPTPTTIKSAPTTPKEPAPTTTKSAPTTPKEPAPTTTKEPAPTTPKEPAPTTTKEPAPTTTKSAPTTPKEPAPTTPKKPAPTTPKEPAPTTPKEPTPTTPKEPAPTTKEPAPTTPKEPAPTAPKKPAPTTPKEPAPTTPKEPAPTTTKEPSPTTPKEPAPTTTKSAPTTTKEPAPTTTKSAPTTPKEPSPTTTKEPAPTTPKEPAPTTPKKPAPTTPKEPAPTTPKEPAPTTTKKPAPTAPKEPAPTTPKETAPTTPKKLTPTTPEKLAPTTPEKPAPTTPEELAPTTPEEPTPTTPEEPAPTTPKAAAPNTPKEPAPTTPKEPAPTTPKEPAPTTPKETAPTTPKGTAPTTLKEPAPTTPKKPAPKELAPTTTKEPTSTTSDKPAPTTPKGTAPTTPKGTAPTTLKEPAPTTPKKPAPKELAPTTTKGPTSTTSDKPAPTTPKETAPTTPKEPAPTTPKKPAPTTPETPPPTTSEVSTPTTTKEPTTIHKSPDESTPELSAEPTPKALENSPKEPGVPTTKTPAATKPEMIQPHK

SEQ ID NO: 888056 - protein, 1371 aa, Homo sapiens; identical to SEQ ID NO: 888054

SEQ ID NO: 888057 - protein, 129 aa, Homo sapiens
MWNCESIKPLSPLNYPVYGETTQVRRRRFERAIGPSQTHTIRIQYSPARLAYQDKGVLHNEVKVSILWRGLPNVVTSAISLPNIRKPDGYDYYAFSKDQYYNIDVPSRTARAITTRSGQTLSKVWYNCP

SEQ ID NO: 888058 - protein, 1183 aa, Homo sapiens
AAATIRYLKTTMAWKTLPIYLLLLLSVFVIQQVSSQDLSSCAGRCGEGYSRDATCNCDYNCQHYMECCPDFKRVCTAELSCKGRCFESFERGRECDCDAQCKKYDKCCPDYESFCAEVHNPTSPPSSKKAPPPSGASQTIKSTTKRSPKPPNKKKTKKVIESEEITEEHSVSENQESSSSSSSSSSSSTIWKIKSSKNSAANRELQKKLKVKDNKKNRTKKKPTPKPPVVDEAGSGLDNGDFKVTTPDTSTTQHNKVSTSPKITTAKPINPRPSLPPNSDTSKETSLTVNKETTVETKETTTTNKQTSTDGKEKTTSAKETQSIEKTSAKDLAPTSKVLAKPTPKAETTTKGPALTTPKEPTPTTPKEPASTTPKEPTPTTIKSAPTTPKEPAPTTTKSAPTTPKEPAPTTTKEPAPTTPKEPAPTTTKEPAPTTTKSAPTTPKEPAPTTPKKPAPTTPKEPAPTTPKEPTPTTPKEPAPTTKEPAPTTPKEPAPTAPKKPAPTTPKEPAPTTPKEPAPTTTKEPSPTTPKEPAPTTTKSAPTTTKEPAPTTTKSAPTTPKEPSPTTTKEPAPTTPKEPAPTTPKKPAPTTPKEPAPTTPKEPAPTTTKKPAPTAPKEPAPTTPKETAPTTPKKLTPTTPEKLAPTTPEKPAPTTPEELAPTTPEEPTPTTPEEPAPTTPKAAAPNTPKEPAPTTPKEPAPTTPKEPAPTTPKETAPTTPKGTAPTTLKEPAPTTPKKPAPKELAPTTTKEPTSTTSDKPAPTTPKGTAPTTPKEPAPTTPKEPAPTTPKGTAPTTLKEPAPTTPKKPAPKELAPTTTKGPTSTTSDKPAPTTPKETAPTTPKEPAPTTPKKPAPTTPETPPPTTSEVSTPTTTKEPTTIHKSPDESTPELSAEPTPKALENSPKEPGVPTTKTPAATKPEMTTTAKDKTTERDLRTTPETTTAAPKMTKETATTTEKTTESKITATTTQVTSTTTQDTTPFKITTLKTTTLAPKVTTTKKTITTTEIMNKPEETAKPKDRATNSKATTPKPQKPTKAPKKPTSTKKPKTMPRVRKPKTTPTPRKMTSTMPELNPTSRIAEAMLQTTTRPNQTPNSKLVEVNPKSEDAGGAEGETPHMLLRPHVFMPEVTPDMDYLPRVPNQGIIINPMLSDETNICNGKPVDGLTTLRNGTLVAFRGHYFRM

SEQ ID NO: 888059 - protein, 911 aa, Homo sapiens; identical to SEQ ID NO: 888055

SEQ ID NO: 888060 - protein, 176 aa, Homo sapiens
RKGGVAGGHFRFRWGGPPCAVMSRFKFIDIGINLTDPMFRGIYRGVQKHQDDLQDVIGRAVEIGVKKFMITGGNLQDSKDALHLAQTNGMFFSTVGCHPTRCGEFEKNNPDLYLKELLNLAENNKGKVVAIGECGLDFDRLQFCPKDTQLKYFEKQFELSEQTKLPMFLHVSKLTC

SEQ ID NO: 888061 - protein, 176 aa, Homo sapiens; identical to SEQ ID NO: 888060

SEQ ID NO: 888062 - protein, 176 aa, Homo sapiens; identical to SEQ ID NO: 888060

SEQ ID NO: 888063 - protein, 99 aa, Homo sapiens
RKGGVAGGHFRFRWGGPPCAVMSRFKFIDIGINLTDPMFRGIYRGVQKHQDDLQDVIGRAVEIGVKKFMITGGNLQDSKDALHLAQTNGILIFLLPKKK

SEQ ID NO: 888064 - protein, 108 aa, Homo sapiens
RTSSIVSRTHLKTEANLEVLKSIPSEKLMIETDAPWCGVKSTHAGSKYIRTAFPTKKKWESGHCLKDRNEPCHIIQILEIMSAVRDEDPLELANTLYNNTIKVFFPGI

SEQ ID NO: 888065 - protein, 176 aa, Homo sapiens; identical to SEQ ID NO: 888060

SEQ ID NO: 888066 - protein, 108 aa, Homo sapiens
MITGGNLQDSKDALHLAQTNGMFFSTVGCHPTRCGEFEKNNPDLYLKELLNLAENNKGKVVAIGECGLDFDRLQFCPKDTQLKYFEKQFELSEQTKLPMFLHVSKLTC

SEQ ID NO: 888067 - protein, 139 aa, Homo sapiens
MFRGIYRGVQKHQDDLQDVIGRAVEIGVKKFMITGGNLQDSKDALHLAQTNGMFFSTVGCHPTRCGEFEKNNPDLYLKELLNLAENNKGKVVAIGECGLDFDRLQFCPKDTQLKYFEKQFELSEQTKLPMFLHVSKLTC

SEQ ID NO: 888068 - protein, 139 aa, Homo sapiens
RKGGVAGGHFRFRWGGPPCAVMSRFKFIDDLQDVIGRAVEIGVKKFMITGGNLQDSKDALHLAQTNDILKNSLNCQNKQNYQCFFMCRNSHAEFLDIMKRNRDRCVGGVVHSFDGTKEAAAALIDLDLYIGFNGCSLEN

SEQ ID NO: 888069 - protein, 176 aa, Homo sapiens; identical to SEQ ID NO: 888060

SEQ ID NO: 888070 - protein, 176 aa, Homo sapiens; identical to SEQ ID NO: 888060

SEQ ID NO: 888071 - protein, 176 aa, Homo sapiens; identical to SEQ ID NO: 888060

SEQ ID NO: 888072 - protein, 176 aa, Homo sapiens; identical to SEQ ID NO: 888060

SEQ ID NO: 888073 - protein, 99 aa, Homo sapiens; identical to SEQ ID NO: 888063

SEQ ID NO: 888074 - protein, 122 aa, Homo sapiens
MHCIWHKQMVSSYFFYQKKNELSNFEEVFLKTASGMFFSTVGCHPTRCGEFEKNNPDLYLKELLNLAENNKGKVVAIGECGLDFDRLQFCPKDTQLKYFEKQFELSEQTKLPMFLHVSKLTC

SEQ ID NO: 888075 - protein, 176 aa, Homo sapiens; identical to SEQ ID NO: 888060

SEQ ID NO: 888076 - protein, 139 aa, Homo sapiens; identical to SEQ ID NO: 888067

SEQ ID NO: 888077 - protein, 108 aa, Homo sapiens; identical to SEQ ID NO: 888066

SEQ ID NO: 888078 - protein, 154 aa, Homo sapiens
RKGGVAGGHFRFRWGGPPCAVMSRFKFIDDLQDVIGRAVEIGVKKFMITGGNLQDSKDALHLAQTNGMFFSTVGCHPTRCGEFEKNNPDLYLKELLNLAENNKGKVVAIGECGLDFDRLQFCPKDTQLKYFEKQFELSEQTKLPMFLHVSKLTC

SEQ ID NO: 888079 - protein, 77 aa, Homo sapiens
RKGGVAGGHFRFRWGGPPCAVMSRFKFIDDLQDVIGRAVEIGVKKFMITGGNLQDSKDALHLAQTNGILIFLLPKKK

SEQ ID NO: 888080 - protein, 116 aa, Homo sapiens
SKDICMIDVGKERNKSAHLKTEANLEVLKSIPSEKLMIETDAPWCGVKSTHAGSKYIRTAFPTKKKWESGHCLKDRNEPCHIIQILEIMSAVRDEDPLELANTLYNNTIKVFFPGI

SEQ ID NO: 888081 - protein, 102 aa, Homo sapiens
MVAHLKTEANLEVLKSIPSEKLMIETDAPWCGVKSTHAGSKYIRTAFPTKKKWESGHCLKDRNEPCHIIQILEIMSAVRDEDPLELANTLYNNTIKVFFPGI

SEQ ID NO: 888082 - protein, 610 aa, Homo sapiens
ASSGRRGEGGWWRLPRSPSLPAVPTPGTMFPAGPPSHSLLRLPLLQLLLLVVQAVGRGLGRASPAGGPLEDVVIERYHIPRACPREVQMGDFVRYHYNGTFEDGKKFDSSYDRNTLVAIVVGVGRLITGMDRGLMGMCVNERRRLIVPPHLGYGSIGLAGLIPPDATLYFDVVLLDVWNKEDTVQVSTLLRPPHCPRMVQDGDFVRYHYNGTLLDGTSFDTSYSKGGTYDTYVGSGWLIKGMDQGLLGMCPGERRKIIIPPFLAYGEKGYGTVIPPQASLVFHVLLIDVHNPKDAVQLETLELPPGCVRRAGAGDFMRYHYNGSLMDGTLFDSSYSRNHTYNTYIGQGYIIPGMDQGLQGACMGERRRITIPPHLAYGENGTGDKIPGSAVLIFNVHVIDFHNPADVVEIRTLSRPSETCNETTKLGDFVRYHYNCSLLDGTQLFTSHDYGAPQEATLGANKVIEGLDTGLQGMCVGERRQLIVPPHLAHGESGARGVPGSAVLLFEVELVSREDGLPTGYLFVWHKDPPANLFEDMDLNKDGEVPPEEFSTFIKAQVSEGKGRLMPGQDPEKTIGDMFQNQDRNQDGKITVDELKLKSDEDEERVHEEL

SEQ ID NO: 888083 - protein, 584 aa, Homo sapiens
KLWYLTCKRRVIPAAHSPSLVLSCAAWEGAWGLGRASPAGGPLEDVVIERYHIPRACPREVQMGDFVRYHYNGTFEDGKKFDSSYDRNTLVAIVVGVGRLITGMDRGLMGMCVNERRRLIVPPHLGYGSIGLAGLIPPDATLYFDVVLLDVWNKEDTVQVSTLLRPPHCPRMVQDGDFVRYHYNGTLLDGTSFDTSYSKGGTYDTYVGSGWLIKGMDQGLLGMCPGERRKIIIPPFLAYGEKGYGTVIPPQASLVFHVLLIDVHNPKDAVQLETLELPPGCVRRAGAGDFMRYHYNGSLMDGTLFDSSYSRNHTYNTYIGQGYIIPGMDQGLQGACMGERRRITIPPHLAYGENGTGDKIPGSAVLIFNVHVIDFHNPADVVEIRTLSRPSETCNETTKLGDFVRYHYNCSLLDGTQLFTSHDYGAPQEATLGANKVIEGLDTGLQGMCVGERRQLIVPPHLAHGESGARGVPGSAVLLFEVELVSREDGLPTGYLFVWHKDPPANLFEDMDLNKDGEVPPEEFSTFIKAQVSEGKGRLMPGQDPEKTIGDMFQNQDRNQDGKITVDELKLKSDEDEERVHEEL

SEQ ID NO: 888084 - protein, 671 aa, Homo sapiens
ASSGRRGEGGWWRLPRSPSLPAVPTPGTMFPAGPPSHSLLRLPLLQLLLLVVQAVGRGLGRASPAGGPLEDVVIERYHIPRACPREVQMGDFVRYHYNGTFEDGKKFDSSYDRNTLVAIVVGVGRLITGMDRGLMGMCVNERRRLIVPPHLGYGSIGLAGLIPPDATLYFDVVLLDVWNKEDTVQVSTLLRPPHCPRMVQDGDFVRYHYNGTLLDGTSFDTSYSKGGTYDTYVGSGWLIKGMDQGLLGMCPGERRKIIIPPFLAYGEKGYGTVIPPQASLVFHVLLIDVHNPKDAVQLETLELPPGCVRRAGAGDFMRYHYNGSLMDGTLFDSSYSRNHTYNTYIGQGYIIPGMDQGLQGACMGERRRITIPPHLAYGENGTDSIGFLQGSAPLRPFRSGEGQPSLGREGGYGKTEPAYPQDPAVLGASVSSPVKWASHADPQGDKIPGSAVLIFNVHVIDFHNPADVVEIRTLSRPSETCNETTKLGDFVRYHYNCSLLDGTQLFTSHDYGAPQEATLGANKVIEGLDTGLQGMCVGERRQLIVPPHLAHGESGARGVPGSAVLLFEVELVSREDGLPTGYLFVWHKDPPANLFEDMDLNKDGEVPPEEFSTFIKAQVSEGKGRLMPGQDPEKTIGDMFQNQDRNQDGKITVDELKLKSDEDEERVHEEL

SEQ ID NO: 888085 - protein, 499 aa, Homo sapiens
PVFIDATSDLRSGRLITGMDRGLMGMCVNERRRLIVPPHLGYGSIGLAGLIPPDATLYFDVVLLDVWNKEDTVQVSTLLRPPHCPRMVQDGDFVRYHYNGTLLDGTSFDTSYSKGGTYDTYVGSGWLIKGMDQGLLGMCPGERRKIIIPPFLAYGEKGYGTVIPPQASLVFHVLLIDVHNPKDAVQLETLELPPGCVRRAGAGDFMRYHYNGSLMDGTLFDSSYSRNHTYNTYIGQGYIIPGMDQGLQGACMGERRRITIPPHLAYGENGTGDKIPGSAVLIFNVHVIDFHNPADVVEIRTLSRPSETCNETTKLGDFVRYHYNCSLLDGTQLFTSHDYGAPQEATLGANKVIEGLDTGLQGMCVGERRQLIVPPHLAHGESGARGVPGSAVLLFEVELVSREDGLPTGYLFVWHKDPPANLFEDMDLNKDGEVPPEEFSTFIKAQVSEGKGRLMPGQDPEKTIGDMFQNQDRNQDGKITVDELKLKSDEDEERVHEEL

SEQ ID NO: 888086 - protein, 752 aa, Homo sapiens
ASSGRRGEGGWWRLPRSPSLPAVPTPGTMFPAGPPSHSLLRLPLLQLLLLVVQAVGRGLGRASPAGGPLEDVVIERYHIPRACPREVQMGDFVRYHYNGTFEDGKKFDSSYDRNTLVAIVVGVGRLITGMDRGLMGMCVNERRRLIVPPHLGYGSIGLAGLIPPDATLYFDVVLLDVWNKEDTVQVSTLLRPPHCPRMVQDGDFVRYHYNGTLLDGTSFDTSYSKGGTYDTYVGSGWLIKGMDQGLLGMCPGERRKIIIPPFLAYGEKGYGTVIPPQASLVFHVLLIDVHNPKDAVQLETLELPPGCVRRAGAGDFMRYHYNGSLMDGTLFDSSYSRNHTYNTYIGQGYIIPGMDQGLQGACMGERRRITIPPHLAYGENGTDSIGFLQGSAPLRPFRSGEGQPSLGREGGYGKTEPAYPQDPAVLGASVSSPVKWASHADPQGKLLGVCKTVVEKGFLTGKLPSPAPCPSESLLELTLDKHPVPSSFGSSGREGVSGLGTSMERPQVASPSALSCPHSPILASGDKIPGSAVLIFNVHVIDFHNPADVVEIRTLSRPSETCNETTKLGDFVRYHYNCSLLDGTQLFTSHDYGAPQEATLGANKVIEGLDTGLQGMCVGERRQLIVPPHLAHGESGARGVPGSAVLLFEVELVSREDGLPTGYLFVWHKDPPANLFEDMDLNKDGEVPPEEFSTFIKAQVSEGKGRLMPGQDPEKTIGDMFQNQDRNQDGKITVDELKLKSDEDEERVHEEL

SEQ ID NO: 888087 - protein, 629 aa, Homo sapiens
ASSGRRGEGGWWRLPRSPSLPAVPTPGTMFPAGPPSHSLLRLPLLQLLLLVVQAVGRGLGRASPAGGPLEDVVIERYHIPRACPREVQMGDFVRYHYNGTFEDGKKFDSSYDRNTLVAIVVGVGRLITGMDRGLMGMCVNERRRLIVPPHLGYGSIGLAGLIPPDATLYFDVVLLDVWNKEDTVQVSTLLRPPHCPRMVQDGDFVRYHYNGTLLDGTSFDTSYSKGGTYDTYVGSGWLIKGMDQGLLGMCPGERRKIIIPPFLAYGEKGYGTVIPPQASLVFHVLLIDVHNPKDAVQLETLELPPGCVRRAGAGDFMRYHYNGSLMDGTLFDSSYSRNHTYNTYIGQGYIIPGMDQGLQGACMGERRRITIPPHLAYGENGTGDKIPGSAVLIFNVHVIDFHNPADVVEIRTLSRPSETCNETTKLGDFVRYHYNCSLLDGTQLFTSGETDAGSHEPSRPHFRGQRHDYGAPQEATLGANKVIEGLDTGLQGMCVGERRQLIVPPHLAHGESGARGVPGSAVLLFEVELVSREDGLPTGYLFVWHKDPPANLFEDMDLNKDGEVPPEEFSTFIKAQVSEGKGRLMPGQDPEKTIGDMFQNQDRNQDGKITVDELKLKSDEDEERVHEEL

SEQ ID NO: 888088 - protein, 137 aa, Homo sapiens [sequence omitted]

SEQ ID NO: 888089 - protein, 142 aa, Homo sapiens
MWRGGMCVGERRQLIVPPHLAHGESGARGVPGSAVLLFEVELVSREDGLPTGYLFVWHKDPPANLFEDMDLNKDGEVPPEEFSTFIKAQVSEGKGRLMPGQDPEKTIGDMFQNQDRNQDGKITVDELKLKSDEDEERVHEEL

SEQ ID NO: 888090 - protein, 631 aa, Homo sapiens
ASSGRRGEGGWWRLPRSPSLPAVPTPGTMFPAGPPSHSLLRLPLLQLLLLVVQAVGRGLGRASPAGGPLEDVVIERYHIPRACPREVQMGDFVRYHYNGTFEDGKKFDSSYDRNTLVAIVVGVGRLITGMDRGLMGMCVNERRRLIVPPHLGYGSIGLAGLIPPDATLYFDVVLLDVWNKEDTVQVSTLLRPPHCPRMVQDGDFVRYHYNGTLLDGTSFDTSYSKGGTYDTYVGSGWLIKGMDQGLLGMCPGERRKIIIPPFLAYGEKGYGTVIPPQASLVFHVLLIDVHNPKDAVQLETLELPPGCVRRAGAGDFMRYHYNGSLMDGTLFDSSYSRNHTYNTYIGQGYIIPGMDQGLQGACMGERRRITIPPHLAYGENGTGDKIPGSAVLIFNVHVIDFHNPADVVEIRTLSRPSETCNETTKLGDFVRYHYNCSLLDGTQLFTSHDYGAPQEATLGANKVIEGLDTGLQGMCVGERRQLIVPPHLAHGESGARGVPGSAVLLFEVELVSREDGLPTGYLFVWHKDPPANLFEDMDLNKDGEVPPEEFSTFIKAQVSEGKGRLMPGQDPEKTIGDMFQNQDRNQDGKITVDELKLKSDEDEERVHEELWSRSQLKQWQRRHLWCSHHPR

SEQ ID NO: 888091 - protein, 610 aa, Homo sapiens; identical to SEQ ID NO: 888082

SEQ ID NO: 888092 - protein, 610 aa, Homo sapiens; identical to SEQ ID NO: 888082

SEQ ID NO: 888093 - protein, 619 aa, Homo sapiens
ASSGRRGEGGWWRLPRSPSLPAVPTPGTMFPAGPPSHSLLRLPLLQLLLLVVQAVGRGLGRASPAGGPLEDVVIERYHIPRACPREVQMGDFVRYHYNGTFEDGKKFDSSYDRNTLVAIVVGVGRLITGMDRGLMGMCVNERRRLIVPPHLGYGSIGLAGLIPPDATLYFDVVLLDVWNKEDTVQVSTLLRPPHCPRMVQDGDFVRYHYNGTLLDGTSFDTSYSKGGTYDTYVGSGWLIKGMDQGLLGMCPGERRKIIIPPFLAYGEKGYGTVIPPQASLVFHVLLIDVHNPKDAVQLETLELPPGCVRRAGAGDFMRYHYNGSLMDGTLFDSSYSRNHTYNTYIGQGYIIPGMDQGLQGACMGERRRITIPPHLAYGENGTGDKIPGSAVLIFNVHVIDFHNPADVVEIRTLSRPSETCNETTKLGDFVRYHYNCSLLDGTQLFTSHDYGAPQEATLGANKVIEGLDTGLQGMCVGERRQLIVPPHLAHGESGARGVPGSAVLLFEVELVSREDGLPTGYLFVWHKDPPANLFEDMDLNKDGEVPPEEFSTFIKAQVSEGKGRLMPGQDPEKTIGDMFQNQDRNQDGKITVDELKLKSDEDEERVHEELCEGSCLGGC

SEQ ID NO: 888094 - protein, 593 aa, Homo sapiens
ASSGRRGEGGWWRLPRSPSLPAVPTPGTMFPAGPPSHSLLRLPLLQLLLLVVQAVGRGLGRASPAGGPLEDVVIERYHIPRACPREVQMGDFVRYHYNGTFEDGKKFDSSYDRNTLVAIVVGVGRLITGMDRGLMGMCVNERRRLIVPPHLGYGSIGLAGLIPPDATLYFDVVLLDVWNKEDTVQVSTLLRPPHCPRMVQDGDFVRYHYNGTLLDGTSFDTSYSKGGTYDTYVGSGWLIKGMDQGLLGMCPGERRKIIIPPFLAYGEKGYGTVIPPQASLVFHVLLIDVHNPKDAVQLETLELPPGCVRRAGAGDFMRYHYNGSLMDGTLFDSSYSRNHTYNTYIGQGYIIPGMDQGLQGACMGERRRITIPPHLAYGENGTGDKIPGSAVLIFNVHVIDFHNPADVVEIRTLSRPSETCNETTKLGDFVRYHYNCSLLDGTQLFTSHDYGAPQEATLGANKVIEGLDTGLQGMCVGERRQLIVPPHLAHGESGARGVPGSAVLLFEVELVSREDGLPTGYLFVWHKDPPANLFEDMDLNKDGEVPPEEFSTFIKAQVSEGKGRLMPGQDPEKTIEERKKTKGMCEGSCLGGC

SEQ ID NO: 888095 - protein, 471 aa, Homo sapiens
ASSGRRGEGGWWRLPRSPSLPAVPTPGTMFPAGPPSHSLLRLPLLQLLLLVVQAVGRGLGRASPAGGPLEDVVIERYHIPRACPREVQMGDFVRYHYNGTFEDGKKFDSSYDRNTLVAIVVGVGRLITGMDRGLMGMCVNERRRLIVPPHLGYGSIGLAGLIPPDATLYFDVVLLDVWNKEDTVQVSTLLRPPHCPRMVQDGDFVRYHYNGTLLDGTSFDTSYSKGGTYDTYVGSGWLIKGMDQGLLGMCPGERRKIIIPPFLAYGEKGYGTVIPPQASLVFHVLLIDVHNPKDAVQLETLELPPGCVRRAGAGDFMRYHYNGSLMDGTLFDSSYSRNHTYNTYIGQGYIIPGMDQGLQGACMGERRRITIPPHLAYGENGTDSIGFLQGSAPLRPFRSGEGQPSLGREGGYGKTEPAYPQDPAVLGASVSSPVKWASHADPQGKLLGVCKTVSGKGLSYWKAAFPCPLPQ

SEQ ID NO: 888096 - protein, 127 aa, Homo sapiens
PCFFLGTHAGCSLPETSHRLSPCHASTPAPTRTPAPVPFPALPELQGAGEPGKKEEKESTHWPPPGAPAPPKAMTLTARSPGSPLPQFSTFIKAQVSEGKGRLMPGQDPEKTIGDMFQNQDRNQDGK

SEQ ID NO: 888097 - protein, 358 aa, Homo sapiens
ASSGRRGEGGWWRLPRSPSLPAVPTPGTMFPAGPPSHSLLRLPLLQLLLLVVQAVGRGLGRASPAGGPLEDVVIERYHIPRACPREVQMGDFVRYHYNGTFEDGKKFDSSYDRNTLVAIVVGVGRLITGMDRGLMGMCVNERRRLIVPPHLGYGSIGLAGLIPPDATLYFDVVLLDVWNKEDTVQVSTLLRPPHCPRMVQDGDFVRYHYNGTLLDGTSFDTSYSKGGTYDTYVGSGWLIKGMDQGLLGMCPGERRKIIIPPFLAYGEKGYGEGGQGHKGKFRRRGKNQASTYSCSGCILHEGIQPRTQGGMKSTLGATKKGCFGRAWWLTLVIPALWEAKAGGSRGQEIETTVKPRLY

SEQ ID NO: 888098 - protein, 575 aa, Homo sapiens
MRPWTGSWRWIMLILFAWGTLLFYIGGHLVRDNDHPDHSSRELSKILAKLERLKQQNEDLRRMAESLRIPEGPIDQGPAIGRVRVLEEQLVKAKEQIENYKKQTRNGLGKDHEILRRRIENGAKELWFFLQSELKKLKNLEGNELQRHADEFLLDLGHHERSIMTDLYYLSQTDGAGDWREKEAKDLTELVQRRITYLQNPKDCSKAKKLVCNINKGCGYGCQLHHVVYCFMIAYGTQRTLILESQNWRYATGGWETVFRPVSETCTDRSGISTGHWSGEVKDKNVQVVELPIVDSLHPRPPYLPLAVPEDLADRLVRVHGDPAVWWVSQFVKYLIRPQPWLEKEIEEATKKLGFKHPVIGVHVRRTDKVGTEAAFHPIEEYMVHVEEHFQLLARRMQVDKKRVYLATDDPSLLKEAKTKYPNYEFISDNSISWSAGLHNRYTENSLRGVILDIHFLSQADFLVCTFSSQVCRVAYEIMQTLHPDASANFHSLDDIYYFGGQNAHNQIAIYAHQPRTADEIPMEPGDIIGVAGNHWDGYSKGVNRKLGRTGLYPSYKVREKIETVKYPTYPEAEK

SEQ ID NO: 888099 - protein, 575 aa, Homo sapiens; identical to SEQ ID NO: 888098

SEQ ID NO: 888100 - protein, 152 aa, Homo sapiens
ARPEQPVPSSPGPLLIPPPPPGPATRPFVSPRNGAGTAQGRAPWTQLALGLALSATARLAPPRALPQSVAPKAPLSGGGGSCFRFFLSVRSGVASSTQPPFPLPHRGAAAAEGCGFGSCDGERRRPPLLPPGVAAFAQRTSMTLMVFLFKIK

SEQ ID NO: 888101 - protein, 446 aa, Homo sapiens
MAITVSLVNNKRKIVVLAQPTTVKRKRITPYKSIMTDLYYLSQTDGAGDWREKEAKDLTELVQRRITYLQNPKDCSKAKKLVCNINKGCGYGCQLHHVVYCFMIAYGTQRTLILESQNWRYATGGWETVFRPVSETCTDRSGISTGHWSGEVKDKNVQVVELPIVDSLHPRPPYLPLAVPEDLADRLVRVHGDPAVWWVSQFVKYLIRPQPWLEKEIEEATKKLGFKHPVIGVHVRRTDKVGTEAAFHPIEEYMVHVEEHFQLLARRMQVDKKRVYLATDDPSLLKEAKTKYPNYEFISDNSISWSAGLHNRYTENSLRGVILDIHFLSQADFLVCTFSSQVCRVAYEIMQTLHPDASANFHSLDDIYYFGGQNAHNQIAIYAHQPRTADEIPMEPGDIIGVAGNHWDGYSKGVNRKLGRTGLYPSYKVREKIETVKYPTYPEAEK

SEQ ID NO: 888102 - protein, 575 aa, Homo sapiens; identical to SEQ ID NO: 888098

SEQ ID NO: 888103 - protein, 308 aa, Homo sapiens
MRPWTGSWRWIMLILFAWGTLLFYIGGHLVRDNDHPDHSSRELSKILAKLERLKQQNEDLRRMAESLRIPEGPIDQGPAIGRVRVLEEQLVKAKEQIENYKKQTRNGLGKDHEILRRRIENGAKELWFFLQSELKKLKNLEGNELQRHADEFLLDLGHHERSIMTDLYYLSQTDGAGDWREKEAKDLTELVQRRITYLQNPKDCSKAKKLVCNINKGCGYGCQLHHVVYCFMIAYGTQRTLILESQNWRYATGGWETVFRPVSETCTDRSGISTGHWSGTPIMNLLVITLFPGQLDCTIDTQKIHFVE

SEQ ID NO: 888104 - protein, 367 aa, Homo sapiens
MRPWTGSWRWIMLILFAWGTLLFYIGGHLVRDNDHPDHSSRELSKILAKLERLKQQNEDLRRMAESLRIPEGPIDQGPAIGRVRVLEEQLVKAKEQIENYKKQTRNGLGKDHEILRRRIENGAKELWFFLQSELKKLKNLEGNELQRHADEFLLDLGHHERSIMTDLYYLSQTDGAGDWREKEAKDLTELVQRRITYLQNPKDCSKAKKLVCNINKGCGYGCQLHHVVYCFMIAYGTQRTLILESQNWRYATGGWETVFRPVSETCTDRSGISTGHWSGEVKDKNVQVVELPIVDSLHPRPPYLPLAVPEDLADRLVRVHGDPAVWWVSQFVNHEAVDHMMELTAIATACVDSDIPACGLCVQSLGF

SEQ ID NO: 888105 - protein, 575 aa, Homo sapiens; identical to SEQ ID NO: 888098

SEQ ID NO: 888106 - protein, 575 aa, Homo sapiens; identical to SEQ ID NO: 888098

SEQ ID NO: 888107 - protein, 575 aa, Homo sapiens; identical to SEQ ID NO: 888098

SEQ ID NO: 888108 - protein, 575 aa, Homo sapiens; identical to SEQ ID NO: 888098

SEQ ID NO: 888109 - protein, 458 aa, Homo sapiens
MRPWTGSWRWIMLILFAWGTLLFYIGGHLVRDNDHPDHSSRELSKILAKLERLKQQNEDLRRMAESLRIPEGPIDQGPAIGRVRVLEEQLVKAKEQIENYKKQTRNGLGKDHEILRRRIENGAKELWFFLQSELKKLKNLEGNELQRHADEFLLDLGHHERSIMTDLYYLSQTDGAGDWREKEAKDLTELVQRRITYLQNPKDCSKAKKLVCNINKGCGYGCQLHHVVYCFMIAYGTQRTLILESQNWRYATGGWETVFRPVSETCTDRSGISTGHWSGEVKDKNVQVVELPIVDSLHPRPPYLPLAVPEDLADRLVRVHGDPAVWWVSQFVKYLIRPQPWLEKEIEEATKKLGFKHPVIGVHVRRTDKVGTEAAFHPIEEYMVHVEEHFQLLARRMQVDKKRVYLATDDPSLLKEAKTKYPNYEFISDNSISWSAGLHNRYTVPSVYFFIPGLSSCL

SEQ ID NO: 888110 - protein, 219 aa, Homo sapiens
LIPPPPPGPATRPFVSPRNGAGTAQGRAPWTQLALGLALSATARLAPPRALPQSVAPKAPLSGGGGSCFRFFLSVRSGVASSTQPPFPLPHRGAAAAEGCGFGSCDGERRRPPLLPPGVRGRFGSRAPRASGSWAGLRAGSEEAPRLSLLVHPGLLLQLLPVNQRLSEKWGGSPRDALADALAQPRGRGQRVRGARLSSRDAELRRCCPRRRASLPRAG

SEQ ID NO: 888111 - protein, 373 aa, Homo sapiens
PRWGLGGPLKRVDWLGVLRSANPDAPGRRGPASSPALWARSAPREGGWMPGSSGAGMEAAVAPGRDAPAPAASQPSGCGKHNSPERKVYMDYNATTPLEPEVIQAMTKAMWEAWGNPSSPYSAGRKAKDIINAARESLAKMIGGKPQDIIFTSGGTESNNLVIHSVVKHFHANQTSKGHTGGHHSPVKGAKPHFITSSVEHDSIRLPLEHLVEEQVAAVTFVPVSKVSGQTEVDDILAAVRPTTRLVTIMLANNETGIVMPVPEISQRIKALNQERVAAGLPPILVHTDAAQALGKQRVDVEDLGVDFLTIVGHKFYGPRIGALYIRGLGEFTPLYPMLFGGGQERNFRPGTENTPMIAGLGKVSPGELEEMS

SEQ ID NO: 888112 - protein, 436 aa, Homo sapiens
PRWGLGGPLKRVDWLGVLRSANPDAPGRRGPASSPALWARSAPREGGWMPGSSGAGMEAAVAPGRDAPAPAASQPSGCGKHNSPERKVYMDYNATTPLEPEVIQAMTKAMWEAWGNPSSPYSAGRKAKDIINAARESLAKMIGGKPQDIIFTSGGTESNNLVIHSVVKHFHANQTSKGHTGGHHSPVKGAKPHFITSSVEHDSIRLPLEHLVEEQVAAVTFVPVSKVSGQTEVDDILAAVRPTTRLVTIMLANNETGIVMPVPEISQRIKALNQERVAAGLPPILVHTDAAQALGKQRVDVEDLGVDFLTIVGHKFYGPRIGALYIRGLGEFTPLYPMLFGGGQERNFRPGTENTPMIAGLGKAAELVTQNCEAYEAHMRDVRDYLEERLEAEFGQKRIHLNSQFPGTQRLPNTCNFSIRGPRLQGDGPSPWSFRV

SEQ ID NO: 888113 - protein, 366 aa, Homo sapiens
PRWGLGGPLKRVDWLGVLRSANPDAPGRRGPASSPALWARSAPREGGWMPGSSGAGMEAAVAPGRDAPAPAASQPSGCGKHNSPERKVYMDYNATTPLEPEVIQAMTKAMWEAWGNPSSPYSAGRKAKDIINAARESLAKMIGGKPQDIIFTSGGTESNNLVIHSVVKHFHANQTSKGHTGGHHSPVKGAKPHFITSSVEHDSIRLPLEHLVEEQVAAVTFVPVSKVSGQTEVDDILAAVRPTTRLVTIMLANNETGIVMPVPEISQRIKALNQERVAAGLPPILVHTDAAQALGKQRVDVEDLGVDFLTIVGHKFYGPRIGALYIRGLGEFTPPASPSLTLFRPLAIRAAHFPVHGPQAFLSCPF

SEQ ID NO: 888114 - protein, 331 aa, Homo sapiens
PRWGLGGPLKRVDWLGVLRSANPDAPGRRGPASSPALWARSAPREGGWMPGSSGAGMEAAVAPGRDAPAPAASQPSGCGKHNSPERKVYMDYNATTPLEPEVIQAMTKAMWEAWGNPSSPYSAGRKAKDIINAARESLAKMIGGKPQDIIFTSGGTESNNLVIHSVVKHFHANQTSKGHTGGHHSPVKGAKPHFITSSVEHDSIRLPLEHLVEEQVAAVTFVPVSKVSGQTEVDDILAAVRPTTRLVTIMLANNETGIVMPVPEISQRIKALNQERVAAGLPPILVHTDAAQALGKQRVDVEDLGVDFLTIVGHKDREHPNDCWPWEGEPW

SEQ ID NO: 888115 - protein, 371 aa, Homo sapiens
REICTSAVRGLLFQYRGGAGMEAAVAPGRDAPAPAASQPSGCGKHNSPERKVYMDYNATTPLEPEVIQAMTKAMWEAWGNPSSPYSAAVTFVPVSKVSGQTEVDDILAAVRPTTRLVTIMLANNETGIVMPVPEISQRIKALNQERVAAGLPPILVHTDAAQALGKQRVDVEDLGVDFLTIVGHKFYGPRIGALYIRGLGEFTPLYPMLFGGGQERNFRPGTENTPMIAGLGKAAELVTQNCEAYEAHMRDVRDYLEERLEAEFGQKRIHLNSQFPGTQRLPNTCNFSIRGPRLQGHVVLAQCRVLMASVGAACHSDHGDQPSPVLLSYGVPFDVARNALRLSVGRSTTRAEVDLVVQDLKQAVAQLEDQA

SEQ ID NO: 888116 - protein, 219 aa, Homo sapiens
PRWGLGGPLKRVDWLGVLRSANPDAPGRRGPASSPALWARSAPREGGWMPGSSGAGMEAAVAPGRDAPAPAASQPSGCGKHNSPERKVYMDYNATTPLEPEVIQAMTKAMWEAWGNPSSPYSAGRKAKDIINAARESLAKMIGGKPQDIIFTSGGTESNNLVIHSVVKHFHANQTSKGHTGGHHSPVKGAKPHFITSSVEHDSIRLPLEHLVEEQVAGE

SEQ ID NO: 888117 - protein, 114 aa, Homo sapiens
REICTSAVRGLLFQYRGGAGMEAAVAPGRDAPAPAASQPSGCGKHNSPERKVYMDYNATTPLEPEVIQAMTKAMWEAWGNPSSPYSAGNSRRCTCSLMGDNGDGALLEKLHTHT

SEQ ID NO: 888118 - protein, 337 aa, Homo sapiens
REICTSAVRGLLFQYRGGAGMEAAVAPGRDAPAPAASQPSGCGKHNSPERKVYMDYNATTPLEPEVIQAMTKAMWEAWGNPSSPYSAGRKAKDIINAARESLAKMIGGKPQDIIFTSGGTESNNLVIHSVVKHFHANQTSKGHTGGHHSPVKGAKPHFITSSVEHDSIRLPLEHLVEEQVAAVTFVPVSKVSGQTEVDDILAAVRPTTRLVTIMLANNETGIVMPVPEISQRIKALNQERVAAGLPPILVHTDAAQALGKQRVDVEDLGVDFLTIVGHKFYGPRIGALYIRGLGEFTPLYPMLFGGGQERNFRPGTENTPMIAGLGKVSPGELEEMS

SEQ ID NO: 888119 - protein, 501 aa, Homo sapiens
PRWGLGGPLKRVDWLGVLRSANPDAPGRRGPASSPALWARSAPREGGWMPGSSGAGMEAAVAPGRDAPAPAASQPSGCGKHNSPERKVYMDYNATTPLEPEVIQAMTKAMWEAWGNPSSPYSAGRKAKDIINAARESLAKMIGGKPQDIIFTSGGTESNNLVIHSVVKHFHANQTSKGHTGGHHSPVKGAKPHFITSSVEHDSIRLPLEHLVEEQVAAVTFVPVSKVSGQTEVDDILAAVRPTTRLVTIMLANNETGIVMPVPEISQRIKALNQERVAAGLPPILVHTDAAQALGKQRVDVEDLGVDFLTIVGHKFYGPRIGALYIRGLGEFTPLYPMLFGGGQERNFRPGTENTPMIAGLGKAAELVTQNCEAYEAHMRDVRDYLEERLEAEFGQKRIHLNSQFPGTQRLPNTCNFSIRGPRLQGHVVLAQCRVLMASVGAACHSDHGDQPSPVLLSYGVPFDVARNALRLSVGRSTTRAEVDLVVQDLKQAVAQLEDQA

SEQ ID NO: 888120 - protein, 463 aa, Homo sapiens
PRWGLGGPLKRVDWLGVLRSANPDAPGRRGPASSPALWARSAPREGGWMPGSSGAGMEAAVAPGRDAPAPAASQPSGCGKHNSPERKVYMDYNATTPLEPEVIQAMTKAMWEAWGNPSSPYSAGRKAKDIINAARESLAKMIGGKPQDIIFTSGGTESNNLVIHSVVKHFHANQTSKGHTGGHHSPVKGAKPHFITSSVEHDSIRLPLEHLVEEQVAAVTFVPVSKVSGQTEVDDILAAVRPTTRLVTIMLANNETGIVMPVPEISQRIKALNQERVAAGLPPILVHTDAAQALGKQRVDVEDLGVDFLTIVGHKFYGPRIGALYIRGLGEFTPLYPMLFGGGQERNFRPGTENTPMIAGLGKAEFGQKRIHLNSQFPGTQRLPNTCNFSIRGPRLQGHVVLAQCRVLMASVGAACHSDHGDQGFFSQNALAFGHTSHVDICIGVIFSGITFLMCGFTVQGTT

SEQ ID NO: 888121 - protein, 531 aa, Homo sapiens
MYECGARVVISVQGWGGDGGGRGAGEGCAGTRGESAQRLRETQLAGEVRAFRAGLGSGRRLSPIVPRGRTKGAPGLWPLSRGASRAGMSARSAKVRDASFKEERVRAVAPQGPTERKVYMDYNATTPLEPEVIQAMTKAMWEAWGNPSSPYSAGRKAKDIINAARESLAKMIGGKPQDIIFTSGGTESNNLVIHSVVKHFHANQTSKGHTGGHHSPVKGAKPHFITSSVEHDSIRLPLEHLVEEQVAAVTFVPVSKVSGQTEVDDILAAVRPTTRLVTIMLANNETGIVMPVPEISQRIKALNQERVAAGLPPILVHTDAAQALGKQRVDVEDLGVDFLTIVGHKFYGPRIGALYIRGLGEFTPLYPMLFGGGQERNFRPGTENTPMIAGLGKAAELVTQNCEAYEAHMRDVRDYLEERLEAEFGQKRIHLNSQFPGTQRLPNTCNFSIRGPRLQGHVVLAQCRVLMASVGAACHSDHGDQPSPVLLSYGVPFDVARNALRLSVGRSTTRAEVDLVVQDLKQAVAQLEDQA

SEQ ID NO: 888122 - protein, 71 aa, Homo sapiens
GERPHRTAHIGPPTWDRPHRTVHMGPPTWQRRIGLPTWDRPHRTAHMDRPHGTAHMGPPTWDRPHRTVLQW

SEQ ID NO: 888123 - protein, 343 aa, Homo sapiens
AERRGRPLAGQRHVAAPAGILGHYLPPAHSPWVGEGSSGREGWRSGADGGSPAQPLPGSVLRPRPAPRPSPSPPAAPARPSVPPPAAPQYAQCTLEGAYEPGAAPAAAAGGADYGFLGSGPAYDFPGVLGRAAFSACLKASADGHPGAFQTASPAPGTYPKSVSPASGLPAAFSTFEWMKVKRNASKKDSGWVLWRRRVPGRIPWSLPRVQIRKMCQALRKFQEGALRGTSPGKLAEYGAASPSSAIRTNFSTKQLTELEKEFHFNKYLTRARRIEIANCLHLNDTQVKIWFQNRRMKQKKREREGLLATAIPVAPLQLPLSGTTPTKFIKNPGSPSQSQEPS

SEQ ID NO: 888124 - protein, 328 aa, Homo sapiens
MSSYLEYVSCSSSGGVGGDVLSLAPKFCRSDARPVALQPAFPLGNGDGAFVSCLPLAAARPSPSPPAAPARPSVPPPAAPQYAQCTLEGAYEPGAAPAAAAGGADYGFLGSGPAYDFPGVLGRAADDGGSHVHYATSAVFSGGGSFLLSGQVDYAAFGEPGPFPACLKASADGHPGAFQTASPAPGTYPKSVSPASGLPAAFSTFEWMKVKRNASKKGKLAEYGAASPSSAIRTNFSTKQLTELEKEFHFNKYLTRARRIEIANCLHLNDTQVKIWFQNRRMKQKKREREGLLATAIPVAPLQLPLSGTTPTKFIKNPGSPSQSQEPS

SEQ ID NO: 888125 - protein, 226 aa, Homo sapiens
MDGSHSAALKLQQLPPTSSSSAVSEASFSYKENLIGALLAIFGHLVVSIALNLQKYCHIRLAGSKDPRAYFKTKTWWLGLFLMLLGELGVFASYAFAPLSLIVPLSAVSVIASAIIGIIFIKEKWKPKDFLRRYVLSFVGCGLAVVGTYLLVTFAPNSHEKMTGENVTRHLVSWPFLLYMLVEIILFCLLLYFYKEKNANNIVVILLLVALLVLLCHPGWSAVVQS

SEQ ID NO: 888126 - protein, 406 aa, Homo sapiens
MDGSHSAALKLQQLPPTSSSSAVSEASFSYKENLIGALLAIFGHLVVSIALNLQKYCHIRLAGSKDPRAYFKTKTWWLGLFLMLLGELGVFASYAFAPLSLIVPLSAVSVIASAIIGIIFIKEKWKPKDFLRRYVLSFVGCGLAVVGTYLLVTFAPNSHEKMTGENVTRHLVSWPFLLYMLVEIILFCLLLYFYKEKNANNIVVILLLVALLGSMTVVTVKAVAGMLVLSIQGNLQLDYPIFYVMFVCMVATAVYQAAFLSQASQMYDSSLIASVGYILSTTIAITAGAIFYLDFIGEDVLHICMFALGCLIAFLGVFLITRNRKKPIPFEPYISMDAMPGMQNMHDKGMTVQPELKASFSYGALENNDNISEIYAPATLPVMQEEHGSRSASGVPYRVLEHTKKE

SEQ ID NO: 888127 - protein, 406 aa, Homo sapiens; identical to SEQ ID NO: 888126

SEQ ID NO: 888128 - protein, 406 aa, Homo sapiens; identical to SEQ ID NO: 888126

SEQ ID NO: 888129 - protein, 321 aa, Homo sapiens
MVLGVFASYAFAPLSLIVPLSAVSVIASAIIGIIFIKEKWKPKDFLRRYVLSFVGCGLAVVGTYLLVTFAPNSHEKMTGENVTRHLVSWPFLLYMLVEIILFCLLLYFYKEKNANNIVVILLLVALLGSMTVVTVKAVAGMLVLSIQGNLQLDYPIFYVMFVCMVATAVYQAAFLSQASQMYDSSLIASVGYILSTTIAITAGAIFYLDFIGEDVLHICMFALGCLIAFLGVFLITRNRKKPIPFEPYISMDAMPGMQNMHDKGMTVQPELKASFSYGALENNDNISEIYAPATLPVMQEEHGSRSASGVPYRVLEHTKKE

SEQ ID NO: 888130 - protein, 406 aa, Homo sapiens; identical to SEQ ID NO: 888126

SEQ ID NO: 888131 - protein, 368 aa, Homo sapiens
MDGSHSAALKLQQLPPTSSSSAVSEASFSYKENLIGALLAIFGHLVVSIALNLQKYCHIRLAGSKDPRAYFKTKTWWLGLFLMLLGELGVFASYAFAPLSLIVPLSAVSVIASAIIGIIFIKEKWKPKDFLRRYVLSFVGCGLAVVGTYLLVTFAPNSHEKMTGENVTRHLVSWPFLLYMLVEIILFCLLLYFYKEKNANNIVVILLLVALLGSMTVVTVKAVAGMLVLSIQGNLQLDYPIFYVMFVCMVATAVYQAAFLSQASQMYDSSLIASVGYILSTTIAITAGAIFYLDFIGEDVLHICMFALGCLIAFLGVFLITRNRKKPIPFEPYISMDAMPDSYLHNRQLLFKRYSNSRNLPHHNLESL

SEQ ID NO: 888132 - protein, 258 aa, Homo sapiens
MDGSHSAALKLQQLPPTSSSSAVSEASFSYKENLIGALLAIFGHLVVSIALNLQKYCHIRLAGSKDPRAYFKTKTWWLGLFLMLLGELGVFASYAFAPLSLIVPLSAVSVIASAIIGIIFIKEKWKPKDFLRRYVLSFVGCGLAVVGTYLLVTFAPNSHEKMTGENVTRHLVSWPFLLYMLVEIILFCLLLYFYKEKNANNIVVILLLVALLGSMTVVTVKAVAGMLVLSIQGNLQLDYPIFYVMFVCMVATAVYQAA

SEQ ID NO: 888133 - protein, 77 aa, Homo sapiens
ILAALNWEGMKEAVPPGCTKSPSHFSEGFDRWALEETPPSTARTGKHTPLCLPGRATEIGTSLSEAEEKAVNLPKQP

SEQ ID NO: 888134 - protein, 406 aa, Homo sapiens; identical to SEQ ID NO: 888126

SEQ ID NO: 888135 - protein, 406 aa, Homo sapiens; identical to SEQ ID NO: 888126

SEQ ID NO: 888136 - protein, 385 aa, Homo sapiens
HVHSCELSLQENLIGALLAIFGHLVVSIALNLQKYCHIRLAGSKDPRAYFKTKTWWLGLFLMLLGELGVFASYAFAPLSLIVPLSAVSVIASAIIGIIFIKEKWKPKDFLRRYVLSFVGCGLAVVGTYLLVTFAPNSHEKMTGENVTRHLVSWPFLLYMLVEIILFCLLLYFYKEKNANNIVVILLLVALLGSMTVVTVKAVAGMLVLSIQGNLQLDYPIFYVMFVCMVATAVYQAAFLSQASQMYDSSLIASVGYILSTTIAITAGAIFYLDFIGEDVLHICMFALGCLIAFLGVFLITRNRKKPIPFEPYISMDAMPGMQNMHDKGMTVQPELKASFSYGALENNDNISEIYAPATLPVMQEEHGSRSASGVPYRVLEHTKKE

SEQ ID NO: 888137 - protein, 192 aa, Homo sapiens [sequence omitted]

SEQ ID NO: 888138 - protein, 378 aa, Homo sapiens
MDGSHSAALKLQQLPPTSSSSAVSEASFSYKENLIGALLAIFGHLVVSIALNLQKYCHIRLAGSKDPRAYFKTKTWWLGLFLMLLGELGVFASYAFAPLSLIVPLSAVSVIASAIIGIIFIKEKWKPKDFLRRYVLSFVGCGLAVVGTYLLVTFAPNSHEKMTGENVTRHLVSWPFLLYMLVEIILFCLLLYFYKEKNANNIVVILLLVALLGSMTVVTVKAVAGMLVLSIQGNLQLDYPIFYVMFVCMVATAVYQAAFLSQASQMYDSSLIASVGYILSTTIAITAGAIFYLDFIGEDVLHICMFALGCLIAFLGVFLITRNRKKPIPFEPYISMDAMPVETSQFDGTVRIQDSIRLVLGNQPGSLPCEFQSCFNTG

SEQ ID NO: 888139 - protein, 1152 aa, Homo sapiens
AGPFSPRADGGGEKSGWAGTKAGSREATGCWGAPDFAGFVGPVEEAPRTDFGRGRAGLSAAMSAKAISEQTGKELLYKFICTTSAIQNRFKYARVTPDTDWARLLQDHPWLLSQNLVVKPDQLIKRRGKLGLVGVNLTLDGVKSWLKPRLGQEATVGKATGFLKNFLIEPFVPHSQAEEFYVCIYATREGDYVLFHHEGGVDVGDVDAKAQKLLVGVDEKLNPEDIKKHLLVHAPEDKKEILASFISGLFNFYEDLYFTYLEINPLVVTKDGVYVLDLAAKVDATADYICKVKWGDIEFPPPFGREAYPEEAYIADLDAKSGASLKLTLLNPKGRIWTMVAGGGASVVYSDTICDLGGVNELANYGEYSGAPSEQQTYDYAKTILSLMTREKHPDGKILIIGGSIANFTNVAATFKGIVRAIRDYQGPLKEHEVTIFVRRGGPNYQEGLRVMGEVGKTTGIPIHVFGTETHMTAIVGMALGHRPIPNQPPTAAHTANFLLNASGSTSTPAPSRTASFSESRADEVAPAKKAKPAMPQGKSTTLFSRHTKAIVWGMQTRAVQGMLDFDYVCSRDEPSVAAMVYPFTGDHKQKFYWGHKEILIPVFKNMADAMRKHPEVDVLINFASLRSAYDSTMETMNYAQIRTIAIIAEGIPEALTRKLIKKADQKGVTIIGPATVGGIKPGCFKIGNTGGMLDNILASKLYRPGSVAYVSRSGGMSNELNNIISRTTDGVYEGVAIGGDRYPGSTFMDHVLRYQDTPGVKMIVVLGEIGGTEEYKICRGIKEGRLTKPIVCWCIGTCATMFSSEVQFGHAGACANQASETAVAKNQALKEAGVFVPRSFDELGEIIQSVYEDLVANGVIVPAQEVPPPTVPMDYSWARELGLIRKPASFMTSICDERGQELIYAGMPITEVFKEEMGIGGVLGLLWFQKRLPKYSCQFIEMCLMVTADHGPAVSGAHNTIICARAGKDLVSSLTSGLLTIGDRFGGALDAAAKMFSKAFDSGIIPMEFVNKMKKEGKLIMGIGHRVKSINNPDMRVQILKDYVRQHFPATPLLDYALEVEKITTSKKPNLILNVDGLIGVAFVDMLRNCGSFTREEADEYIDIGALNGIFVLGRSMGFIGHYLDQKRLKQGLYRHPWDDISYVLPEHMSM

SEQ ID NO: 888140 - protein, 1162 aa, Homo sapiens
AGPFSPRADGGGEKSGWAGTKAGSREATGCWGAPDFAGFVGPVEEAPRTDFGRGRAGLSAAMSAKAISEQTGKELLYKFICTTSAIQNRFKYARVTPDTDWARLLQDHPWLLSQNLVVKPDQLIKRRGKLGLVGVNLTLDGVKSWLKPRLGQEATVGKATGFLKNFLIEPFVPHSQAEEFYVCIYATREGDYVLFHHEGGVDVGDVDAKAQKLLVGVDEKLNPEDIKKHLLVHAPEDKKEILASFISGLFNFYEDLYFTYLEINPLVVTKDGVYVLDLAAKVDATADYICKVKWGDIEFPPPFGREAYPEEAYIADLDAKSGASLKLTLLNPKGRIWTMVAGGGASVVYSDTICDLGGVNELANYGEYSGAPSEQQTYDYAKTILSLMTREKHPDGKILIIGGSIANFTNVAATFKGIVRAIRDYQGPLKEHEVTIFVRRGGPNYQEGLRVMGEVGKTTGIPIHVFGTETHMTAIVGMALGHRPIPNQPPTAAHTANFLLNASGSTSTPAPSRTASFSESRADEVAPAKKAKPAMPQDSVPSPRSLQGKSTTLFSRHTKAIVWGMQTRAVQGMLDFDYVCSRDEPSVAAMVYPFTGDHKQKFYWGHKEILIPVFKNMADAMRKHPEVDVLINFASLRSAYDSTMETMNYAQIRTIAIIAEGIPEALTRKLIKKADQKGVTIIGPATVGGIKPGCFKIGNTGGMLDNILASKLYRPGSVAYVSRSGGMSNELNNIISRTTDGVYEGVAIGGDRYPGSTFMDHVLRYQDTPGVKMIVVLGEIGGTEEYKICRGIKEGRLTKPIVCWCIGTCATMFSSEVQFGHAGACANQASETAVAKNQALKEAGVFVPRSFDELGEIIQSVYEDLVANGVIVPAQEVPPPTVPMDYSWARELGLIRKPASFMTSICDERGQELIYAGMPITEVFKEEMGIGGVLGLLWFQKRLPKYSCQFIEMCLMVTADHGPAVSGAHNTIICARAGKDLVSSLTSGLLTIGDRFGGALDAAAKMFSKAFDSGIIPMEFVNKMKKEGKLIMGIGHRVKSINNPDMRVQILKDYVRQHFPATPLLDYALEVEKITTSKKPNLILNVDGLIGVAFVDMLRNCGSFTREEADEYIDIGALNGIFVLGRSMGFIGHYLDQKRLKQGLYRHPWDDISYVLPEHMSM

SEQ ID NO: 888141 - protein, 1162 aa, Homo sapiens; identical to SEQ ID NO: 888140

SEQ ID NO: 888142 - protein, 641 aa, Homo sapiens
SVRQPWPLQVSWGYVFWVHSLCLCPPGKSTTLFSRHTKAIVWGMQTRAVQGMLDFDYVCSRDEPSVAAMVYPFTGDHKQKFYWGHKEILIPVFKNMADAMRKHPEVDVLINFASLRSAYDSTMETMNYAQIRTIAIIAEGIPEALTRKLIKKADQKGVTIIGPATVGGIKPGCFKIGNTGGMLDNILASKLYRPGSVAYVSRSGGMSNELNNIISRTTDGVYEGVAIGGDRYPGSTFMDHVLRYQDTPGVKMIVVLGEIGGTEEYKICRGIKEGRLTKPIVCWCIGTCATMFSSEVQFGHAGACANQASETAVAKNQALKEAGVFVPRSFDELGEIIQSVYEDLVANGVIVPAQEVPPPTVPMDYSWARELGLIRKPASFMTSICDERGQELIYAGMPITEVFKEEMGIGGVLGLLWFQKRLPKYSCQFIEMCLMVTADHGPAVSGAHNTIICARAGKDLVSSLTSGLLTIGDRFGGALDAAAKMFSKAFDSGIIPMEFVNKMKKEGKLIMGIGHRVKSINNPDMRVQILKDYVRQHFPATPLLDYALEVEKITTSKKPNLILNVDGLIGVAFVDMLRNCGSFTREEADEYIDIGALNGIFVLGRSMGFIGHYLDQKRLKQGLYRHPWDDISYVLPEHMSM

SEQ ID NO: 888143 - protein, 1024 aa, Homo sapiens
AGPFSPRADGGGEKSGWAGTKAGSREATGCWGAPDFAGFVGPVEEAPRTDFGRGRAGLSAAMSAKAISEQTGKELLYKFICTTSAIQNRFKYARVTPDTDWARLLQDHPWLLSQNLVVKPDQLIKRRGKLGLVGVNLTLDGVKSWLKPRLGQEATVGKATGFLKNFLIEPFVPHSQAEEFYVCIYATREGDYVLFHHEGGVDVGDVDAKAQKLLVGVDEKLNPEDIKKHLLVHAPEDKKEILASFISGLFNFYEDLYFTYLEINPLVVTKDGVYVLDLAAKVDATADYICKVKWGDIEFPPPFGREAYPEEAYIADLDAKSGASLKLTLLNPKGRIWTMVAGGGASVVYSDTICDLGGVNELANYGEYSGAPSEQQTYDYAKTILSLMTREKHPDGKILIIGGSIANFTNVAATFKGIVRAIRDYQGPLKEHEVTIFVRRGGPNYQEGLRVMGEVGKTTGIPIHVFGTETHMTAIVGMALGHRPIPNQPPTAAHTANFLLNASGSTSTPAPSRTASFSESRADEVAPAKKAKPAMPQDSVPSPRSLQGKSTTLFSRHTKAIVWGMQTRAVQGMLDFDYVCSRDEPSVAAMVYPFTGDHKQKFYWGHKEILIPVFKNMADAMRKHPEVDVLINFASLRSAYDSTMETMNYAQIRTIAIIAEGIPEALTRKLIKKADQKGVTIIGPATVGGIKPGCFKIGNTGGMLDNILASKLYRPGSVAYVSRSGGMSNELNNIISRTTDGVYEGVAIGGDRYPGSTFMDHVLRYQDTPGVKMIVVLGEIGGTEEYKICRGIKEGRLTKPIVCWCIGTCATMFSSEVQFGHAGACANQASETAVAKNQALKEAGVFVPRSFDELGEIIQSVYEDLVANGVIVPAQEVPPPTVPMDYSWARELGLIRKPASFMTSICDERGQELIYAGMPITEVFKEEMGIGGVLGLLWFQKRLPKYSCQFIEMCLMVTADHGPAVSGAHNTIICARAGKDLVSSLTSGLLTIGDRFGGALDAAAKITLPPRKSVQTAGSGACFI

SEQ ID NO: 888144 - protein, 117 aa, Homo sapiens
MRVQILKDYVRQHFPATPLLDYALEVEKITTSKKPNLILNVDGLIGVAFVDMLRNCGSFTREEADEYIDIGALNGIFVLGRSMGFIGHYLDQKRLKQGLYRHPWDDISYVLPEHMSM

SEQ ID NO: 888145 - protein, 146 aa, Homo sapiens
AAAYYYYIPGRSTLIMGIGHRVQSINNPDMRVQILKDYVRQHFPATPLLDYALEVEKITTSKKPNLILNVDGLIGVAFVDMLRNCGSFTREEADEYIDIGALNGIFVLGRSMGFIGHYLDQKRLKQGLYRHPWDDISYVLPEHMSM

SEQ ID NO: 888146 - protein, 1073 aa, Homo sapiens
AGPFSPRADGGGEKSGWAGTKAGSREATGCWGAPDFAGFVGPVEEAPRTDFGRGRAGLSAAMSAKAISEQTGKELLYKFICTTSAIQNRFKYARVTPDTDWARLLQDHPWLLSQNLVVKPDQLIKRRGKLGLVGVNLTLDGVKSWLKPRLGQEATVGKATGFLKNFLIEPFVPHSQAEEFYVCIYATREGDYVLFHHEGGVDVGDVDAKAQKLLVGVDEKLNPEDIKKHLLVHAPEDKKEILASFISGLFNFYEDLYFTYLEINPLVVTKDGVYVLDLAAKVDATADYICKVKWGDIEFPPPFGREAYPEEAYIADLDAKSGASLKLTLLNPKGRIWTMVAGGGASVVYSDTICDLGGVNELANYGEYSGAPSEQQTYDYAKTILSLMTREKHPDGKILIIGGSIANFTNVAATFKGIVRAIRDYQGPLKEHEVTIFVRRGGPNYQEGLRVMGEVGKTTGIPIHVFGTETHMTAIVGMALGHRPIPNQPPTAAHTANFLLNASGSTSTPAPSRTASFSESRADEVAPAKKAKPAMPQDSVPSPRSLQGKSTTLFSRHTKAIVWGMQTRAVQGMLDFDYVCSRDEPSVAAMVYPFTGDHKQKFYWGHKEILIPVFKNMADAMRKHPEVDVLINFASLRSAYDSTMETMNYAQIRTIAIIAEGIPEALTRKLIKKADQKGVTIIGPATVGGIKPGCFKIGNTGGMLDNILASKLYRPGSVAYVSRSGGMSNELNNIISRTTDGVYEGVAIGGDRYPGSTFMDHVLRYQDTPGVKMIVVLGEIGGTEEYKICRGIKEGRLTKPIVCWCIGTCATMFSSEVQFGHAGACANQASETAVAKNQALKEAGVFVPRSFDELGEIIQSVYEDLVANGVIVPAQEVPPPTVPMDYSWARELGLIRKPASFMTSICDERGQELIYAGMPITEVFKEEMGIGGVLGLLWFQKRLPKYSCQFIEMCLMVTADHGPAVSGAHNTIICARAGKDLVSSLTSGLLTIGDRFGGALDAAAKMFSKAFDSGIIPMEFVNKMKKEGKLIMGIGHRVKSVSCYSPKKVGWRPGAVAHACNHSTLGGQGRWIT

SEQ ID NO: 888147 - protein, 701 aa, Homo sapiens
AGPFSPRADGGGEKSGWAGTKAGSREATGCWGAPDFAGFVGPVEEAPRTDFGRGRAGLSAAMSAKAISEQTGKELLYKFICTTSAIQNRFKYARVTPDTDWARLLQDHPWLLSQNLVVKPDQLIKRRGKLGLVGVNLTLDGVKSWLKPRLGQEATVGKATGFLKNFLIEPFVPHSQAEEFYVCIYATREGDYVLFHHEGGVDVGDVDAKAQKLLVGVDEKLNPEDIKKHLLVHAPEDKKEILASFISGLFNFYEDLYFTYLEINPLVVTKDGVYVLDLAAKVDATADYICKVKWGDIEFPPPFGREAYPEEAYIADLDAKSGASLKLTLLNPKGRIWTMVAGGGASVVYSDTICDLGGVNELANYGEYSGAPSEQQTYDYAKTILSLMTREKHPDGKILIIGGSIANFTNVAATFKGIVRAIRDYQGPLKEHEVTIFVRRGGPNYQEGLRVMGEVGKTTGIPIHVFGTETHMTAIVGMALGHRPIPNQPPTAAHTANFLLNASGSTSTPAPSRTASFSESRADEVAPAKKAKPAMPQDSVPSPRSLQGKSTTLFSRHTKAIVWGMQTRAVQGMLDFDYVCSRDEPSVAAMVYPFTGDHKQKFYWGHKEILIPVFKNMADAMRKHPEVDVLINFASLRSAYDSTMETMNYAQIRTIAIIAEGIPEALTRKLIKKADQKGVTIIGPATVSFPSGKPFTFDAIL

SEQ ID NO: 888148 - protein, 829 aa, Homo sapiens
AGPFSPRADGGGEKSGWAGTKAGSREATGCWGAPDFAGFVGPVEEAPRTDFGRGRAGLSAAMSAKAISEQTGKELLYKFICTTSAIQNRFKYARVTPDTDWARLLQDHPWLLSQNLVVKPDQLIKRRGKLGLVGVNLTLDGVKSWLKPRLGQEATVGKATGFLKNFLIEPFVPHSQAEEFYVCIYATREGDYVLFHHEGGVDVGDVDAKAQKLLVGVDEKLNPEDIKKHLLVHAPEDKKEILASFISGLFNFYEDLYFTYLEINPLVVTKDGVYVLDLAAKVDATADYICKVKWGDIEFPPPFGREAYPEEAYIADLDAKSGASLKLTLLNPKGRIWTMVAGGGASVVYSDTICDLGGVNELANYGEYSGAPSEQQTYDYAKTILSLMTREKHPDGKILIIGGSIANFTNVAATFKGIVRAIRDYQGPLKEHEVTIFVRRGGPNYQEGLRVMGEVGKTTGIPIHVFGTETHMTAIVGMALGHRPIPNQPPTAAHTANFLLNASGSTSTPAPSRTASFSESRADEVAPAKKAKPAMPQGKSTTLFSRHTKAIVWGMQTRAVQGMLDFDYVCSRDEPSVAAMVYPFTGDHKQKFYWGHKEILIPVFKNMADAMRKHPEVDVLINFASLRSAYDSTMETMNYAQIRTIAIIAEGIPEALTRKLIKKADQKGVTIIGPATVGGIKPGCFKIGNTGGMLDNILASKLYRPGSVAYVSRSGGMSNELNNIISRTTDGVYEGVAIGGDRYPGLHFPGSCCNAIQDLQESPPHRGSWRTLGGPDGIFHFAGASGGARSLYPSLSRASGVFPCVSLGPVGPPAPFPTPQSVSTRSSPV

SEQ ID NO: 888149 - protein, 472 aa, Homo sapiens
AGPFSPRADGGGEKSGWAGTKAGSREATGCWGAPDFAGFVGPVEEAPRTDFGRGRAGLSAAMSAKAISEQTGKELLYKFICTTSAIQNRFKYARVTPDTDWARLLQDHPWLLSQNLVVKPDQLIKRRGKLGLVGVNLTLDGVKSWLKPRLGQEATVGKATGFLKNFLIEPFVPHSQAEEFYVCIYATREGDYVLFHHEGGVDVGDVDAKAQKLLVGVDEKLNPEDIKKHLLVHAPEDKKEILASFISGLFNFYEDLYFTYLEINPLVVTKDGVYVLDLAAKVDATADYICKVKWGDIEFPPPFGREAYPEEAYIADLDAKSGASLKLTLLNPKGRIWTMVAGGGASVVYSDTICDLGGVNELANYGEYSGAPSEQQTYDYAKTILSLMTREKHPDGKILIIGGSIANFTNVAATFKGIVRAIRDYQGPLKEHEVTIFVRRGGPNYQEGLRVMGEVARTLDVTHCSHKLTFVA

SEQ ID NO: 888150 - protein, 442 aa, Homo sapiens
AGPFSPRADGGGEKSGWAGTKAGSREATGCWGAPDFAGFVGPVEEAPRTDFGRGRAGLSAAMSAKAISEQTGKELLYKFICTTSAIQNRFKYARVTPDTDWARLLQDHPWLLSQNLVVKPDQLIKRRGKLGLVGVNLTLDGVKSWLKPRLGQEATVGKATGFLKNFLIEPFVPHSQAEEFYVCIYATREGDYVLFHHEGGVDVGDVDAKAQKLLVGVDEKLNPEDIKKHLLVHAPEDKKEILASFISGLFNFYEDLYFTYLEINPLVVTKDGVYVLDLAAKVDATADYICKVKWGDIEFPPPFGREAYPEEAYIADLDAKSGASLKLTLLNPKGRIWTMVAGGGASVVYSDTICDLGGVNELANYGEYSGAPSEQQTYDYAKTILSLMTREKHPDGKILIIGGSIANFTNVAATFKVTVATVVQFLGKVVWGKQGRGLESRV

SEQ ID NO: 888151 - protein, 1162 aa, Homo sapiens; identical to SEQ ID NO: 888140

SEQ ID NO: 888152 - protein, 1162 aa, Homo sapiens; identical to SEQ ID NO: 888140

SEQ ID NO: 888153 - protein, 1101 aa, Homo sapiens
MSAKAISEQTGKELLYKFICTTSAIQNRFKYARVTPDTDWARLLQDHPWLLSQNLVVKPDQLIKRRGKLGLVGVNLTLDGVKSWLKPRLGQEATVGKATGFLKNFLIEPFVPHSQAEEFYVCIYATREGDYVLFHHEGGVDVGDVDAKAQKLLVGVDEKLNPEDIKKHLLVHAPEDKKEILASFISGLFNFYEDLYFTYLEINPLVVTKDGVYVLDLAAKVDATADYICKVKWGDIEFPPPFGREAYPEEAYIADLDAKSGASLKLTLLNPKGRIWTMVAGGGASVVYSDTICDLGGVNELANYGEYSGAPSEQQTYDYAKTILSLMTREKHPDGKILIIGGSIANFTNVAATFKGIVRAIRDYQGPLKEHEVTIFVRRGGPNYQEGLRVMGEVGKTTGIPIHVFGTETHMTAIVGMALGHRPIPNQPPTAAHTANFLLNASGSTSTPAPSRTASFSESRADEVAPAKKAKPAMPQDSVPSPRSLQGKSTTLFSRHTKAIVWGMQTRAVQGMLDFDYVCSRDEPSVAAMVYPFTGDHKQKFYWGHKEILIPVFKNMADAMRKHPEVDVLINFASLRSAYDSTMETMNYAQIRTIAIIAEGIPEALTRKLIKKADQKGVTIIGPATVGGIKPGCFKIGNTGGMLDNILASKLYRPGSVAYVSRSGGMSNELNNIISRTTDGVYEGVAIGGDRYPGSTFMDHVLRYQDTPGVKMIVVLGEIGGTEEYKICRGIKEGRLTKPIVCWCIGTCATMFSSEVQFGHAGACANQASETAVAKNQALKEAGVFVPRSFDELGEIIQSVYEDLVANGVIVPAQEVPPPTVPMDYSWARELGLIRKPASFMTSICDERGQELIYAGMPITEVFKEEMGIGGVLGLLWFQKRLPKYSCQFIEMCLMVTADHGPAVSGAHNTIICARAGKDLVSSLTSGLLTIGDRFGGALDAAAKMFSKAFDSGIIPMEFVNKMKKEGKLIMGIGHRVKSINNPDMRVQILKDYVRQHFPATPLLDYALEVEKITTSKKPNLILNVDGLIGVAFVDMLRNCGSFTREEADEYIDIGALNGIFVLGRSMGFIGHYLDQKRLKQGLYRHPWDDISYVLPEHMSM

SEQ ID NO: 888154 - protein, 662 aa, Homo sapiens
SLLISPQTPAPSRTASFSESRADEVAPAKKAKPAMPQDSVPSPRSLQGKSTTLFSRHTKAIVWGMQTRAVQGMLDFDYVCSRDEPSVAAMVYPFTGDHKQKFYWGHKEILIPVFKNMADAMRKHPEVDVLINFASLRSAYDSTMETMNYAQIRTIAIIAEGIPEALTRKLIKKADQKGVTIIGPATVGGIKPGCFKIGNTGGMLDNILASKLYRPGSVAYVSRSGGMSNELNNIISRTTDGVYEGVAIGGDRYPGSTFMDHVLRYQDTPGVKMIVVLGEIGGTEEYKICRGIKEGRLTKPIVCWCIGTCATMFSSEVQFGHAGACANQASETAVAKNQALKEAGVFVPRSFDELGEIIQSVYEDLVANGVIVPAQEVPPPTVPMDYSWARELGLIRKPASFMTSICDERGQELIYAGMPITEVFKEEMGIGGVLGLLWFQKRLPKYSCQFIEMCLMVTADHGPAVSGAHNTIICARAGKDLVSSLTSGLLTIGDRFGGALDAAAKMFSKAFDSGIIPMEFVNKMKKEGKLIMGIGHRVKSINNPDMRVQILKDYVRQHFPATPLLDYALEVEKITTSKKPNLILNVDGLIGVAFVDMLRNCGSFTREEADEYIDIGALNGIFVLGRSMGFIGHYLDQKRLKQGLYRHPWDDISYVLPEHMSM

SEQ ID NO: 888155 - protein, 280 aa, Homo sapiens
SLFPISAQELGLIRKPASFMTSICDERGQELIYAGMPITEVFKEEMGIGGVLGLLWFQKRLPKYSCQFIEMCLMVTADHGPAVSGAHNTIICARAGKDLVSSLTSGLLTIGDRFGGALDAAAKMFSKAFDSGIIPMEFVNKMKKEGKLIMGIGHRVKSINNPDMRVQILKDYVRQHFPATPLLDYALEVEKITTSKKPNLILNVDGLIGVAFVDMLRNCGSFTREEADEYIDIGALNGIFVLGRSMGFIGHYLDQKRLKQGLYRHPWDDISYVLPEHMSM

SEQ ID NO: 888156 - protein, 141 aa, Homo sapiens
LALHGASVLFTGFLKGPSALMALHLLEDALERAVKQHFPATPLLDYALEVEKITTSKKPNLILNVDGLIGVAFVDMLRNCGSFTREEADEYIDIGALNGIFVLGRSMGFIGHYLDQKRLKQGLYRHPWDDISYVLPEHMSM

SEQ ID NO: 888157 - protein, 942 aa, Homo sapiens
AGPFSPRADGGGEKSGWAGTKAGSREATGCWGAPDFAGFVGPVEEAPRTDFGRGRAGLSAAMSAKAISEQTGKELLYKFICTTSAIQNRFKYARVTPDTDWARLLQDHPWLLSQNLVVKPDQLIKRRGKLGLVGVNLTLDGVKSWLKPRLGQEATVGKATGFLKNFLIEPFVPHSQAEEFYVCIYATREGDYVLFHHEGGVDVGDVDAKAQKLLVGVDEKLNPEDIKKHLLVHAPEDKKEILASFISGLFNFYEDLYFTYLEINPLVVTKDGVYVLDLAAKVDATADYICKVKWGDIEFPPPFGREAYPEEAYIADLDAKSGASLKLTLLNPKGRIWTMVAGGGASVVYSDTICDLGGVNELANYGEYSGAPSEQQTYDYAKTILSLMTREKHPDGKILIIGGSIANFTNVAATFKGIVRAIRDYQGPLKEHEVTIFVRRGGPNYQEGLRVMGEVGKTTGIPIHVFGTETHMTAIVGMALGHRPIPNQPPTAAHTANFLLNASGSTSTPAPSRTASFSESRADEVAPAKKAKPAMPQDSVPSPRSLQGKSTTLFSRHTKAIVWGMQTRAVQGMLDFDYVCSRDEPSVAAMVYPFTGDHKQKFYWGHKEILIPVFKNMADAMRKHPEVDVLINFASLRSAYDSTMETMNYAQIRTIAIIAEGIPEALTRKLIKKADQKGVTIIGPATVGGIKPGCFKIGNTGGMLDNILASKLYRPGSVAYVSRSGGMSNELNNIISRTTDGVYEGVAIGGDRYPGSTFMDHVLRYQDTPGVKMIVVLGEIGGTEEYKICRGIKEGRLTKPIVCWCIGTCATMFSSEVQFGHAGACANQASETAVAKNQALKEAGVFVPRSFDELGEIIQSVYEDLVANGVIVPAQEVPPPTVPMDYSWARELGLIRKPASFMTSICDERGQELIYAGMPITEVFKEEMGIGGVLGLLWFQKR

SEQ ID NO: 888158 - protein, 1191 aa, Homo sapiens
MERPLENGDESPDSQGHATDWRFAVCSFRDAWEEEEPASQMHVKDPGPPRPPAGATQDEELQGSPLSRKFQLPPAADESGDAQRGTVESSSVLSEGPGPSGVESLLCPMSSHLSLAQGESDTPGVGLVGDPGPSRAMPSGLSPGALDSDPVGLGDPLSEISKLLEAAPSGSGLPKPADCLLAQDLCWELLASGMATLPGTRDVQGRAVLLLCAHSPAWLQSECSSQELIRLLLYLRSIPRPEVQALGLTVLVDARICAPSSSLFSGLSQLQEAAPGAVYQVLLVGSTLLKEVPSGLQLEQLPSQSLLTHIPTAGLPTSLGGGLPYCHQAWLDFRRRLEALLQNCQAACALLQGAIESVKAVPQPMEPGEVGQLLQQTEVLMQQVLDSPWLAWLQCQGGRELTWLKQEVPEVTLSPDYRTAMDKADELYDRVDGLLHQLTLQSNQRIQALELVQTLEARESGLHQIEVWLQQVGWPALEEAGEPSLDMLLQAQGSFQELYQVAQEQVRQGEKFLQPLTGWEAAELDPPGARFLALRAQLTEFSRALAQRCQRLADAERLFQLFREALTWAEEGQRVLAELEQERPGVVLQQLQLHWTRHPDLPPAHFRKMWALATGLGSEAIRQECRWAWARCQDTWLALDQKLEASLKLPPVGSTASLCVSQVPAAPAHPPLRKAYSFDRNLGQSLSEPACHCHHAATIAACRRPEAGGGALPQASPTVPPPGSSDPRSLNRLQLVLAEMVATEREYVRALEYTMENYFPELDRPDVPQGLRGQRAHLFGNLEKLRDFHCHFFLRELEACTRHPPRVAYAFLRHRVQFGMYALYSKNKPRSDALMSSYGHTFFKDKQQALGDHLDLASYLLKPIQRMGKYALLLQELARACGGPTQELSALREAQSLVHFQLRHGNDLLAMDAIQGCDVNLKEQGQLVRQDEFVVRTGRHKSVRRIFLFEELLLFSKPRHGPTGVDTFAYKRSFKMADLGLTECCGNSNLRFEIWFRRRKARDTFVLQASSLAIKQAWTADISHLLWRQAVHNKEVRMAEMVSMGVGNKAFRDIAPSEEAINDRTVNYVLKCREVRSRASIAVAPFDHDSLYLGASNSLPGDPASCSVLGSLNLHLYRDPALLGLRCPLYPSFPEEAALEAEAELGGQPSLTAEDSEISSQCPSASGSSGSDSSCVSGQALGRGLEDLPCV

SEQ ID NO: 888159 - protein, 1191 aa, Homo sapiens; identical to SEQ ID NO: 888158

SEQ ID NO: 888160 - protein, 1160 aa, Homo sapiens
MERPLENGDESPDSQGHATDWRFAVCSFRDAWEEEEPASQMHVKDPGPPRPPAGATQDEELQGSPLSRKFQLPPAADESGDAQRGTVESSSVLSEGPGPSGVESLLCPMSSHLSLAQGESDTPGVGLVGDPGPSRAMPSGLSPGALDSDPVGLGDPLSEISKLLEAAPSGSGLPKPADCLLAQDLCWELLASGMATLPGTRDVQGRAVLLLCAHSPAWLQSECSSQELIRLLLYLRSIPRPEVQALGLTVLVDARICAPSSSLFSGLSQLQEAAPGAVYQVLLVGSTLLKEVPSGLQLEQLPSQSLLTHIPTAGLPTSLGGGLPYCHQAWLDFRRRLEALLQNCQAACALLQGAIESVKAVPQPMEPGEVGQLLQQTEVLMQQVLDSPWLAWLQCQGGRELTWLKQEVPEVTLSPDYRTAMDKADELYDRVDGLLHQLTLQSNQRIQALELVQTLEARESGLHQIEVWLQQVGWPALEEAGEPSLDMLLQAQGSFQELYQVAQEQVRQGEKFLQPLTGWEAAELDPPGARFLALRAQLTEFSRALAQRCQRLADAERLFQLFREALTWAEEGQRVLAELEQERPGVVLQQLQLHWTRHPDLPPAHFRKMWALATGLGSEAIRQECRWAWARCQDTWLALDQKLEASLKLPPVGSTASLCVSQVPAAPAHPPLRKAYSFDRNLGQSLSEPACHCHHAATIAACRRPEAGGGALPQASPTVPPPGSSDPRSLNRLQLVLAEMVATEREYVRALEYTMENYFPELDRPDVPQGLRGQRAHLFGNLEKLRDFHCHFFLRELEACTRHPPRVAYAFLRHRVQFGMYALYSKNKPRSDALMSSYGHTFFKDKQQALGDHLDLASYLLKPIQRMGKYALLLQELARACGGPTQELSALREAQSLVHFQLRHGNDLLAMDAIQGCDVNLKEQGQLVRQDEFVVRTGRHKSVRRIFLFEELLLFSKPRHGPTGVDTFAYKRSFKMADLGLTECCGNSNLRFEIWFRRRKARDTFVLQASSLAIKQAWTADISHLLWRQAVHNKEVRMAEMVSMGVGNKAFRDIAPSEEAINDRTVNYVLKCREVRSRASIAVAPFDHDSLYLGASNSLPGDPASCSVLGSLNLHLYRDPALLGLRCPLYPSFPEEAALEAEAELGGQPSLSLSPGLDEQ

SEQ ID NO: 888161 - protein, 170 aa, Homo sapiens
MSRSIPLMSTLHPEVRMAEMVSMGVGNKAFRDIAPSEEAINDRTVNYVLKCREVRSRASIAVAPFDHDSLYLGASNSLPGDPASCSVLGSLNLHLYRDPALLGLRCPLYPSFPEEAALEAEAELGGQPSLTAEDSEISSQCPSASGSSGSDSSCVSGQALGRGLEDLPCV

SEQ ID NO: 888162 - protein, 131 aa, Homo sapiens
MERPLENGDESPDSQGHATDWRFAVCSFRDAWEEEEPASQMHVKDPGTRDVQGRAVLLLCAHSPAWLQSECSSQELIRLLLYLRSIPRPEVQALGLTVLVDARICAPSSSLFSGSPLSPVSQLPRGSSTGG

SEQ ID NO: 888163 - protein, 1191 aa, Homo sapiens; identical to SEQ ID NO: 888158

SEQ ID NO: 888164 - protein, 1191 aa, Homo sapiens; identical to SEQ ID NO: 888158

SEQ ID NO: 888165 - protein, 1191 aa, Homo sapiens; identical to SEQ ID NO: 888158

SEQ ID NO: 888166 - protein, 1191 aa, Homo sapiens; identical to SEQ ID NO: 888158

SEQ ID NO: 888167 - protein, 102 aa, Homo sapiens
SEISSQCPSASGSSGSDSSCVSGQALGRGLEDLPCVSAICPIPTSPSPAQAEPVTVTSPSPAQARPLLWVELGVGGPEPFPRHLLGPESGKQAFMPGLALQV

SEQ ID NO: 888168 - protein, 253 aa, Homo sapiens
MGGKNKKHKAPAAAVVRAAVSASRAKSAEAGIAGEAQSKKPVSRPATAAAAAAGSREPRVKQGPKIYSFNSTNDSSGPANLDKSILKVVINNKLEQRIIGVINEHKKQNNDKGMISGRLTAKKLQDLYMALQAFSFKTKDIEDAMTNTLLYGGDLHSALDWLCLNLSDDALPEGFSQEFEEQQPKSRPKFQSPQIQATISPPLQPKTKTYEEDPKSKNCSLQPKRRINGVLAEWFDCDPMEKMKLRDKNGQKI

SEQ ID NO: 888169 - protein, 966 aa, Homo sapiens
MRLLLCRVRVIKSEDDVLGSMPYNLNRRWACKLSTWGATLALYRLVKGQSVHQLLPPTYRDVWLEWSDAEKKREELNKMETNKPRDLFIAKLLNKLKQQQQQQQQHSENKRENSEDPEESWENLVSDEDFSALSLESANVEDLEPVRNLFRKLQSTPKYQKLLKERQQLPVFKHRDSIVETLKRHRVVVVAGETGSGKSTQVPHFLLEDLLLNEWEASKCNIVCTQPRRISAVSLANRVCDELGCENGPGGRNSLCGYQIRMESRACESTRLLYCTTGVLLRKLQEDGLLSNVSHVIVDEVHERSVQSDFLLIILKEILQKRSDLHLILMSATVDSEKFSTYFTHCPILRISGRSYPVEVFHLEDIIEETGFVLEKDSEYCQKFLEEEEEVTINVTSKAGGIKKYQEYIPVQTGAHADLNPFYQKYSSRTQHAILYMNPHKINLDLILELLAYLDKSPQFRNIEGAVLIFLPGLAHIQQLYDLLSNDRRFYSERYKVIALHSILSTQDQAAAFTLPPPGVRKIVLATNIAETGITIPDVVFVIDTGRTKENKYHESSQMSSLVETFVSKASALQRQGRAGRVRDGFCFRMYTRERFEGFMDYSVPEILRVPLEELCLHIMKCNLGSPEDFLSKALDPPQLQVISNAMNLLRKIGACELNEPKLTPLGQHLAALPVNVKIGKMLIFGAIFGCLDPVATLAAVMTEKSPFTTPIGRKDEADLAKSALAMADSDHLTIYNAYLGWKKARQEGGYRSEITYCRRNFLNRTSLLTLEDVKQELIKLVKAAGFSSSTTSTSWEGNRASQTLSFQEIALLKAVLVAGLYDNVGKIIYTKSVDVTEKLACIVETAQGKAQVHPSSVNRDLQTHGWLLYQEKIRYARVYLRETTLITPFPVLLFGGDIEVQHRERLLSIDGWIYFQAPVKIAVIFKQLRVLIDSVLRKKLENPKMSLENDKILQIITELIKTENN

SEQ ID NO: 888170 - protein, 966 aa, Homo sapiens; identical to SEQ ID NO: 888169

SEQ ID NO: 888171 - protein, 966 aa, Homo sapiens; identical to SEQ ID NO: 888169

SEQ ID NO: 888172 - protein, 419 aa, Homo sapiens [sequence omitted]

SEQ ID NO: 888173 - protein, 86 aa, Homo sapiens
TFYLSRWKKARQEGGYRSEITYCRRNFLNRTSLLTLEAPVKIAVIFKQLRVLIDSVLRKKLENPKMSLENDKILQIITELIKTENN

SEQ ID NO: 888174 - protein, 1370 aa, Homo sapiens
MGGKNKKHKAPAAAVVRAAVSASRAKSAEAGIAGEAQSKKPVSRPATAAAAAAGSREPRVKQGPKIYSFNSTNDSSGPANLDKSILKVVINNKLEQRIIGVINEHKKQNNDKGMISGRLTAKKLQDLYMALQAFSFKTKDIEDAMTNTLLYGGDLHSALDWLCLNLSDDALPEGFSQEFEEQQPKSRPKFQSPQIQATISPPLQPKTKTYEEDPKSKPKKEEKNMEVNMKEWILRYAEQQNEEEKNENSKSLEEEEKFDPNERYLHLAAKLLDAKEQAATFKLEKNKQGQKEAQEKIRKFQREMETLEDHPVFNPAMKISHQQNERKKPPVATEGESALNFNLFEKSAAATEEEKDKKKEPHDVRNFDYTARSWTGKSPKQFLIDWVRKNLPKSPNPSFEKVPVGRYWKCRVRVIKSEDDVLGSMPYNLNRRWACKLSTWGATLALYRLVKGQSVHQLLPPTYRDVWLEWSDAEKKREELNKMETNKPRDLFIAKLLNKLKQQQQQQQQHSENKRENSEDPEESWENLVSDEDFSALSLESANVEDLEPVRNLFRKLQSTPKYQKLLKERQQLPVFKHRDSIVETLKRHRVVVVAGETGSGKSTQVPHFLLEDLLLNEWEASKCNIVCTQPRRISAVSLANRVCDELGCENGPGGRNSLCGYQIRMESRACESTRLLYCTTGVLLRKLQEDGLLSNVSHVIVDEVHERSVQSDFLLIILKEILQKRSDLHLILMSATVDSEKFSTYFTHCPILRISGRSYPVEVFHLEDIIEETGFVLEKDSEYCQKFLEEEEEVTINVTSKAGGIKKYQEYIPVQTGAHADLNPFYQKYSSRTQHAILYMNPHKINLDLILELLAYLDKSPQFRNIEGAVLIFLPGLAHIQQLYDLLSNDRRFYSERYKVIALHSILSTQDQAAAFTLPPPGVRKIVLATNIAETGITIPDVVFVIDTGRTKENKYHESSQMSSLVETFVSKASALQRQGRAGRVRDGFCFRMYTRERFEGFMDYSVPEILRVPLEELCLHIMKCNLGSPEDFLSKALDPPQLQVISNAMNLLRKIGACELNEPKLTPLGQHLAALPVNVKIGKMLIFGAIFGCLDPVATLAAVMTEKSPFTTPIGRKDEADLAKSALAMADSDHLTIYNAYLGWKKARQEGGYRSEITYCRRNFLNRTSLLTLEDVKQELIKLVKAAGFSSSTTSTSWEGNRASQTLSFQEIALLKAVLVAGLYDNVGKIIYTKSVDVTEKLACIVETAQGKAQVHPSSVNRDLQTHGWLLYQEKIRYARVYLRETTLITPFPVLLFGGDIEVQHRERLLSIDGWIYFQAPVKIAVIFKQLRVLIDSVLRKKLENPKMSLENDKILQIITELIKTENN

SEQ ID NO: 888175 - protein, 966 aa, Homo sapiens; identical to SEQ ID NO: 888169

SEQ ID NO: 888176 - protein, 113 aa, Homo sapiens
PVGRGQVSAGLACGKALELGTGPPDEVAVCSHTHTHTHTHTHTGSRPRIEAAQKLLPGFFSSELVLSQTPSSQGTRISNESWKPSHSFPQSEEAVVMSPSPTGFPTRRGLGPR

SEQ ID NO: 888177 - protein, 105 aa, Homo sapiens
FCDKNQEQDDDKRGKSTATFDCGTHATHTHTHTHTGSRPRIEAAQKLLPGFFSSELVLSQTPSSQGTRISNESWKPSHSFPQSEEAVVMSPSPTGFPTRRGLGPR

SEQ ID NO: 888178 - protein, 134 aa, Homo sapiens
MGPWLSRECSKQPACRPSLTNDEHFLGSALDTETSVFTPASIMVFGASRARGLSGGKRTGPDLPELTGPPRWVWDILEALHLSLDRGPGGAWNVAKKKVTQGMSVFYPSAWVGFSKIIICRRKASIYDAICNYI

SEQ ID NO: 888179 - protein, 125 aa, Homo sapiens
MEARPSPPRSHAPDATATAGARSSLGCFSIWICIPSLGRESSGPLVMSQEEWGLGALLSVSVRPQTLHLALKSHSYLGPLPVVPPSPPCPAKSPACPPLSILPPLPLPPVETVFLSVCPFGPDPA

SEQ ID NO: 888180 - protein, 113 aa, Homo sapiens; identical to SEQ ID NO: 888176

SEQ ID NO: 888181 - protein, 113 aa, Homo sapiens; identical to SEQ ID NO: 888176

SEQ ID NO: 888182 - protein, 399 aa, Homo sapiens
MERKNPSRESPRRLSAKVGKGTEMKKVARQLGMAAAESDKDSGFSDGSSECLSSAEQMESEDMLSALGWSREDRPRQNSKTAKNAFPTLSPMVVMKNVLVKQGSSSSQLQSWTVQPSFEVISAQPQLLFLHPPVPSPVSPCHTGEKKSDSRNYLPILNSYTKIAPHPGKRGLSLGPEEKGTSGVQKKICTERLGPSLSSSEPTKAGAVPSSPSTPAPPSAKLAEDSALQGVPSLVAGGSPQTLQPVSSSHVAKAPSLTFASPASPVCASDSTLHGLESNSPLSPLSANYSSPLWAAEHLCRSPDIFSEQRQSKHRRFQNTLVVLHKSGLLEITLKTKELIRQNQATQVELDQLKEQTQLFIEATKSRAPQAWAKLQASLTPGSSNTGSDLEAFSDHPAI

SEQ ID NO: 888183 - protein, 576 aa, Homo sapiens
MIVFGWAVFLASRSLGQGLLLTLEEHIAHFLGTGGAATTMGNSCICRDDSGTDDSVDTQQQQAENSAVPTADTRSQPRDPVRPPRRGRGPHEPRRKKQNVDGLVLDTLAVIRTLVDNDQEPPYSMITLHEMAETDEGWLDVVQSLIRVIPLEDPLGPAVITLLLDECPLPTKDALQKLTEILNLNGEVACQDSSHPAKHRNTSAVLGCLAEKLAGPASIGLLSPGILEYLLQCLKLQSHPTVMLFALIALEKFAQTSENKLTISESSISDRLVTLESWANDPDYLKRQVGFCAQWSLDNLFLKEGRQLTYEKVNLSSIRAMLNSNDVSEYLKISPHGLEARCDASSFESVRCTFCVDAGVWYYEVTVVTSGVMQIGWATRDSKFLNHEGYGIGDDEYSCAYDGCRQLIWYNARSKPHIHPCWKEGDTVGFLLDLNEKQMIFFLNGNQLPPEKQVFSSTVSGFFAAASFMSYQQCEFNFGAKPFKYPPSMKFSTFNDYAFLTAEEKIILPRHRRLALLKQVSIRENCCSLCCDEVADTQLKPCGHSDLCMDCALQLETCPLCRKEIVSRIRQISHIS

SEQ ID NO: 888184 - protein, 576 aa, Homo sapiens; identical to SEQ ID NO: 888183

SEQ ID NO: 888185 - protein, 576 aa, Homo sapiens; identical to SEQ ID NO: 888183

SEQ ID NO: 888186 - protein, 325 aa, Homo sapiens [sequence omitted]

SEQ ID NO: 888187 - protein, 117 aa, Homo sapiens
MIVFGWAVFLASRSLGQGLLLTLEEHIAHFLGTGGAATTMGNSCICRDDSGTDDSVDTQQQQAENSAVPTADTRSQPRDPVRPPRRGRGPHEPRRKKQNVDGLVLDTLAVIRTLVDK

SEQ ID NO: 888188 - protein, 576 aa, Homo sapiens; identical to SEQ ID NO: 888183

SEQ ID NO: 888189 - protein, 318 aa, Homo sapiens
LLLLNSRPRRRDRLVTLESWANDPDYLKRQVGFCAQWSLDNLFLKEGRQLTYEKVNLSSIRAMLNSNDVSEYLKISPHGLEARCDASSFESVRCTFCVDAGVWYYEVTVVTSGVMQIGWATRDSKFLNHEGYGIGDDEYSCAYDGCRQLIWYNARSKPHIHPCWKEGDTVGFLLDLNEKQMIFFLNGNQLPPEKQVFSSTVSGFFAAASFMSYQQCEFNFGAKPFKYPPSMKFSTFNDYAFLTAEEKIILPRHRRLALLKQVSIRENCCSLCCDEVADTQLKPCGHSDLCMDCALQLETCPLCRKEIVSRIRQISHIS

SEQ ID NO: 888190 - protein, 214 aa, Homo sapiens
CNGWPDCNGWPECGWATRDSKFLNHEGYGIGDDEYSCAYDGCRQLIWYNARSKPHIHPCWKEGDTVGFLLDLNEKQMIFFLNGNQLPPEKQVFSSTVSGFFAAASFMSYQQCEFNFGAKPFKYPPSMKFSTFNDYAFLTAEEKIILPRHRRLALLKQVSIRENCCSLCCDEVADTQLKPCGHSDLCMDCALQLETCPLCRKEIVSRIRQISHIS

SEQ ID NO: 888191 - protein, 330 aa, Homo sapiens [sequence omitted]

SEQ ID NO: 888192 - protein, 387 aa, Homo sapiens
MEKIEEQFANLHIVKCSLGTKEPTYLLGIDTSKTVQAGKENLVAVLCSNGSIRIYDKERLNVLREFSGYPGLLNGVRFANSCDSVYSACTDGTVKCWDARVAREKPVQLFKGYPSNIFISFDINCNDHIICAGTEKVDDDALLVFWDARMNSQNLSTTKDSLGAYSETHSDDVTQVRFHPSNPNMVVSGSSDGLVNVFDINIDNEEDALVTTCNSISSVSCIGWSGKGYKQIYCMTHDEGFYWWDLNHLDTDEPVTRLNIQDVREVVNMKEDALDYLIGGLYHEKTDTLHVIGGTNKGRIHLMNCSMSGLTHVTSLQGGHAATVRSFCWNVQDDSLLTGGEDAQLLLWKPGAIEKTFTKKESMKIASSVHQRVRVHSNDSYKRRKKQ

SEQ ID NO: 888193 - protein, 387 aa, Homo sapiens; identical to SEQ ID NO: 888192

SEQ ID NO: 888194 - protein, 387 aa, Homo sapiens; identical to SEQ ID NO: 888192

SEQ ID NO: 888195 - protein, 283 aa, Homo sapiens
MEKIEEQFANLHIVKCSLGTKEPTYLLGIDTSKTVQAGKENLVAVLCSNGSIRIYDKERLNVLREFSGYPGLLNGVRFANSCDSVYSACTDGTVKCWDARVAREKPVQLFKGYPSNIFISFDINCNDHIICAGTEKVDDDALLVFWDARMNSQNLSTTKDSLGAYSETHSDDVTQVRFHPSNPNMVVSGSSDGLVNVFDINIDNEEDALVTTCNSISSVSCIGWSGKGYKQIYCMTHDEGFYWWDLNHLDTDEPVTRLNIQDVREVVNMKEDALDYLIGGPCD

SEQ ID NO: 888196 - protein, 135 aa, Homo sapiens
MGQATLRDPPKSQSKAQTSDEGAGSPQGPSSEVRARRGAASGGARCEGRAFHCRWRELACPVGIREEPPPRTPRSAMAEVAIVSAATKTVLTCTTFPSIFPGVPLTLHLRVQQAGFRECSVQKRKNCRESSPSFC

SEQ ID NO: 888197 - protein, 135 aa, Homo sapiens; identical to SEQ ID NO: 888196

SEQ ID NO: 888198 - protein, 135 aa, Homo sapiens; identical to SEQ ID NO: 888196

SEQ ID NO: 888199 - protein, 135 aa, Homo sapiens; identical to SEQ ID NO: 888196

SEQ ID NO: 888200 - protein, 1485 aa, Homo sapiens
MAAPAQPKKIVAPTVSQINAEFVTQLACKYWAPHIKKKSPFDIKVIEDIYEKEIVKSRFAIRKIMLLEFSQYLENYLWMNYSPEVSSKAYLMSICCMVNEKFRENVPAWEIFKKKPDHFPFFFKHILKAALAETDGEFSLHEQTVLLLFLDHCFNSLEVDLIRSQVQQLISLPMWMGLQLARLELELKKTPKLRKFWNLIKKNDEKMDPEAREQAYQERRFLSQLIQKFISVLKSVPLSEPVTMDKVHYCERFIELMIDLEALLPTRRWFNTILDDSHLLVHCYLSNLVRREEDGHLFSQLLDMLKFYTGFEINDQTGNALTENEMTTIHYDRITSLQRAAFAHFPELYDFALSNVAEVDTRESLVKFFGPLSSNTLHQVASYLCLLPTLPKNEDTTFDKEFLLELLVSRHERRISQIQQLNQMPLYPTEKIIWDENIVPTEYYSGEGCLALPKLNLQFLTLHDYLLRNFNLFRLESTYEIRQDIEDSVSRMKPWQSEYGGVVFGGWARMAQPIVAFTVVEVAKPNIGENWPTRVRADVTINLNVRDHIKDEWEGLRKHDVCFLITVRPTKPYGTKFDRRRPFIEQVGLVYVRGCEIQGMLDDKGRVIEDGPEPRPNLRGESRTFRVFLDPNQYQQDMTNTIQNGAEDVYETFNIIMRRKPKENNFKAVLETIRNLMNTDCVVPDWLHDIILGYGDPSSAHYSKMPNQIATLDFNDTFLSIEHLKASFPGHNVKVTVEDPALQIPPFRITFPVRSGKGKKRKDADVEDEDTEEAKTLIVEPHVIPNRGPYPYNQPKRNTIQFTHTQIEAIRAGMQPGLTMVVGPPGTGKTDVAVQIISNIYHNFPEQRTLIVTHSNQALNQLFEKIMALDIDERHLLRLGHGEEELETEKDFSRYGRVNYVLARRIELLEEVKRLQKSLGVPGDASYTCETAGYFFLYQVMSRWEEYISKVKNKGSTLPDVTEVSTFFPFHEYFANAPQPIFKGRSYEEDMEIAEGCFRHIKKIFTQLEEFRASELLRSGLDRSKYLLVKEAKIIAMTCTHAALKRHDLVKLGFKYDNILMEEAAQILEIETFIPLLLQNPQDGFSRLKRWIMIGDHHQLPPVIKNMAFQKYSNMEQSLFTRFVRVGVPTVDLDAQGRARASLCNLYNWRYKNLGNLPHVQLLPEFSTANAGLLYDFQLINVEDFQGVGESEPNPYFYQNLGEAEYVVALFMYMCLLGYPADKISILTTYNGQKHLIRDIINRRCGNNPLIGRPNKVTTVDRFQGQQNDYILLSLVRTRAVGHLRDVRRLVVAMSRARLGLYIFARVSLFQNCFELTPAFSQLTARPLHLHIIPTEPFPTTRKNGERPSHEVQIIKNMPQMANFVYNMYMHLIQTTHHYHQTLLQLPPAMVEEGEEVQNQETELETEEEAMTVQADIIPSPTDTSCRQETPAFQTDTTPSETGATSTPEAIPALSETTPTVVGAVSAPAEANTPQDATSAPEETK

SEQ ID NO: 888201 - protein, 158 aa, Homo sapiens
PVPSRALLRNRLSLNDLSSSSTMARIWDLLFILFTLQLACKYWAPHIKKKSPFDIKVIEDIYEKEIVKSRFAIRKIMLLEFSQYLENYLWMNYSPEVSSKAYLMSICCMVNEKFRENVPAWEVTDLKYFIAFILTHISHYKVAELLLIVVLLEQNFTQ

SEQ ID NO: 888202 - protein, 1467 aa, Homo sapiens
MAAPAQPKKIVAPTVSQINAEFVTQLACKYWAPHIKKKSPFDIKVIEDIYEKEIVKSRFAIRKIMLLEFSQYLENYLWMNYSPEVSSKAYLMSICCMVNEKFRENVPAWEIFKKKPDHFPFFFKHILKAALAETDGEFSLHEQTVLLLFLDHCFNSLEVDLIRSQVQQLISLPMWMGLQLARLELELKKTPKLRKFWNLIKKNDEKMDPEAREQAYQERRFLSQLIQKFISVLKSVPLSEPVTMDKVHYCERFIELMIDLEALLPTRRWFNTILDDSHLLVHCYLSNLVRREEDGHLFSQLLDMLKFYTGFEINDQTGNALTENEMTTIHYDRITSLQRAAFAHFPELYDFALSNVAEVDTRESLVKFFGPLSSNTLHQVASYLCLLPTLPKNEDTTFDKEFLLELLVSRHERRISQIQQLNQMPLYPTEKIIWDENIVPTEYYSGEGCLALPKLNLQFLTLHDYLLRNFNLFRLESTYEIRQDIEDSVSRMKPWQSEYGGVVFGGWARMAQPIVAFTVVEVAKPNIGENWPTRVRADVTINLNVRDHIKDEWEGLRKHDVCFLITVRPTKPYGTKFDRRRPFIEQVGLVYVRGCEIQGMLDDKGRVIEDGPEPRPNLRGESRTFRVFLDPNQYQQDMTNTIQNGAEDVYETFNIIMRRKPKENNFKAVLETIRNLMNTDCVVPDWLHDIILGYGDPSSAHYSKMPNQIATLDFNDTFLSIEHLKASFPGHNVKVTVEDPALQIPPFRITFPVRSGKGKKRKDADVEDEDTEEAKTLIVEPHVIPNRGPYPYNQPKRNTIQFTHTQIEAIRAGMQPGLTMVVGPPGTGKTDVAVQIISNIYHNFPEQRTLIVTHSNQALNQLFEKIMALDIDERHLLRLGHGEEELETEKDFSRYGRVNYVLARRIELLEEVKRLQKSLGVPGDASYTCETAGYFFLYQVMSRWEEYISKVKNKGSTLPDVTEVSTFFPFHEYFANAPQPIFKGRSYEEDMEIAEGCFRHIKKIFTQLEEFRASELLRSGLDRSKYLLVKEAKIIAMTCTHAALKRHDLVKLGFKYDNILMEEAAQILEIETFIPLLLQNPQDGFSRLKRWIMIGDHHQLPPVIKNMAFLPTVDLDAQGRARASLCNLYNWRYKNLGNLPHVQLLPEFSTANAGLLYDFQLINVEDFQGVGESEPNPYFYQNLGEAEYVVALFMYMCLLGYPADKISILTTYNGQKHLIRDIINRRCGNNPLIGRPNKVTTVDRFQGQQNDYILLSLVRTRAVGHLRDVRRLVVAMSRARLGLYIFARVSLFQNCFELTPAFSQLTARPLHLHIIPTEPFPTTRKNGERPSHEVQIIKNMPQMANFVYNMYMHLIQTTHHYHQTLLQLPPAMVEEGEEVQNQETELETEEEAMTVQADIIPSPTDTSCRQETPAFQTDTTPSETGATSTPEAIPALSETTPTVVGAVSAPAEANTPQDATSAPEETK

SEQ ID NO: 888203 - protein, 1485 aa, Homo sapiens; identical to SEQ ID NO: 888200

SEQ ID NO: 888204 - protein, 889 aa, Homo sapiens
MRGMLDDKGRVIEDGPEPRPNLRGESRTFRVFLDPNQYQQDMTNTIQNGAEDVYETFNIIMRRKPKENNFKAVLETIRNLMNTDCVVPDWLHDIILGYGDPSSAHYSKMPNQIATLDFNDTFLSIEHLKASFPGHNVKVTVEDPALQIPPFRITFPVRSGKGKKRKDADVEDEDTEEAKTLIVEPHVIPNRGPYPYNQPKRNTIQFTHTQIEAIRAGMQPGLTMVVGPPGTGKTDVAVQIISNIYHNFPEQRTLIVTHSNQALNQLFEKIMALDIDERHLLRLGHGEEELETEKDFSRYGRVNYVLARRIELLEEVKRLQKSLGVPGDASYTCETAGYFFLYQVMSRWEEYISKVKNKGSTLPDVTEVSTFFPFHEYFANAPQPIFKGRSYEEDMEIAEGCFRHIKKIFTQLEEFRASELLRSGLDRSKYLLVKEAKIIAMTCTHAALKRHDLVKLGFKYDNILMEEAAQILEIETFIPLLLQNPQDGFSRLKRWIMIGDHHQLPPVIKNMAFQKYSNMEQSLFTRFVRVGVPTVDLDAQGRARASLCNLYNWRYKNLGNLPHVQLLPEFSTANAGLLYDFQLINVEDFQGVGESEPNPYFYQNLGEAEYVVALFMYMCLLGYPADKISILTTYNGQKHLIRDIINRRCGNNPLIGRPNKVTTVDRFQGQQNDYILLSLVRTRAVGHLRDVRRLVVAMSRARLGLYIFARVSLFQNCFELTPAFSQLTARPLHLHIIPTEPFPTTRKNGERPSHEVQIIKNMPQMANFVYNMYMHLIQTTHHYHQTLLQLPPAMVEEGEEVQNQETELETEEEAMTVQADIIPSPTDTSCRQETPAFQTDTTPSETGATSTPEAIPALSETTPTVVGAVSAPAEANTPQDATSAPEETK

SEQ ID NO: 888205 - protein, 192 aa, Homo sapiens
MSRARLGLYIFARVSLFQNCFELTPAFSQLTARPLHLHIIPTEPFPTTRKNGERPSHEVQIIKNMPQMANFVYNMYMHLIQTTHHYHQTLLQLPPAMVEEGEEVQNQETELETEEEAMTVQADIIPSPTDTSCRQETPAFQTDTTPSETGATSTPEAIPALSETTPTVVGAVSAPAEANTPQDATSAPEETK

SEQ ID NO: 888206 - protein, 1142 aa, Homo sapiens
MAAPAQPKKIVAPTVSQINAEFVTQLACKYWAPHIKKKSPFDIKVIEDIYEKEIVKSRFAIRKIMLLEFSQYLENYLWMNYSPEVSSKAYLMSICCMVNEKFRENVPAWEIFKKKPDHFPFFFKHILKAALAETDGEFSLHEQTVLLLFLDHCFNSLEVDLIRSQVQQLISLPMWMGLQLARLELELKKTPKLRKFWNLIKKNDEKMDPEAREQAYQERRFLSQLIQKFISVLKSVPLSEPVTMDKVHYCERFIELMIDLEALLPTRRWFNTILDDSHLLVHCYLSNLVRREEDGHLFSQLLDMLKFYTGFEINDQTGNALTENEMTTIHYDRITSLQRAAFAHFPELYDFALSNVAEVDTRESLVKFFGPLSSNTLHQVASYLCLLPTLPKNEDTTFDKEFLLELLVSRHERRISQIQQLNQMPLYPTEKIIWDENIVPTEYYSGEGCLALPKLNLQFLTLHDYLLRNFNLFRLESTYEIRQDIEDSVSRMKPWQSEYGGVVFGGWARMAQPIVAFTVVEVAKPNIGENWPTRVRADVTINLNVRDHIKDEWEGLRKHDVCFLITVRPTKPYGTKFDRRRPFIEQVGLVYVRGCEIQGMLDDKGRVIEDGPEPRPNLRGESRTFRVFLDPNQYQQDMTNTIQNGAEDVYETFNIIMRRKPKENNFKAVLETIRNLMNTDCVVPDWLHDIILGYGDPSSAHYSKMPNQIATLDFNDTFLSIEHLKASFPGHNVKVTVEDPALQIPPFRITFPVRSGKGKKRKDADVEDEDTEEAKTLIVEPHVIPNRGPYPYNQPKRNTIQFTHTQIEAIRAGMQPGLTMVVGPPGTGKTDVAVQIISNIYHNFPEQRTLIVTHSNQALNQLFEKIMALDIDERHLLRLGHGEEELETEKDFSRYGRVNYVLARRIELLEEVKRLQKSLGVPGDASYTCETAGYFFLYQVMSRWEEYISKVKNKGSTLPDVTEVSTFFPFHEYFANAPQPIFKGRSYEEDMEIAEGCFRHIKKIFTQLEEFRASELLRSGLDRSKYLLVKEAKIIAMTCTHAALKRHDLVKLGFKYDNILMEEAAQILEIETFIPLLLQNPQDGFSRLKRWIMIGDHHQLPPVIKNMAFQKYSNMEQSLFTRFVRVGVPTVDLDAQGRARAR

SEQ ID NO: 888207 - protein, 422 aa, Homo sapiens
MSLHFLYYCSEPTLDVKIAFCQGFDKQVDVSYIAKHYNMSKSKVDNQFYSVEVGDSTFTVLKRYQNLKPIGSGAQGIVCAAYDAVLDRNVAIKKLSRPFQNQTHAKRAYRELVLMKCVNHKNIISLLNVFTPQKTLEEFQDVYLVMELMDANLCQVIQMELDHERMSYLLYQMLCGIKHLHSAGIIHRDLKPSNIVVKSDCTLKILDFGLARTAGTSFMMTPYVVTRYYRAPEVILGMGYKENVDIWSVGCIMGEMVRHKILFPGRDYIDQWNKVIEQLGTPCPEFMKKLQPTVRNYVENRPKYAGLTFPKLFPDSLFPADSEHNKLKASQARDLLSKMLVIDPAKRISVDDALQHPYINVWYDPAEVEAPPPQIYDKQLDEREHTIEEWKELIYKEVMNSEEKTKNGVVKGQPSPSAQVQQ

SEQ ID NO: 888208 - protein, 402 aa, Homo sapiens
MSLHFLYYCSEPTLDVKIAFCQGFDKQVDVSYIAKHYNMSKSKVDNQFYSVEVGDSTFTVLKRYQNLKPIGSGAQGIVCAAYDAVLDRNVAIKKLSRPFQNQTHAKRAYRELVLMKCVNHKITSVMELMDANLCQVIQMELDHERMSYLLYQMLCGIKHLHSAGIIHRDLKPSNIVVKSDCTLKILDFGLARTAGTSFMMTPYVVTRYYRAPEVILGMGYKENVDIWSVGCIMGEMVRHKILFPGRDYIDQWNKVIEQLGTPCPEFMKKLQPTVRNYVENRPKYAGLTFPKLFPDSLFPADSEHNKLKASQARDLLSKMLVIDPAKRISVDDALQHPYINVWYDPAEVEAPPPQIYDKQLDEREHTIEEWKELIYKEVMNSEEKTKNGVVKGQPSPSAQVQQ

SEQ ID NO: 888209 - protein, 440 aa, Homo sapiens
MSLHFLYYCSEPTLDVKIAFCQGVCSLQVKQGFDKQVDVSYIAKHYNMSKSKVDNQFYSVEVGDSTFTVLKRYQNLKPIGSGAQGIVCAAYDAVLDRNVAIKKLSRPFQNQTHAKRAYRELVLMKCVNHKNIISLLNVFTPQKTLEEFQDVYLVMELMDANLCQVIQMELDHERMSYLLYQMLCGIKHLHSAGIIHRDLKPSNIVVKSDCTLKILDFGLARTAGTSFMMTPYVVTRYYRAPEVILGMGYKENVDIWSVGCIMGEMVRHKILFPGRDYIDQWNKVIEQLGTPCPEFMKKLQPTVRNYVENRPKYAGLTFPKLFPDSLFPADSEHNKLKASQARDLLSKMLVIDPAKRISVDDALQHPYINVWYDPAEVEAPPPQIYDKQLDEREHTIEEWKELIYKEVMNSEEKTKNGVVKGQPSPSVDVATAHSGSMLLL

SEQ ID NO: 888210 - protein, 422 aa, Homo sapiens; identical to SEQ ID NO: 888207

SEQ ID NO: 888211 - protein, 431 aa, Homo sapiens
MSLHFLYYCSEPTLDVKIAFCQGVCSLQVKQGFDKQVDVSYIAKHYNMSKSKVDNQFYSVEVGDSTFTVLKRYQNLKPIGSGAQGIVCAAYDAVLDRNVAIKKLSRPFQNQTHAKRAYRELVLMKCVNHKNIISLLNVFTPQKTLEEFQDVYLVMELMDANLCQVIQMELDHERMSYLLYQMLCGIKHLHSAGIIHRDLKPSNIVVKSDCTLKILDFGLARTAGTSFMMTPYVVTRYYRAPEVILGMGYKENVDIWSVGCIMGEMVRHKILFPGRDYIDQWNKVIEQLGTPCPEFMKKLQPTVRNYVENRPKYAGLTFPKLFPDSLFPADSEHNKLKASQARDLLSKMLVIDPAKRISVDDALQHPYINVWYDPAEVEAPPPQIYDKQLDEREHTIEEWKELIYKEVMNSEEKTKNGVVKGQPSPSAQVQQ

SEQ ID NO: 888212 - protein, 431 aa, Homo sapiens; identical to SEQ ID NO: 888211

SEQ ID NO: 888213 - protein, 177 aa, Homo sapiens
MLQTSNYSLVLSLQFLLLSYDLFVNSFSELLQKTPVIQLVLFIIQDIAVLFNIIIIFLMFFNTFVFQAGLVNLLFHKFKGTIILTAVYFALSISLHVWVMNLRWKNSNSFIWTDGLQMLFVFQRLGKDQSKVRPLSGPTCVSFSEGLDAGFPDLSQLAWDGCDSHTRNRRDYCPCPC

SEQ ID NO: 888214 - protein, 162 aa, Homo sapiens
MLQTSNYSLVLSLQFLLLSYDLFVNSFSELLQKTPVIQLVLFIIQDIAVLFNIIIIFLMFFNTFVFQAGLVNLLFHKFKGTIILTAVYFALSISLHVWVMNLRWKNSNSFIWTDGLQMLFVFQRLAAVLYCYFYKRTAVRLGDPHFYQDSLWLRKEFMQVRR

SEQ ID NO: 888215 - protein, 162 aa, Homo sapiens; identical to SEQ ID NO: 888214

SEQ ID NO: 888216 - protein, 162 aa, Homo sapiens; identical to SEQ ID NO: 888214

SEQ ID NO: 888217 - protein, 162 aa, Homo sapiens; identical to SEQ ID NO: 888214

SEQ ID NO: 888218 - protein, 162 aa, Homo sapiens; identical to SEQ ID NO: 888214

SEQ ID NO: 888219 - protein, 162 aa, Homo sapiens; identical to SEQ ID NO: 888214

SEQ ID NO: 888220 - protein, 105 aa, Homo sapiens
MLQTSNYSLVLSLQFLLLSYDLFVNSFSELLQKTPVIQLVLFIIQDIAVLFNIIIIFLMFFNTFVFQAGLVNLLFHKFKGTIILTAVYFALSISLHVWVMVRVAV

SEQ ID NO: 888221 - protein, 105 aa, Homo sapiens; identical to SEQ ID NO: 888220

SEQ ID NO: 888222 - protein, 119 aa, Homo sapiens [sequence omitted]

SEQ ID NO: 888223 - protein, 104 aa, Homo sapiens
MFFNTFVFQAGLVNLLFHKFKGTIILTAVYFALSISLHVWVMNLRWKNSNSFIWTDGLQMLFVFQRLAAVLYCYFYKRTAVRLGDPHFYQDSLWLRKEFMQVRR

SEQ ID NO: 888224 - protein, 161 aa, Homo sapiens
MCPWGPEKTEGRCSRPVTTAWCSLCSSCCCPMTSLSIPSQNCIQDIAVLFNIIIIFLMFFNTFVFQAGLVNLLFHKFKGTIILTAVYFALSISLHVWVMNLRWKNSNSFIWTDGLQMLFVFQRLAAVLYCYFYKRTAVRLGDPHFYQDSLWLRKEFMQVRR

SEQ ID NO: 888225 - protein, 177 aa, Homo sapiens; identical to SEQ ID NO: 888213

SEQ ID NO: 888226 - protein, 108 aa, Homo sapiens
MLQTSNYSLVLSLQFLLLSYDLFVNSFSELLQKTPVIQLVLFIIQDIAVLFNIIIIFLMFFNTFVFQAGLVNLLFHKFKGTIILTAVYFALSISLHVWVMFGPNSNFS

SEQ ID NO: 888227 - protein, 134 aa, Homo sapiens
MLQTSNYSLVLSLQFLLLSYDLFVNSFSELLQKTPVIQLVLFIIQDIAVLFNIIIIFLMFFNTFVFQAGLVNLLFHKFKGTIILTAVYFALSISLHVWVMNLRWKNSNSFIWTDGLQMLFVFQRLESRKLLSYL

SEQ ID NO: 888228 - protein, 119 aa, Homo sapiens [sequence omitted]

SEQ ID NO: 888229 - protein, 211 aa, Homo sapiens
MGCGQSNQSFQCSGCNWRWNARIKKIMQTDEEIGKVAAAVPVIISRALELFLESLLKKACQVTQSRNAKTMTTSHLKQCIELEQQFDFLKDLVASVPDMQGDGEDNHMDGDKGARRGRKPGSGGRKNGGMGTKSKDKKLSGTDSEQEDESEDTDTDGEEETSQPPPQASHPSAHFQSPPTPFLPFASTLPLPPAPPGPSAPDEEDEEDYDS

SEQ ID NO: 888230 - protein, 205 aa, Homo sapiens
MPSKKKKYNARFPPARIKKIMQTDEEIGKVAAAVPVIISRALELFLESLLKKACQVTQSRNAKTMTTSHLKQCIELEQQFDFLKDLVASVPDMQGDGEDNHMDGDKGARRGRKPGSGGRKNGGMGTKSKDKKLSGTDSEQEDESEDTDTDGEEETSQPPPQASHPSAHFQSPPTPFLPFASTLPLPPAPPGPSAPDEEDEEDYDS

SEQ ID NO: 888231 - protein, 446 aa, Homo sapiens
HVGLGVKCSKEVATAIRGAIILAKLSIVPVRRGYWGNKIGKPHTVPCKVTGRCGSVLVRLIPAPRGTGIVSAPVPKKLLMMAGIDDCYTSARGCTATLGNFAKATFDAISKTYSYLTPDLWKETVFTKSPYQEFTDHLVKTHTRVSVQLDSGSSCGYNIGFLYKKNNSEFKRVTVLKKKTDAWAGGEQAREPGGCGRRRWTRRGERGPEMPSKKKKYNARFPPARIKKIMQTDEEIGKVAAAVPVIICILPGADRVEGRGGGRQRVALSCPGVLLDSSSARALELFLESLLKKACQVTQSRNAKTMTTSHLKQCIELEQQFDFLKDLVASVPDMQGDGEDNHMDGDKGARRGRKPGSGGRKNGGMGTKSKDKKLSGTDSEQEDESEDTDTDGEEETSQPPPQASHPSAHFQSPPTPFLPFASTLPLPPAPPGPSAPDEEDEEDYDS

SEQ ID NO: 888232 - protein, 460 aa, Homo sapiens
HVGLGVKCSKEVATAIRGAIILAKLSIVPVRRGYWGNKIGKPHTVPCKVTGRCGSVLVRLIPAPRGTGIVSAPVPKKLLMMAGIDDCYTSARGCTATLGNFAKATFDAISKTYSYLTPDLWKETVFTKSPYQEFTDHLVKTHTRVSVQLDSGSSCGYNIGFLYKKNNSEFKRVTVLKKKTDAWAGGEQAREPGGCGRRRWTRRGERGPEMPSKKKKYNARFPPARIKKIMQTDEEIGKVAAAVPVIISRALELFLESLLKKACQVTQSRNAKTMTTSHLKQCIELEQQFDFLKDLVASVPDMQGDGEDNHMDGDKGARRWGQGLAYSGEGQGHRAWGWQGVGSTPGRWTVPSQRGRKPGSGGRKNGGMGTKSKDKKLSGTDSEQEVSEAPALRPALGDGTGSLAKLTEEQLTFCTVPGTERAEEAASPEDDTEYPAGQPGRHPNTKPHDTTKPNNHHKNP

SEQ ID NO: 888233 - protein, 183 aa, Homo sapiens
AWCDSVLRGCSLEQRSFISVRLLSYLSACRHPMEDSMDMDMSPLRPQNYLFGCELKADKDYHFKVDNDENEHQLSLRTVSLGAGAKDELHIVEAEAMNYEGSPIKVTLATLKMSVQPTVSLGGFEITPPVVLRLKCGSGPVHISGQHLVAVEEDAESEDERGRRRLRLLAPSAPQTIAPFSWF

SEQ ID NO: 888234 - protein, 414 aa, Homo sapiens
HVGLGVKCSKEVATAIRGAIILAKLSIVPVRRGYWGNKIGKPHTVPCKVTGRCGSVLVRLIPAPRGTGIVSAPVPKKLLMMAGIDDCYTSARGCTATLGNFAKATFDAISKTYSYLTPDLWKETVFTKSPYQEFTDHLVKTHTRVSVQLDSGSSCGYNIGFLYKKNNSEFKRVTVLKKKTDAWAGGEQAREPGGCGRRRWTRRGERGPEMPSKKKKYNARFPPARIKKIMQTDEEIGKVAAAVPVIISRALELFLESLLKKACQVTQSRNAKTMTTSHLKQCIELEQQFDFLKDLVASVPDMQGDGEDNHMDGDKGARRGRKPGSGGRKNGGMGTKSKDKKLSGTDSEQEDESEDTDTDGEEETSQPPPQASHPSAHFQSPPTPFLPFASTLPLPPAPPGPSAPDEEDEEDYDS

SEQ ID NO: 888235 - protein, 375 aa, Homo sapiens
HVGLGVKCSKEVATAIRGAIILAKLSIVPVRRGYWGNKIGKPHTVPCKVTGRCGSVLVRLIPAPRGTGIVSAPVPKKLLMMAGIDDCYTSARGCTATLGNFAKATFDAISKTYSYLTPDLWKETVFTKSPYQEFTDHLVKTHTRVSVQLDSGSSCGYNIGFLYKKNNSEFKRVTVLKKKTDAWAGGEQAREPGGCGRRRWTRRGERGPEMPSKKKKYNARFPPARIKKIMQTDEEIGKVAAAVPVIISRALELFLESLLKKACQGDGEDNHMDGDKGARRGRKPGSGGRKNGGMGTKSKDKKLSGTDSEQEDESEDTDTDGEEETSQPPPQASHPSAHFQSPPTPFLPFASTLPLPPAPPGPSAPDEEDEEDYDS

SEQ ID NO: 888236 - protein, 262 aa, Homo sapiens
AAARLLAPEHAREPPRSAPEPPAVPPAASRAPPPAHPRTLWPTPPAGPFCRMVAHNQVAADNAVSTAAEPRRRPEPSSSSSSSPAAPARPRPCPAVPAPAPGDTHFRTFRSHADYRRITRASALLDACGFYWGPLSVHGAHERLRAEPVGTFLVRDSRQRNCFFALSVKMASGPTSIRVHFQAGRFHLDGSRESFDCLFELLEHYVAAPRRMLGAPLRQRRVRPLQELCRQRIVATVGRENLARIPLNPVLRDYLSSFPFQI

SEQ ID NO: 888237 - protein, 262 aa, Homo sapiens; identical to SEQ ID NO: 888236

SEQ ID NO: 888238 - protein, 262 aa, Homo sapiens; identical to SEQ ID NO: 888236

SEQ ID NO: 888239 - protein, 199 aa, Homo sapiens
NTYVRAKPKKTRKLIIFIFLAAAPARPRPCPAVPAPAPGDTHFRTFRSHADYRRITRASALLDACGFYWGPLSVHGAHERLRAEPVGTFLVRDSRQRNCFFALSVKMASGPTSIRVHFQAGRFHLDGSRESFDCLFELLEHYVAAPRRMLGAPLRQRRVRPLQELCRQRIVATVGRENLARIPLNPVLRDYLSSFPFQI

SEQ ID NO: 888240 - protein, 103 aa, Homo sapiens
NTYVRAKPKKTRKLIIFIFLDRGPRAPAAVPRGPGPGPRRHALPHIPFARRLPAHHARQRAPGRLRILLGAPERARGARAAARRARGHLPGARQPPAELLFRP

SEQ ID NO: 888241 - protein, 262 aa, Homo sapiens; identical to SEQ ID NO: 888236

SEQ ID NO: 888242 - protein, 173 aa, Homo sapiens
AAARLLAPEHAREPPRSAPEPPAVPPAASRAPPPAHPRTLWPTPPAGPFCRMVAHNQVAADNAVSTAAEPRRRPEPSSSSSSSPAAPARPRPCPAVPAPAPGDTHFRTFRSHADYRRITRASALLDACGFYWGPLSVHGAHERLRAEPVGTFLVRDSRQRNCFFALTVSGART

SEQ ID NO: 888243 - protein, 169 aa, Homo sapiens
MVAHNQVAADNAVSTAAEPRRRPEPSSSSSSSPAAPARPRPCPAVPAPAPGDTHFRTFRSHADYRRITRASALLDACGFYWGPLSVHGAHERLRAEPVGTFLVRDSRQRNCFFALSVKMASGPTSIRVHFQAGRFHLDGSRESFDCLFELLEHYVAAPRRMLGAPLRQR

SEQ ID NO: 888244 - protein, 108 aa, Homo sapiens
MATCGTRLCAPPPMTGGWSPASRRSTTASSQGWWRRCTLPMGSLSSSLATASAVYTCSISCCASPRPGRTALLMASSLLGLPGVAPSSPCWSWPQVTTRASPSCPASS

SEQ ID NO: 888245 - protein, 440 aa, Homo sapiens
MGPPGSPWQWVTLLLGLLLPPAAPFWLLNVLFPPHTTPKAELSNHTRPVILVPGCLGNQLEAKLDKPDVVNWMCYRKTEDFFTIWLDLNMFLPLGVDCWIDNTRVVYNRSSGLVSNAPGVQIRVPGFGKTYSVEYLDSSKLAGYLHTLVQNLVNNGYVRDETVRAAPYDWRLEPGQQEEYYRKLAGLVEEMHAAYGKPVFLIGHSLGCLHLLYFLLRQPQAWKDRFIDGFISLGAPWGGSIKPMLVLASGDNQGIPIMSSIKLKEEQRITTTSPWMFPSRMAWPEDHVFISTPSFNYTGRDFQRFFADLHFEEGWYMWLQSRDLLAGLPAPGVEVYCLYGVGLPTPRTYIYDHGFPYTDPVGVLYEDGDDTVATRSTELCGLWQGRQPQPVHLLPLHGIQHLNMVFSNLTLEHINAILLGAYRQGPPASPTASPEPPPPE

SEQ ID NO: 888246 - protein, 440 aa, Homo sapiens; identical to SEQ ID NO: 888245

SEQ ID NO: 888247 - protein, 108 aa, Homo sapiens; identical to SEQ ID NO: 888244

SEQ ID NO: 888248 - protein, 108 aa, Homo sapiens; identical to SEQ ID NO: 888244

SEQ ID NO: 888249 - protein, 122 aa, Homo sapiens
MCYRKTEDFFTIWLDLNMFLPLGVDCWIDNTRYSHVLHPSPNTLPLGYWLLSGTPAPQGCLQPELWARVQRPWCPDPRPWLWQDLLCGVPGQQQAGRVPAHTGAEPGQQWLRAGRDCARRPL

SEQ ID NO: 888250 - protein, 257 aa, Homo sapiens
MGPPGSPWQWVTLLLGLLLPPAAPFWLLNVLFPPHTTPKAELSNHTRPVILVPGCLGNQLEAKLDKPDVVNWMCYRKTEDFFTIWLDLNMFLPLGVDCWIDNTRVVYNRSSGLVSNAPGVQIRVPGFGKTYSVEYLDSSKLAGYLHTLVQNLVNNGYVRDETVRAAPYDWRLEPGQQEEYYRKLAGLVEEMHAAYGKPVFLIGHSLGCLHLLYFLLRQPQAWKDRFIDGFISLGAPWGGSIKPMLVLASGSGTRAQH

SEQ ID NO: 888251 - protein, 259 aa, Homo sapiens
MGPPGSPWQWVTLLLGLLLPPAAPFWLLNVLFPPHTTPKAELSNHTRPVILVPGCLGNQLEAKLDKPDVVNWMCYRKTEDFFTIWLDLNMFLPLGVDCWIDNTRVVYNRSSGLVSNAPGVQIRVPGFGKTYSVEYLDSSKLAGYLHTLVQNLVNNGYVRDETVRAAPYDWRLEPGQQEEYYRKLAGLVEEMHAAYGKPVFLIGHSLGCLHLLYFLLRQPQAWKDRFIDGFISLGAPWGGSIKPMLVLASGVPLPRDVLH

SEQ ID NO: 888252 - protein, 256 aa, Homo sapiens
MGPPGSPWQWVTLLLGLLLPPAAPFWLLNVLFPPHTTPKAELSNHTRPVILVPGCLGNQLEAKLDKPDVVNWMCYRKTEDFFTIWLDLNMFLPLGVDCWIDNTRVVYNRSSGLVSNAPGVQIRVPGFGKTYSVEYLDSSKLAGYLHTLVQNLVNNGYVRDETVRAAPYDWRLEPGQQEEYYRKLAGLVEEMHAAYGKPVFLIGHSLGCLHLLYFLLRQPQAWKDRFIDGFISLGAPWGGSIKPMLVLASGEKASNT

SEQ ID NO: 888253 - protein, 133 aa, Homo sapiens
MERLVARGTFPVLVRTSACRSLFGPVDHEELSRELQARLAELNAEDQNRWDYDFQQDMPLRGPGRLQWTEVDSDSVPAFYRETVQISSPSARDQRLRSRRAMSPRRVPLPSRRPWRAGSVEQTPAQEAAVSPI

SEQ ID NO: 888254 - protein, 349 aa, Homo sapiens
MSDASLRSTSTMERLVARGTFPVLVRTSACRSLFGPVDHEELSRELQARLAELNAEDQNRWDYDFQQDMPLRGPGRLQWTEVDSDSVPAFYRETVQVGRCRLLLAPRPVAVAVAVSPPLEPAAESLDGLEEAPEQLPSVPVPAPASTPPPVPVLAPAPAPAPAPVAAPVAAPVAVAVLAPAPAPAPAPAPAPAPVAAPAPAPAPAPAPAPAPAPAPDAAPQESAEQGANQGQRGQEPLADQLHSGISGRPAAGTAAASANGAAIKKLSGPLISDFFAKRKRSAPEKSSGDVPAPCPSPKPPPLACGLGGADPRARGCGEPNLEPQRAPRETCRGSGRWKGAGPRLGPFM

SEQ ID NO: 888255 - protein, 338 aa, Homo sapiens
MERLVARGTFPVLVRTSACRSLFGPVDHEELSRELQARLAELNAEDQNRWDYDFQQDMPLRGPGRLQWTEVDSDSVPAFYRETVQVGRCRLLLAPRPVAVAVAVSPPLEPAAESLDGLEEAPEQLPSVPVPAPASTPPPVPVLAPAPAPAPAPVAAPVAAPVAVAVLAPAPAPAPAPAPAPAPVAAPAPAPAPAPAPAPAPAPAPDAAPQESAEQGANQGQRGQEPLADQLHSGISGRPAAGTAAASANGAAIKKLSGPLISDFFAKRKRSAPEKSSGDVPAPCPSPKPPPLACGLGGADPRARGCGEPNLEPQRAPRETCRGSGRWKGAGPRLGPFM

SEQ ID NO: 888256 - protein, 516 aa, Homo sapiens
MERLVARGTFPVLVRTSACRSLFGPVDHEELSRELQARLAELNAEDQNRWDYDFQQDMPLRGPGRLQWTEVDSDSVPAFYRETVQVGRCRLLLAPRPVAVAVAVSPPLEPAAESLDGLEEAPEQLPSVPVPAPASTPPPVPVLAPAPAPAPAPVAAPVAAPVAVAVLAPAPAPAPAPAPAPAPVAAPAPAPAPAPAPAPAPAPAPDAAPQESAEQGANQGQRGQEPLADQLHSGISGRPAAGTAAASANGAAIKKLSGPLISGEPRTAPPRPGPAPLCPAGRSPQPSGASLGSRLLTVALKGPQRSGRGCAYPPPRPVVVPSTASRGPGWEAESRPRPPGSAVFAPGRGSPSPGAPAPREHGVEGVKRGGGPGGLDSTLRGDVNKADPPRTSARAGPPPPPRGRGRRPHPGRPAPRALSRPPLGSPGRPRPDRPRALSPADFFAKRKRSAPEKSSGDVPAPCPSPKPPPLACGLGGADPRARGCGEPNLEPQRAPRETCRGSGRWKGAGPRLGPFM

SEQ ID NO: 888257 - protein, 338 aa, Homo sapiens; identical to SEQ ID NO: 888255

SEQ ID NO: 888258 - protein, 338 aa, Homo sapiens; identical to SEQ ID NO: 888255

SEQ ID NO: 888259 - protein, 336 aa, Homo sapiens
MERKISRIHLVSEPSITHFLQVSWEKTLESGFVITLTDGHSAWTGTVSESEISQEADDMAMEKGKYVGELRKALLSGAGPADVYTFNFSKESCYFFFEKNLKDVSFRLGSFNLEKVENPAEVIRELICYCLDTIAENQAKNEHLQKENERLLRDWNDVQGRFEKCVSAKEALETDLYKRFILVLNEKKTKIRSLHNKLLNAAQEREKDIKQEGETAICSEMTADRDPVYDESTDEESENQTDLSGLASAAVSKDDSIISSLDVTDIAPSRKRRQRMQRNLGTEPKMAPQENQLQEKENSRPDSSLPETSKKEHISAENMSLETLRNSSPEDLFDEI

SEQ ID NO: 888260 - protein, 336 aa, Homo sapiens; identical to SEQ ID NO: 888259

SEQ ID NO: 888261 - protein, 310 aa, Homo sapiens
MERKISRIHLVSEPSITHFLQVSWEKTLESGFVITLTDGHSAWTGTVSESEISQEADDMAMEKGKYVGELRKALLSGAGPADVYTFNFSKESCYFFFEKNLKDVSFRLGSFNLEKVENPAEVIRELICYCLDTIAENQAKNEHLQKENERLLRDWNDVQGRFEKCVSAKEALETDLYKRFILVLNEKKTKIRSLHNKLLNAAQEREKDIKQEGETAICSEMTADRDPVYDESTDEESENQTDLSGLASAAVSKDDSIISSLDVTDIAPSRKRRQRMQRNLGTEPKMAPQENQLQEKEKGRKKETSEKEAV

SEQ ID NO: 888262 - protein, 120 aa, Homo sapiens
MIPLFQVLMSLILHQVEKGDSECKEILGQNLKWLLRRISFKKRKNGVLLCHQAIINDIGCNFRVIKKIRKWGERKGGNRKKIKERTEKEGKKKGRKAGRKQQGRKRRRKTDNHKADFSGN

SEQ ID NO: 888263 - protein, 336 aa, Homo sapiens; identical to SEQ ID NO: 888259

SEQ ID NO: 888264 - protein, 336 aa, Homo sapiens; identical to SEQ ID NO: 888259

SEQ ID NO: 888265 - protein, 309 aa, Homo sapiens
VSPVRSSYTQFTPRTVTGTVSESEISQEADDMAMEKGKYVGELRKALLSGAGPADVYTFNFSKESCYFFFEKNLKDVSFRLGSFNLEKVENPAEVIRELICYCLDTIAENQAKNEHLQKENERLLRDWNDVQGRFEKCVSAKEALETDLYKRFILVLNEKKTKIRSLHNKLLNAAQEREKDIKQEGETAICSEMTADRDPVYDESTDEESENQTDLSGLASAAVSKDDSIISSLDVTDIAPSRKRRQRMQRNLGTEPKMAPQENQLQEKENSRPDSSLPETSKKEHISAENMSLETLRNSSPEDLFDEI

SEQ ID NO: 888266 - protein, 116 aa, Homo sapiens
MTADRDPVYDESTDEESENQTDLSGLASAAVSKDDSIISSLDVTDIAPSRKRRQRMQRNLGTEPKMAPQENQLQEKENSRPDSSLPETSKKEHISAENMSLETLRNSSPEDLFDEI

SEQ ID NO: 888267 - protein, 271 aa, Homo sapiens
MERKISRIHLVSEPSITHFLQVSWEKTLESGFVITLTDGHSAWTGTVSESEISQEADDMAMEKGKYVGELRKALLSGAGPADVYTFNFSKESCYFFFEKNLKDVSFRLGSFNLEKVENPAEVIRELICYCLDTIAENQAKNEHLQKENERLLRDWNDVQGRFEKCVSAKEALETDLYKRFILVLNEKKTKIRSLHNKLLNAAQEREKDIKQEGETAICSEMTADRDPVYDESTDEESENQTDLSGLASEGGRRRLQRKRPCDGSKIREKRC

SEQ ID NO: 888268 - protein, 157 aa, Homo sapiens
MERKISRIHLVSEPSITHFLQVSWEKTLESGFVITLTDGHSAWTGTVSESEISQEADDMAMEKGKYVGELRKALLSGAGPADVYTFNFSKESCYFFFEKNLKDVSFRLGSFNLEKVENPAEVIRELICYCLDTIGNLEDFQRAIWKYVRGIEIFGLC

SEQ ID NO: 888269 - protein, 121 aa, Homo sapiens
APPHSPLSDKVTFHPYYNKSKTPTLLFPAVTTYAHENMPLAKDLLHPSPEEEKRKHKKKRLVQSPNSYFMDVKCPGCYKITTVFSHAQTVVLCVGCSTVLCQPTGGKARLTEGCSFRRKQH

SEQ ID NO: 888270 - protein, 102 aa, Homo sapiens
QFCFPVEFPAVTTYAHENMPLAKDLLHPSPEEEKRKHKKKRLVQSPNSYFMDVKCPGCYKITTVFSHAQTVVLCVGCSTVLCQPTGGKARLTEGCSFRRKQH

SEQ ID NO: 888271 - protein, 73 aa, Homo sapiens
EDPRYSSGTSLFIVSGGDDLRTREHASRKGSPSSLSRRGEEETQEETPGAEPQFLTFGALGLNNNLGPKEGFN

SEQ ID NO: 888272 - protein, 109 aa, Homo sapiens
LRIPAIHRAPRYSSFPAVTTYAHENMPLAKDLLHPSPEEEKRKHKKKRLVQSPNSYFMDVKCPGCYKITTVFSHAQTVVLCVGCSTVLCQPTGGKARLTEGCSFRRKQH

SEQ ID NO: 888273 - protein, 123 aa, Homo sapiens
TSKIHTGEKRYNVRNMGKHLLWMISCLNIRKFRIVRNFVTIRSVDKPSLCTKNLLNTRELILMRNLVNIKECVKNFHHGLGFAQLLSIHTSEKSLSVRNVGRFIATLNTLEFGEDNSCEKVFE

SEQ ID NO: 888274 - protein, 175 aa, Homo sapiens
YPVRGWVAKQVEGAGFTSASWAGRWWSYAVKASTFLAISTETSHFRAPSRIFWRTVRGMLPHKTKRGQAALDRLKVFDGIPPPYDKKKRMVVPAALKVVRLKPTRKFAYLGRLAHEVGWKYQAVTATLEEKRKEKAKIHYRKKKQLMRLRKQAEKNVEKKIDKYTEVLKTHGLLV

SEQ ID NO: 888275 - protein, 142 aa, Homo sapiens
MNTNPSRGPYHFRAPSRIFWRTVRGMLPHKTKRGQAALDRLKVFDGIPPPYDKKKRMVVPAALKVVRLKPTRKFAYLGRLAHEVGWKYQAVTATLEEKRKEKAKIHYRKKKQLMRLRKQAEKNVEKKIDKYTEVLKTHGLLV

SEQ ID NO: 888276 - protein, 77 aa, Homo sapiens
ETAHEATDLGFLFPLLLQVGWKYQAVTATLEEKRKEKAKIHYRKKKQLMRLRKQAEKNVEKKIDKYTEVLKTHGLLV

SEQ ID NO: 888277 - protein, 210 aa, Homo sapiens
LFQAAAKMAEVQVLVLDGRGHLLGRLAAIVAKQVLLGRKVVVVRCEGINISGNFYRNKLKYLAFLRKRMNTNPSRGPYHFRAPSRIFWRTVRGMLPHKTKRGQAALDRLKVFDGIPPPYDKKKRMVVPAALKVVRLKPTRKFAYLGRLAHEVGWKYQAVTATLEEKRKEKAKIHYRKKKQLMRLRKQAEKNVEKKIDKYTEVLKTHGLLV

SEQ ID NO: 888278 - protein, 125 aa, Homo sapiens
PHPGALLHPGALLHQRGQAALDRLKVFDGIPPPYDKKKRMVVPAALKVVRLKPTRKFAYLGRLAHEVGWKYQAVTATLEEKRKEKAKIHYRKKKQLMRLRKQAEKNVEKKIDKYTEVLKTHGLLV

SEQ ID NO: 888279 - protein, 116 aa, Homo sapiens
MSPSAFKQLREAVTKTLSLLPASYAQGACGTWTAAALKVVRLKPTRKFAYLGRLAHEVGWKYQAVTATLEEKRKEKAKIHYRKKKQLMRLRKQAEKNVEKKIDKYTEVLKTHGLLV

SEQ ID NO: 888280 - protein, 210 aa, Homo sapiens; identical to SEQ ID NO: 888277

SEQ ID NO: 888281 - protein, 210 aa, Homo sapiens; identical to SEQ ID NO: 888277

SEQ ID NO: 888282 - protein, 195 aa, Homo sapiens
LFQAAAKMAEVQVLVLDGRGHLLGRLAAIVAKQVLLGRKVVVVRCEGINISGNFYRNKLKYLAFLRKRMNTNPSRGPYHFRAPSRIFWRTVRGMLPHKTKRGQAALDRLKVFDGIPPPYDKKKRMVVPAALKVVRLKPTRKFAYLGRLAHEVGWKYQAVTATLEEKRKEKAKIHYRKKKQLMRLRKQAEKNVEKQ

SEQ ID NO: 888283 - protein, 476 aa, Homo sapiens
SRTRGTPVPEVLQKCTPGPGFREADSSLPHECRELWSPPDASCETAQGAAGYAGTAEPFRRASGLRVPSPRADAQRLRLPKSPCGRARKWRRRRRPGAPEAAVMELPSGPGPERLFDSHRLPGDCFLLLVLLLYAPVGFCLLVLRLFLGIHVFLVSCALPDSVLRRFVVRTMCAVLGLVARQEDSGLRDHSVRVLISNHVTPFDHNIVNLLTTCSTPLLNSPPSFVCWSRGFMEMNGRGELVESLKRFCASTRLPPTPLLLFPEEEATNGREGLLRFSSWPFSIQDVVQPLTLQVQRPLVSVTVSDASWVSELLWSLFVPFTVYQVRWLRPVHRQLGEANEEFALRVQQLVAKELGQTGTRLTPADKAEHMKRQRHPRLRPQSAQSSFPPSPGPSPDVQLATLAQRVKEVLPHVPLGVIQRDLAKTGCVDLTITNLLEGAVAFMPEDITKGTQSLPTASASKAFDACLMMMTPQAL

SEQ ID NO: 888284 - protein, 279 aa, Homo sapiens
MNGRGELVESLKRFCASTRLPPTPLLLFPEEEATNGREGLLRFSSWPFSIQDVVQPLTLQVQRPLVSVTVSDASWVSELLWSLFVPFTVYQVRWLRPVHRQLGEANEEFALRVQQLVAKELGQTGTRLTPADKAEHMKRQRHPRLRPQSAQSSFPPSPGPSPDVQLATLAQRVKEVLPHVPLGVIQRDLAKTGCVDLTITNLLEGAVAFMPEDITKGTQSLPTASASKFPSSGPVTPQPTALTFAKSSWARQESLQERKQALYEYARRRFTERRAQEAD

SEQ ID NO: 888285 - protein, 513 aa, Homo sapiens
SRTRGTPVPEVLQKCTPGPGFREADSSLPHECRELWSPPDASCETAQGAAGYAGTAEPFRRASGLRVPSPRADAQRLRLPKSPCGRARKWRRRRRPGAPEAAVMELPSGPGPERLFDSHRLPGDCFLLLVLLLYAPVGFCLLVLRLFLGIHVFLVSCALPDSVLRRFVVRTMCAVLGLVARQEDSGLRDHSVRVLISNHVTPFDHNIVNLLTTCSTPLLNSPPSFVCWSRGFMEMNGRGELVESLKRFCASTRLPPTPLLLFPEEEATNGREGLLRFSSWPFSIQDVVQPLTLQVQRPLVSVTVSDASWVSELLWSLFVPFTVYQVRWLRPVHRQLGEANEEFALRVQQLVAKELGQTGTRLTPADKAEHMKRQRHPRLRPQSAQSSFPPSPGPSPDVQLATLAQRVKEVLPHVPLGVIQRDLAKTGCVDLTITNLLEGAVAFMPEDITKGTQSLPTASASKFPSSGPVTPQPTALTFAKSSWARQESLQERKQALYEYARRRFTERRAQEAD

SEQ ID NO: 888286 - protein, 370 aa, Homo sapiens
SRTRGTPVPEVLQKCTPGPGFREADSSLPHECRELWSPPDASCETAQGAAGYAGTAEPFRRASGLRVPSPRADAQRLRLPKSPCGRARKWRRRRRPGAPEAAVMELPSGPGPERLFDSHRLPGDCFLLLVLLLYAPVGFCLLVLRLFLGIHVFLVSCALPDSVLRRFVVRTMCAVLGLVARQEDSGLRDHSVRVLISNHVTPFDHNIVNLLTTCSTPLLNSPPSFVCWSRGFMEMNGRGELVESLKRFCASTRLPPTPLLLFPEEEATNGREGLLRFSSWPFSIQDVVQPLTLQVQRPLVSVTVSDASWVSELLWSLFVPFTVYQVRWLRPVHRQLGEANEEFALRVQQVVGCTDRVEAGSLLRRRGRKA

SEQ ID NO: 888287 - protein, 448 aa, Homo sapiens
SRTRGTPVPEVLQKCTPGPGFREADSSLPHECRELWSPPDASCETAQGAAGYAGTAEPFRRASGLRVPSPRADAQRLRLPKSPCGRARKWRRRRRPGAPEAAVMELPSGPGPERLFDSHRLPGDCFLLLVLLLYAPVGFCLLVLRLFLGIHVFLVSCALPDSVLRRFVVRTMCAVLGLVARQEDSGLRDHSVRVLISNHVTPFDHNIVNLLTTCSTPLLNSPPSFVCWSRGFMEMNGRGELVESLKRFCASTRLPPTPLLLFPEEEATNGREGLLRFSSWPFSIQDVVQPLTLQVQRPLVSVTVSDASWVSELLWSLFVPFTVYQVRWLRPVHRQLGEANEEFALRVQQLVAKELGQTGTRLTPADKAEHMKRQRHPRLRPQSAQSSFPPSPGPSPDVQLATLAQRVKEVLPHVPLGVIQRDLGMGKGGPTLGDGHREEKWVVKEESK

SEQ ID NO: 888288 - protein, 486 aa, Homo sapiens
SRTRGTPVPEVLQKCTPGPGFREADSSLPHECRELWSPPDASCETAQGAAGYAGTAEPFRRASGLRVPSPRADAQRLRLPKSPCGRARKWRRRRRPGAPEAAVMELPSGPGPERLFDSHRLPGDCFLLLVLLLYAPVGFCLLVLRLFLGIHVFLVSCALPDSVLRRFVVRTMCAVLGLVARQEDSGLRDHSVRVLISNHVTPFDHNIVNLLTTCSTPLLNSPPSFVCWSRGFMEMNGRGELVESLKRFCASTRLPPTPLLLFPEEEATNGREGLLRFSSWPFSIQDVVQPLTLQVQRPLVSVTVSDASWVSELLWSLFVPFTVYQVRWLRPVHRQLGEANEEFALRVQQLVAKELGQTGTRLTPADKAEHMKRQRHPRLRPQSAQSSFPPSPGPSPDVQLATLAQRVKEVLPHVPLGVIQRDLAKTGCVDLTITNLLEGAVAFMPEDITKGTQSLPTASASKGETQEMVRSKCWGELGAGYVLPYP

SEQ ID NO: 888289 - protein, 328 aa, Homo sapiens
SRTRGTPVPEVLQKCTPGPGFREADSSLPHECRELWSPPDASCETAQGAAGYAGTAEPFRRASGLRVPSPRADAQRLRLPKSPCGRARKWRRRRRPGAPEAAVMELPSGPGPERLFDSHRLPGDCFLLLVLLLYAPVGFCLLVLRLFLGIHVFLVSCALPDSVLRRFVVRTMCAVLGLVARQEDSGLRDHSVRVLISNHVTPFDHNIVNLLTTCSTPLLNSPPSFVCWSRGFMEMNGRGELVESLKRFCASTRLPPTPLLLFPEEEATNGREGLLRFSSWPFSIQDVVQPLTLQVQRPLVSVTVSDASWVSELLWSLFVPFTVYQVRY

SEQ ID NO: 888290 - protein, 493 aa, Homo sapiens
SRTRGTPVPEVLQKCTPGPGFREADSSLPHECRELWSPPDASCETAQGAAGYAGTAEPFRRASGLRVPSPRADAQRLRLPKSPCGRARKWRRRRRPGAPEAAVMELPSGPGPERLFDSHRLPGDCFLLLVLLLYAPVGFCLLVLRLFLGIHVFLVSCALPDSVLRRFVVRTMCAVLGLVARQEDSGLRDHSVRVLISNHVTPFDHNIVNLLTTCSTPLLNSPPSFVCWSRGFMEMNGRGELVESLKRFCASTRLPPTPLLLFPEEEATNGREGLLRFSSWPFSIQDVVQPLTLQVQRPLVSVTVSDASWVSELLWSLFVPFTVYQVRWLRPVHRQLGEANEEFALRVQQLVAKELGQTGTRLTPADKAEHMKRQRHPRLRPQSAQSSFPPSPGPSPDVQLATLAQRVKEVLPHVPLGVIQRDLAKTGCVDLTITNLLEGAVAFMPEDITKGTQSLPTASASKWARQESLQERKQALYEYARRRFTERRAQEAD

SEQ ID NO: 888291 - protein, 252 aa, Homo sapiens
SRTRGTPVPEVLQKCTPGPGFREADSSLPHECRELWSPPDASCETAQGAAGYAGTAEPFRRASGLRVPSPRADAQRLRLPKSPCGRARKWRRRRRPGAPEAAVMELPSGPGPERLFDSHRLPGDCFLLLVLLLYAPVGFCLLVLRLFLGIHVFLVSCALPDSVLRRFVVRTMCAVLGLVARQEDSGLRDHSVRVLISNHVTPFDHNIVNLLTTCSTVSESEAESATGRFPGAQLKAPLSPLAFRMEDTEPYP

SEQ ID NO: 888292 - protein, 328 aa, Homo sapiens; identical to SEQ ID NO: 888289

SEQ ID NO: 888293 - protein, 448 aa, Homo sapiens; identical to SEQ ID NO: 888287

SEQ ID NO: 888294 - protein, 278 aa, Homo sapiens
SRTRGTPVPEVLQKCTPGPGFREADSSLPHECRELWSPPDASCETAQGAAGYAGTASTFRRASGLRVPSPRADAQRLRLPKSPCGRARKWRRRRRPGAPEAAVMELPSGPGPERLFDSHRLPGDCFLLLVLLLYAPVGFCLLVLRLFLGIHVFLVSCALPDSVLRRFVVRTMCAVLGLVARQEDSGLRDHSVRVLISNHVTPFDHNIVNLLTTCSTFLAIFYPRCGTTSYPASSETPGLCDGVRCLLGLRTAVVTFRPFHGVSSKVASSCSSPTRGSE

SEQ ID NO: 888295 - protein, 167 aa, Homo sapiens
SRTRGTPVPEVLQKCTPGPGFREADSSLPHECRELWSPPDASCETAQGAAGYAGTASPSGAPQDFGSPHPGRMPKDSAFPRAPAAGRENGGGGDGRALLKQQLWSFPQGRGRSGSLTRTGFRVTASYCSCCCSTRQSGSASSSCASFSGSTSSWSAARCQTASFADS

SEQ ID NO: 888296 - protein, 181 aa, Homo sapiens
SRVSHACRFRVALRVQQLVAKELGQTGTRLTPADKAEHMKRQRHPRLRPQSAQSSFPPSPGPSPDVQLATLAQRVKEVLPHVPLGVIQRDLAKTGCVDLTITNLLEGAVAFMPEDITKGTQSLPTASASKFPSSGPVTPQPTALTFAKSSWARQESLQERKQALYEYARRRFTERRAQEAD

SEQ ID NO: 888297 - protein, 280 aa, Homo sapiens
SRTRGTPVPEVLQKCTPGPGFREADSSLPHECRELWSPPDASCETAQGAAGYAGTAEPFRRASGLRVPSPRADAQRLRLPKSPCGRARKWRRRRRPGAPEAAVMELPSGPGPERLFDSHRLPGDCFLLLVLLLYAPVGFCLLVLRLFLGIHVFLVSCALPDSVLRRFVVRTMCAVLGLVARQEDSGLRDHSVRVLISNHVTPFDHNIVNLLTTCSTPLLNSPPSFVCWSRGFMEMNGRGELVESLKRFCASTRLPPTPLLLFPEEEATNGREGLLRFRWV

SEQ ID NO: 888298 - protein, 513 aa, Homo sapiens; identical to SEQ ID NO: 888285

SEQ ID NO: 888299 - protein, 513 aa, Homo sapiens; identical to SEQ ID NO: 888285

SEQ ID NO: 888300 - protein, 279 aa, Homo sapiens; identical to SEQ ID NO: 888284

SEQ ID NO: 888301 - protein, 545 aa, Homo sapiens
SRTRGTPVPEVLQKCTPGPGFREADSSLPHECRELWSPPDASCETAQGAAGYAGTAEPFRRASGLRVPSPRADAQRLRLPKSPCGRARKWRRRRRPGAPEAAVMELPSGPGPERLFDSHRLPGDCFLLLVLLLYAPVGFCLLVLRLFLGIHVFLVSCALPDSVLRRFVVRTMCAVLGLVARQEDSGLRDHSVRVLISNHVTPFDHNIVNLLTTCSTPLLNSPPSFVCWSRGFMEMNGRGELVESLKRFCASTRLPPTPLLLFPEEEATNGREGLLRFSSWPFSIQDVVQPLTLQVQRPLVSVTVSDASWVSELLWSLFVPFTVYQVRWLRPVHRQLGEANEEFALRVQQLVAKELGQTGTRLTPADKAEHMKRQRHPRLRPQSAQSSFPPSPGPSPDVQLATLAQRVKEVLPHVPLGVIQRDLAKTGCVDLTITNLLEGAVAFMPEDITKGTQSLPTASASKFPSSGPVTPQPTALTFAKSSWARQESLQERKQALYEYARRRSQKRRAQEGDDSQDGCPEREEIGAYTSQGGWGGRGWVPSYFG

SEQ ID NO: 888302 - protein, 465 aa, Homo sapiens
SRTRGTPVPEVLQKCTPGPGFREADSSLPHECRELWSPPDASCETAQGAAGYAGTAEPFRRASGLRVPSPRADAQRLRLPKSPCGRARKWRRRRRPGAPEAAVMELPSGPGPERLFDSHRLPGDCFLLLVLLLYAPVGFCLLVLRLFLGIHVFLVSCALPDSVLRRFVVRTMCAVLGLVARQEDSGLRDHSVRVLISNHVTPFDHNIVNLLTTCSTPLLNSPPSFVCWSRGFMEMNGRGELVESLKRFCASTRLPPTPLLLFPEEEATNGREGLLRFSSWPFSIQDVVQPLTLQVQRPLVSVTVSDASWVSELLWSLFVPFTVYQVRWLRPVHRQLGEANEEFALRVQQLVAKELGQTGTRLTPADKAEHMKRQRHPRLRPQSAQSSFPPSPGPSPDVQLATLAQRVKEVLPHVPLGVIQRDLAKTGCVDLTITNLLEGAVAFMPEDITKGTQSLPTASASKTLA

SEQ ID NO: 888303 - protein, 479 aa, Homo sapiens
SRTRGTPVPEVLQKCTPGPGFREADSSLPHECRELWSPPDASCETAQGAAGYAGTAEPFRRASGLRVPSPRADAQRLRLPKSPCGRARKWRRRRRPGAPEAAVMELPSGPGPERLFDSHRLPGDCFLLLVLLLYAPVGFCLLVLRLFLGIHVFLVSCALPDSVLRRFVVRTMCAVLGLVARQEDSGLRDHSVRVLISNHVTPFDHNIVNLLTTCSTPLLNSPPSFVCWSRGFMEMNGRGELVESLKRFCASTRLPPTPLLLFPEEEATNGREGLLRFSSWPFSIQDVVQPLTLQVQRPLVSVTVSDASWVSELLWSLFVPFTVYQVRWLRPVHRQLGEANEEFALRVQQLVAKELGQTGTRLTPADKAEHMKRQRHPRLRPQSAQSSFPPSPGPSPDVQLATLAQRVKEVLPHVPLGVIQRDLAKTGCVDLTITNLLEGAVAFMPEDITKGTQSLPTASASKPHPTHNRLDGWVVKREG

SEQ ID NO: 888304 - protein, 280 aa, Homo sapiens; identical to SEQ ID NO: 888297

SEQ ID NO: 888305 - protein, 495 aa, Homo sapiens
SRTRGTPVPEVLQKCTPGPGFREADSSLPHECRELWSPPDASCETAQGAAGYAGTAEPFRRASGLRVPSPRADAQRLRLPKSPCGRARKWRRRRRPGAPEAAVMELPSGPGPERLFDSHRLPGDCFLLLVLLLYAPVGFCLLVLRLFLGIHVFLVSCALPDSVLRRFVVRTMCAVLGLVARQEDSGLRDHSVRVLISNHVTPFDHNIVNLLTTCSTPLLNSPPSFVCWSRGFMEMNGRGELVESLKRFCASTRLPPTPLLLFPEEEATNGREGLLRFSSWPFSIQDVVQPLTLQVQRPLVSVTVSDASWVSELLWSLFVPFTVYQVRWLRPVHRQLGEANEEFALRVQQLVAKELGQTGTRLTPADKAEHMKRQRHPRLRPQSAQSSFPPSPGPSPDVQLATLAQRVKEVLPHVPLGVIQRDLAFMPEDITKGTQSLPTASASKFPSSGPVTPQPTALTFAKSSWARQESLQERKQALYEYARRRFTERRAQEAD

SEQ ID NO: 888306 - protein, 280 aa, Homo sapiens; identical to SEQ ID NO: 888297

SEQ ID NO: 888307 - protein, 306 aa, Homo sapiens
SRTRGTPVPEVLQKCTPGPGFREADSSLPHECRELWSPPDASCETAQGAAGYAGTASTFRRASGLRVPSPRADAQRLRLPKSPCGRARKWRRRRRPGAPEAAVMELPSGPGPERLFDSHRWLRPVHRQLGEANEEFALRVQQLVAKELGQTGTRLTPADKAEHMKRQRHPRLRPQSAQSSFPPSPGPSPDVQLATLAQRVKEVLPHVPLGVIQRDLAKTGCVDLTITNLLEGAVAFMPEDITKGTQSLPTASASKFPSSGPVTPQPTALTFAKSSWARQESLQERKQALYEYARRRFTERRAQEAD

SEQ ID NO: 888308 - protein, 328 aa, Homo sapiens; identical to SEQ ID NO: 888289

SEQ ID NO: 888309 - protein, 437 aa, Homo sapiens
MENQVLVIRIKIPNSGAVDWTVHSGPQLLFRDVLDVIGQVLPEATTTAFEYEDEDGDRITVRSDEEMKAMLSYYYSTVMEQQVNGQLIEPLQIFPRACKPPGERNIHGLKVNTRAGPSQHSSPAVSDSLPSNSLKKSSAELKKILANGQMNEQDIRYRDTLGHGNGGTVYKAYHVPSGKILAVKVILLDITLELQKQIMSELEILYKCDSSYIIGFYGAFFVENRISICTEFMDGGSLDVYRKMPEHVLGRIAVAVVKGLTYLWSLKILHRDVKPSNMLVNTRGQVKLCDFGVSTQLVNSIAKTYVGTNAYMAPERISGEQYGIHSDVWSLGISFMELALGRFPYPQIQKNQGSLMPLQLLQCIVDEDSPVLPVGEFSEPFVHFITQCMRKQPKERPAPEELMGHPFIVQFNDGNAAVVSMWVCRALEERRSQQGPP

SEQ ID NO: 888310 - protein, 438 aa, Homo sapiens
MLWLALGPFPAMENQVLVIRIKIPNSGAVDWTVHSGPQLLFRDVLDVIGQVLPEATTTAFEYEDEDGDRITVRSDEEMKAMLSYYYSTVMEQQVNGQLIEPLQIFPRACKPPGERNIHGLKVNTRAGPSQHSSPAVSDSLPSNSLKKSSAELKKILANGQMNEQDIRYRDTLGHGNGGTVYKAYHVPSGKILAVKVILLDITLELQKQIMSELEILYKCDSSYIIGFYGAFFVENRISICTEFMDGGSLDVYRKMPEHVLGRIAVAVVKGLTYLWSLKILHRDVKPSNMLVNTRGQVKLCDFGVSTQLVNSIAKTYVGTNAYMAPERISGEQYGIHSDVWSLGISFMEIQKNQGSLMPLQLLQCIVDEDSPVLPVGEFSEPFVHFITQCMRKQPKERPAPEELMGHPFIVQFNDGNAAVVSMWVCRALEERRSQQGPP

SEQ ID NO: 888311 - protein, 511 aa, Homo sapiens
MLWLALGPFPAMENQVLVIRIKIPNSGAVDWTVHSGPQLLFRDVLDVIGQVLPEATTTAFEYEDEDGDRITVRSDEEMKAMLSYYYSTVMEQQVNGQLIEPLQIFPRACKPPGERNIHGLKVNTRAGPSQHSSPAVSDSLPSNSLKKSSAELKKILANGQMNEQDIRYRDTLGHGNGGTVYKAYHVPSGKILAVKTPSSSAFGLLDLTPVICRGLSGLQLQTEGCTVGFPTFEVFRLGLASLLLSLQMAYCGTSPCHPVILLDITLELQKQIMSELEILYKCDSSYIIGFYGAFFVENRISICTEFMDGGSLDVYRKMPEHVLGRIAVAVVKGLTYLWSLKILHRDVKPSNMLVNTRGQVKLCDFGVSTQLVNSIAKTYVGTNAYMAPERISGEQYGIHSDVWSLGISFMELALGRFPYPQIQKNQGSLMPLQLLQCIVDEDSPVLPVGEFSEPFVHFITQCMRKQPKERPAPEELMGHPFIVQFNDGNAAVVSMWVCRALEERRSQQGPP

SEQ ID NO: 888312 - protein, 411 aa, Homo sapiens [sequence omitted]

SEQ ID NO: 888313 - protein, 371 aa, Homo sapiens
MKAMLSYYYSTVMEQQVNGQLIEPLQIFPRACKPPGERNIHGLKVNTRAGPSQHSSPAVSDSLPSNSLKKSSAELKKILANGQMNEQDIRYRDTLGHGNGGTVYKAYHVPSGKILAVKVILLDITLELQKQIMSELEILYKCDSSYIIGFYGAFFVENRISICTEFMDGGSLDVYRKMPEHVLGRIAVAVVKGLTYLWSLKILHRDVKPSNMLVNTRGQVKLCDFGVSTQLVNSIAKTYVGTNAYMAPERISGEQYGIHSDVWSLGISFMELALGRFPYPQIQKNQGSLMPLQLLQCIVDEDSPVLPVGEFSEPFVHFITQCMRKQPKERPAPEELMGHPFIVQFNDGNAAVVSMWVCRALEERRSQQGPP

SEQ ID NO: 888314 - protein, 83 aa, Homo sapiens
AATAAAQPPADCMFQASMRSPNMEPFKQQKVEDFYDIGEELGRATRSSCSSMMEMPPWCPCGCAGRWRRGGASRGPREAAAGH

SEQ ID NO: 888315 - protein, 438 aa, Homo sapiens; identical to SEQ ID NO: 888310

SEQ ID NO: 888316 - protein, 438 aa, Homo sapiens
MLWLALGPFPAMENQVLVIRIKIPNSGAVDWTVHSGPQLLFRDVLDVIGQVLPEATTTAFEYEDEDGDRITVRSDEEMKAMLSYYYSTVMEQQVNGQLIEPLQIFPRACKPPGERNIHGLKVNTRAGPSQHSSPAVSDSLPSNSLKKSSAELKKILANGQMNEQDIRYRDTLGHGNGGTVYKAYHVPSGKILAVKTPSSSAFGLLDLTPVICRGLSGLQLQTEGCTVGFPTFEVFRLGLASLLLSLQMAYCGTSPCHPVILLDITLELQKQIMSELEILYKCDSSYIIGFYGAFFVENRISICTEFMDGGSLDVYRKMPEHVLGRIAVAVVKGLTYLWSLKILHRDVKPSNMLVNTRGQVKLCDFGVSTQLVNSIAKTYVGTNAYMAPERISGEQYGIHSDVWSLGISFMELALGRFPYPQVRLFITAVCHCDIHSYV

SEQ ID NO: 888317 - protein, 289 aa, Homo sapiens
MLWLALGPFPAMENQVLVIRIKIPNSGAVDWTVHSGPQLLFRDVLDVIGQVLPEATTTAFEYEDEDGDRITVRSDEEMKAMLSYYYSTVMEQQVNGQLIEPLQIFPRACKPPGERNIHGLKVNTRAGPSQHSSPAVSDSLPSNSLKKSSAELKKILANGQMNEQDIRYRDTLGHGNGGTVYKAYHVPSGKILAVKVILLDITLELQKQIMSELEILYKCDSSYIIGFYGAFFVENRISICTEFMDGGSLDVYRKMPEHVLGRIAVAVVKGLTYLWSLKILHRANKDLCT

SEQ ID NO: 888318 - protein, 184 aa, Homo sapiens
MENQVLVIRIKIPNSGAVDWTVHSGPQLLFRDVLDVIGQVLPEATTTAFEYEDEDGDRITVRSDEEMKAMLSYYYSTVMEQQVNGQLIEPLQIFPRACKPPGERNIHGLKVNTRAGPSQHSSPAVSDSLPSNSLKKSSAELKKILANGQMNEQDIRYRDTLGHGNGGTVYKAYHVPSGKILAVK

SEQ ID NO: 888319 - protein, 76 aa, Homo sapiens
FRSNSVAAAFLLLLSPLPPSPPPQPPPVRAASGGRSSACARRALCLRVGQKTRPLNLPRGLSVVWRPWGSFLIAPD

SEQ ID NO: 888320 - protein, 437 aa, Homo sapiens; identical to SEQ ID NO: 888309

SEQ ID NO: 888321 - protein, 437 aa, Homo sapiens; identical to SEQ ID NO: 888309

SEQ ID NO: 888322 - protein, 437 aa, Homo sapiens; identical to SEQ ID NO: 888309

SEQ ID NO: 888323 - protein, 342 aa, Homo sapiens
MYLLLTPTCVLDGAIMYTLWIMYYTVYSKFFSFWTLGPTPVICRGLSGLQLQTEGCTVGFPTFEVFRLGLASLLLSLQMAYCGTSPCHPVILLDITLELQKQIMSELEILYKCDSSYIIGFYGAFFVENRISICTEFMDGGSLDVYRKMPEHVLGRIAVAVVKGLTYLWSLKILHRDVKPSNMLVNTRGQVKLCDFGVSTQLVNSIAKTYVGTNAYMAPERISGEQYGIHSDVWSLGISFMELALGRFPYPQIQKNQGSLMPLQLLQCIVDEDSPVLPVGEFSEPFVHFITQCMRKQPKERPAPEELMGHPFIVQFNDGNAAVVSMWVCRALEERRSQQGPP

SEQ ID NO: 888324 - protein, 467 aa, Homo sapiens
MLWLALGPFPAMENQVLVIRIKIPNSGAVDWTVHSGPQLLFRDVLDVIGQVLPEATTTAFEYEDEDGDRITVRSDEEMKAMLSYYYSTVMEQQVNGQLIEPLQIFPRACKPPGERNIHGLKVNTRAGPSQHSSPAVSDSLPSNSLKKSSAELKKILANGQMNEQDIRYRDTLGHGNGGTVYKAYHVPSGKILAVKVILLDITLELQKQIMSELEILYKCDSSYIIGFYGAFFVENRISICTEFMDGGSLDVYRKMPEHVLGRIAVAVVKGLTYLWSLKILHRDVKPSNMLVNTRGQVKLCDFGVSTQLVNSIAKTYVGTNAYMAPERISGEQYGIHSDVWSLGISFMEIQKNQGSLMPLQLLQCIVDEDSPVLPVGEFSEPFVHFITQCMRKQPKERPAPEELMGHPFIVQFNDGNAAVVSMWVCRALEERRSLASLPSPSPLSAGGLAWGAPCVAHPTRPSPYLLV

SEQ ID NO: 888325 - protein, 380 aa, Homo sapiens
MLWLALGPFPAMENQVLVIRIKIPNSGAVDWTVHSGPQLLFRDVLDVIGQVLPEATTTAFEYEDEDGDRITVRSDEEMKAMLSYYYSTVMEQQVNGQLIEPLQIFPRACKPPGERNIHGLKVNTRAGPSQHSSPAVSDSLPSNSLKKSSAELKKILANGQMNEQDIRYRDTLGHGNGGTVYKAYHVPSGKILAVKVILLDITLELQKQIMSELEILYKCDSSYIIGFYGAFFVENRISICTEFMDGGSLDVYRKMPEHVLGRIAVAVVKGLTYLWSLKILHRDVKPSNMLVNTRGQVKLCDFGVSTQLVNSIAKTYVGTNAYMAPERISGEQYGIHSDVWSLGISFMEPLQLLQCIVDEDSPVLPVGEFSEPFVHFITQW

SEQ ID NO: 888326 - protein, 182 aa, Homo sapiens
MEAPRVPAHFCFPNVFLYKGSGPSASLMGIKVLMLCDKKKQPTHTNTTRNTRTKTPTPHRQDPPQDQQQTAKKHRDTSTTHNPQHQHTEGARPPLHHPTTQATHDARPPHQMSQRAPPRRGNRQTEDAGAASKAHANRPTTQTHEEEETNGREGRSGNNQRKKAPHHNQNGRKHNRRASHRN

SEQ ID NO: 888327 - protein, 177 aa, Homo sapiens
PCSGARLGELPLVLHFSSYRAVGEGGPEDCELSAFRLELPLGIPPGGRAGPWGGTLWRTSFYGRFRHFLDIIDPRTLFVTERRLREAVQLLEDYKHGTLRPGVTNEQLWSAQKIKQAILHPDTNEKIFMPFRMSGYIPFGTPIALLETALTRVVLPMPILVLPPIVMSMLEKLKHPN

SEQ ID NO: 888328 - protein, 112 aa, Homo sapiens
MADTATTASAAAASAASASSDAPPFQLGKPRFQQTSFYGRFRHFLDIIDPRTLFVTEEEGCLCSKNALNKASEEEVALLDRGEEWCILILNGERRGKEEEEKNSGKESMILR

SEQ ID NO: 888329 - protein, 136 aa, Homo sapiens
PCSGARLGELPLVLHFSSYRAVGEGGPEDCELSAFRLELPLGIPPGGRAGPWGGTLWRTSFYGRFRHFLDIIDPRTLFVTEEEGCLCSKNALNKASEEEVALLDRGEEWCILILNGERRGKEEEEKNSGKESMILR

SEQ ID NO: 888330 - protein, 340 aa, Homo sapiens
MADTATTASAAAASAASASSDAPPFQLGKPRFQQTSFYGRFRHFLDIIDPRTLFVTERRLREAVQLLEDYKHGTLRPGVTNEQLWSAQKIKQAILHPDTNEKIFMPFRMSGYIPFGTPIVVGLLLPNQTLASTVFWQWLNQSHNACVNYANRNATKPSPASKFIQGYLGAVISAVSIAVGLNVLVQKANKFTPATRLLIQRFVPFPAVASANICNVVLMRYGELEEGIDVLDSDGNLVGSSKIAARHALLETALTRVVLPMPILVLPPIVMSMLEKTALLQARPRLLLPVQSLVCLAAFGLALPLAISLFPQMSEIETSQLEPEIAQATSSRTVVYNKGL

SEQ ID NO: 888331 - protein, 173 aa, Homo sapiens
MPFRMSGYIPFGTPIVVGLLLPNQTLASTVFWQWLNQSHNACVNYANRNATKPSPASKFIQGYLGAVISAVSIAVGLNVLVQKANKFTPATRLLIQRFVPFPAVGPAGDGADASGPAHAHPGATPDRHVHAGEDGSPAGTPPAAPPCAKPRVPGSLRPGPAAGHQPLPANVRD

SEQ ID NO: 888332 - protein, 177 aa, Homo sapiens
MPFRMSGYIPFGTPIVVGLLLPNQTLASTVFWQWLNQSHNACVNYANRNATKPSPASKFIQGYLGAVISAVSIAVGLNVLVQKANKFTPATRLLIQRFVPFPAVASANICNVVLMRYGELEEGIDVLDSDGNLVGSSKIAARHALLETALTRVVLPMPILVLPPIVMSMLEKLKHPN

SEQ ID NO: 888333 - protein, 236 aa, Homo sapiens
MPFRMSGYIPFGTPIVVGLLLPNQTLASTVFWQWLNQSHNACVNYANRNATKPSPASKFIQGYLGAVISAVSIAVGLNVLVQKANKFTPATRLLIQRFVPFPAVASANICNVVLMRYGELEEGIDVLDSDGNLVGSSKIAARHALLETALTRVVLPMPILVLPPIVMSMLEKTALLQARPRLLLPVQSLVCLAAFGLALPLAISLFPQMSEIETSQLEPEIAQATSSRTVVYNKGL

SEQ ID NO: 888334 - protein, 131 aa, Homo sapiens
PCSGARLGELPLVLHFSSYRAVGEGGPEDCELSAFRLELPLGIPPGGRAGPWGGTLWRTSFYGRFRHFLDIIDPRTLFVTEVSHGCHLSGPWAFVPCHFRICGSLREGEDGGVKRIGEVRGERKVTNSLYL

SEQ ID NO: 888335 - protein, 236 aa, Homo sapiens; identical to SEQ ID NO: 888333

SEQ ID NO: 888336 - protein, 364 aa, Homo sapiens
PCSGARLGELPLVLHFSSYRAVGEGGPEDCELSAFRLELPLGIPPGGRAGPWGGTLWRTSFYGRFRHFLDIIDPRTLFVTERRLREAVQLLEDYKHGTLRPGVTNEQLWSAQKIKQAILHPDTNEKIFMPFRMSGYIPFGTPIVVGLLLPNQTLASTVFWQWLNQSHNACVNYANRNATKPSPASKFIQGYLGAVISAVSIAVGLNVLVQKANKFTPATRLLIQRFVPFPAVASANICNVVLMRYGELEEGIDVLDSDGNLVGSSKIAARHALLETALTRVVLPMPILVLPPIVMSMLEKTALLQARPRLLLPVQSLVCLAAFGLALPLAISLFPQMSEIETSQLEPEIAQATSSRTVVYNKGL

SEQ ID NO: 888337 - protein, 97 aa, Homo sapiens
QPDSGVQQGVVSVVSGLGTEHCAAGELEGQARRLTAAVASANICNVVLMRYGELEEGIDVLDSDGNLVGSSKIAARHALLETALTRVVLPMPIHILT

SEQ ID NO: 888338 - protein, 80 aa, Homo sapiens
QAFDLGFASLQNCFLHHHNSMWSDRIGFKEETKSHLLQETALPSTSSPYSLVLQTPKLCRRKAAWYMGRKTRLSDLESTS

SEQ ID NO: 888339 - protein, 521 aa, Homo sapiens
MEASVLSPTSWEKRRAWLRQSRNWQTQVLEEEAAAALQDVPDPEPSSLDDVFQEGNPINKIEDWLQDCGYSEEGFSEEAGQFIYNGFCSHGTSFEDDLTLGAEATLLAANGKLFSRSFLETARPCQLLDLGCSLASSSMTGGTNKTSSSISEILDKVQEDAEDVLFSLGFGQEDHKDTSRIPARFFTTPSQAKGIDFQLFLKSQVRRIEMEDPCLMLASRFKQVQTLAVTADAFFCLYSYVSKTPVQKFTPSHMFWNCNHPTDVPSIRILSREPEPQSPRDRLRKAISKMCLYTCPRDRPPPPHNTPKRNSLDQVVLEVMDKVKEEKQFLQQDSDLGQFSQEDPVPPAEGKKLPTSPYPCVFCCEEETQQRMSTVLAPSQTLDSNPKVPCCTHSLPIEDPQWSTDPAQIRRELCSLPATNTETHPAKDETFWKRKSRARKSLFQKNLMGRKVKSLDLSITQQKWKQSVDRPELRRSLSQQPQDTFDLEEVQSNSEEEQSQSRWPSRPRHPHHHQTFAGKDS

SEQ ID NO: 888340 - protein, 449 aa, Homo sapiens
MEASVLSPTSWEKRRAWLRQSRNWQTQVLEEEAAAALQDVPDPEPSSLDDVFQEGNPINKIEDWLQDCGYSEEGFSEEAGQFIYNGFCSHGTSFEDDLTLGAEATLLAANGKLFSRSFLETARPCQLLDLGCSLASSSMTGGTNKTSSSISEILDKVQEDAFFCLYSYVSKTPVQKFTPSHMFWNCNHPTDVPSIRILSREPEPQSPRDRLRKAISKMCLYTCPRDRPPPPHNTPKRNSLDQVVLEVMDKVKEEKQFLQQDSDLGQFSQEDPVPPAEGKKLPTSPYPCVFCCEEETQQRMSTVLAPSQTLDSNPKVPCCTHSLPIEDPQWSTDPAQIRRELCSLPATNTETHPAKDETFWKRKSRARKSLFQKNLMGRKVKSLDLSITQQKWKQSVDRPELRRSLSQQPQDTFDLEEVQSNSEEEQSQSRWPSRPRHPHHHQTFAGKDS

SEQ ID NO: 888341 - protein, 383 aa, Homo sapiens
MTGGTNKTSSSISEILDKVQEDAEDVLFSLGFGQEDHKDTSRIPARFFTTPSQAKGIDFQLFLKSQVRRIEMEDPCLMLASRFKQVQTLAVTADAFFCLYSYVSKTPVQKFTPSHMFWNCNHPTDVPSIRILSREPEPQSPRDRLRKAISKMCLYTCPRDRPPPPHNTPKRNSLDQVVLEVMDKVKEEKQFLQQDSDLGQFSQEDPVPPAEGKKLPTSPYPCVFCCEEETQQRMSTVLAPSQTLDSNPKVPCCTHSLPIEDPQWSTDPAQIRRELCSLPATNTETHPAKDETFWKRKSRARKSLFQKNLMGRKVKSLDLSITQQKWKQSVDRPELRRSLSQQPQDTFDLEEVQSNSEEEQSQSRWPSRPRHPHHHQTFAGKDS

SEQ ID NO: 888342 - protein, 411 aa, Homo sapiens
MTGGTNKTSSSISEILDKVQEDAEDVLFSLGFGQEDHKDTSRIPARFFTTPSQAKGIDFQLFLKSQVRRIEMEDPCLMLASRFKQVQTLAVTADAFFCLYSYVSKTPVQKFTPSHMFWNCNHPTDVPSIRILSREPEPQSPRDRLRKAISKMCLYTCPRDRPPPPHNTPKRNSLDQVVLEVMDKVKEEKQFLQQDSDLGQFSQEDPVPPAEGKKLPTSPYPCVFCCEEETQQRMSTVLAPSQTLDSNPKVPCCTHSLPIEDPQWSTDPAQIRRELCSLPATNTETHPAKDETFWKRKSRARKSLFQKNLMGRKVKSLDLSITQQKWKQSVDRPELRRSLSQQPQDTFDLEEAFSTTTTACGLTELASKKKLKATSCRKLHCPQHPAPTPWSSKPPNSAGERQHGTWGGRPD

SEQ ID NO: 888343 - protein, 383 aa, Homo sapiens; identical to SEQ ID NO: 888341

SEQ ID NO: 888344 - protein, 383 aa, Homo sapiens; identical to SEQ ID NO: 888341

SEQ ID NO: 888345 - protein, 383 aa, Homo sapiens; identical to SEQ ID NO: 888341

SEQ ID NO: 888346 - protein, 383 aa, Homo sapiens; identical to SEQ ID NO: 888341

SEQ ID NO: 888347 - protein, 599 aa, Homo sapiens
MDGSRRVRATSVLPRYGPPCLFKGHLSTKSNAFCTDSSSLRLSTLQLVKNHMAVHYNKILSAKAAVDCSVPVSVSTSIKYADQQRREKLKKELAQCEKEFKLTKTAMRANYKNNSKSLFNTLQKPSGEPQIEDDMLKEEMNGFSSFARSLVPSSERLHLSLHKSSKVITNGPEKNSSSSPSSVDYAASGPRKLSSGALYGRRPRSTFPNSHRFQLVISKAPSGDLLDKHSELFSNKQLPFTPRTLKTEAKSFLSQYRYYTPAKRKKDFTDQRIEAETQTELSFKSELGTAETKNMTDSEMNIKQASNCVTYDAKEKIAPLPLEGHDSTWDEIKDDALQHSSPRAMCQYSLKPPSTRKIYSDEEELLYLSFIEDVTDEILKLGLFSNRFLERLFERHIKQNKHLEEEKMRHLLHVLKVDLGCTSEENSVKQNDVDMLNVFDFEKAGNSEPNELKNESEVTIQQERQQYQKALDMLLSAPKDENEIFPSPTEFFMPIYKSKHSEGVIIQQVNDETNLETSTLDENHPSISDSLTDRETSVNVIEGDSDPEKVEISNGLCGLNTSPSQSVQFSSVKGDNNHDMELSTLKIMEMSIEDCPLDV

SEQ ID NO: 888348 - protein, 567 aa, Homo sapiens
MDGSRRVRATSVLPRYGPPCLFKGHLSTKSNAAVDCSVPVSVSTSIKYADQQRREKLKKELAQCEKEFKLTKTAMRANYKNNSKSLFNTLQKPSGEPQIEDDMLKEEMNGFSSFARSLVPSSERLHLSLHKSSKVITNGPEKNSSSSPSSVDYAASGPRKLSSGALYGRRPRSTFPNSHRFQLVISKAPSGDLLDKHSELFSNKQLPFTPRTLKTEAKSFLSQYRYYTPAKRKKDFTDQRIEAETQTELSFKSELGTAETKNMTDSEMNIKQASNCVTYDAKEKIAPLPLEGHDSTWDEIKDDALQHSSPRAMCQYSLKPPSTRKIYSDEEELLYLSFIEDVTDEILKLGLFSNRFLERLFERHIKQNKHLEEEKMRHLLHVLKVDLGCTSEENSVKQNDVDMLNVFDFEKAGNSEPNELKNESEVTIQQERQQYQKALDMLLSAPKDENEIFPSPTEFFMPIYKSKHSEGVIIQQVNDETNLETSTLDENHPSISDSLTDRETSVNVIEGDSDPEKVEISNGLCGLNTSPSQSVQFSSVKGDNNHDMELSTLKIMEMSIEDCPLDV

SEQ ID NO: 888349 - protein, 493 aa, Homo sapiens
MRANYKNNSKSLFNTLQKPSGEPQIEDDMLKEEMNGFSSFARSLVPSSERLHLSLHKSSKVITNGPEKNSSSSPSSVDYAASGPRKLSSGALYGRRPRSTFPNSHRFQLVISKAPSGDLLDKHSELFSNKQLPFTPRTLKTEAKSFLSQYRYYTPAKRKKDFTDQRIEAETQTELSFKSELGTAETKNMTDSEMNIKQASNCVTYDAKEKIAPLPLEGHDSTWDEIKDDALQHSSPRAMCQYSLKPPSTRKIYSDEEELLYLSFIEDVTDEILKLGLFSNRFLERLFERHIKQNKHLEEEKMRHLLHVLKVDLGCTSEENSVKQNDVDMLNVFDFEKAGNSEPNELKNESEVTIQQERQQYQKALDMLLSAPKDENEIFPSPTEFFMPIYKSKHSEGVIIQQVNDETNLETSTLDENHPSISDSLTDRETSVNVIEGDSDPEKVEISNGLCGLNTSPSQSVQFSSVKGDNNHDMELSTLKIMEMSIEDCPLDV

SEQ ID NO: 888350 - protein, 585 aa, Homo sapiens
MDGSRRVRATSVLPRYGPPCLFKGHLSTKSNAAVDCSVPVSVSTSIKCIHVPWWFAAPINLSSTLDADQQRREKLKKELAQCEKEFKLTKTAMRANYKNNSKSLFNTLQKPSGEPQIEDDMLKEEMNGFSSFARSLVPSSERLHLSLHKSSKVITNGPEKNSSSSPSSVDYAASGPRKLSSGALYGRRPRSTFPNSHRFQLVISKAPSGDLLDKHSELFSNKQLPFTPRTLKTEAKSFLSQYRYYTPAKRKKDFTDQRIEAETQTELSFKSELGTAETKNMTDSEMNIKQASNCVTYDAKEKIAPLPLEGHDSTWDEIKDDALQHSSPRAMCQYSLKPPSTRKIYSDEEELLYLSFIEDVTDEILKLGLFSNRFLERLFERHIKQNKHLEEEKMRHLLHVLKVDLGCTSEENSVKQNDVDMLNVFDFEKAGNSEPNELKNESEVTIQQERQQYQKALDMLLSAPKDENEIFPSPTEFFMPIYKSKHSEGVIIQQVNDETNLETSTLDENHPSISDSLTDRETSVNVIEGDSDPEKVEISNGLCGLNTSPSQSVQFSSVKGDNNHDMELSTLKIMEMSIEDCPLDV

SEQ ID NO: 888351 - protein, 535 aa, Homo sapiens
MNLGAPVLGANIPRIDADQQRREKLKKELAQCEKEFKLTKTAMRANYKNNSKSLFNTLQKPSGEPQIEDDMLKEEMNGFSSFARSLVPSSERLHLSLHKSSKVITNGPEKNSSSSPSSVDYAASGPRKLSSGALYGRRPRSTFPNSHRFQLVISKAPSGDLLDKHSELFSNKQLPFTPRTLKTEAKSFLSQYRYYTPAKRKKDFTDQRIEAETQTELSFKSELGTAETKNMTDSEMNIKQASNCVTYDAKEKIAPLPLEGHDSTWDEIKDDALQHSSPRAMCQYSLKPPSTRKIYSDEEELLYLSFIEDVTDEILKLGLFSNRFLERLFERHIKQNKHLEEEKMRHLLHVLKVDLGCTSEENSVKQNDVDMLNVFDFEKAGNSEPNELKNESEVTIQQERQQYQKALDMLLSAPKDENEIFPSPTEFFMPIYKSKHSEGVIIQQVNDETNLETSTLDENHPSISDSLTDRETSVNVIEGDSDPEKVEISNGLCGLNTSPSQSVQFSSVKGDNNHDMELSTLKIMEMSIEDCPLDV

SEQ ID NO: 888352 - protein, 493 aa, Homo sapiens; identical to SEQ ID NO: 888349

SEQ ID NO: 888353 - protein, 458 aa, Homo sapiens
MDGSRRVRATSVLPRYGPPCLFKGHLSTKSNAFCTDSSSLRLSTLQLVKNHMAVHYNKILSAKAAVDCSVPVSVSTSIKYADQQRREKLKKELAQCEKEFKLTKTAMRANYKNNSKSLFNTLQKPSGEPQIEDDMLKEEMNGFSSFARSLVPSSERLHLSLHKSSKVITNGPEKNSSSSPSSVDYAASGPRKLSSGALYGRRPRSTFPNSHRFQLVISKAPSGDLLDKHSELFSNKQLPFTPRTLKTEAKSFLSQYRYYTPAKRKKDFTDQRIEAETQTELSFKSELGTAETKNMTDSEMNIKQASNCVTYDAKEKIAPLPLEGHDSTWDEIKDDALQHSSPRAMCQYSLKPPSTRKIYSDEEELLYLSFIEDVTDEILKLGLFSNRFLERLFERHIKQNKHLEEEKMRHLLHVLKVDLGCTSEENSFSSVKGDNNHDMELSTLKIMEMSIEDCPLDV

SEQ ID NO: 888354 - protein, 504 aa, Homo sapiens
MDGSRRVRATSVLPRYGPPCLFKGHLSTKSNAFCTDSSSLRLSTLQLVKNHMAVHYNKILSAKAAVDCSVPVSVSTSIKYADQQRREKLKKELAQCEKEFKLTKTAMRANYKNNSKSLFNTLQKPSGEPQIEDDMLKEEMNGFSSFARSLVPSSERLHLSLHKSSKVITNGPEKNSSSSPSSVDYAASGPRKLSSGALYGRRPRSTFPNSHRFQLVISKAPSGDLLDKHSELFSNKQLPFTPRTLKTEAKSFLSQYRYYTPAKRKKDFTDQRIEAETQTELSFKSELGTAETKNMTDSEMNIKQASNCVTYDAKEKIAPLPLEGHDSTWDEIKDDALQHSSPRAMCQYSLKPPSTRKIYSDEEELLYLSFIEDVTDEILKLGLFSNRFLERLFERHIKQNKHLEEEKMRHLLHVLKVDLGCTSEENSVKQNDVDMLNVFDFEKAGNSEPNELKNESEVTIQQERQQYQKALDMYCRHQRMRTRYSLHQLNFSCLFINQSIQKGL

SEQ ID NO: 888355 - protein, 444 aa, Homo sapiens
MDGSRRVRATSVLPRYGPPCLFKGHLSTKSNAFCTDSSSLRLSTLQLVKNHMAVHYNKILSAKAAVDCSVPVSVSTSIKYADQQRREKLKKELAQCEKEFKLTKTAMRANYKNNSKSLFNTLQKPSGEPQIEDDMLKEEMNGFSSFARSLVPSSERLHLSLHKSSKVITNGPEKNSSSSPSSVDYAASGPRKLSSGALYGRRPRSTFPNSHRFQLVISKAPSGDLLDKHSELFSNKQLPFTPRTLKTEAKSFLSQYRYYTPAKRKKDFTDQRIEAETQTELSFKSELGTAETKNMTDSEMNIKQASNCVTYDAKEKIAPLPLEGHDSTWDEIKDDALQHSSPRAMCQYSLKPPSTRKIYSDEEELLYLSFIEDVTDEILKLGLFSNRFLERLFERHIKQNKHLEEEKMRHLLHVLKVDLGCTSEENSIPDAATTGPKTTPLEDE

SEQ ID NO: 888356 - protein, 174 aa, Homo sapiens
MKYKNLMARALYDNVPECAEELAFRKGDILTVIEQNTGGLEGWWLCSLHGRQGIVPGNRVKLLIGPMQETASSHEQPASGLMQQTFGQQKLYQVPNPQAAPRDTIYQVPPSYQNQGIYQVPTGHGTQEQEVYQVPPSVQRSIGGTSGPHVGKKVFQRDGQVSYFLVRASKQTSL

SEQ ID NO: 888357 - protein, 834 aa, Homo sapiens
MKYKNLMARALYDNVPECAEELAFRKGDILTVIEQNTGGLEGWWLCSLHGRQGIVPGNRVKLLIGPMQETASSHEQPASGLMQQTFGQQKLYQVPNPQAAPRDTIYQVPPSYQNQGIYQVPTGHGTQEQEVYQVPPSVQRSIGGTSGPHVGKKVITPVRTGHGYVYEYPSRYQKDVYDIPPSHTTQGVYDIPPSSAKGPVFSVPVGEIKPQGVYDIPPTKGVYAIPPSACRDEAGLREKDYDFPPPMRQAGRPDLRPEGVYDIPPTCTKPAGKDLHVKYNCDIPGAAEPVARRHQSLSPNHPPPQLGQSVGSQNDAYDVPRGVQFLEPPAETSEKANPQERDGVYDVPLHNPPDAKGSRDLVDGINRLSFSSTGSTRSNMSTSSTSSKESSLSASPAQDKRLFLDPDTAIERLQRLQQALEMGVSSLMALVTTDWRCYGYMERHINEIRTAVDKVELFLKEYLHFVKGAVANAACLPELILHNKMKRELQRVEDSHQILSQTSHDLNECSWSLNILAINKPQNKCDDLDRFVMVAKTVPDDAKQLTTTINTNAEALFRPGPGSLHLKNGPESIMNSTEYPHGGSQGQLLHPGDHKAQAHNKALPPGLSKEQAPDCSSSDGSERSWMDDYDYVHLQGKEEFERQQKELLEKENIMKQNKMQLEHHQLSQFQLLEQEITKPVENDISKWKPSQSLPTTNSGVSAQDRQLLCFYYDQCETHFISLLNAIDALFSCVSSAQPPRIFVAHSKFVILSAHKLVFIGDTLTRQVTAQDIRNKVMNSSNQLCEQLKTIVMATKMAALHYPSTTALQEMVHQVTDLSRNAQLFKRSLLEMATF

SEQ ID NO: 888358 - protein, 834 aa, Homo sapiens; identical to SEQ ID NO: 888357

SEQ ID NO: 888359 - protein, 834 aa, Homo sapiens; identical to SEQ ID NO: 888357

SEQ ID NO: 888360 - protein, 818 aa, Homo sapiens
MKYKNLMARALYDNVPECAEELAFRKGDILTVIEQNTGGLEGWWLCSLHGRQGIVPGNRVKLLIGPMQETASSHEQPASGLMQQTFGQQKLYQVPNPQAAPRDTIYQVPPSYQNQGIYQVPTGHGTQEQEVYQVPPSVQRSIGGTSGPHVGKKVITPVRTGHGYVYEYPSRYQKDVYDIPPSHTTQGVYDIPPSSAKGPVFSVPVGEIKPQGVYDIPPTKGVYAIPPSACRDEAGLREKDYDFPPPMRQAGRPDLRPEGVYDIPPTCTKPAGKDLHVKYNCDIPGAAEPVARRHQSLSPNHPPPQLGQSVGSQNDAYDVPRGVQFLEPPAETSEKANPQERDGVYDVPLHNPPDAKGSRDLVDGINRLSFSSTGSTRSNMSTSSTSSKEILTVSLPSSGQKQALEMGVSSLMALVTTDWRCYGYMERHINEIRTAVDKVELFLKEYLHFVKGAVANAACLPELILHNKMKRELQRVEDSHQILSQTSHDLNECSWSLNILAINKPQNKCDDLDRFVMVAKTVPDDAKQLTTTINTNAEALFRPGPGSLHLKNGPESIMNSTEYPHGGSQGQLLHPGDHKAQAHNKALPPGLSKEQAPDCSSSDGSERSWMDDYDYVHLQGKEEFERQQKELLEKENIMKQNKMQLEHHQLSQFQLLEQEITKPVENDISKWKPSQSLPTTNSGVSAQDRQLLCFYYDQCETHFISLLNAIDALFSCVSSAQPPRIFVAHSKFVILSAHKLVFIGDTLTRQVTAQDIRNKVMNSSNQLCEQLKTIVMATKMAALHYPSTTALQEMVHQVTDLSRNAQLFKRSLLEMATF

SEQ ID NO: 888361 - protein, 834 aa, Homo sapiens
MWTRNLMARALYDNVPECAEELAFRKGDILTVIEQNTGGLEGWWLCSLHGRQGIVPGNRVKLLIGPMQETASSHEQPASGLMQQTFGQQKLYQVPNPQAAPRDTIYQVPPSYQNQGIYQVPTGHGTQEQEVYQVPPSVQRSIGGTSGPHVGKKVITPVRTGHGYVYEYPSRYQKDVYDIPPSHTTQGVYDIPPSSAKGPVFSVPVGEIKPQGVYDIPPTKGVYAIPPSACRDEAGLREKDYDFPPPMRQAGRPDLRPEGVYDIPPTCTKPAGKDLHVKYNCDIPGAAEPVARRHQSLSPNHPPPQLGQSVGSQNDAYDVPRGVQFLEPPAETSEKANPQERDGVYDVPLHNPPDAKGSRDLVDGINRLSFSSTGSTRSNMSTSSTSSKESSLSASPAQDKRLFLDPDTAIERLQRLQQALEMGVSSLMALVTTDWRCYGYMERHINEIRTAVDKVELFLKEYLHFVKGAVANAACLPELILHNKMKRELQRVEDSHQILSQTSHDLNECSWSLNILAINKPQNKCDDLDRFVMVAKTVPDDAKQLTTTINTNAEALFRPGPGSLHLKNGPESIMNSTEYPHGGSQGQLLHPGDHKAQAHNKALPPGLSKEQAPDCSSSDGSERSWMDDYDYVHLQGKEEFERQQKELLEKENIMKQNKMQLEHHQLSQFQLLEQEITKPVENDISKWKPSQSLPTTNSGVSAQDRQLLCFYYDQCETHFISLLNAIDALFSCVSSAQPPRIFVAHSKFVILSAHKLVFIGDTLTRQVTAQDIRNKVMNSSNQLCEQLKTIVMATKMAALHYPSTTALQEMVHQVTDLSRNAQLFKRSLLEMATF

SEQ ID NO: 888362 - protein, 685 aa, Homo sapiens
MKYKVITPVRTGHGYVYEYPSRYQKDVYDIPPSHTTQGVYDIPPSSAKGPVFSVPVGEIKPQGVYDIPPTKGVYAIPPSACRDEAGLREKDYDFPPPMRQAGRPDLRPEGVYDIPPTCTKPAGKDLHVKYNCDIPGAAEPVARRHQSLSPNHPPPQLGQSVGSQNDAYDVPRGVQFLEPPAETSEKANPQERDGVYDVPLHNPPDAKGSRDLVDGINRLSFSSTGSTRSNMSTSSTSSKESSLSASPAQDKRLFLDPDTAIERLQRLQQALEMGVSSLMALVTTDWRCYGYMERHINEIRTAVDKVELFLKEYLHFVKGAVANAACLPELILHNKMKRELQRVEDSHQILSQTSHDLNECSWSLNILAINKPQNKCDDLDRFVMVAKTVPDDAKQLTTTINTNAEALFRPGPGSLHLKNGPESIMNSTEYPHGGSQGQLLHPGDHKAQAHNKALPPGLSKEQAPDCSSSDGSERSWMDDYDYVHLQGKEEFERQQKELLEKENIMKQNKMQLEHHQLSQFQLLEQEITKPVENDISKWKPSQSLPTTNSGVSAQDRQLLCFYYDQCETHFISLLNAIDALFSCVSSAQPPRIFVAHSKFVILSAHKLVFIGDTLTRQVTAQDIRNKVMNSSNQLCEQLKTIVMATKMAALHYPSTTALQEMVHQVTDLSRNAQLFKRSLLEMATF

SEQ ID NO: 888363 - protein, 611 aa, Homo sapiens
MKYKNLMARALYDNVPECAEELAFRKGDILTVIEQNTGGLEGWWLCSLHGRQGIVPGNRVKLLIGPMQETASSHEQPASGLMQQTFGQQKLYQVPNPQAAPRDTIYQVPPSYQNQGIYQVPTGHGTQEQEVYQVPPSVQRSIGGTSGPHVGKKVITPVRTGHGYVYEYPSRYQKDVYDIPPSHTTQGVYDIPPSSAKGPVFSVPVGEIKPQGVYDIPPTKGVYAIPPSACRDEAGLREKDYDFPPPMRQAGRPDLRPEGVYDIPPTCTKPAGKDLHVKYNCDIPGAAEPVARRHQSLSPNHPPPQLGQSVGSQNDAYDVPRGVQFLEPPAETSEKANPQERDGVYDVPLHNPPDAKGSRDLVDGINRLSFSSTGSTRSNMSTSSTSSKESSLSASPAQDKSWMDDYDYVHLQGKEEFERQQKELLEKENIMKQNKMQLEHHQLSQFQLLEQEITKPVENDISKWKPSQSLPTTNSGVSAQDRQLLCFYYDQCETHFISLLNAIDALFSCVSSAQPPRIFVAHSKFVILSAHKLVFIGDTLTRQVTAQDIRNKVMNSSNQLCEQLKTIVMATKMAALHYPSTTALQEMVHQVTDLSRNAQLFKRSLLEMATF

SEQ ID NO: 888364 - protein, 834 aa, Homo sapiens; identical to SEQ ID NO: 888357

SEQ ID NO: 888365 - protein, 814 aa, Homo sapiens
MKYKNLMARALYDNVPECAEELAFRKGDILTVIEQNTGGLEGWWLCSLHGRQGIVPGNRVKLLIGPMQETASSHEQPASGLMQQTFGQQKLYQVPNPQAAPRDTIYQVPPSYQNQGIYQVPTGHGTQEQEVYQVPPSVQRSIGGTSGPHVGKKVITPVRTGHGYVYEYPSRYQKDVYDIPPSHTTQGVYDIPPSSAKGPVFSVPVGEIKPQGVYDIPPTKGVYAIPPSACRDEAGLREKDYDFPPPMRQAGRPDLRPEGVYDIPPTCTKPAGKDLHVKYNCDIPGAAEPVARRHQSLSPNHPPPQLGQSVGSQNDAYDVPRGVQFLEPPAETSEKANPQERDGVYDVPLHNPPDAKGSRDLVDGINRLSFSSTGSTRSNMSTSSTSSKESSLSASPAQDKRLFLDPDTAIERLQRLQQALEMGVSSLMALVTTDWRCYGYMERHINEIRTAVDKVELFLKEYLHFVKGAVANAACLPELILHNKMKRELQRVEDSHQILSQTSHDLNECSWSLNILAINKPQNKCDDLDRFVMVAKTVPDDAKQLTTTINTNAEALFRPGPGSLHLKNGPESIMNSTEYPHGGSQGQLLHPGDHKAQAHNKALPPGLSKEQAPDCSSSDGSERSWMDDYDYVHLQGKEEFERQQKELLEKENIMKQNKMQLEHHQLSQFQLLEQEITKPVENDISKWKPSQSLPTTNSGVSAQDRQLLCFYYDQCETHFISLLNAIDALFSCVSSAQPPRIFVAHSKFVILSAHKLVFIGDTLTRARWNWAPKGGKTQIFPGPKTQKKGVPKFGKNPFPPKGPKKTPQKGPFPL

SEQ ID NO: 888366 - protein, 693 aa, Homo sapiens
MKYKNLMARALYDNVPECAEELAFRKGDILTVIEQNTGGLEGWWLCSLHGRQGIVPGNRVKLLIGPMQETASSHEQPASGLMQQTFGQQKLYQVPNPQAAPRDTIYQVPPSYQNQGIYQVPTGHGTQEQEVYQVPPSVQRSIGGTSGPHVGKKVITPVRTGHGYVYEYPSRYQKDVYDIPPSHTTQGVYDIPPSSAKGPVFSVPVGEIKPQGVYDIPPTKGVYAIPPSACRDEAGLREKDYDFPPPMRQAGRPDLRPEGVYDIPPTCTKPAGKDLHVKYNCDIPGAAEPVARRHQSLSPNHPPPQLGQSVGSQNDAYDVPRGVQFLEPPAETSEKANPQERDGVYDVPLHNPPDAKGSRDLVDGINRLSFSSTGSTRSNMSTSSTSSKESSLSASPAQDKRLFLDPDTAIERLQRLQQALEMGVSSLMALVTTDWRCYGYMERHINEIRTAVDKVELFLKEYLHFVKGAVANAACLPELILHNKMKRELQRVEDSHQILSQTSHDLNECSWSLNILAINKPQNKCDDLDRFVMVAKTVPDDAKQLTTTINTNAEALFRPGPGSLHLKNGPESIMNSTEYPHGGSQGQLLHPGDHKAQAHNKALPPGLSKEQAPDCSSSDGSERSWMDDYDYVHLQGKEEFERQQKELLEKENIMKQNKMQLEHHQVSSIRAKTAWHWKDFPPSTKERYHFKRL

SEQ ID NO: 888367 - protein, 177 aa, Homo sapiens
MKYKNLMARALYDNVPECAEELAFRKGDILTVIEQNTGGLEGWWLCSLHGRQGIVPGNRVKLLIGPMQETASSHEQPASGLMQQTFGQQKLYQVPNPQAAPRDTIYQVPPSYQNQGIYQVPTGHGTQEQEVYQVPPSVQRSIGGTSGPHVGKKAPSQLCIKEVKWMPKERSAPKETC

SEQ ID NO: 888368 - protein, 174 aa, Homo sapiens; identical to SEQ ID NO: 888356

SEQ ID NO: 888369 - protein, 177 aa, Homo sapiens; identical to SEQ ID NO: 888367

SEQ ID NO: 888370 - protein, 110 aa, Homo sapiens
MRQAGRPDLRPEGVYDIPPTCTKPAGKDLHVKYNCDIPGAAEPVARRHQSLSPNHPPPQLGQSVGSQNDAYDVPRGVQFLEPPAETSEKANPQERDGVYDVPLHNPPDAK

SEQ ID NO: 888371 - protein, 750 aa, Homo sapiens [sequence omitted]

SEQ ID NO: 888372 - protein, 750 aa, Homo sapiens [sequence omitted]

SEQ ID NO: 888373 - protein, 732 aa, Homo sapiens
MLRAKNQLFLLSPHYLRQVKESSGSRLIQQRLLHQQQPLHPEWAALAKKQLKGKNPEDLIWHTPEGISIKPLYSKRDTMDLPEELPGVKPFTRGPYPTMYTFRPWTIRQYAGFSTVEESNKFYKDNIKAGQQGLSVAFDLATHRGYDSDNPRVRGDVGMAGVAIDTVEDTKILFDGIPLEKMSVSMTMNGAVIPVLANFIVTGEEQGVPKEKLTGTIQNDILKEFMVRNTYIFPPEPSMKIIADIFEYTAKHMPKFNSISISGYHMQEAGADAILELAYTLADGLEYSRTGLQAGLTIDEFAPRLSFFWGIGMNFYMEIAKMRAGRRLWAHLIEKMFQPKNSKSLLLRAHCQTSGWSLTEQDPYNNIVRTAIEAMAAVFGGTQSLHTNSFDEALGLPTGIPKVADPWGGSYMMECLTNDVYDAALKLINEIEEMGGMAKAVAEGIPKLRIEECAARRQARIDSGSEVIVGVNKYQLEKEDAVEVLAIDNTSVRNRQIEKLKKIKSSRDQALAERCLAALTECAASGDGNILALAVDASRARCTVGEITDALKKVFGEHKANDRMVSGAYRQEFGESKEITSAIKRVHKFMEREGRRPRLLVAKMGQDGHDRGAKVIATGFADLGFDVDIGPLFQTPREVAQQAVDADVHAVGVSTLAAGHKTLVPELIKELNSLGRPDILVMCGGVIPPQDYEFLFEVGVSNVFGPGTRIPKAAVQVLDDIEKCLEKKQQSV

SEQ ID NO: 888374 - protein, 732 aa, Homo sapiens
MLRAKNQLFLLSPHYLRQVKESSGSRLIQQRLLHQQQPLHPEWAALAKKQLKGKNPEDLIWHTPEGISIKPLYSKRDTMDLPEELPGVKPFTRGPYPTMYTFRPWTIRQYAGFSTVEESNKFYKDNIKAGQQGLSVAFDLATHRGYDSDNPRVRGDVGMAGVAIDTVEDTKILFDGIPLEKMSVSMTMNGAVIPVLANFIVTGEEQGVPKEKLTGTIQNDILKEFMVRNTYIFPPEPSMKIIADIFEYTAKHMPKFNSISISGYHMQEAGADAILELAYTLADGLEYSRTGLQAGLTIDEFAPRLSFFWGIGMNFYMEIAKMRAGRRLWAHLIEKMFQPKNSKSLLLRAHCQTSGWSLTEQDPYNNIVRTAIEAMAAVFGGTQSLHTNSFDEALGLPTVKSARIARNTQIIIQEESGIPKVADPWGGSYMMECLTNDVYDAALKLINEIEEMGGMAKAVAEGIPKLRIEECAARRQARIDSGSEVIVGVNKYQLEKEDAVEVLAIDNTSVRNRQIEKLKKIKSSRDQALAERCLAALTECAASGDGNILALAVDASRARCTVGEITDALKKEFGESKEITSAIKRVHKFMEREGRRPRLLVAKMGQDGHDRGAKVIATGFADLGFDVDIGPLFQTPREVAQQAVDADVHAVGVSTLAAGHKTLVPELIKELNSLGRPDILVMCGGVIPPQDYEFLFEVGVSNVFGPGTRIPKAAVQVLDDIEKCLEKKQQSV

SEQ ID NO: 888375 - protein, 652 aa, Homo sapiens
MYTFRPWTIRQYAGFSTVEESNKFYKDNIKAGQQGLSVAFDLATHRGYDSDNPRVRGDVGMAGVAIDTVEDTKILFDGIPLEKMSVSMTMNGAVIPVLANFIVTGEEQGVPKEKLTGTIQNDILKEFMVRNTYIFPPEPSMKIIADIFEYTAKHMPKFNSISISGYHMQEAGADAILELAYTLADGLEYSRTGLQAGLTIDEFAPRLSFFWGIGMNFYMEIAKMRAGRRLWAHLIEKMFQPKNSKSLLLRAHCQTSGWSLTEQDPYNNIVRTAIEAMAAVFGGTQSLHTNSFDEALGLPTVKSARIARNTQIIIQEESGIPKVADPWGGSYMMECLTNDVYDAALKLINEIEEMGGMAKAVAEGIPKLRIEECAARRQARIDSGSEVIVGVNKYQLEKEDAVEVLAIDNTSVRNRQIEKLKKIKSSRDQALAERCLAALTECAASGDGNILALAVDASRARCTVGEITDALKKVFGEHKANDRMVSGAYRQEFGESKEITSAIKRVHKFMEREGRRPRLLVAKMGQDGHDRGAKVIATGFADLGFDVDIGPLFQTPREVAQQAVDADVHAVGVSTLAAGHKTLVPELIKELNSLGRPDILVMCGGVIPPQDYEFLFEVGVSNVFGPGTRIPKAAVQVLDDIEKCLEKKQQSV

SEQ ID NO: 888376 - protein, 750 aa, Homo sapiens [sequence omitted]

SEQ ID NO: 888377 - protein, 376 aa, Homo sapiens [sequence omitted]

SEQ ID NO: 888378 - protein, 750 aa, Homo sapiens [sequence omitted]

SEQ ID NO: 888379 - protein, 220 aa, Homo sapiens
MFNYIEYYGKQISLSQNNEVNGTTISCFRCTVGEITDALKKVFGEHKANDRMVSGAYRQEFGESKEITSAIKRVHKFMEREGRRPRLLVAKMGQDGHDRGAKVIATGFADLGFDVDIGPLFQTPREVAQQAVDADVHAVGVSTLAAGHKTLVPELIKELNSLGRPDILVMCGGVIPPQDYEFLFEVGVSNVFGPGTRIPKAAVQVLDDIEKCLEKKQQSV

SEQ ID NO: 888380 - protein, 750 aa, Homo sapiens [sequence omitted]

SEQ ID NO: 888381 - protein, 603 aa, Homo sapiens
MLRAKNQLFLLSPHYLRQVKESSGSRLIQQRLLHQQQPLHPEWAALAKKQLKGKNPEDLIWHTPEGISIKPLYSKRDTMDLPEELPGVKPFTRGPYPTMYTFRPWTIRQYAGFSTVEESNKFYKDNIKAGQQGLSVAFDLATHRGYDSDNPRVRGDVGMAGVAIDTVEDTKILFDGIPLEKMSVSMTMNGAVIPVLANFIVTGEEQGVPKEKLTGTIQNDILKEFMVRNTYIFPPEPSMKIIADIFEYTAKHMPKFNSISISGYHMQEAGADAILELAYTLADGLEYSRTGLQAGLTIDEFAPRLSFFWGIGMNFYMEIAKMRAGRRLWAHLIEKMFQPKNSKSLLLRAHCQTSGWSLTEQDPYNNIVRTAIEAMAAVFGGTQSLHTNSFDEALGLPTVKSARIARNTQIIIQEESGIPKVADPWGGSYMMECLTNDVYDAALKLINEIEEMGGMAKAVAEGIPKLRIEECAARRQARIDSGSEVIVGVNKYQLEKEDAVEVLAIDNTSVRNRQIEKLKKIKSSRDQALAERCLAALTECAASGDGNILALAVDASRARCTVGEITDALKKVFGEHKANDRMVSGAYRQEFGESKEITSAIKR

SEQ ID NO: 888382 - protein, 585 aa, Homo sapiens
MLRAKNQLFLLSPHYLRQVKESSGSRLIQQRLLHQQQPLHPEWAALAKKQLKGKNPEDLIWHTPEGISIKPLYSKRDTMDLPEELPGVKPFTRGPYPTMYTFRPWTIRQYAGFSTVEESNKFYKDNIKAGQQGLSVAFDLATHRGYDSDNPRVRGDVGMAGVAIDTVEDTKILFDGIPLEKMSVSMTMNGAVIPVLANFIVTGEEQGVPKEKLTGTIQNDILKEFMVRNTYIFPPEPSMKIIADIFEYTAKHMPKFNSISISGYHMQEAGADAILELAYTLADGLEYSRTGLQAGLTIDEFAPRLSFFWGIGMNFYMEIAKMRAGRRLWAHLIEKMFQPKNSKSLLLRAHCQTSGWSLTEQDPYNNIVRTAIEAMAAVFGGTQSLHTNSFDEALGLPTVKSARIARNTQIIIQEESGIPKVADPWGGSYMMECLTNDVYDAALKLINEIEEMGGMAKAVAEGIPKLRIEECAARRQARIDSGSEVIVGVNKYQLEKEDAVEVLAIDNTSVRNRQIEKLKKIKSSRDQALAERCLAALTECAASGDGNILALAVDASRARWTVGENTDAWKRILGTLCVEGEPPQI

SEQ ID NO: 888383 - protein, 190 aa, Homo sapiens
MLRAKNQLFLLSPHYLRQVKESSGSRLIQQRLLHQQQPLHPEWAALAKKQLKGKNPEDLIWHTPEGISIKPLYSKRDTMDLPEELPGVKPFTRGPYPTMYTFRPWTIRQYAGFSTVEESNKFYKDNIKAGQQGLSVAFDLATHRGYDSDNPRVRGDVGMAGVAIDTVEDTKILFDGIPLDYSNLERNKVS

SEQ ID NO: 888384 - protein, 266 aa, Homo sapiens
RTVADRLRPPAPGVMQLPPALCARLAAGPGAAEPLPVERDPAAGAAPFRFVARPVRFPREHQFFEDGDVQRHLYLQDVIMQVADVPEKPRVPAFACQVAGCCQVFDALDDYEHHYHTLHGNVCSFCKRAFPSGHLLDAHILEWHDSLFQILSERQDMYQCLVEGCTEKFKTSRDRKDHMVRMHLYPADFRFDKPKKSRSPASAEAPGDSGERSEGEAMEICSEPVAASPAPAGERRIYRHRIPSTICFGQGAARGFKSNKKKTKQC

SEQ ID NO: 888385 - protein, 202 aa, Homo sapiens
RTVADRLRPPAPGVMQLPPALCARLAAGPGAAEPLPVERDPAAGAAPFRFVARPVRFPREHQFFEDGDVQRHLYLQDVIMQVADVPEKPRVPAFACQVAGCCQVFDALDDYEHHYHTLHGNVCSFCKRAFPSGHLLDAHILEWHDSLFQILSERQDMYQCLVEGCTEKFKTSRDRKDHMPSLSRSPRGQWRAVRRGGHGNLL

SEQ ID NO: 888386 - protein, 306 aa, Homo sapiens
RTVADRLRPPAPGVMQLPPALCARLAAGPGAAEPLPVERDPAAGAAPFRFVARPVRFPREHQFFEDGDVQRHLYLQDVIMQVADVPEKPRVPAFACQVAGCCQVFDALDDYEHHYHTLHGNVCSFCKRAFPSGHLLDAHILEWHDSLFQILSERQDMYQCLVEGCTEKFKTSRDRKDHMVRMHLYPADFRFDKPKKSRSPASAEAPGDSGERSEGEAMEICSEPVAASPAPAEYPLPSALVRVPLEDLKATRRKPNNADRLRKGVGGSHHCWAWHPPWAFLRPSGVAALGARPSPSSPSLFLSKWH

SEQ ID NO: 888387 - protein, 261 aa, Homo sapiens
RTVADRLRPPAPGVMQLPPALCARLAAGPGAAEPLPVERDPAAGAAPFRFVARPVRFPREHQFFEDGDVQRHLYLQDVIMQVADVPEKPRVPAFACQVAGCCQVFDALDDYEHHYHTLHGNVCSFCKRAFPSGHLLDAHILEWHDSLFQILSERQDMYQCLVEGCTEKFKTSRDRKDHMVRMHLYPADFRFDKPKKSRSPASAEAPGDSGERSEGEAMEICSEPVAASPAPAGERRIYRHRSVSELFLKPVLNMCSVLRIL

SEQ ID NO: 888388 - protein, 109 aa, Homo sapiens
MFPAPSLQMPGLWPVNEPRGAGTVGVFMEWTWGSRKSQPQRAWQEPPSLRSSSQRVCVGGWGAVTTAGRGIRLGPFSDLLVWPPWGPGPRHPPHPCSSANGISSCHQKL

SEQ ID NO: 888389 - protein, 94 aa, Homo sapiens
RTVADRLRPPAPGVMQLPPALCARLAAGPGAAEPLPVERDPAAGAAPFRFVARPVRFPREHQFFEDGDVQRHLYLQDVIMQVADVPEKPSISAW

SEQ ID NO: 888390 - protein, 110 aa, Homo sapiens
MYQCLVEGCTEKFKTSRDRKDHMVRMHLYPADFRFDKPKKSRSPASAEAPGDSGERSEGEAMEICSEPVAASPAPAGERRIYRHRIPSTICFGQGAARGFKSNKKKTKQC

SEQ ID NO: 888391 - protein, 113 aa, Homo sapiens [sequence omitted]

SEQ ID NO: 888392 - protein, 185 aa, Homo sapiens
CSPSTTASSGSRWAPGPRGEPLARPPAAPTPLARLGLRGRRRRGPTPLGRPAARRRATFPHCRRRDRRLRSPLRTAPRPGRSSGLGGRTRTKRKRRRRPGVVEALRAGGRREPFSPSPEAGLRSRMGWRARGSDPHESERPSHSHHRRLAPEREARSQIFSQGTTIRRGAGGLLPRTVLHQGPEP

SEQ ID NO: 888393 - protein, 75 aa, Homo sapiens
PGGARGSRQPPPPLAALPDPGVALLRGSPQAQRQDFAAGWGEIPAPNPSAPLALVYPTCRGDWGFPPRLRGRMEL

SEQ ID NO: 888394 - protein, 185 aa, Homo sapiens; identical to SEQ ID NO: 888392

SEQ ID NO: 888395 - protein, 185 aa, Homo sapiens; identical to SEQ ID NO: 888392

SEQ ID NO: 888396 - protein, 185 aa, Homo sapiens; identical to SEQ ID NO: 888392

SEQ ID NO: 888397 - protein, 185 aa, Homo sapiens; identical to SEQ ID NO: 888392

SEQ ID NO: 888398 - protein, 340 aa, Homo sapiens
MGKDYYQTLGLARGASDEEIKRAYRRQALRYHPDKNKEPGAEEKFKEIAEAYDVLSDPRKREIFDRYGEEGLKGSGPSGGSGGGANGTSFSYTFHGDPHAMFAEFFGGRNPFDTFFGQRNGEEGMDIDDPFSGFPMGMGGFTNVNFGRSRSAQEPARKKQDPPVTHDLRVSLEEIYSGCTKKMKISHKRLNPDGKSIRNEDKILTIEVKKGWKEGTKITFPKEGDQTSNNIPADIVFVLKDKPHNIFKRDGSDVIYPARISLREALCGCTVNVPTLDGRTIPVVFKDVIRPGMRRKVPGEGLPLPKTPEKRGDLIIEFEVIFPERIPQTSRTVLEQVLPI

SEQ ID NO: 888399 - protein, 340 aa, Homo sapiens; identical to SEQ ID NO: 888398

SEQ ID NO: 888400 - protein, 343 aa, Homo sapiens
AWWRIRHEDQTLGLARGASDEEIKRAYRRQALRYHPDKNKEPGAEEKFKEIAEAYDVLSDPRKREIFDRYGEEGLKGSGPSGGSGGGANGTSFSYTFHGDPHAMFAEFFGGRNPFDTFFGQRNGEEGMDIDDPFSGFPMGMGGFTNVNFGRSRSAQEPARKKQDPPVTHDLRVSLEEIYSGCTKKMKISHKRLNPDGKSIRNEDKILTIEVKKGWKEGTKITFPKEGDQTSNNIPADIVFVLKDKPHNIFKRDGSDVIYPARISLREALCGCTVNVPTLDGRTIPVVFKDVIRPGMRRKVPGEGLPLPKTPEKRGDLIIEFEVIFPERIPQTSRTVLEQVLPI

SEQ ID NO: 888401 - protein, 285 aa, Homo sapiens
GDSEDPPSVDRYGEEGLKGSGPSGGSGGGANGTSFSYTFHGDPHAMFAEFFGGRNPFDTFFGQRNGEEGMDIDDPFSGFPMGMGGFTNVNFGRSRSAQEPARKKQDPPVTHDLRVSLEEIYSGCTKKMKISHKRLNPDGKSIRNEDKILTIEVKKGWKEGTKITFPKEGDQTSNNIPADIVFVLKDKPHNIFKRDGSDVIYPARISLREALCGCTVNVPTLDGRTIPVVFKDVIRPGMRRKVPGEGLPLPKTPEKRGDLIIEFEVIFPERIPQTSRTVLEQVLPI

SEQ ID NO: 888402 - protein, 281 aa, Homo sapiens
MDASVDRYGEEGLKGSGPSGGSGGGANGTSFSYTFHGDPHAMFAEFFGGRNPFDTFFGQRNGEEGMDIDDPFSGFPMGMGGFTNVNFGRSRSAQEPARKKQDPPVTHDLRVSLEEIYSGCTKKMKISHKRLNPDGKSIRNEDKILTIEVKKGWKEGTKITFPKEGDQTSNNIPADIVFVLKDKPHNIFKRDGSDVIYPARISLREALCGCTVNVPTLDGRTIPVVFKDVIRPGMRRKVPGEGLPLPKTPEKRGDLIIEFEVIFPERIPQTSRTVLEQVLPI

SEQ ID NO: 888403 - protein, 340 aa, Homo sapiens; identical to SEQ ID NO: 888398

SEQ ID NO: 888404 - protein, 282 aa, Homo sapiens
GRPGPESGAASEGLKGSGPSGGSGGGANGTSFSYTFHGDPHAMFAEFFGGRNPFDTFFGQRNGEEGMDIDDPFSGFPMGMGGFTNVNFGRSRSAQEPARKKQDPPVTHDLRVSLEEIYSGCTKKMKISHKRLNPDGKSIRNEDKILTIEVKKGWKEGTKITFPKEGDQTSNNIPADIVFVLKDKPHNIFKRDGSDVIYPARISLREALCGCTVNVPTLDGRTIPVVFKDVIRPGMRRKVPGEGLPLPKTPEKRGDLIIEFEVIFPERIPQTSRTVLEQVLPI

SEQ ID NO: 888405 - protein, 340 aa, Homo sapiens; identical to SEQ ID NO: 888398

SEQ ID NO: 888406 - protein, 240 aa, Homo sapiens
MFAEFFGGRNPFDTFFGQRNGEEGMDIDDPFSGFPMGMGGFTNVNFGRSRSAQEPARKKQDPPVTHDLRVSLEEIYSGCTKKMKISHKRLNPDGKSIRNEDKILTIEVKKGWKEGTKITFPKEGDQTSNNIPADIVFVLKDKPHNIFKRDGSDVIYPARISLREALCGCTVNVPTLDGRTIPVVFKDVIRPGMRRKVPGEGLPLPKTPEKRGDLIIEFEVIFPERIPQTSRTVLEQVLPI

SEQ ID NO: 888407 - protein, 240 aa, Homo sapiens; identical to SEQ ID NO: 888406

SEQ ID NO: 888408 - protein, 322 aa, Homo sapiens
MGKDYYQTLGLARGASDEEIKRAYRRQALRYHPDKNKEPGAEEKFKEIAEAYDVLSDPRKREIFDRYGEEGLKGSGPSGGSGGGANGTSFSYTFHGDPHAMFAEFFGGRNPFDTFFGQRNGEEGMDIDDPFSGFPMGMGGFTNVNFGRSRSAQEPARKKQDPPVTHDLRVSLEEIYSGCTKKMKISHKRLNPDGKSIRNEDKILTIEVKKGWKEGTIVFVLKDKPHNIFKRDGSDVIYPARISLREALCGCTVNVPTLDGRTIPVVFKDVIRPGMRRKVPGEGLPLPKTPEKRGDLIIEFEVIFPERIPQTSRTVLEQVLPI

SEQ ID NO: 888409 - protein, 340 aa, Homo sapiens; identical to SEQ ID NO: 888398

SEQ ID NO: 888410 - protein, 313 aa, Homo sapiens
MGKDYYQTLGLARGASDEEIKRAYRRQALRYHPDKNKEIAEAYDVLSDPRKREIFDRYGEEGLKGSGPSGGSGGGANGTSFSYTFHGDPHAMFAEFFGGRNPFDTFFGQRNGEEGMDIDDPFSGFPMGMGGFTNVNFGRSRSAQEPARKKQDPPVTHDLRVSLEEIYSGCTKKMKISHKRLNPDGKSIRNEDKILTIEVKKGWKEGTIVFVLKDKPHNIFKRDGSDVIYPARISLREALCGCTVNVPTLDGRTIPVVFKDVIRPGMRRKVPGEGLPLPKTPEKRGDLIIEFEVIFPERIPQTSRTVLEQVLPI

SEQ ID NO: 888411 - protein, 171 aa, Homo sapiens
MGKDYYQTLGLARGASDEEIKRAYRRQALRYHPDKNKEPGAEEKFKEIAEAYDVLSDPRKREIFDRYGEEGLKGSGPSGGSGGGANGTSFSYTFHGDPHAMFAEFFGGRNPFDTFFGQRNGEEGMDIDDPFSGFPMGMGGFTNVNFGRSLEKASPSPKHPRNVGTSLLSLK

SEQ ID NO: 888412 - protein, 68 aa, Homo sapiens
ELAGIINEHIAPSSVVDQFVLYSVFVSHVLLFSMENSVFSLAIIEFEVIFPERIPQTSRTVLEQVLPI

SEQ ID NO: 888413 - protein, 340 aa, Homo sapiens; identical to SEQ ID NO: 888398

SEQ ID NO: 888414 - protein, 95 aa, Homo sapiens
HLFKDNFAPLRFVTNIGLPTWGHWGTHDQSVRMLTCERTDQGPFQSSRISGPFYQLWTMRGWEGPGRAFVLLNVFQSIYYNLSKSHTRLQWFFEL

SEQ ID NO: 888415 - protein, 70 aa, Homo sapiens
FAAASTRTARRRQGDQGPFQSSRISGPFYQLWTMRGWEGPGRAFVLLNVFQSIYYNLSKSHTRLQWFFEL

SEQ ID NO: 888416 - protein, 340 aa, Homo sapiens; identical to SEQ ID NO: 888398

SEQ ID NO: 888417 - protein, 340 aa, Homo sapiens; identical to SEQ ID NO: 888398

SEQ ID NO: 888418 - protein, 354 aa, Homo sapiens
MGKDYYQTLGLARGASDEEIKRAYRRQALRYHPDKNKEPGAEEKFKEIAEAYDVLSDPRKREIFDRYGEEGLKGSGPSGGSGGGANGTSFSYTFHGDPHAMFAEFFGGRNPFDTFFGQRNGEEGMDIDDPFSGFPMGMGGFTNVNFGRSRSAQEPARKKQDPPVTHDLRVSLEEIYSGCTKKMKISHKRLNPDGKSIRNEDKILTIEVKKGWKEGTKITFPKEGDQTSNNIPADIVFVLKDKPHNIFKRDGSDVIYPARISLREALCGCTVNVPTLDGRTIPVVFKDVIRPGMRRKVPGEGLPLPKTPEKRGDLKSWGGKGSWNKCLFPGGQSSAQTFRLIVSCHCQHETKVCD

SEQ ID NO: 888419 - protein, 217 aa, Homo sapiens
MGKDYYQTLGLARGASDEEIKRAYRRQALRYHPDKNKEPGAEEKFKEIAEAYDVLSDPRKREIFDRYGEEGLKGSGPSGGSGGGANGTSFSYTFHGDPHAMFAEFFGGRNPFDTFFGQRNGEEGMDIDDPFSGFPMGMGGFTNVNFGRSRSAQEPARKKQDPPVTHDLRVSLEEIYSGCTKKMKISHKRSTDERSTDERSTDERSTDERSTDASVDR

SEQ ID NO: 888420 - protein, 315 aa, Homo sapiens
MGKDYYQTLGLARGASDEEIKRAYRRQALRYHPDKNKEPGAEEKFKEIAEAYDVLSDPRKREIFDRYGEEGLKGSGPSGGSGGGANGTSFSYTFHGDPHAMFAEFFGGRNPFDTFFGQRNGEEGMDIDDPFSGFPMGMGGFTNVNFGRSRSAQEPARKKQDPPVTHDLRVSLEEIYSGCTKKMKISHKRLNPDGKSIRNEDKILTIEVKKGWKEGTKITFPKEGDQTSNNIPADIVFVLKDKPHNIFKRDGSDVIYPARISLREALCGCTVNVPTLDGRTIPVVFKDVIRPGMRRKVPLKPSNGTFGAAACSIGF

SEQ ID NO: 888421 - protein, 172 aa, Homo sapiens
MGKDYYQTLGLARGASDEEIKRAYRRQALRYHPDKNKEPGAEEKFKEIAEAYDVLSDPRKREIFDRYGEEGLKGSGPSGGSGGGANGTSFSYTFHGDPHTKDADVTAVPEIRLDTLQGDWSGEPVMHRDDPILLSVPTDTWGVNNVVPLTAYARMHAHEHTIVEVVIDSRHM

SEQ ID NO: 888422 - protein, 1791 aa, Homo sapiens
MMCLKILRISLAILAGWALCSANSELGWTRKKSLVEREHLNQVLLEGERCWLGAKVRRPRASPQHHLFGVYPSRAGNYLRPYPVGEQEIHHTGRSKPDTEGNAVSLVPPDLTENPAGLRGAVEEPAAPWVGDSPIGQSELLGDDDAYLGNQRSKESLGEAGIQKGSAMAATTTTAIFTTLNEPKPETQRRGWAKSRQRRQVWKRRAEDGQGDSGISSHFQPWPKHSLKHRVKKSPPEESNQNGGEGSYREAETFNSQVGLPILYFSGRRERLLLRPEVLAEIPREAFTVEAWVKPEGGQNNPAIIAGVFDNCSHTVSDKGWALGIRSGKDKGKRDARFFFSLCTDRVKKATILISHSRYQPGTWTHVAATYDGRHMALYVDGTQVASSLDQSGPLNSPFMASCRSLLLGGDSSEDGHYFRGHLGTLVFWSTALPQSHFQHSSQHSSGEEEATDLVLTASFEPVNTEWVPFRDEKYPRLEVLQGFEPEPEILSPLQPPLCGQTVCDNVELISQYNGYWPLRGEKVIRYQVVNICDDEGLNPIVSEEQIRLQHEALNEAFSRYNISWQLSVHQVHNSTLRHRVVLVNCEPSKIGNDHCDPECEHPLTGYDGGDCRLQGRCYSWNRRDGLCHVECNNMLNDFDDGDCCDPQVADVRKTCFDPDSPKRAYMSVKELKEALQLNSTHFLNIYFASSVREDLAGAATWPWDKDAVTHLGGIVLSPAYYGMPGHTDTMIHEVGHVLGLYHVFKGVSERESCNDPCKETVPSMETGDLCADTAPTPKSELCREPEPTSDTCGFTRFPGAPFTNYMSYTDDNCTDNFTPNQVARMHCYLDLVYQQWTESRKPTPIPIPPMVIGQTNKSLTIHWLPPISGVVYDRASGSLCGACTEDGTFRQYVHTASSRRVCDSSGYWTPEEAVGPPDVDQPCEPSLQAWSPEVHLYHMNMTVPCPTEGCSLELLFQHPVQADTLTLWVTSFFMESSQVLFDTEILLENKESVHLGPLDTFCDIPLTIKLHVDGKVSGVKVYTFDERIEIDAALLTSQPHSPLCSGCRPVRYQVLRDPPFASGLPVVVTHSHRKFTDVEVTPGQMYQYQVLAEAGGELGEASPPLNHIHGAPYCGDGKVSERLGEECDDGDLVSGDGCSKVCELEEGFNCVGEPSLCYMYEGDGICEPFERKTSIVDCGIYTPKGYLDQWATRAYSSHEDKKKCPVSLVTGEPHSLICTSYHPDLPNHRPLTGWFPCVASENETQDDRSEQPEGSLKKEDEVWLKVCFNRPGEARAIFIFLTTDGLVPGEHQQPTVTLYLTDVRGSNHSLGTYGLSCQHNPLIINVTHHQNVLFHHTTSVLLNFSSPRVGISAVALRTSSRIGLSAPSNCISEDEGQNHQGQSCIHRPCGKQDSCPSLLLDHADVVNCTSIGPGLMKCAITCQRGFALQASSGQYIRPMQKEILLTCSSGHWDQNVSCLPVDCGVPDPSLVNYANFSCSEGTKFLKRCSISCVPPAKLQGLSPWLTCLEDGLWSLPEVYCKLECDAPPIILNANLLLPHCLQDNHDVGTICKYECKPGYYVAESAEGKVRNKLLKIQCLEGGIWEQGSCIPVVCEPPPPVFEGMYECTNGFSLDSQCVLNCNQEREKLPILCTKEGLWTQEFKLCENLQGECPPPPSELNSVEYKCEQGYGIGAVCSPLCVIPPSDPVMLPENITADTLEHWMEPVKVQSIVCTGRRQWHPDPVLVHCIQSCEPFQADGWCDTINNRAYCHYDGGDCCSSTLSSKKVIPFAADCDLDECTCRDPKAEENQ

SEQ ID NO: 888423 - protein, 1791 aa, Homo sapiens; identical to SEQ ID NO: 888422

SEQ ID NO: 888424 - protein, 1791 aa, Homo sapiens; identical to SEQ ID NO: 888422

SEQ ID NO: 888425 - protein, 1791 aa, Homo sapiens; identical to SEQ ID NO: 888422

SEQ ID NO: 888426 - protein, 1791 aa, Homo sapiens; identical to SEQ ID NO: 888422

SEQ ID NO: 888427 - protein, 1624 aa, Homo sapiens
MMCLKILRISLAILAGWALCSANSELGWTRKKSLVEREHLNQVLLEGERCWLGAKVRRPRASPQHHLFGVYPSRAGNYLRPYPVGEQEIHHTGRSKPDTEGNAVSLVPPDLTENPAGLRGAVEEPAAPWVGDSPIGQSELLGDDDAYLGNQRSKESLGEAGIQKGSAMAATTTTAIFTTLNEPKPETQRRGWAKSRQRRQVWKRRAEDGQGDSGISSHFQPWPKHSLKHRVKKSPPEESNQNGGEGSYREAETFNSQVGLPILYFSGRRERLLLRPEVLAEIPREAFTVEAWVKPEGGQNNPAIIAGVFDNCSHTVSDKGWALGIRSGKDKGKRDARFFFSLCTDRVKKATILISHSRYQPGTWTHVAATYDGRHMALYVDGTQVASSLDQSGPLNSPFMASCRSLLLGGDSSEDGHYFRGHLGTLVFWSTALPQSHFQHSSQHSSGEEEATDLVLTASFEPVNTEWVPFRDEKYPRLEVLQGFEPEPEILSPLQPPLCGQTVCDNVELISQYNGYWPLRGEKVIRYQVVNICDDEGLNPIVSEEQIRLQHEALNEAFSRYNISWQLSVHQVHNSTLRHRVVLVNCEPSKIGNDHCDPECEHPLTGYDGGDCRLQGRCYSWNRRDGLCHVECNNMLNDFDDGDCCDPQVADVRKTCFDPDSPKRAYMSVKELKEALQLNSTHFLNIYFASSVREDLAGAATWPWDKDAVTHLGGIVLSPAYYGMPGHTDTMIHEVGHVLGLYHVFKGVSERESCNDPCKETVPSMETGDLCADTAPTPKSELCREPEPTSDTCGFTRFPGAPFTNYMSYTDDNCTDNFTPNQVARMHCYLDLVYQQWTESRKPTPIPIPPMVIGQTNKSLTIHWLPPISGVVYDRASGSLCGACTEDGTFRQYVHTASSRRVCDSSGYWTPEEAVGPPDVDQPCEPSLQAWSPEVHLYHMNMTVPCPTEGCSLELLFQHPVQADTLTLWVTSFFMESSQVLFDTEILLENKESVHLGPLDTFCDIPLTIKLHVDGKVSGVKVYTFDERIEIDAALLTSQPHSPLCSGCRPVRYQVLRDPPFASGLPVVVTHSHRKFTDVEVTPGQMYQYQVLAEAGGELGEASPPLNHIHGAPYCGDGKVSERLGEECDDGDLVSGDGCSKVCELEEGFNCVGEPSLCYMYEGDGICEPFERKTSIVDCGIYTPKGYLDQWATRAYSSHEDKKKCPVSLVTGEPHSLICTSYHPDLPNHRPLTGWFPCVASENETQDDRSEQPEGSLKKEDEVWLKVCFNRPGEARAIFIFLTTDGLVPGEHQQPTVTLYLTDVRGSNHSLGTYGLSCQHNPLIINVTHHQNVLFHHTTSVLLNFSSPRVGISAVALRTSSRIGLSAPSNCISEDEGQNHQGQSCIHRPCGKQDSCPSLLLDHADVVNCTSIGPGLMKCAITCQRGFALQASSGQYIRPMQKEILLTCSSGHWDQNVSCLPVDCGVPDPSLVNYANFSCSEGTKFLKRCSISCVPPAKLQGLSPWLTCLEDGLWSLPEVYCKLECDAPPIILNANLLLPHCLQDNHDVGTICKYECKPGYYVAESAEGKVRNKLLKIQCLEGGIWEQGSCIPVVCEPPPPVFEGMYEGPWFAGPGGNGPKGGPR

SEQ ID NO: 888428 - protein, 1240 aa, Homo sapiens
MMCLKILRISLAILAGWALCSANSELGWTRKKSLVEREHLNQVLLEGERCWLGAKVRRPRASPQHHLFGVYPSRAGNYLRPYPVGEQEIHHTGRSKPDTEGNAVSLVPPDLTENPAGLRGAVEEPAAPWVGDSPIGQSELLGDDDAYLGNQRSKESLGEAGIQKGSAMAATTTTAIFTTLNEPKPETQRRGWAKSRQRRQVWKRRAEDGQGDSGISSHFQPWPKHSLKHRVKKSPPEESNQNGGEGSYREAETFNSQVGLPILYFSGRRERLLLRPEVLAEIPREAFTVEAWVKPEGGQNNPAIIAGVFDNCSHTVSDKGWALGIRSGKDKGKRDARFFFSLCTDRVKKATILISHSRYQPGTWTHVAATYDGRHMALYVDGTQVASSLDQSGPLNSPFMASCRSLLLGGDSSEDGHYFRGHLGTLVFWSTALPQSHFQHSSQHSSGEEEATDLVLTASFEPVNTEWVPFRDEKYPRLEVLQGFEPEPEILSPLQPPLCGQTVCDNVELISQYNGYWPLRGEKVIRYQVVNICDDEGLNPIVSEEQIRLQHEALNEAFSRYNISWQLSVHQVHNSTLRHRVVLVNCEPSKIGNDHCDPECEHPLTGYDGGDCRLQGRCYSWNRRDGLCHVECNNMLNDFDDGDCCDPQVADVRKTCFDPDSPKRAYMSVKELKEALQLNSTHFLNIYFASSVREDLAGAATWPWDKDAVTHLGGIVLSPAYYGMPGHTDTMIHEVGHVLGLYHVFKGVSERESCNDPCKETVPSMETGDLCADTAPTPKSELCREPEPTSDTCGFTRFPGAPFTNYMSYTDDNCTDNFTPNQVARMHCYLDLVYQQWTESRKPTPIPIPPMVIGQTNKSLTIHWLPPISGVVYDRASGSLCGACTEDGTFRQYVHTASSRRVCDSSGYWTPEEAVGPPDVDQPCEPSLQAWSPEVHLYHMNMTVPCPTEGCSLELLFQHPVQADTLTLWVTSFFMESSQVLFDTEILLENKESVHLGPLDTFCDIPLTIKLHVDGKVSGVKVYTFDERIEIDAALLTSQPHSPLCSGCRPVRYQVLRDPPFASGLPVVVTHSHRKFTDVEVTPGQMYQYQVLAEAGGELGEASPPLNHIHGAPYCGDGKVSERLGEECDDGDLVSGDGCSKVCELEEGFNCVGEPSLCYMYEGDGICEPFERKTSIVDCGIYTPKGYLDQWATRAYSSHEDKKKCPVSLVTGEPHSLICTSYHPDLPSGRHGGGEGRLFE

SEQ ID NO: 888429 - protein, 827 aa, Homo sapiens
MMCLKILRISLAILAGWALCSANSELGWTRKKSLVEREHLNQVLLEGERCWLGAKVRRPRASPQHHLFGVYPSRAGNYLRPYPVGEQEIHHTGRSKPDTEGNAVSLVPPDLTENPAGLRGAVEEPAAPWVGDSPIGQSELLGDDDAYLGNQRSKESLGEAGIQKGSAMAATTTTAIFTTLNEPKPETQRRGWAKSRQRRQVWKRRAEDGQGDSGISSHFQPWPKHSLKHRVKKSPPEESNQNGGEGSYREAETFNSQVGLPILYFSGRRERLLLRPEVLAEIPREAFTVEAWVKPEGGQNNPAIIAGVFDNCSHTVSDKGWALGIRSGKDKGKRDARFFFSLCTDRVKKATILISHSRYQPGTWTHVAATYDGRHMALYVDGTQVASSLDQSGPLNSPFMASCRSLLLGGDSSEDGHYFRGHLGTLVFWSTALPQSHFQHSSQHSSGEEEATDLVLTASFEPVNTEWVPFRDEKYPRLEVLQGFEPEPEILSPLQPPLCGQTVCDNVELISQYNGYWPLRGEKVIRYQVVNICDDEGLNPIVSEEQIRLQHEALNEAFSRYNISWQLSVHQVHNSTLRHRVVLVNCEPSKIGNDHCDPECEHPLTGYDGGDCRLQGRCYSWNRRDGLCHVECNNMLNDFDDGDCCDPQVADVRKTCFDPDSPKRAYMSVKELKEALQLNSTHFLNIYFASSVREDLAGAATWPWDKDAVTHLGGIVLSPAYYGMPGHTDTMIHEVGHVLGLYHVFKGVSERESCNDPCKETVPSMETGDLCADTAPTPKSELCREPEPTSDTCGFTRFPGAPFTNYMSYTGITTVLFCFLLRIHGGL

SEQ ID NO: 888430 - protein, 481 aa, Homo sapiens
LHNVGPSPECVPISIMCAHHQNVLFHHTTSVLLNFSSPRVGISAVALRTSSRIGLSAPSNCISEDEGQNHQGQSCIHRPCGKQDSCPSLLLDHADVVNCTSIGPGLMKCAITCQRGFALQASSGQYIRPMQKEILLTCSSGHWDQNVSCLPVDCGVPDPSLVNYANFSCSEGTKFLKRCSISCVPPAKLQGLSPWLTCLEDGLWSLPEVYCKLECDAPPIILNANLLLPHCLQDNHDVGTICKYECKPGYYVAESAEGKVRNKLLKIQCLEGGIWEQGSCIPVVCEPPPPVFEGMYECTNGFSLDSQCVLNCNQEREKLPILCTKEGLWTQEFKLCENLQGECPPPPSELNSVEYKCEQGYGIGAVCSPLCVIPPSDPVMLPENITADTLEHWMEPVKVQSIVCTGRRQWHPDPVLVHCIQSCEPFQADGWCDTINNRAYCHYDGGDCCSSTLSSKKVIPFAADCDLDECTCRDPKAEENQ

SEQ ID NO: 888431 - protein, 341 aa, Homo sapiens
THNGVHTAPIPYPCSHLYSTEFSSEGGGGHSPCKFLKRCSISCVPPAKLQGLSPWLTCLEDGLWSLPEVYCKLECDAPPIILNANLLLPHCLQDNHDVGTICKYECKPGYYVAESAEGKVRNKLLKIQCLEGGIWEQGSCIPVVCEPPPPVFEGMYECTNGFSLDSQCVLNCNQEREKLPILCTKEGLWTQEFKLCENLQGECPPPPSELNSVEYKCEQGYGIGAVCSPLCVIPPSDPVMLPENITADTLEHWMEPVKVQSIVCTGRRQWHPDPVLVHCIQSCEPFQADGWCDTINNRAYCHYDGGDCCSSTLSSKKVIPFAADCDLDECTCRDPKAEENQ

SEQ ID NO: 888432 - protein, 1791 aa, Homo sapiens; identical to SEQ ID NO: 888422

SEQ ID NO: 888433 - protein, 1791 aa, Homo sapiens; identical to SEQ ID NO: 888422

SEQ ID NO: 888434 - protein, 1760 aa, Homo sapiens
MMCLKILRISLAILAGWALCSANSELGWTRKKSLVEREHLNQVLLEGERCWLGAKVRRPRASPQHHLFGVYPSRAGNYLRPYPVGEQEIHHTGRSKPDTEGNAVSLVPPDLTENPAGLRGAVEEPAAPWVGDSPIGQSELLGDDDAYLGNQRSKESLGEAGIQKGSAMAATTTTAIFTTLNEPKPETQRRGWAKSRQRRQVWKRRAEDGQGDSGISSHFQPWPKHSLKHRVKKSPPEESNQNGGEGSYREAETFNSQVGLPILYFSGRRERLLLRPEVLAEIPREAFTVEAWVKPEGGQNNPAIIAGVFDNCSHTVSDKGWALGIRSGKDKGKRDARFFFSLCTDRVKKATILISHSRYQPGTWTHVAATYDGRHMALYVDGTQVASSLDQSGPLNSPFMASCRSLLLGGDSSEDGHYFRGHLGTLVFWSTALPQSHFQHSSQHSSGEEEATDLVLTASFEPVNTEWVPFRDEKYPRLEVLQGFEPEPEILSPLQPPLCGQTVCDNVELISQYNGYWPLRGEKVIRYQVVNICDDEGLNPIVSEEQIRLQHEALNEAFSRYNISWQLSVHQVHNSTLRHRVVLVNCEPSKIGNDHCDPECEHPLTGYDGGDCRLQGRCYSWNRRDGLCHVECNNMLNDFDDGDCCDPQVADVRKTCFDPDSPKRAYMSVKELKEALQLNSTHFLNIYFASSVREDLAGAATWPWDKDAVTHLGGIVLSPAYYGMPGHTDTMIHEVGHVLGLYHVFKGVSERESCNDPCKETVPSMETGDLCADTAPTPKSELCREPEPTSDTCGFTRFPGAPFTNYMSYTDDNCTDNFTPNQVARMHCYLDLVYQQWTESRKPTPIPIPPMVIGQTNKSLTIHWLPPISGVVYDRASGSLCGACTEDGTFRQYVHTASSRRVCDSSGYWTPEEAVGPPDVDQPCEPSLQAWSPEVHLYHMNMTVPCPTEGCSLELLFQHPVQADTLTLWVTSFFMESSQVLFDTEILLENKESVHLGPLDTFCDIPLTIKLHVDGKVSGVKVYTFDERIEIDAALLTSQPHSPLCSGCRPVRYQVLRDPPFASGLPVVVTHSHRKFTDVEVTPGQMYQYQVLAEAGGELGEASPPLNHIHGAPYCGDGKVSERLGEECDDGDLVSGDGCSKVCELEEGFNCVGEPSLCYMYEGDGICEPFERKTSIVDCGIYTPKGYLDQWATRAYSSHEDKKKCPVSLVTGEPHSLICTSYHPDLPNHRPLTGWFPCVASENETQDDRSEQPEGSLKKEDEVWLKVCFNRPGEARAIFIFLTTDGLVPGEHQQPTVTLYLTDVRGSNHSLGTYGLSCQHNPLIINVTHHQNVLFHHTTSVLLNFSSPRVGISAVALRTSSRIGLSAPSNCISEDEGQNHQGQSCIHRPCGKQDSCPSLLLDHADVVNCTSIGPGLMKCAITCQRGFALQASSGQYIRPMQKEILLTCSSGHWDQNVSCLPVDCGVPDPSLVNYANFSCSEGTKFLKRCSISCVPPAKLQGLSPWLTCLEDGLWSLPEVYCKLECDAPPIILNANLLLPHCLQDNHDVGTICKYECKPGYYVAESAEGKVRNKLLKIQCLEGGIWEQGSCIPVVCEPPPPVFEGMYECTNGFSLDSQCVLNCNQEREKLPILCTKEGLWTQEFKLCENLQGECPPPPSELNSVEYKCEQGYGIGAVCSPLCVIPPSDPVMLPENITADTLEHWMEPVKVQSIVCTGRRQWHPDPVLVHCIQSCETHLSDSSEPSSPKLFSMGPRCCGASS

SEQ ID NO: 888435 - protein, 1122 aa, Homo sapiens
MMCLKILRISLAILAGWALCSANSELGWTRKKSLVEREHLNQVLLEGERCWLGAKVRRPRASPQHHLFGVYPSRAGNYLRPYPVGEQEIHHTGRSKPDTEGNAVSLVPPDLTENPAGLRGAVEEPAAPWVGDSPIGQSELLGDDDAYLGNQRSKESLGEAGIQKGSAMAATTTTAIFTTLNEPKPETQRRGWAKSRQRRQVWKRRAEDGQGDSGISSHFQPWPKHSLKHRVKKSPPEESNQNGGEGSYREAETFNSQVGLPILYFSGRRERLLLRPEVLAEIPREAFTVEAWVKPEGGQNNPAIIAGVFDNCSHTVSDKGWALGIRSGKDKGKRDARFFFSLCTDRVKKATILISHSRYQPGTWTHVAATYDGRHMALYVDGTQVASSLDQSGPLNSPFMASCRSLLLGGDSSEDGHYFRGHLGTLVFWSTALPQSHFQHSSQHSSGEEEATDLVLTASFEPVNTEWVPFRDEKYPRLEVLQGFEPEPEILSPLQPPLCGQTVCDNVELISQYNGYWPLRGEKVIRYQVVNICDDEGLNPIVSEEQIRLQHEALNEAFSRYNISWQLSVHQVHNSTLRHRVVLVNCEPSKIGNDHCDPECEHPLTGYDGGDCRLQGRCYSWNRRDGLCHVECNNMLNDFDDGDCCDPQVADVRKTCFDPDSPKRAYMSVKELKEALQLNSTHFLNIYFASSVREDLAGAATWPWDKDAVTHLGGIVLSPAYYGMPGHTDTMIHEVGHVLGLYHVFKGVSERESCNDPCKETVPSMETGDLCADTAPTPKSELCREPEPTSDTCGFTRFPGAPFTNYMSYTDDNCTDNFTPNQVARMHCYLDLVYQQWTESRKPTPIPIPPMVIGQTNKSLTIHWLPPISGVVYDRASGSLCGACTEDGTFRQYVHTASSRRVCDSSGYWTPEEAVGPPDVDQPCEPSLQAWSPEVHLYHMNMTVPCPTEGCSLELLFQHPVQADTLTLWVTSFFMESSQVLFDTEILLENKESVHLGPLDTFCDIPLTIKLHVDGKVSGVKVYTFDERIEIDAALLTSQPHSPLCSGCRPVRYQVLRDPPFASGLPVVVTHSHRKFTDVEVTPGQMYQYQVLAEAGGELGEASPPLNHIHGAPYCGDGKVSE

SEQ ID NO: 888436 - protein, 317 aa, Homo sapiens
MMCLKILRISLAILAGWALCSANSELGWTRKKSLVEREHLNQVLLEGERCWLGAKVRRPRASPQHHLFGVYPSRAGNYLRPYPVGEQEIHHTGRSKPDTEGNAVSLVPPDLTENPAGLRGAVEEPAAPWVGDSPIGQSELLGDDDAYLGNQRSKESLGEAGIQKGSAMAATTTTAIFTTLNEPKPETQRRGWAKSRQRRQVWKRRAEDGQGDSGISSHFQPWPKHSLKHRVKKSPPEESNQNGGEGSYREAETFNSQVGLPILYFSGRRERLLLRPEVLAEIPREAFTVEAWVKPEGGQNNPAIIAGNTLLLGFLNL

SEQ ID NO: 888437 - protein, 83 aa, Homo sapiens
AAKSLLLLTGSQPVLRWFYFSYPSCIHRPCGKQDSCPSLLLDHADVVNCTSIGPGLMKCAITCQRGFALQASSGQYIRPMQVS

SEQ ID NO: 888438 - protein, 541 aa, Homo sapiens
MSSNSDTGDLQESLKHGLTPIGAGLPDRHGSPIPARGRLVMLPKVETEALGLARSHGEQGQMPENMQVSQFKMVNYSYDEDLEELCPVCGDKVSGYHYGLLTCESCKGFFKRTVQNNKRYTCIENQNCQIDKTQRKRCPYCRFQKCLSVGMKLEAVRADRMRGGRNKFGPMYKRDRALKQQKKALIRANGLKLEAMSQVIQAMPSDLTISSAIQNIHSASKGLPLNHAALPPTDYDRSPFVTSPISMTMPPHGSLQGYQTYGHFPSRAIKSEYPDPYTSSPESIMGYSYMDSYQTSSPASIPHLILELLKCEPDEPQVQAKIMAYLQQEQANRSKHEKLSTFGLMCKMADQTLFSIVEWARSSIFFRELKVDDQMKLLQNCWSELLILDHIYRQVVHGKEGSIFLVTGQQVDYSIIASQAGATLNNLMSHAQELVAKLRSLQFDQREFVCLKFLVLFSLDVKNLENFQLVEGVQEQVNAALLDYTMCNYPQQTEKFGQLLLRLPEIRAISMQAEEYLYYKHLNGDVPYNNLLIEMLHAKRA

SEQ ID NO: 888439 - protein, 565 aa, Homo sapiens
MSSNSDTGDLQESLKHGLTPIDRGNCRSGCFSFAATLRQRSLLTSCAGLPDRHGSPIPARGRLVMLPKVETEALGLARSHGEQGQMPENMQVSQFKMVNYSYDEDLEELCPVCGDKVSGYHYGLLTCESCKGFFKRTVQNNKRYTCIENQNCQIDKTQRKRCPYCRFQKCLSVGMKLEAVRADRMRGGRNKFGPMYKRDRALKQQKKALIRANGLKLEAMSQVIQAMPSDLTISSAIQNIHSASKGLPLNHAALPPTDYDRSPFVTSPISMTMPPHGSLQGYQTYGHFPSRAIKSEYPDPYTSSPESIMGYSYMDSYQTSSPASIPHLILELLKCEPDEPQVQAKIMAYLQQEQANRSKHEKLSTFGLMCKMADQTLFSIVEWARSSIFFRELKVDDQMKLLQNCWSELLILDHIYRQVVHGKEGSIFLVTGQQVDYSIIASQAGATLNNLMSHAQELVAKLRSLQFDQREFVCLKFLVLFSLDVKNLENFQLVEGVQEQVNAALLDYTMCNYPQQTEKFGQLLLRLPEIRAISMQAEEYLYYKHLNGDVPYNNLLIEMLHAKRA

SEQ ID NO: 888440 - protein, 167 aa, Homo sapiens [sequence omitted]

SEQ ID NO: 888441 - protein, 68 aa, Homo sapiens
MSSNSDTGDLQESLKHGLTPIDNTENTGTRKMREQHTTISHLFRRAEPPRCAGKESFPAAPRSSGSAS

SEQ ID NO: 888442 - protein, 495 aa, Homo sapiens
MSSNSDTGDLQESLKHGLTPIVSQFKMVNYSYDEDLEELCPVCGDKVSGYHYGLLTCESCKGFFKRTVQNNKRYTCIENQNCQIDKTQRKRCPYCRFQKCLSVGMKLEAVRADRMRGGRNKFGPMYKRDRALKQQKKALIRANGLKLEAMSQVIQAMPSDLTISSAIQNIHSASKGLPLNHAALPPTDYDRSPFVTSPISMTMPPHGSLQGYQTYGHFPSRAIKSEYPDPYTSSPESIMGYSYMDSYQTSSPASIPHLILELLKCEPDEPQVQAKIMAYLQQEQANRSKHEKLSTFGLMCKMADQTLFSIVEWARSSIFFRELKVDDQMKLLQNCWSELLILDHIYRQVVHGKEGSIFLVTGQQVDYSIIASQAGATLNNLMSHAQELVAKLRSLQFDQREFVCLKFLVLFSLDVKNLENFQLVEGVQEQVNAALLDYTMCNYPQQTEKFGQLLLRLPEIRAISMQAEEYLYYKHLNGDVPYNNLLIEMLHAKRA

SEQ ID NO: 888443 - protein, 487 aa, Homo sapiens
MSSNSDTGDLQESLKHGLTPIDRGNCRSGCFSFAATLRQRSLLTSCAGLPDRHGSPIPARGRLVMLPKVETEALGLARSHGEQGQMPENMQVSQFKMVNYSYDEDLEELCPVCGDKVSGYHYGLLTCESCKGFFKRTVQNNKRYTCIENQNCQIDKTQRKRCPYCRFQKCLSVGMKLEAVRADRMRGGRNKFGPMYKRDRALKQQKKALIRANGLKLEAMSQVIQAMPSDLTISSAIQNIHSASKGLPLNHAALPPTDYDRSPFVTSPISMTMPPHGSLQGYQTYGHFPSRAIKSEYPDPYTSSPESIMGYSYMDSYQTSSPASIPHLILELLKCEPDEPQVQAKIMAYLQQEQANRSKHEKLSTFGLMCKMADQTLFSIVEWARSSIFFRELKGLTLSPSLECSGTILAHGNLHLLHSSDSPASASRVAGITGVHHNTHLIFVFLVEMGFCHVGQAGLKTPDLRVICLPRPPKVAGIMGMSHCAWP

SEQ ID NO: 888444 - protein, 367 aa, Homo sapiens
MAYRVLGRAGPPQPRRARRLLFAFTLSLSCTYLCYSFLCCCDDLGRSRLLGAPRCLRGPSAGGQKLLQKSRPCDPSGPTPSEPSAPSAPAAAVPAPRLSGSNHSGSPKLGTKRLPQALIVGVKKGGTRAVLEFIRVHPDVRALGTEPHFFDRNYGRGLDWYRSLMPRTLESQITLEKTPSYFVTQEAPRRIFNMSRDTKLIVVVRNPVTRAISDYTQTLSKKPDIPTFEGLSFRNRTLGLVDVSWNAIRIGMYVLHLESWLQYFPLAQIHFVSGERLITDPAGEMGRVQDFLGIKRFITDKHFYFNKTKGFPCLKKTESSLLPRCLGKSKGRTHVQIDPEVIDQLREFYRPYNIKFYETVGQDFRWE

SEQ ID NO: 888445 - protein, 235 aa, Homo sapiens
QWNDHSSLQPQTPGLKRSSHLSFPRELTYRSLMPRTLESQITLEKTPSYFVTQEAPRRIFNMSRDTKLIVVVRNPVTRAISDYTQTLSKKPDIPTFEGLSFRNRTLGLVDVSWNAIRIGMYVLHLESWLQYFPLAQIHFVSGERLITDPAGEMGRVQDFLGIKRFITDKHFYFNKTKGFPCLKKTESSLLPRCLGKSKGRTHVQIDPEVIDQLREFYRPYNIKFYETVGQDFRWE

SEQ ID NO: 888446 - protein, 1323 aa, Homo sapiens
LELLWRPTRGGGRGDPPLSTWTVAKASADAFTPGRGGRTAVAAAAAERARGLGAPDGRRDLAAPARRVRPFYGLGRREACLCARFHSPFLGTHGWGKFLRQPGWAVDGESWAERNRAREAPSSSSPVAFPRRGLRSSGRGPRCPPARGQARARLACLCIGPSERGSAARLTAEPEARNLRRLPSSGAAPHPGEHGGGVGHGLRRRRRGRRKMAAGKSGGSAGEITFLEALARSESKRDGGFKNNWSFDHEEESEGDTDKDGTNLLSVDEDEDSETSKGKKLNRRSEIVANSSGEFILKTYVRRNKSESFKTLKGNPIGLNMLSNNKKLSENTQNTSLCSGTVVHGRRFHHAHAQIPVVKTAAQSSLDRKERKEYPPHVQKVEINPVRLSRLQGVERIMKKTEESESQVEPEIKRKVQQKRHCSTYQPTPPLSPASKKCLTHLEDLQRNCRQAITLNESTGPLLRTSIHQNSGGQKSQNTGLTTKKFYGNNVEKVPIDIIVNCDDSKHTYLQTNGKVILPGAKIPKITNLKERKTSLSDLNDPIILSSDDDDDNDRTNRRESISPQPADSACSSPAPSTGKVEAALNENTCRAERELRSIPEDSELNTVTLPRKARMKDQFGNSIINTPLKRRKVFSQEPPDALALSCQSSFDSVILNCRSIRVGTLFRLLIEPVIFCLDFIKIQLDEPDHDPVEIILNTSDLTKCEWCNVRKLPVVFLQAIPAVYQKLSIQLQMNKEDKVWNDCKGVNKLTNLEEQYIILIFQNGLDPPANMVFESIINEIGIKNNISNFFAKIPFEEANGRLVACTRTYEESIKGSCGQKENKIKTVSFESKIQLRSKQEFQFFDEEEETGENHTIFIGPVEKLIVYPPPPAKGGISVTNEDLHCLNEGEFLNDVIIDFYLKYLVLEKLKKEDADRIHIFSSFFYKRLNQRERRNHETTNLSIQQKRHGRVKTWTRHVDIFEKDFIFVPLNEAAHWFLAVVCFPGLEKPKYEPNPHYHENAVIQKCSTVEDSCISSSASEMESCSQNSSAKPVIKKMLNKKHCIAVIDSNPGQEESDPRYKRNICSVKYSVKKINHTASENEEFNKGESTSQKVADRTKSENGLQNESLSSTHHTDGLSKIRLNYSDESPEAGKMLEDELVDFSEDQDNQDDSSDDGFLADDNCSSEIGQWHLKPTICKQPCILLMDSLRGPSRSNVVKILREYLEVEWEVKKGSKRSFSKDVMKGSNPKVPQQNNFSDCGVYVLQYVESFFENPILSFELPMNLANWFPPPRMRTKREEIRNIILKLQEDQSKEKRKHKDTYSTEAPLGEGTEQYVNSISD

SEQ ID NO: 888447 - protein, 1316 aa, Homo sapiens
LELLWRPTRGGGRGDPPLSTWTVAKASADAFTPGRGGRTAVAAAAAERARGLGAPDGRRDLAAPARRVRPFYGLGRREACLCARFHSPFLGTHGWGKFLRQPGWAVDGESWAERNRAREAPSSSSPVAFPRRGLRSSGRGPRCPPARGQARARLACLCIGPSERGSAARLTAEPEARNLRRLPSSGAAPHPGEHGGGVGHGLRRRRRGRRKMAAGKSGGSAGEITFLEALARSESKRDGGFKNNWSFDHEEESEGDTDKDGTNLLSVDEDEDSETSKGKKLNRRSEIVANSSGEFILKTYVRRNKSESFKTLKGNPIGLNMLSNNKKLSENTQNTSLCSGTVVHGRRFHHAHAQIPVVKTAAQRKEYPPHVQKVEINPVRLSRLQGVERIMKKTEESESQVEPEIKRKVQQKRHCSTYQPTPPLSPASKKCLTHLEDLQRNCRQAITLNESTGPLLRTSIHQNSGGQKSQNTGLTTKKFYGNNVEKVPIDIIVNCDDSKHTYLQTNGKVILPGAKIPKITNLKERKTSLSDLNDPIILSSDDDDDNDRTNRRESISPQPADSACSSPAPSTGKVEAALNENTCRAERELRSIPEDSELNTVTLPRKARMKDQFGNSIINTPLKRRKVFSQEPPDALALSCQSSFDSVILNCRSIRVGTLFRLLIEPVIFCLDFIKIQLDEPDHDPVEIILNTSDLTKCEWCNVRKLPVVFLQAIPAVYQKLSIQLQMNKEDKVWNDCKGVNKLTNLEEQYIILIFQNGLDPPANMVFESIINEIGIKNNISNFFAKIPFEEANGRLVACTRTYEESIKGSCGQKENKIKTVSFESKIQLRSKQEFQFFDEEEETGENHTIFIGPVEKLIVYPPPPAKGGISVTNEDLHCLNEGEFLNDVIIDFYLKYLVLEKLKKEDADRIHIFSSFFYKRLNQRERRNHETTNLSIQQKRHGRVKTWTRHVDIFEKDFIFVPLNEAAHWFLAVVCFPGLEKPKYEPNPHYHENAVIQKCSTVEDSCISSSASEMESCSQNSSAKPVIKKMLNKKHCIAVIDSNPGQEESDPRYKRNICSVKYSVKKINHTASENEEFNKGESTSQKVADRTKSENGLQNESLSSTHHTDGLSKIRLNYSDESPEAGKMLEDELVDFSEDQDNQDDSSDDGFLADDNCSSEIGQWHLKPTICKQPCILLMDSLRGPSRSNVVKILREYLEVEWEVKKGSKRSFSKDVMKGSNPKVPQQNNFSDCGVYVLQYVESFFENPILSFELPMNLANWFPPPRMRTKREEIRNIILKLQEDQSKEKRKHKDTYSTEAPLGEGTEQYVNSISD

SEQ ID NO: 888448 - protein, 1298 aa, Homo sapiens
LELLWRPTRGGGRGDPPLSTWTVAKASADAFTPGRGGRTAVAAAAAERARGLGAPDGRRDLAAPARRVRPFYGLGRREACLCARFHSPFLGTHGWGKFLRQPGWAVDGESWAERNRAREAPSSSSPVAFPRRGLRSSGRGPRCPPARGQARARLACLCIGPSERGSAARLTAEPEARNLRRLPSSGAAPHPGEHGGGVGHGLRRRRRGRRKMAAGKSGGSAGEITFLEALARSESKRDGGFKNNWSFDHEEESEGDTDKDGTNLLSVDEDEDSETSKGKKLNRRSEIVANSSGEFILKTYVRRNKSESFKTLKGNPIGLNMLSNNKKLSENTQNTSLCSGTVVHGRRFHHAHAQIPVVKTAAQRKEYPPHVQKVEINPVRLSRLQGVERIMKKTEESESQVEPEIKRKVQQKRHCSTYQPTPPLSPASKKCLTHLEDLQRNCRQAITLNESTGPLLRTSIHQNSGGQKSQNTGLTTKKFYGNNVEKVPIDIIVNCDDSKHTYLQTNGKVILPGAKIPKITNLKERKTSLSDLNDPIILSSDDDDDNDRTNRRESISPQPADSACSSPAPSTGKVEAALNENTCRAERELRSIPEDSELNTVTLPRSRKVFSQEPPDALALSCQSSFDSVILNCRSIRVGTLFRLLIEPVIFCLDFIKIQLDEPDHDPVEIILNTSDLTKCEWCNVRKLPVVFLQAIPAVYQKLSIQLQMNKEDKVWNDCKGVNKLTNLEEQYIILIFQNGLDPPANMVFESIINEIGIKNNISNFFAKIPFEEANGRLVACTRTYEESIKGSCGQKENKIKTVSFESKIQLRSKQEFQFFDEEEETGENHTIFIGPVEKLIVYPPPPAKGGISVTNEDLHCLNEGEFLNDVIIDFYLKYLVLEKLKKEDADRIHIFSSFFYKRLNQRERRNHETTNLSIQQKRHGRVKTWTRHVDIFEKDFIFVPLNEAAHWFLAVVCFPGLEKPKYEPNPHYHENAVIQKCSTVEDSCISSSASEMESCSQNSSAKPVIKKMLNKKHCIAVIDSNPGQEESDPRYKRNICSVKYSVKKINHTASENEEFNKGESTSQKVADRTKSENGLQNESLSSTHHTDGLSKIRLNYSDESPEAGKMLEDELVDFSEDQDNQDDSSDDGFLADDNCSSEIGQWHLKPTICKQPCILLMDSLRGPSRSNVVKILREYLEVEWEVKKGSKRSFSKDVMKGSNPKVPQQNNFSDCGVYVLQYVESFFENPILSFELPMNLANWFPPPRMRTKREEIRNIILKLQEDQSKEKRKHKDTYSTEAPLGEGTEQYVNSISD

SEQ ID NO: 888449 - protein, 645 aa, Homo sapiens
GDPTLPDPPQIAFPREIILNTSDLTKCEWCNVRKLPVVFLQAIPAVYQKLSIQLQMNKEDKVWNDCKGVNKLTNLEEQYIILIFQNGLDPPANMVFESIINEIGIKNNISNFFAKIPFEEANGRLVACTRTYEESIKGSCGQKENKIKTVSFESKIQLRSKQEFQFFDEEEETGENHTIFIGPVEKLIVYPPPPAKGGISVTNEDLHCLNEGEFLNDVIIDFYLKYLVLEKLKKEDADRIHIFSSFFYKRLNQRERRNHETTNLSIQQKRHGRVKTWTRHVDIFEKDFIFVPLNEAAHWFLAVVCFPGLEKPKYEPNPHYHENAVIQKCSTVEDSCISSSASEMESCSQNSSAKPVIKKMLNKKHCIAVIDSNPGQEESDPRYKRNICSVKYSVKKINHTASENEEFNKGESTSQKVADRTKSENGLQNESLSSTHHTDGLSKIRLNYSDESPEAGKMLEDELVDFSEDQDNQDDSSDDGFLADDNCSSEIGQWHLKPTICKQPCILLMDSLRGPSRSNVVKILREYLEVEWEVKKGSKRSFSKDVMKGSNPKVPQQNNFSDCGVYVLQYVESFFENPILSFELPMNLANWFPPPRMRTKREEIRNIILKLQEDQSKEKRKHKDTYSTEAPLGEGTEQYVNSISD

SEQ ID NO: 888450 - protein, 302 aa, Homo sapiens [sequence omitted]

SEQ ID NO: 888451 - protein, 1175 aa, Homo sapiens
LELLWRPTRGGGRGDPPLSTWTVAKASADAFTPGRGGRTAVAAAAAERARGLGAPDGRRDLAAPARRVRPFYGLGRREACLCARFHSPFLGTHGWGKFLRQPGWAVDGESWAERNRAREAPSSSSPVAFPRRGLRSSGRGPRCPPARGQARARLACLCIGPSERGSAARLTAEPEARNLRRLPSSGAAPHPGEHGGGVGHGLRRRRRGRRKMAAGKSGGSAGEITFLEALARSESKRDGGFKNNWSFDHEEESEGDTDKDGTNLLSVDEDEDSETSKGKKLNRRSEIVANSSGEFILKTYVRRNKSESFKTLKGNPIGLNMLSNNKKLSENTQNTSLCSGTVVHGRRFHHAHAQIPVVKTAAQRKEYPPHVQKVEINPVRLSRLQGVERIMKKTEESESQVEPEIKRKVQQKRHCSTYQPTPPLSPASKKCLTHLEDLQRNCRQAITLNESTGPLLRTSIHQNSGGQKSQNTGLTTKKFYGNNVEKVPIDIIVNCDDSKHTYLQTNGKVILPGAKIPKITNLKERKTSLSDLNDPIILSSDDDDDNDRTNRRESISPQPADSACSSPAPSTGKVEAALNENTCRAERELRSIPEDSELNTVTLPRKARMKDQFGNSIINTPLKRRKVFSQEPPDALALSCQSSFDSVILNCRSIRVGTLFRLLIEPVIFCLDFIKIQLDEPDHDPVEIILNTSDLTKCEWCNVRKLPVVFLQAIPAVYQKLSIQLQMNKEDKVWNDCKGVNKLTNLEEQYIILIFQNGLDPPANMVFESIINEIGIKNNISNFFAKIPFEEANGRLVACTRTYEESIKGSCGQKENKIKTVSFESKIQLRSKQEFQFFDEEEETGENHTIFIGPVEKLIVYPPPPAKGGISVTNEDLHCLNEGEFLNDVIIDFYLKYLVLEKLKKEDADRIHIFSSFFYKRLNQRERRNHETTNLSIQQKRHGRVKTWTRHVDIFEKDFIFVPLNEAAHWFLAVVCFPGLEKPKYEPNPHYHENAVIQKCSTVEDSCISSSASEMESCSQNSSAKPVIKKMLNKKHCIAVIDSNPGQEESDPRYKRNICSVKYSVKKINHTASENEEFNKGESTSQKVADRTKSENGLQNESLSSTHHTDGLSKIRLNYSDESPEAGKMLEDELVDFSEDQDNQTLYPTYGLTPRPFSVKCCQNFKRVFRSGMGS

SEQ ID NO: 888452 - protein, 188 aa, Homo sapiens
MLEDELVDFSEDQDNQDDSSDDGFLADDNCSSEIGQWHLKPTICKQPCILLMDSLRGPSRSNVVKILREYLEVEWEVKKGSKRSFSKDVMKGSNPKVPQQNNFSDCGVYVLQYVESFFENPILSFELPMNLANWFPPPRMRTKREEIRNIILKLQEDQSKEKRKHKDTYSTEAPLGEGTEQYVNSISD

SEQ ID NO: 888453 - protein, 583 aa, Homo sapiens
MLSNNKKLSENTQNTSLCSGTVVHGRRFHHAHAQIPVVKTAAQSSLDRKERKEYPPHVQKVEINPVRLSRLQGVERIMKKTEESESQVEPEIKRKVQQKRHCSTYQPTPPLSPASKKCLTHLEDLQRNCRQAITLNESTGPLLRTSIHQNSGGQKSQNTGLTTKKFYGNNVEKVPIDIIVNCDDSKHTYLQTNGKVILPGAKIPKITNLKERKTSLSDLNDPIILSSDDDDDNDRTNRRESISPQPADSACSSPAPSTGKVEAALNENTCRAERELRSIPEDSELNTVTLPRKARMKDQFGNSIINTPLKRRKVFSQEPPDALALSCQSSFDSVILNCRSIRVGTLFRLLIEPVIFCLDFIKIQLDEPDHDPVEIILNTSDLTKCEWCNVRKLPVVFLQAIPAVYQKLSIQLQMNKEDKVWNDCKGVNKLTNLEEQYIILIFQNGLDPPANMVFESIINEIGIKNNISNFFAKIPFEEANGRLVACTRTYEESIKGSCGQKENKIKTVSFESKIQLRSKQEFQFFDEEEETGENHTIFIGPVEKLIVYPPPPAKGGISVTNEDLHCLNEGEFLNDVIIDFYLK

SEQ ID NO: 888454 - protein, 967 aa, Homo sapiens
LELLWRPTRGGGRGDPPLSTWTVAKASADAFTPGRGGRTAVAAAAAERARGLGAPDGRRDLAAPARRVRPFYGLGRREACLCARFHSPFLGTHGWGKFLRQPGWAVDGESWAERNRAREAPSSSSPVAFPRRGLRSSGRGPRCPPARGQARARLACLCIGPSERGSAARLTAEPEARNLRRLPSSGAAPHPGEHGGGVGHGLRRRRRGRRKMAAGKSGGSAGEITFLEALARSESKRDGGFKNNWSFDHEEESEGDTDKDGTNLLSVDEDEDSETSKGKKLNRRSEIVANSSGEFILKTYVRRNKSESFKTLKGNPIGLNMLSNNKKLSENTQNTSLCSGTVVHGRRFHHAHAQIPVVKTAAQRKEYPPHVQKVEINPVRLSRLQGVERIMKKTEESESQVEPEIKRKVQQKRHCSTYQPTPPLSPASKKCLTHLEDLQRNCRQAITLNESTGPLLRTSIHQNSGGQKSQNTGLTTKKFYGNNVEKVPIDIIVNCDDSKHTYLQTNGKVILPGAKIPKITNLKERKTSLSDLNDPIILSSDDDDDNDRTNRRESISPQPADSACSSPAPSTGKVEAALNENTCRAERELRSIPEDSELNTVTLPRKARMKDQFGNSIINTPLKRRKVFSQEPPDALALSCQSSFDSVILNCRSIRVGTLFRLLIEPVIFCLDFIKIQLDEPDHDPVEIILNTSDLTKCEWCNVRKLPVVFLQAIPAVYQKLSIQLQMNKEDKVWNDCKGVNKLTNLEEQYIILIFQNGLDPPANMVFESIINEIGIKNNISNFFAKIPFEEANGRLVACTRTYEESIKGSCGQKENKIKTVSFESKIQLRSKQEFQFFDEEEETGENHTIFIGPVEKLIVYPPPPAKGGISVTNEDLHCLNEGEFLNDVIIDFYLKYLVLEKLKKEDADRIHIFSSFFYKRLNQRERRNHETTNLSIQQKRHGRVKTWTRHVDIFEKDFIFVPLNEA

SEQ ID NO: 888455 - protein, 364 aa, Homo sapiens
LELLWRPTRGGGRGDPPLSTWTVAKASADAFTPGRGGRTAVAAAAAERARGLGAPDGRRDLAAPARRVRPFYGLGRREACLCARFHSPFLGTHGWGKFLRQPGWAVDGESWAERNRAREAPSSSSPVAFPRRGLRSSGRGPRCPPARGQARARLACLCIGPSERGSAARLTAEPEARNLRRLPSSGAAPHPGEHGGGVGHGLRRRRRGRRKMAAGKSGGSAGEITFLEALARSESKRDGGFKNNWSFDHEEESEGDTDKDGTNLLSVDEDEDSETSKGKKLNRRSEIVANSSGEFILKTYVRRNKSESFKTLKGNPIGLNMLSNNKKLSENTQNTSLCSGTVVHGRRFHHAHAQIPVVKTAAQR

SEQ ID NO: 888456 - protein, 1323 aa, Homo sapiens; identical to SEQ ID NO: 888446

SEQ ID NO: 888457 - protein, 1003 aa, Homo sapiens
MLSNNKKLSENTQNTSLCSGTVVHGRRFHHAHAQIPVVKTAAQSSLDRKERKEYPPHVQKVEINPVRLSRLQGVERIMKKTEESESQVEPEIKRKVQQKRHCSTYQPTPPLSPASKKCLTHLEDLQRNCRQAITLNESTGPLLRTSIHQNSGGQKSQNTGLTTKKFYGNNVEKVPIDIIVNCDDSKHTYLQTNGKVILPGAKIPKITNLKERKTSLSDLNDPIILSSDDDDDNDRTNRRESISPQPADSACSSPAPSTGKVEAALNENTCRAERELRSIPEDSELNTVTLPRKARMKDQFGNSIINTPLKRRKVFSQEPPDALALSCQSSFDSVILNCRSIRVGTLFRLLIEPVIFCLDFIKIQLDEPDHDPVEIILNTSDLTKCEWCNVRKLPVVFLQAIPAVYQKLSIQLQMNKEDKVWNDCKGVNKLTNLEEQYIILIFQNGLDPPANMVFESIINEIGIKNNISNFFAKIPFEEANGRLVACTRTYEESIKGSCGQKENKIKTVSFESKIQLRSKQEFQFFDEEEETGENHTIFIGPVEKLIVYPPPPAKGGISVTNEDLHCLNEGEFLNDVIIDFYLKYLVLEKLKKEDADRIHIFSSFFYKRLNQRERRNHETTNLSIQQKRHGRVKTWTRHVDIFEKDFIFVPLNEAAHWFLAVVCFPGLEKPKYEPNPHYHENAVIQKCSTVEDSCISSSASEMESCSQNSSAKPVIKKMLNKKHCIAVIDSNPGQEESDPRYKRNICSVKYSVKKINHTASENEEFNKGESTSQKVADRTKSENGLQNESLSSTHHTDGLSKIRLNYSDESPEAGKMLEDELVDFSEDQDNQDDSSDDGFLADDNCSSEIGQWHLKPTICKQPCILLMDSLRGPSRSNVVKILREYLEVEWEVKKGSKRSFSKDVMKGSNPKVPQQNNFSDCGVYVLQYVESFFENPILSFELPMNLANWFPPPRMRTKREEIRNIILKLQEDQSKEKRKHKDTYSTEAPLGEGTEQYVNSISD

SEQ ID NO: 888458 - protein, 976 aa, Homo sapiens
LELLWRPTRGGGRGDPPLSTWTVAKASADAFTPGRGGRTAVAAAAAERARGLGAPDGRRDLAAPARRVRPFYGLGRREACLCARFHSPFLGTHGWGKFLRQPGWAVDGESWAERNRAREAPSSSSPVAFPRRGLRSSGRGPRCPPARGQARARLACLCIGPSERGSAARLTAEPEARNLRRLPSSGAAPHPGEHGGGVGHGLRRRRRGRRKMAAGKSGGSAGEITFLEALARSESKRDGGFKNNWSFDHEEESEGDTDKDGTNLLSVDEDEDSETSKGKKLNRRSEIVANSSGEFILKTYVRRNKSESFKTLKGNPIGLNMLSNNKKLSENTQNTSLCSGTVVHGRRFHHAHAQIPVVKTAAQRKEYPPHVQKVEINPVRLSRLQGVERIMKKTEESESQVEPEIKRKVQQKRHCSTYQPTPPLSPASKKCLTHLEDLQRNCRQAITLNESTGPLLRTSIHQNSGGQKSQNTGLTTKKFYGNNVEKVPIDIIVNCDDSKHTYLQTNGKVILPGAKIPKITNLKERKTSLSDLNDPIILSSDDDDDNDRTNRRESISPQPADSACSSPAPSTGKVEAALNENTCRAERELRSIPEDSELNTVTLPRKARMKDQFGNSIINTPLKRRKVFSQEPPDALALSCQSSFDSVILNCRSIRVGTLFRLLIEPVIFCLDFIKIQLDEPDHDPVEIILNTSDLTKCEWCNVRKLPVVFLQAIPAVYQKLSIQLQMNKEDKVWNDCKGVNKLTNLEEQYIILIFQNGLDPPANMVFESIINEIGIKNNISNFFAKIPFEEANGRLVACTRTYEESIKGSCGQKENKIKTVSFESKIQLRSKQEFQFFDEEEETGENHTIFIGPVEKLIVYPPPPAKGGISVTNEDLHCLNEGEFLNDVIIDFYLKYLVLEKLKKEDADRIHIFSSFFYKRLNQRERRNHETTNLSIQQKRHGRVKTWTRHVDIFEKDFIFVPLNEAWLKQNQTKL

SEQ ID NO: 888459 - protein, 302 aa, Homo sapiens [sequence omitted]

SEQ ID NO: 888460 - protein, 221 aa, Homo sapiens
PPGCRIRHEVPHIIHGLSKIRLNYSDESPEAGKMLEDELVDFSEDQDNQDDSSDDGFLADDNCSSEIGQWHLKPTICKQPCILLMDSLRGPSRSNVVKILREYLEVEWEVKKGSKRSFSKDVMKGSNPKVPQQNNFSDCGVYVLQYVESFFENPILSFELPMNLANWFPPPRMRTKREEIRNIILKLQEDQSKEKRKHKDTYSTEAPLGEGTEQYVNSISD

SEQ ID NO: 888461 - protein, 196 aa, Homo sapiens
EESSRSLANVYLIFVDFSEDQDNQDDSSDDGFLADDNCSSEIGQWHLKPTICKQPCILLMDSLRGPSRSNVVKILREYLEVEWEVKKGSKRSFSKDVMKGSNPKVPQQNNFSDCGVYVLQYVESFFENPILSFELPMNLANWFPPPRMRTKREEIRNIILKLQEDQSKEKRKHKDTYSTEAPLGEGTEQYVNSISD

SEQ ID NO: 888462 - protein, 672 aa, Homo sapiens
LELLWRPTRGGGRGDPPLSTWTVAKASADAFTPGRGGRTAVAAAAAERARGLGAPDGRRDLAAPARRVRPFYGLGRREACLCARFHSPFLGTHGWGKFLRQPGWAVDGESWAERNRAREAPSSSSPVAFPRRGLRSSGRGPRCPPARGQARARLACLCIGPSERGSAARLTAEPEARNLRRLPSSGAAPHPGEHGGGVGHGLRRRRRGRRKMAAGKSGGSAGEITFLEALARSESKRDGGFKNNWSFDHEEESEGDTDKDGTNLLSVDEDEDSETSKGKKLNRRSEIVANSSGEFILKTYVRRNKSESFKTLKGNPIGLNMLSNNKKLSENTQNTSLCSGTVVHGRRFHHAHAQIPVVKTAAQRKEYPPHVQKVEINPVRLSRLQGVERIMKKTEESESQVEPEIKRKVQQKRHCSTYQPTPPLSPASKKCLTHLEDLQRNCRQAITLNESTGPLLRTSIHQNSGGQKSQNTGLTTKKFYGNNVEKVPIDIIVNCDDSKHTYLQTNGKVILPGAKIPKITNLKERKTSLSDLNDPIILSSDDDDDNDRTNRRESISPQPADSACSSPAPSTGKVEAALNENTCRAERELRSIPEDSELNTVTLPRKARMKDQFGNSIINTPLKRRKVFSQEPPDALALSCQSSFDSVILNCRSIRVGTLFRLLIEPVIVSTS

SEQ ID NO: 888463 - protein, 142 aa, Homo sapiens
RRSLALSSRLECSGMISAHCNLRLPSSSDSLASVSRVAGIIGIHHHAQLIFVFLVEMGFHHVGQAGLELLTSGDLPTSASQSAGITGVSHCARPILNFRHCTQYNCYPYRIVLKVSSYCLLCLLTLLVAALLLCLVIFEFIV

SEQ ID NO: 888464 - protein, 723 aa, Homo sapiens
MAAAATMAAAARELVLRAGTSDMEEEEGPLAGGPGLQEPLQLGELDITSDEFILDEVDVHIQANLEDELVKEALKTGVDLRHYSKQVELELQQIEQKSIRDYIQESENIASLHNQITACDAVLERMEQMLGAFQSDLSSISSEIRTLQEQSGAMNIRLRNRQAVRGKLGELVDGLVVPSALVTAILEAPVTEPRFLEQLQELDAKAAAVREQEARGTAACADVRGVLDRLRVKAVTKIREFILQKIYSFRKPMTNYQIPQTALLKYRFFYQFLLGNERATAKEIRDEYVETLSKIYLSYYRSYLGRLMKVQYEEVAEKDDLMGVEDTAKKGFFSKPSLRSRNTIFTLGTRGSVISPTELEAPILVPHTAQRGEQRYPFEALFRSQHYALLDNSCREYLFICEFFVVSGPAAHDLFHAVMGRTLSMTLKHLDSYLADCYDAIAVFLCIHIVLRFRNIAAKRDVPALDRYWEQVLALLWPRFELILEMNVQSVRSTDPQRLGGLDTRPHYITRRYAEFSSALVSINQTIPNERTMQLLGQLQVEVENFVLRVAAEFSSRKEQLVFLINNYDMMLGVLMERAADDSKEVESFQQLLNARTQEFIEELLSPPFGGLVAFVKEAEALIERGQAERLRGEEARVTQLIRGFGSSWKSSVESLSQDVMRSFTNFRNGTSIIQGALTQLIQLYHRFHRVLSQPQLRALPARAELINIHHLMVELKKHKPNF

SEQ ID NO: 888465 - protein, 598 aa, Homo sapiens
MEQMLGAFQSDLSSISSEIRTLQEQSGAMNIRLRNRQAVRGKLGELVDGLVVPSALVTAILEAPVTEPRFLEQLQELDAKAAAVREQEARGTAACADVRGVLDRLRVKAVTKIREFILQKIYSFRKPMTNYQIPQTALLKYRFFYQFLLGNERATAKEIRDEYVETLSKIYLSYYRSYLGRLMKVQYEEVAEKDDLMGVEDTAKKGFFSKPSLRSRNTIFTLGTRGSVISPTELEAPILVPHTAQRGEQRYPFEALFRSQHYALLDNSCREYLFICEFFVVSGPAAHDLFHAVMGRTLSMTLKHLDSYLADCYDAIAVFLCIHIVLRFRNIAAKRDVPALDRYWEQVLALLWPRFELILEMNVQSVRSTDPQRLGGLDTRPHYITRRYAEFSSALVSINQTIPNERTMQLLGQLQVEVENFVLRVAAEFSSRKEQLVFLINNYDMMLGVLMERAADDSKEVESFQQLLNARTQEFIEELLSPPFGGLVAFVKEAEALIERGQAERLRGEEARVTQLIRGFGSSWKSSVESLSQDVMRSFTNFRNGTSIIQGALTQLIQLYHRFHRVLSQPQLRALPARAELINIHHLMVELKKHKPNF

SEQ ID NO: 888466 - protein, 723 aa, Homo sapiens; identical to SEQ ID NO: 888464

SEQ ID NO: 888467 - protein, 664 aa, Homo sapiens
MAAAATMAAAARELVLRAGTSDMEEEEGPLAGGPGLQEPLQLGELDITSDEFILDEVDVHIQANLEDELVKEALKTGVDLRHYSKQVELELQQIEQKSIRDYIQESENIASLHNQITACDAVLERMEQMLGAFQSDLSSISSEIRTLQEQSGAMNIRLRNRQAVRGKLGELVDGLVVPSALVTAILEAPVTEPRFLEQLQELDAKAAAVREQEARGTAACADVRGVLDRLRVKAVTKIREFILQKIYSFRKPMTNYQIPQTALLKYRFFYQFLLGNERATAKEIRDEYVETLSKIYLSYYRSYLGRLMKVQYEEVAEKDDLMGVEDTAKKGFFSKPSLRSRNTIFTLGTRGSVISPTELEAPILVPHTAQRGEQRYPFEALFRSQHYALLDNSCREYLFICEFFVVSGPAAHDLFHAVMGRTLSMTLKHLDSYLADCYDAIAVFLCIHIVLRFRNIAAKRDVPALDRYWEQVLALLWPRFELILEMNVQSVRSTDPQRLGGLDTRPHYITRRYAEFSSALVSINQTIPNERTMQLLGQLQVEVENFVLRVAAEFSSRKEQLVFLINNYDMMLGVLMERAADDSKEVESFQQLLNARTQEFIEELLSPPFGGLVAFVKEAEALIERGQAERLRGEEGSADPADPALSSLPPGAVPAAAPSPPCPG

SEQ ID NO: 888468 - protein, 769 aa, Homo sapiens
MAAAATMAAAARELVLRAGTSDMEEEEGPLAGGPGLQEPLQLGELDITSDEFILDEVDVHIQANLEDELVKEALKTGVDLRHYSKQVELELQQIEQKSIRDYIQESENIASLHNQITACDAVLERMEQMLGAFQSDLSSISSEIRTLQEQSGAMNIRLRNRQAVRGKLGELVDGLVVPSALVTAILEAPVTEPRFLEQLQELDAKAAAVREQEARGTAACADVRGVLDRLRVKAVTKIREFILQKIYSFRKPMTNYQIPQTALLKYRFFYQFLLGNERATAKEIRDEYVETLSKIYLSYYRSYLGRLMKVQYEEVAEKDDLMGVEDTAKKGFFSKPSLRSRNTIFTLGTRGSVISPTELEAPILVPHTAQRGEQRYPFEALFRSQHYALLDNSCREYLFICEFFVVSGPAAHDLFHAVMGRTLSMTLKHLDSYLADCYDAIAVFLCIHIVLRFRNIAAKRDVPALDRYWEQVLALLWPRFELILEMNVQSVRSTDPQRLGGLDTRPHYITRRYAEFSSALVSINQTIPNERTMQLLGQLQVEVENFVLRVAAEFSSRKEQLVFLINNYDMMLGVLMERAADDSKEVESFQQLLNARTQEFIEELLSPPFGGLVAFVKEAEALIERGQVSSSTFTTLWWSSRSISPTSDVPETALRSAGHLHGLLHPIPYPSSPGVPLPVFPLLPRPLTWLTCLHSQHLAQQDKLDPLGLLNIPVSSGFPRPLPCGLPKWPLSFLQSVTLLSCSHTPKACFFPCKNHCLNLWFTQLVTMS

SEQ ID NO: 888469 - protein, 305 aa, Homo sapiens [sequence omitted]

SEQ ID NO: 888470 - protein, 305 aa, Homo sapiens [sequence omitted]

SEQ ID NO: 888471 - protein, 238 aa, Homo sapiens
MNVQSVRSTDPQRLGGLDTRPHYITRRYAEFSSALVSINQTIPNERTMQLLGQLQVEVENFVLRVAAEFSSRKEQLVFLINNYDMMLGVLMERAADDSKEVESFQQLLNARTQEFIEELLSPPFGGLVAFVKEAEALIERGQAERLRGEEARVTQLIRGFGSSWKSSVESLSQDVMRSFTNFRNGTSIIQGALTQLIQLYHRFHRVLSQPQLRALPARAELINIHHLMVELKKHKPNF

SEQ ID NO: 888472 - protein, 723 aa, Homo sapiens; identical to SEQ ID NO: 888464

SEQ ID NO: 888473 - protein, 238 aa, Homo sapiens; identical to SEQ ID NO: 888471

SEQ ID NO: 888474 - protein, 191 aa, Homo sapiens
MQLLGQLQVEVENFVLRVAAEFSSRKEQLVFLINNYDMMLGVLMERAADDSKEVESFQQLLNARTQEFIEELLSPPFGGLVAFVKEAEALIERGQAERLRGEEARVTQLIRGFGSSWKSSVESLSQDVMRSFTNFRNGTSIIQGALTQLIQLYHRFHRVLSQPQLRALPARAELINIHHLMVELKKHKPNF

SEQ ID NO: 888475 - protein, 484 aa, Homo sapiens
MAAAARELVLRAGTSDMEEEEGPLAGGPGLQEPLQLGELDITSDEFILDEVDVHIQANLEDELVKEALKTGVDLRHYSKQVELELQQIEQKSIRDYIQESENIASLHNQITACDAVLERMEQMLGAFQSDLSSISSEIRTLQEQSGAMNIRLRNRQAVRGKLGELVDGLVVPSALVTAILEAPVTEPRFLEQLQELDAKAAAVREQEARGTAACADVRGVLDRLRVKAVTKIREFILQKIYSFRKPMTNYQIPQTALLKYRFFYQFLLGNERATAKEIRDEYVETLSKIYLSYYRSYLGRLMKVQYEEVAEKDDLMGVEDTAKKGFFSKPSLRSRNTIFTLGTRGSVISPTELEAPILVPHTAQRGEQRYPFEALFRSQHYALLDNSCREYLFICEFFVVSGPAAHDLFHAVMGRTLSMTLVRLLFPVPFNTFVPSLHQQHSGVMTLVELKSGSPHSKMSKPWLGVVVHTHNPSTLGVQGSRIA

SEQ ID NO: 888476 - protein, 336 aa, Homo sapiens
MAAAARELVLRAGTSDMEEEEGPLAGGPGLQEPLQLGELDITSDEFILDEVDVHIQANLEDELVKEALKTGVDLRHYSKQVELELQQIEQKSIRDYIQESENIASLHNQITACDAVLERMEQMLGAFQSDLSSISSEIRTLQEQSGAMNIRLRNRQAVRGKLGELVDGLVVPSALVTAILEAPVTEPRFLEQLQELDAKAAAVREQEARGTAACADVRGVLDRLRVKAVTKIREFILQKIYSFRKPMTNYQIPQTALLKYRFFYQFLLGNERATAKEIRDEYVETLSKIYLSYYRSYLGRLMKVQYEEVAEKDDLMGVEDTAKKDILVLGNPHARP

SEQ ID NO: 888477 - protein, 534 aa, Homo sapiens
MEQMLGAFQSDLSSISSEIRTLQEQSGAMNIRLRNRQAVRGKLGELVDGLVVPSALVTAILEAPVTEPRFLEQLQELDAKAAAVREQEARGTAACADVRGVLDRLRVKAVTKIREFILQKIYSFRKPMTNYQIPQTALLKYRFFYQFLLGNERATAKEIRDEYVETLSKIYLSYYRSYLGRLMKVQYPFEALFRSQHYALLDNSCREYLFICEFFVVSGPAAHDLFHAVMGRTLSMTLKHLDSYLADCYDAIAVFLCIHIVLRFRNIAAKRDVPALDRYWEQVLALLWPRFELILEMNVQSVRSTDPQRLGGLDTRPHYITRRYAEFSSALVSINQTIPNERTMQLLGQLQVEVENFVLRVAAEFSSRKEQLVFLINNYDMMLGVLMERAADDSKEVESFQQLLNARTQEFIEELLSPPFGGLVAFVKEAEALIERGQAERLRGEEARVTQLIRGFGSSWKSSVESLSQDVMRSFTNFRNGTSIIQGALTQLIQLYHRFHRVLSQPQLRALPARAELINIHHLMVELKKHKPNF

SEQ ID NO: 888478 - protein, 473 aa, Homo sapiens [sequence omitted]

SEQ ID NO: 888479 - protein, 598 aa, Homo sapiens; identical to SEQ ID NO: 888465

SEQ ID NO: 888480 - protein, 702 aa, Homo sapiens
MAAAATMAAAARELVLRAGTSDMEEEEGPLAGGPGLQEPLQLGELDITSDEFILDEVDVHIQANLEDELVKEALKTGVDLRHYSKQVELELQQIEQKSIRDYIQESENIASLHNQITACDAVLERMEQMLGAFQSDLSSISSEIRTLQEQSGAMNIRLRNRQAVRGKLGELVDGLVVPSALVTAILEAPVTEPRFLEQLQELDAKAAAVREQEARGTAACADVRGVLDRLRVKAVTKIREFILQKIYSFRKPMTNYQIPQTALLKYRFFYQFLLGNERATAKEIRDEYVETLSKIYLSYYRSYLGRLMKVQYEEVAEKDDLMGVEDTAKKGFFSKPSLRSRNTIFTLGTRGSVISPTELEAPILVPHTAQRGEQRYPFEALFRSQHYALLDNSCREYLFICEFFVVSGPAAHDLFHAVMGRTLSMTLKHLDSYLADCYDAIAVFLCIHIVLRFRNIAAKRDVPALDRYWEQVLALLWPRFELILEMNVQSVRSTDPQRLGGLDTRPHYITRRYAEFSSALVSINQTIPNERTMQLLGQLQVEVENFVLRVAAEFSSRKEQLVFLINNYDMMLGVLMERAADDSKEVESFQQLLNARTQEFIEELLSPPFGGLVAFVKEAEALIERGQAERLRGEEARVTQLIRGFGSSWKSSVESLSQDVMRSFTNFRNGTSIIQVTCKSQAPLRSPIINYFPHLFAGLSII

SEQ ID NO: 888481 - protein, 159 aa, Homo sapiens [sequence omitted]

SEQ ID NO: 888482 - protein, 862 aa, Homo sapiens
MKTVLMVAEKPSLAQSIAKILSRGSLSSHKGLNGACSVHEYTGTFAGQPVRFKMTSVCGHVMTLDFLGKYNKWDKVDPAELFSQAPTEKKEANPKLNMVKFLQVEGRGCDYIVLWLDCDKEGENICFEVLDAVLPVMNKAHGGEKTVFRARFSSITDTDICNAMACLGEPDHNEALSVDARQELDLRIGCAFTRFQTKYFQGKYGDLDSSLISFGPCQTPTLGFCVERHDKIQSFKPETYWVLQAKVNTDKDRSLLLDWDRVRVFDREIAQMFLNMTKLEKEAQVEATSRKEKAKQRPLALNTVEMLRVASSSLGMGPQHAMQTAERLYTQGYISYPRTETTHYPENFDLKGSLRQQANHPYWADTVKRLLAEGINRPRKGHDAGDHPPITPMKSATEAELGGDAWRLYEYITRHFIATVSHDCKYLQSTISFRIGPELFTCSGKTVLSPGFTEVMPWQSVPLEESLPTCQRGDAFPVGEVKMLEKQTNPPDYLTEAELITLMEKHGIGTDASIPVHINNICQRNYVTVESGRRLKPTNLGIVLVHGYYKIDAELVLPTIRSAVEKQLNLIAQGKADYRQVLGHTLDVFKRKFHYFVDSIAGMDELMEVSFSPLAATGKPLSRCGKCHRFMKYIQAKPSRLHCSHCDETYTLPQNGTIKLYKELRCPLDDFELVLWSSGSRGKSYPLCPYCYNHPPFRDMKKGMGCNECTHPSCQHSLSMLGIGQCVECESGVLVLDPTSGPKWKVACNKCNVVAHCFENAHRVRVSADTCSVCEAALLDVDFNKAKSPLPGDETQHMGCVFCDPVFQELVELKHAASCHPMHRGGPGRRQGRGRGRARRPPGKPNPRRPKDKMSALAAYFV

SEQ ID NO: 888483 - protein, 862 aa, Homo sapiens; identical to SEQ ID NO: 888482

SEQ ID NO: 888484 - protein, 862 aa, Homo sapiens; identical to SEQ ID NO: 888482

SEQ ID NO: 888485 - protein, 862 aa, Homo sapiens; identical to SEQ ID NO: 888482

SEQ ID NO: 888486 - protein, 862 aa, Homo sapiens; identical to SEQ ID NO: 888482

SEQ ID NO: 888487 - protein, 862 aa, Homo sapiens; identical to SEQ ID NO: 888482

SEQ ID NO: 888488 - protein, 890 aa, Homo sapiens
MKTVLMVAEKPSLAQSIAKILSRGSLSSHKGLNGACSVHEYTGTFAGQPVRFKMTSVCGHVMTLDFLGKYNKWDKVDPAELFSQAPTEKKEANPKLNMVKFLQVEGRGCDYIVLWLDCDKEGENICFEKMKPLIPSKEAAWPGSGGDPESHCTAFLVLDAVLPVMNKAHGGEKTVFRARFSSITDTDICNAMACLGEPDHNEALSVDARQELDLRIGCAFTRFQTKYFQGKYGDLDSSLISFGPCQTPTLGFCVERHDKIQSFKPETYWVLQAKVNTDKDRSLLLDWDRVRVFDREIAQMFLNMTKLEKEAQVEATSRKEKAKQRPLALNTVEMLRVASSSLGMGPQHAMQTAERLYTQGYISYPRTETTHYPENFDLKGSLRQQANHPYWADTVKRLLAEGINRPRKGHDAGDHPPITPMKSATEAELGGDAWRLYEYITRHFIATVSHDCKYLQSTISFRIGPELFTCSGKTVLSPGFTEVMPWQSVPLEESLPTCQRGDAFPVGEVKMLEKQTNPPDYLTEAELITLMEKHGIGTDASIPVHINNICQRNYVTVESGRRLKPTNLGIVLVHGYYKIDAELVLPTIRSAVEKQLNLIAQGKADYRQVLGHTLDVFKRKFHYFVDSIAGMDELMEVSFSPLAATGKPLSRCGKCHRFMKYIQAKPSRLHCSHCDETYTLPQNGTIKLYKELRCPLDDFELVLWSSGSRGKSYPLCPYCYNHPPFRDMKKGMGCNECTHPSCQHSLSMLGIGQCVECESGVLVLDPTSGPKWKVACNKCNVVAHCFENAHRVRVSADTCSVCEAALLDVDFNKAKSPLPGDETQHMGCVFCDPVFQELVELKHAASCHPMHRGGPGRRQGRGRGRARRPPGKPNPRRPKDKMSALAAYFV

SEQ ID NO: 888489 - protein, 890 aa, Homo sapiens; identical to SEQ ID NO: 888488

SEQ ID NO: 888490 - protein, 808 aa, Homo sapiens
MKTVLMVAEKPSLAQSIAKILSRGSLSSHKGLNGACSVHEYTGTFAGQPVRFKMTSVCGHVMTLDFLGKYNKWDKVDPAELFSQAPTEKKEANPKLNMVKFLQVEGRGCDYIVLWLDCDKEGENICFEVLDAVLPVMNKAHGGEKTVFRARFSSITDTDICNAMACLGEPDHNEALSVDARQELDLRIGCAFTRFQTKYFQGKYGDLDSSLISFGPCQTPTLGFCVERHDKIQSFKPETYWVLQAKVNTDKDRSLLLDWDRVRVFDREIAQMFLNMTKLHQLPTDRDHHYPENFDLKGSLRQQANHPYWADTVKRLLAEGINRPRKGHDAGDHPPITPMKSATEAELGGDAWRLYEYITRHFIATVSHDCKYLQSTISFRIGPELFTCSGKTVLSPGFTEVMPWQSVPLEESLPTCQRGDAFPVGEVKMLEKQTNPPDYLTEAELITLMEKHGIGTDASIPVHINNICQRNYVTVESGRRLKPTNLGIVLVHGYYKIDAELVLPTIRSAVEKQLNLIAQGKADYRQVLGHTLDVFKRKFHYFVDSIAGMDELMEVSFSPLAATGKPLSRCGKCHRFMKYIQAKPSRLHCSHCDETYTLPQNGTIKLYKELRCPLDDFELVLWSSGSRGKSYPLCPYCYNHPPFRDMKKGMGCNECTHPSCQHSLSMLGIGQCVECESGVLVLDPTSGPKWKVACNKCNVVAHCFENAHRVRVSADTCSVCEAALLDVDFNKAKSPLPGDETQHMGCVFCDPVFQELVELKHAASCHPMHRGGPGRRQGRGRGRARRPPGKPNPRRPKDKMSALAAYFV

SEQ ID NO: 888491 - protein, 238 aa, Homo sapiens [sequence omitted]

SEQ ID NO: 888492 - protein, 152 aa, Homo sapiens
THRDFRTAFSARVEQEPETHAPCLAVCHRFCMTDYILCIMRGVGVGAKSVAPVTLTPPAWHCLQAKPSRLHCSHCDETYTLPQNGTIKLYKELRCPLDDFELVLWSSGSRGKSYPLCPYCYNHPPFRDMKKGECSHSLLSTGSCSLFSVPTP

SEQ ID NO: 888493 - protein, 890 aa, Homo sapiens
MKTVLMVAEKPSLAQSIAKILSRGSLSSHKGLNGACSVHEYTGTFAGQPVRFKMTSVCGHVMTLDFLGKYNKWDKVDPAELFSQAPTEKKEANPKLNMVKFLQVEGRGCDYIVLWLDCDKEGENICFEKMKPLIPSKEAAWPGSGGDPSPTALAFLVLDAVLPVMNKAHGGEKTVFRARFSSITDTDICNAMACLGEPDHNEALSVDARQELDLRIGCAFTRFQTKYFQGKYGDLDSSLISFGPCQTPTLGFCVERHDKIQSFKPETYWVLQAKVNTDKDRSLLLDWDRVRVFDREIAQMFLNMTKLEKEAQVEATSRKEKAKQRPLALNTVEMLRVASSSLGMGPQHAMQTAERLYTQGYISYPRTETTHYPENFDLKGSLRQQANHPYWADTVKRLLAEGINRPRKGHDAGDHPPITPMKSATEAELGGDAWRLYEYITRHFIATVSHDCKYLQSTISFRIGPELFTCSGKTVLSPGFTEVMPWQSVPLEESLPTCQRGDAFPVGEVKMLEKQTNPPDYLTEAELITLMEKHGIGTDASIPVHINNICQRNYVTVESGRRLKPTNLGIVLVHGYYKIDAELVLPTIRSAVEKQLNLIAQGKADYRQVLGHTLDVFKRKFHYFVDSIAGMDELMEVSFSPLAATGKPLSRCGKCHRFMKYIQAKPSRLHCSHCDETYTLPQNGTIKLYKELRCPLDDFELVLWSSGSRGKSYPLCPYCYNHPPFRDMKKGMGCNECTHPSCQHSLSMLGIGQCVECESGVLVLDPTSGPKWKVACNKCNVVAHCFENAHRVRVSADTCSVCEAALLDVDFNKAKSPLPGDETQHMGCVFCDPVFQELVELKHAASCHPMHRGGPGRRQGRGRGRARRPPGKPNPRRPKDKMSALAAYFV

SEQ ID NO: 888494 - protein, 690 aa, Homo sapiens
MKTVLMVAEKPSLAQSIAKILSRGSLSSHKGLNGACSVHEYTGTFAGQPVRFKMTSVCGHVMTLDFLGKYNKWDKVDPAELFSQAPTEKKEANPKLNMVKFLQVEGRGCDYIVLWLDCDKEGENICFEVNTDKDRSLLLDWDRVRVFDREIAQMFLNMTKLHQLPTDRDHHYPENFDLKGSLRQQANHPYWADTVKRLLAEGINRPRKGHDAGDHPPITPMKSATEAELGGDAWRLYEYITRHFIATVSHDCKYLQSTISFRIGPELFTCSGKTVLSPGFTEVMPWQSVPLEESLPTCQRGDAFPVGEVKMLEKQTNPPDYLTEAELITLMEKHGIGTDASIPVHINNICQRNYVTVESGRRLKPTNLGIVLVHGYYKIDAELVLPTIRSAVEKQLNLIAQGKADYRQVLGHTLDVFKRKFHYFVDSIAGMDELMEVSFSPLAATGKPLSRCGKCHRFMKYIQAKPSRLHCSHCDETYTLPQNGTIKLYKELRCPLDDFELVLWSSGSRGKSYPLCPYCYNHPPFRDMKKGMGCNECTHPSCQHSLSMLGIGQCVECESGVLVLDPTSGPKWKVACNKCNVVAHCFENAHRVRVSADTCSVCEAALLDVDFNKAKSPLPGDETQHMGCVFCDPVFQELVELKHAASCHPMHRGGPGRRQGRGRGRARRPPGKPNPRRPKDKMSALAAYFV

SEQ ID NO: 888495 - protein, 622 aa, Homo sapiens
MKTVLMVAEKPSLAQSIAKILSRGSLSSHKGLNGACSVHEYTGTFAGQPVRFKMTSVCGHVMTLDFLGKYNKWDKVDPAELFSQAPTEKKEANPKLNMVKFLQVEGRGCDYIVLWLDCDKEGENICFEKMKPLIPSKEAAWPGSGGDPESHCTAFLVLDAVLPVMNKAHGGEKTVFRARFSSITDTDICNAMACLGEPDHNEALSVDARQELDLRIGCAFTRFQTKYFQGKYGDLDSSLISFGPCQTPTLGFCVERHDKIQSFKPETYWVLQAKVNTDKDRSLLLDWDRVRVFDREIAQMFLNMTKLEKEAQVEATSRKEKAKQRPLALNTVEMLRVASSSLGMGPQHAMQTAERLYTQGYISYPRTETTHYPENFDLKGSLRQQANHPYWADTVKRLLAEGINRPRKGHDAGDHPPITPMKSATEAELGGDAWRLYEYITRHFIATVSHDCKYLQSTISFRIGPELFTCSGKTVLSPGFTEVMPWQSVPLEESLPTCQRGDAFPVGEVKMLEKQTNPPDYLTEAELITLMEKHGIGTDASIPVHINNICQRNYVTVESGRRLKPTNLGIVLVHGYYKIDAELVLPTIRSAVEKQLNLIAQGKADYRQVLGHTLDVFKRKFH

SEQ ID NO: 888496 - protein, 238 aa, Homo sapiens [sequence omitted]

SEQ ID NO: 888497 - protein, 1455 aa, Homo sapiens
MAGRPLRIGDQLVLEEDYDETYIPSEQEILEFAREIGIDPIKEPELMWLAREGIVAPLPGEWKPCQDITGDIYYFNFANGQSMWDHPCDEHYRSLVIQERAKLSTSGAIKKKKKKKEKKDKKDRDPPKSSLALGSSLAPVHVPLGGLAPLRGLVDTPPSALRGSQSVSLGSSVESGRQLGELMLPSQGLKTSAYTKGLLGSIYEDKTALSLLGLGEETNEEDEEESDNQSVHSSSEPLRNLHLDIGALGGDFEYEESLRTSQPEEKKDVSLDSDAAGPPTPCKPSSPGADSSLSSAVGKGRQGSGARPGLPEKEENEKSEPKICRNLVTPKADPTGSEPAKASEKEAPEDTVDAGEEGSRREEAAKEPKKKASALEEGSSDASQELEISEHMKEPQLSDSIASDPKSFHGLDFGFRSRISEHLLDVDVLSPVLGGACRQAQQPLGIEDKDDSQSSQDELQSKQSKGLEERYHRLSPPLPHEERAQSPPRSLATEEEPPQGPEGQPEWKEAEELGEDSAASLSLQLSLQREQAPSPPAACEKGKEQHSQAEELGPGQEEAEDPEEKVAVSPTPPVSPEVRSTEPVAPPEQLSEAALKAMEEAVAQVLEQDQRHLLESKQEKMQQLREKLCQEEEEEILRLHQQKEQSLSSLRERLQKAIEEEEARMREEESQRLSWLRAQVQSSTQADEDQIRAEQEASLQKLREELESQQKAERASLEQKNRQMLEQLKEEIEASEKSEQAALNAAKEKALQQLREQLEGERKEAVATLEKEHSAELERLCSSLEAKHREVVSSLQKKIQEAQQKEEAQLQKCLGQVEHRVHQKSYHVAGYEHELSSLLREKRQEVEGEHERRLDKMKEEHQQVMAKAREQYEAEERKQRAELLGHLTGELERLQRAHERELETVRQEQHKRLEDLRRRHREQERKLQDLELDLETRAKDVKARLALLEVQEETARREKQQLLDVQRQVALKSEEATATHQQLEEAQKEHTHLLQSNQQLREILDELQARKLKLESQVDLLQAQSQQLQKHFSSLEAEAQKKQHLLREVTVEENNASPHFEPDLHIEDLRKSLGTNQTKEVSSSLSQSKEDLYLDSLSSHNVWHLLSAEGVALRSAKEFLVQQTRSMRRRQTALKAAQQHWRHELASAQEVAKDPPGIKALEDMRKNLEKETRHLDEMKSAMRKGHNLLKKKEEKLNQLESSLWEEASDEGTLGGSPTKKAVTFDLSDMDSLSSESSESFSPPHLDSTPSLTSRKIHGLSHSLRQISSQLSSVLSILDSLNPQSPPPLLASMPAQLPPRDPKSTPTPTYYGSLARFSALSSATPTSTQWAWDSGQGPRLPSSVAQTVDDFLLEKWRKYFPSGIPLLSNSPTPLESRLGYMSASEQLRLLQHSHSQVPEAGSTTFQGIIEANRRWLERVKNDPRLPLFSSTPKPKATLSLLQLGLDEHNRVKVYRF

SEQ ID NO: 888498 - protein, 1314 aa, Homo sapiens
EVSLLTRLVSNSRSQAVLPSWSPKVLELQESLRTSQPEEKKDVSLDSDAAGPPTPCKPSSPGADSSLSSAVGKGRQGSGARPGLPEKEENEKSEPKICRNLVTPKADPTGSEPAKASEKEAPEDTVDAGEEGSRREEAAKEPKKKASALEEGSSDASQELEISEHMKEPQLSDSIASDPKSFHGLDFGFRSRISEHLLDVDVLSPVLGGACRQAQQPLGIEDKDDSQSSQDELQSKQSKGLEERYHRLSPPLPHEERAQSPPRSLATEEEPPQGPEGQPEWKEAEELGEDSAASLSLQLSLQREQAPSPPAACEKGKEQHSQAEELGPGQEEAEDPEEKVAVSPTPPVSPEVRSTEPVAPPEQLSEAALKAMEEAVAQVLEQDQRHLLESKQEKMQQLREKLCQEEEEEILRLHQQKEQSLSSLRERLQKAIEEEEARMREEESQRLSWLRAQVQSSTQADEDQIRAEQEASLQKLREELESQQKAERASLEQKNRQMLEQLKEEIEASEKSEQAALNAAKEKALQQLREQLEGERKEAVATLEKEHSAELERLCSSLEAKHREVVSSLQKKIQEAQQKEEAQLQKCLGQVEHRVHQKSYHVAGYEHELSSLLREKRQEVEGEHERRLDKMKEEHQQVMAKAREQYEAEERKQRAELLGHLTGELERLQRAHERELETVRQEQHKRLEDLRRRHREQERKLQDLELDLETRAKDVKARLALLEVQEETARREKQQLLDVQRQVALKSEEATATHQQLEEAQKEHTHLLQSNQQLREILDELQARKLKLESQVDLLQAQSQQLQKHFSSLEAEAQKKQHLLREVTVEENNASPHFEPDLHIEDLRKSLGTNQTKEVSSSLSQSKEDLYLDSLSSHNVWHLLSAEGVALRSAKEFLVQQTRSMRRRQTALKAAQQHWRHELASAQEVAKDPPGIKALEDMRKNLEKETRHLDEMKSAMRKGHNLLKKKEEKLNQLESSLWEEAFGTYAEPCLPPTLLCGSLCDLLRPGYLVELWAPEESTHQVLSSHTSQGRQPTYHLEFVATKLLGEQMEMAIFHGFAASDEGTLGGSPTKKAVTFDLSDMDSLSSESSESFSPPHREWWRQQRIDSTPSLTSRKIHGLSHSLRQISSQLSSVLSILDSLNPQSPPPLLASMPAQLPPRDPKSTPTPTYYGSLARFSALSSATPTSTQWAWDSGQGPRLPSSVAQTVDDFLLEKWRKYFPSGIPLLSNSPTPLESRLGYMSASEQLRLLQHSHSQVPEAGSTTFQGIIEANRRWLERVKNDPRLPLFSSTPKPKATLSLLQLGLDEHNRVKVYRF

SEQ ID NO: 888499 - protein, 596 aa, Homo sapiens
RVRQYEAEERKQRAELLGHLTGELERLQRAHERELETVRQEQHKRLEDLRRRHREQERKLQDLELDLETRAKDVKARLALLEVQEETARREKQQLLDVQRQVALKSEEATATHQQLEEAQKEHTHLLQSNQQLREILDELQARKLKLESQVDLLQAQSQQLQKHFSSLEAEAQKKQHLLREVTVEENNASPHFEPDLHIEDLRKSLGTNQTKEVSSSLSQSKEDLYLDSLSSHNVWHLLSAEGVALRSAKEFLVQQTRSMRRRQTALKAAQQHWRHELASAQEVAKDPPGIKALEDMRKNLEKETRHLDEMKSAMRKGHNLLKKKEEKLNQLESSLWEEASDEGTLGGSPTKKAVTFDLSDMDSLSSESSESFSPPHREWWRQQRIDSTPSLTSRKIHGLSHSLRQISSQLSSVLSILDSLNPQSPPPLLASMPAQLPPRDPKSTPTPTYYGSLARFSALSSATPTSTQWAWDSGQGPRLPSSVAQTVDDFLLEKWRKYFPSGIPLLSNSPTPLESRLGYMSASEQLRLLQHSHSQVPEAGSTTFQGIIEANRRWLERVKNDPRLPLFSSTPKPKATLSLLQLGLDEHNRVKVYRF

SEQ ID NO: 888500 - protein, 1414 aa, Homo sapiens
MAGRPLRIGDQLVLEEDYDETYIPSEQEILEFAREIGIDPIKEPELMWLAREGIVAPLPGEWKPCQDITGDIYYFNFANGQSMWDHPCDEHYRSLVIQERAKLSTSGAIKKKKKKKEKKDKKDRDPPKSSLALGSSLAPVHVPLGGLAPLRGLVDTPPSALRGSQSVSLGSSVESGRQLGELMLPSQGLKTSAYTKGLLGSIYEDKTALSLLGLGEETNEEDEEESDNQSVHSSSEPLRNLHLDIGALGGDFEYEESLRTSQPEEKKDVSLDSDAAGPPTPCKPSSPGADSSLSSAVGKGRQGSGARPGLPEKEENEKSEPKICRNLVTPKADPTGSEPAKASEKEAPEDTVDAGEEGSRREEAAKEPKKKASALEEGSSDASQELEISEHMKEPQLSDSIASDPKSFHGLDFGFRSRISEHLLDVDVLSPVLGGACRQAQQPLGIEDKDDSQSSQDELQSKQSKGLEERYHRLSPPLPHEERAQSPPRSLATEEEPPQGPEGQPEWKEAEELGEDSAASLSLQLSLQRRSTEPVAPPEQLSEAALKAMEEAVAQVLEQDQRHLLESKQEKMQQLREKLCQEEEEEILRLHQQKEQSLSSLRERLQKAIEEEEARMREEESQRLSWLRAQVQSSTQADEDQIRAEQEASLQKLREELESQQKAERASLEQKNRQMLEQLKEEIEASEKSEQAALNAAKEKALQQLREQLEGERKEAVATLEKEHSAELERLCSSLEAKHREVVSSLQKKIQEAQQKEEAQLQKCLGQVEHRVHQKSYHVAGYEHELSSLLREKRQEVEGEHERRLDKMKEEHQQVMAKAREQYEAEERKQRAELLGHLTGELERLQRAHERELETVRQEQHKRLEDLRRRHREQERKLQDLELDLETRAKDVKARLALLEVQEETARREKQQLLDVQRQVALKSEEATATHQQLEEAQKEHTHLLQSNQQLREILDELQARKLKLESQVDLLQAQSQQLQKHFSSLEAEAQKKQHLLREVTVEENNASPHFEPDLHIEDLRKSLGTNQTKEVSSSLSQSKEDLYLDSLSSHNVWHLLSAEGVALRSAKEFLVQQTRSMRRRQTALKAAQQHWRHELASAQEVAKDPPGIKALEDMRKNLEKETRHLDEMKSAMRKGHNLLKKKEEKLNQLESSLWEEASDEGTLGGSPTKKAVTFDLSDMDSLSSESSESFSPPHREWWRQQRIDSTPSLTSRKIHGLSHSLRQISSQLSSVLSILDSLNPQSPPPLLASMPAQLPPRDPKSTPTPTYYGSLARFSALSSATPTSTQWAWDSGQGPRLPSSVAQTVDDFLLEKWRKYFPSGIPLLSNSPTPLESRLGYMSASEQLRLLQHSHSQVPEAGSTTFQGIIEANRRWLERVKNDPRLPLFSSTPKPKATLSLLQLGLDEHNRVKVYRF

SEQ ID NO: 888501 - protein, 1414 aa, Homo sapiens; identical to SEQ ID NO: 888500

SEQ ID NO: 888502 - protein, 1414 aa, Homo sapiens; identical to SEQ ID NO: 888500

SEQ ID NO: 888503 - protein, 923 aa, Homo sapiens
MSQFKRQRINPLPGGRNFSGTASTSLLGPPPGLLTPPVATELSQNARHLQGGEKQRVFTGIVTSLHDYFGVVDEEVFFQLSVVKGRLPQLGEKVLVKAAYNPGQAVPWNAVKVQTLSNQPLLKSPAPPLLHVAALGQKQGILGAQPQLIFQPHRIPPLFPQKPLSLFQTSHTLHLSHLNRFPARGPHGRLDQGRSDDYDSKKRKQRAGGEPWGAKKPRHDLPPYRVHLTPYTVDSPICDFLELQRRYRSLLVPSDFLSVHLSWLSAFPLSQPFSLHHPSRIQVSSEKEAAPDAGAEPITADSDPAYSSKVLLLSSPGLEELYRCCMLFVDDMAEPRETPEHPLKQIKFLLGRKEEEAVLVGGEWSPSLDGLDPQADPQVLVRTAIRCAQAQTGIDLSGCTKWWRFAEFQYLQPGPPRRLQTVVVYLPDVWTIMPTLEEWEALCQQKAAEAAPPTQEAQGETEPTEQAPDALEQAADTSRRNAETPEATTQQETDTDLPEAPPPPLEPAVIARPGCVNLSLHGIVEDRRPKERISFEVMVLAELFLEMLQRDFGYRVYKMLLSLPEKVVSPPEPEKEEAAKEEATKEEEAIKEEVVKEPKDEAQNEGPATESEAPLKEDGLLPKPLSSGGEEEEKPRGEASEDLCEMALDPELLLLRDDGEEEFAGAKLEDSEVRSVASNQSEMEFSSLQDMPKELDPSAVLPLDCLLAFVFFDANWCGYLHRRDLERILLTLGIRLSAEQAKQLVSRVVTQNICQYRSLQYSRQEGLDGGLPEEVLFGNLDLLPPPGKSTKPGAAPTEHKALVSHNGSLINVGSLLQRAEQQDSGRLYLENKIHTLELKLEESHNRFSATEVTNKTLAAEMQELRVRLAEAEETARTAERQKSQLQRLLQELRRRLTPLQLEIQRVVEKADSWVEKEEPAPSN

SEQ ID NO: 888504 - protein, 882 aa, Homo sapiens
MSHCLLLLQGGEKQRVFTGIVTSLHDYFGVVDEEVFFQLSVVKGRLPQLGEKVLVKAAYNPGQAVPWNAVKVQTLSNQPLLKSPAPPLLHVAALGQKQGILGAQPQLIFQPHRIPPLFPQKPLSLFQTSHTLHLSHLNRFPARGPHGRLDQGRSDDYDSKKRKQRAGGEPWGAKKPRHDLPPYRVHLTPYTVDSPICDFLELQRRYRSLLVPSDFLSVHLSWLSAFPLSQPFSLHHPSRIQVSSEKEAAPDAGAEPITADSDPAYSSKVLLLSSPGLEELYRCCMLFVDDMAEPRETPEHPLKQIKFLLGRKEEEAVLVGGEWSPSLDGLDPQADPQVLVRTAIRCAQAQTGIDLSGCTKWWRFAEFQYLQPGPPRRLQTVVVYLPDVWTIMPTLEEWEALCQQKAAEAAPPTQEAQGETEPTEQAPDALEQAADTSRRNAETPEATTQQETDTDLPEAPPPPLEPAVIARPGCVNLSLHGIVEDRRPKERISFEVMVLAELFLEMLQRDFGYRVYKMLLSLPEKVVSPPEPEKEEAAKEEATKEEEAIKEEVVKEPKDEAQNEGPATESEAPLKEDGLLPKPLSSGGEEEEKPRGEASEDLCEMALDPELLLLRDDGEEEFAGAKLEDSEVRSVASNQSEMEFSSLQDMPKELDPSAVLPLDCLLAFVFFDANWCGYLHRRDLERILLTLGIRLSAEQAKQLVSRVVTQNICQYRSLQYSRQEGLDGGLPEEVLFGNLDLLPPPGKSTKPGAAPTEHKALVSHNGSLINVGSLLQRAEQQDSGRLYLENKIHTLELKLEESHNRFSATEVTNKTLAAEMQELRVRLAEAEETARTAERQKSQLQRLLQELRRRLTPLQLEIQRVVEKADSWVEKEEPAPSN

SEQ ID NO: 888505 - protein, 923 aa, Homo sapiens
MSQFKRQRINPLPGGRNFSGTASTSLLGPPPGLLTPPVATELSQNARHLQGGEKQRVFTGIVTSLHDYFGVVDEEVFFQLSVVKGRLPQLGEKVLVKAAYNPGQAVPWNAVKVQTLSNQPLLKSPAPPLLHVAALGQKQGILGAQPQLIFQPHRIPPLFPQKPLSLFQTSHTLHLSHLNRFPARGPHGRLDQGRSDDYDSKKRKQRAGGEPWGAKKPRHDLPPYRVHLTPYTVDSPICDFLELQRRYRSLLVPSDFLSVHLSWLSAFPLSQPFSLHHPSRIQVSSEKEAAPDAGAEPITADSDPAYSSKVLLLSSPGLEELYRCCMLFVDDMAEPRETPEHPLKQIKFLLGRKEEEAVLVGGEWSPSLDGLDPQADPQVLVRTAIRCAQAQTGIDLSGCTKWWRFAEFQYLQPGPPRRLQTVVVYLPDVWTIMPTLEEWEALCQQKAAEAAPPTQEAQGETEPTEQAPDALEQAADTSRRNAETPEATTQQETDTDLPEAPPPPLEPAVIARPGCVNLSLHGIVEDRRPKERISFEVMVLAELFLEMLQRDFGYRVYKMLLSLPEKVVSPPEPEKEEAAKEEATKEEEAIKEEVVKEPKDEAQNEGPATESEAPLKEDGLLPKPLSSGGEEEEKPRGEASEDLCEMALDPELLLLRDDGEEEFAGAKLEDSEVRSVASNQSEMEFSSLQDMPKELDPSAVLPLDCLLAFVFFDANWCGYLHRRDLERILLTLGIRLSAEQAKQLVSRVVTQNICQYRSLQYSRQEGLDGGLPEEVLFGNLDLLPPPGKSTKPGAAPTEHKALVSHNGSLINVGSLLQRAEQQDSGRLYLENKIHTLELKLEESHNRFSATEVTNKTLAAEMQELRVRLAEAEETARTAERQKSQLQRLLQELRRRLTPLQLEIQRVVEKVRWGWTRRQHSSFP

SEQ ID NO: 888506 - protein, 853 aa, Homo sapiens
MTDHVAVIYTAGKQPISLIWVTLVLVKAAYNPGQAVPWNAVKVQTLSNQPLLKSPAPPLLHVAALGQKQGILGAQPQLIFQPHRIPPLFPQKPLSLFQTSHTLHLSHLNRFPARGPHGRLDQGRSDDYDSKKRKQRAGGEPWGAKKPRHDLPPYRVHLTPYTVDSPICDFLELQRRYRSLLVPSDFLSVHLSWLSAFPLSQPFSLHHPSRIQVSSEKEAAPDAGAEPITADSDPAYSSKVLLLSSPGLEELYRCCMLFVDDMAEPRETPEHPLKQIKFLLGRKEEEAVLVGGEWSPSLDGLDPQADPQVLVRTAIRCAQAQTGIDLSGCTKWWRFAEFQYLQPGPPRRLQTVVVYLPDVWTIMPTLEEWEALCQQKAAEAAPPTQEAQGETEPTEQAPDALEQAADTSRRNAETPEATTQQETDTDLPEAPPPPLEPAVIARPGCVNLSLHGIVEDRRPKERISFEVMVLAELFLEMLQRDFGYRVYKMLLSLPEKVVSPPEPEKEEAAKEEATKEEEAIKEEVVKEPKDEAQNEGPATESEAPLKEDGLLPKPLSSGGEEEEKPRGEASEDLCEMALDPELLLLRDDGEEEFAGAKLEDSEVRSVASNQSEMEFSSLQDMPKELDPSAVLPLDCLLAFVFFDANWCGYLHRRDLERILLTLGIRLSAEQAKQLVSRVVTQNICQYRSLQYSRQEGLDGGLPEEVLFGNLDLLPPPGKSTKPGAAPTEHKALVSHNGSLINVGSLLQRAEQQDSGRLYLENKIHTLELKLEESHNRFSATEVTNKTLAAEMQELRVRLAEAEETARTAERQKSQLQRLLQELRRRLTPLQLEIQRVVEKADSWVEKEEPAPSN

SEQ ID NO: 888507 - protein, 923 aa, Homo sapiens; identical to SEQ ID NO: 888503

SEQ ID NO: 888508 - protein, 241 aa, Homo sapiens
MEFSSLQDMPKELDPSAVLPLDCLLAFVFFDANWCGYLHRRDLERILLTLGIRLSAEQAKQLVSRVVTQNICQYRSLQYSRQEGLDGGLPEEVLFGNLDLLPPPGKSTKPGAAPTEHKALVSHNGSLINVGSLLQRAEQQDSGRLYLENKIHTLELKLEESHNRFSATEVTNKTLAAEMQELRVRLAEAEETARTAERQKSQLQRLLQELRRRLTPLQLEIQRVVEKADSWVEKEEPAPSN

SEQ ID NO: 888509 - protein, 254 aa, Homo sapiens
MLVPARGRDNQSEMEFSSLQDIPKELDPSAVLPLDCLLAFVFFDANWCGYLHRRDLERILLTLGIRLSAEQAKQLVSRVVTQNICQYRSLQYSRQEGLDGGLPEEVLFGNLDLLPPPGKSTKPGAAPTEHKALVSHNGSLINVGSLLQRAEQQDSGRLYLENKIHTLELKLEESHNRFSATEVTNKTLAAEMQELRVRLAEAEETARTAERQKSQLQRLLQELRRRLTPLQLEIQRVVEKADSWVEKEEPAPSN

SEQ ID NO: 888510 - protein, 686 aa, Homo sapiens
MSQFKRQRINPLPGGRNFSGTASTSLLGPPPGLLTPPVATELSQNARHLQGGEKQRVFTGIVTSLHDYFGVVDEEVFFQLSVVKGRLPQLGEKVLVKAAYNPGQAVPWNAVKVQTLSNQPLLKSPAPPLLHVAALGQKQGILGAQPQLIFQPHRIPPLFPQKPLSLFQTSHTLHLSHLNRFPARGPHGRLDQGRSDDYDSKKRKQRAGGEPWGAKKPRHDLPPYRVHLTPYTVDSPICDFLELQRRYRSLLVPSDFLSVHLSWLSAFPLSQPFSLHHPSRIQVSSEKEAAPDAGAEPITADSDPAYSSKVLLLSSPGLEELYRCCMLFVDDMAEPRETPEHPLKQIKFLLGRKEEEAVLVGGEWSPSLDGLDPQADPQVLVRTAIRCAQAQTGIDLSGCTKWWRFAEFQYLQPGPPRRLQTVVVYLPDVWTIMPTLEEWEALCQQKAAEAAPPTQEAQGETEPTEQAPDALEQAADTSRRNAETPEATTQQETDTDLPEAPPPPLEPAVIARPGCVNLSLHGIVEDRRPKERISFEVMVLAELFLEMLQRDFGYRVYKMLLSLPEKVVSPPEPEKEEAAKEEATKEEEAIKEEVVKEPKDEAQNEGPATESEAPLKEDGLLPKPLSSGGEEEEKPRGEASEDLCEMALDPELLLLRDDGEEEFAGAKLEDSEVRSVASNQSEMDPC

SEQ ID NO: 888511 - protein, 923 aa, Homo sapiens; identical to SEQ ID NO: 888503

SEQ ID NO: 888512 - protein, 923 aa, Homo sapiens; identical to SEQ ID NO: 888503

SEQ ID NO: 888513 - protein, 923 aa, Homo sapiens; identical to SEQ ID NO: 888503

SEQ ID NO: 888514 - protein, 124 aa, Homo sapiens
MSQFKRQRINPLPGGRNFSGTASTSLLGPPPGLLTPPVATELSQNARHLQGGEKQRVFTGIVTSLHDYFGVVDEEVFFQLSVVKGRLPQLGEKSTSFPWLLCSECGIGSGPAFSPVTHNSCLFP

SEQ ID NO: 888515 - protein, 704 aa, Homo sapiens [sequence omitted]

SEQ ID NO: 888516 - protein, 706 aa, Homo sapiens
MSQFKRQRINPLPGGRNFSGTASTSLLGPPPGLLTPPVATELSQNARHLQGGEKQRVFTGIVTSLHDYFGVVDEEVFFQLSVVKGRLPQLGEKVLVKAAYNPGQAVPWNAVKVQTLSNQPLLKSPAPPLLHVAALGQKQGILGAQPQLIFQPHRIPPLFPQKPLSLFQTSHTLHLSHLNRFPARGPHGRLDQGRSDDYDSKKRKQRAGGEPWGAKKPRHDLPPYRVHLTPYTVDSPICDFLELQRRYRSLLVPSDFLSVHLSWLSAFPLSQPFSLHHPSRIQVSSEKEAAPDAGAEPITADSDPAYSSKVLLLSSPGLEELYRCCMLFVDDMAEPRETPEHPLKQIKFLLGRKEEEAVLVGGEWSPSLDGLDPQADPQVLVRTAIRCAQAQTGIDLSGCTKWWRFAEFQYLQPGPPRRLQTVVVYLPDVWTIMPTLEEWEALCQQKAAEAAPPTQEAQGETEPTEQAPDALEQAADTSRRNAETPEATTQQETDTDLPEAPPPPLEPAVIARPGCVNLSLHGIVEDRRPKERISFEVMVLAELFLEMLQRDFGYRVYKMLLSLPEKVVSPPEPEKEEAAKEEATKEEEAIKEEVVKEPKDEAQNEGPATESEAPLKEDGLLPKPLSSGGEEEEKPRGEASEDLCEMALDPELLLLRDDGEEEFGMLSGERGACRLGMWLSTCGQAGFHFCTVELGGPCSPFILAFL

SEQ ID NO: 888517 - protein, 641 aa, Homo sapiens
MSQFKRQRINPLPGGRNFSGTASTSLLGPPPGLLTPPVATELSQNARHLQGGEKQRVFTGIVTSLHDYFGVVDEEVFFQLSVVKGRLPQLGEKVLVKAAYNPGQAVPWNAVKVQTLSNQPLLKSPAPPLLHVAALGQKQGILGAQPQLIFQPHRIPPLFPQKPLSLFQTSHTLHLSHLNRFPARGPHGRLDQGRSDDYDSKKRKQRAGGEPWGAKKPRHDLPPYRVHLTPYTVDSPICDFLELQRRYRSLLVPSDFLSVHLSWLSAFPLSQPFSLHHPSRIQVSSEKEAAPDAGAEPITADSDPAYSSKVLLLSSPGLEELYRCCMLFVDDMAEPRETPEHPLKQIKFLLGRKEEEAVLVGGEWSPSLDGLDPQADPQVLVRTAIRCAQAQTGIDLSGCTKWWRFAEFQYLQPGPPRRLQTVVVYLPDVWTIMPTLEEWEALCQQKAAEAAPPTQEAQGETEPTEQAPDALEQAADTSRRNAETPEATTQQETDTDLPEAPPPPLEPAVIARPGCVNLSLHGIVEDRRPKERISFEVMVLAELFLEMLQRDFGYRVYKMLLSLPEKVVSPPEPEKEEAAKEEATKEEEAIKEEVVKEPKDEAQNEGPATESEAPLVSTLPPRAVIVLIQCSLHSASTFTCT

SEQ ID NO: 888518 - protein, 377 aa, Homo sapiens [sequence omitted]

SEQ ID NO: 888519 - protein, 311 aa, Homo sapiens [sequence omitted]

SEQ ID NO: 888520 - protein, 215 aa, Homo sapiens
GGYRWPNPGTQRVSFQLLSQETEPTEQAPDALEQAADTSRRNAETPEATTQQETDTDLPEAPPPPLEPAVIARPGCVNLSLHGIVEDRRPKERISFEAGVKSLGEAVGWDFVGLKQSFFLMLMDPPTSPVMVLAELFLEMLQRDFGYRVYKMLLSLPEKVVSPPEPEKEEAAKEEATKEEEAIKEEVVKEPKDEAQNEGPATESEAPLVSTLPPR

SEQ ID NO: 888521 - protein, 85 aa, Homo sapiens
MCFLQAKQLVSRVVTQNICQYRSLQYSRQEGLDGGLPEEVLFGMFWGPAAFLGQRAGQAALSGDSILNSFSRFSLGNLDLLPPPG

SEQ ID NO: 888522 - protein, 923 aa, Homo sapiens; identical to SEQ ID NO: 888503

SEQ ID NO: 888523 - protein, 923 aa, Homo sapiens; identical to SEQ ID NO: 888503

SEQ ID NO: 888524 - protein, 598 aa, Homo sapiens
MLFVDDMAEPRETPEHPLKQIKFLLGRKEEEAVLVGGEWSPSLDGLDPQADPQVLVRTAIRCAQAQTGIDLSGCTKWWRFAEFQYLQPGPPRRLQTVVVYLPDVWTIMPTLEEWEALCQQKAAEAAPPTQEAQGETEPTEQAPDALEQAADTSRRNAETPEATTQQETDTDLPEAPPPPLEPAVIARPGCVNLSLHGIVEDRRPKERISFEVMVLAELFLEMLQRDFGYRVYKMLLSLPEKVVSPPEPEKEEAAKEEATKEEEAIKEEVVKEPKDEAQNEGPATESEAPLKEDGLLPKPLSSGGEEEEKPRGEASEDLCEMALDPELLLLRDDGEEEFAGAKLEDSEVRSVASNQSEMEFSSLQDMPKELDPSAVLPLDCLLAFVFFDANWCGYLHRRDLERILLTLGIRLSAEQAKQLVSRVVTQNICQYRSLQYSRQEGLDGGLPEEVLFGNLDLLPPPGKSTKPGAAPTEHKALVSHNGSLINVGSLLQRAEQQDSGRLYLENKIHTLELKLEESHNRFSATEVTNKTLAAEMQELRVRLAEAEETARTAERQKSQLQRLLQELRRRLTPLQLEIQRVVEKADSWVEKEEPAPSN

SEQ ID NO: 888525 - protein, 741 aa, Homo sapiens
MWFLTVGDGSTSSDDYDSKKRKQRAGGEPWGAKKPRHDLPPYRVHLTPYTVDSPICDFLELQRRYRSLLVPSDFLSVHLSWLSAFPLSQPFSLHHPSRIQVSSEKEAAPDAGAEPITADSDPAYSSKVLLLSSPGLEELYRCCMLFVDDMAEPRETPEHPLKQIKFLLGRKEEEAVLVGGEWSPSLDGLDPQADPQVLVRTAIRCAQAQTGIDLSGCTKWWRFAEFQYLQPGPPRRLQTVVVYLPDVWTIMPTLEEWEALCQQKAAEAAPPTQEAQGETEPTEQAPDALEQAADTSRRNAETPEATTQQETDTDLPEAPPPPLEPAVIARPGCVNLSLHGIVEDRRPKERISFEVMVLAELFLEMLQRDFGYRVYKMLLSLPEKVVSPPEPEKEEAAKEEATKEEEAIKEEVVKEPKDEAQNEGPATESEAPLKEDGLLPKPLSSGGEEEEKPRGEASEDLCEMALDPELLLLRDDGEEEFAGAKLEDSEVRSVASNQSEMEFSSLQDMPKELDPSAVLPLDCLLAFVFFDANWCGYLHRRDLERILLTLGIRLSAEQAKQLVSRVVTQNICQYRSLQYSRQEGLDGGLPEEVLFGNLDLLPPPGKSTKPGAAPTEHKALVSHNGSLINVGSLLQRAEQQDSGRLYLENKIHTLELKLEESHNRFSATEVTNKTLAAEMQELRVRLAEAEETARTAERQKSQLQRLLQELRRRLTPLQLEIQRVVEKADSWVEKEEPAPSN

SEQ ID NO: 888526 - protein, 386 aa, Homo sapiens [sequence omitted]

SEQ ID NO: 888527 - protein, 270 aa, Homo sapiens
MHHCMWPKPLDSGQAEILGDRATEGTICKSCSSLFSLQPKELDPSAVLPLDCLLAFVFFDANWCGYLHRRDLERILLTLGIRLSAEQAKQLVSRVVTQNICQYRSLQYSRQEGLDGGLPEEVLFGNLDLLPPPGKSTKPGAAPTEHKALVSHNGSLINVGSLLQRAEQQDSGRLYLENKIHTLELKLEESHNRFSATEVTNKTLAAEMQELRVRLAEAEETARTAERQKSQLQRLLQELRRRLTPLQLEIQRVVEKADSWVEKEEPAPSN

SEQ ID NO: 888528 - protein, 910 aa, Homo sapiens
MSQFKRQRINPLPGGRNFSGTASTSLLGPPPGLLTPPVATELSQNARHLQGGEKQRVFTGIVTSLHDYFGVVDEEVFFQLSVVKGRLPQLGEKVLVKAAYNPGQAVPWNAVKVQTLSNQPLLKSPAPPLLHVAALGQKQGILGAQPQLIFQPHRIPPLFPQKPLSLFQTSHTLHLSHLNRFPARGPHGRLDQGRSDDYDSKKRKQRAGGEPWGAKKPRHDLPPYRVHLTPYTVDSPICDFLELQRRYRSLLVPSDFLSVHLSWLSAFPLSQPFSLHHPSRIQVSSEKEAAPDAGAEPITADSDPAYSSKVLLLSSPGLEELYRCCMLFVDDMAEPRETPEHPLKQIKFLLGRKEEEAVLVGGEWSPSLDGLDPQADPQVLVRTAIRCAQAQTGIDLSGCTKWWRFAEFQYLQPGPPRRLQTVVVYLPDVWTIMPTLEEWEALCQQKAAEAAPPTQEAQGETEPTEQAPDALEQAADTSRRNAETPEATTQQETDTDLPEAPPPPLEPAVIARPGCVNLSLHGIVEDRRPKERISFEVMVLAELFLEMLQRDFGYRVYKMLLSLPEKVVSPPEPEKEEAAKEEATKEEEAIKEEVVKEPKDEAQNEGPATESEAPLKEDGLLPKPLSSGGEEEEKPRGEASEDLCEMALDPELLLLRDDGEEEFAGAKLEDSEVRSVASNQSEMEFSSLQDMPKELDPSAVLPLDCLLAFVFFDANWCGYLHRRDLERILLTLGIRLSAEQAKQLVSRVVTQNICQYRSLQYSRQEGLDGGLPEEVLFGNLDLLPPPGKSTKPGAAPTEHKALVSHNGSLINVGSLLQRAEQQDSGRLYLENKIHTLELKLEESHNRFSATEVTNKTLAAEMQELRVRLAEAEETARTAERQKSQLQRLLQELRRRLTPELNSAVVKGYTG

SEQ ID NO: 888529 - protein, 923 aa, Homo sapiens; identical to SEQ ID NO: 888503

SEQ ID NO: 888530 - protein, 706 aa, Homo sapiens; identical to SEQ ID NO: 888516

SEQ ID NO: 888531 - protein, 656 aa, Homo sapiens
MSQFKRQRINPLPGGRNFSGTASTSLLGPPPGLLTPPVATELSQNARHLQGGEKQRVFTGIVTSLHDYFGVVDEEVFFQLSVVKGRLPQLGEKVLVKAAYNPGQAVPWNAVKVQTLSNQPLLKSPAPPLLHVAALGQKQGILGAQPQLIFQPHRIPPLFPQKPLSLFQTSHTLHLSHLNRFPARGPHGRLDQGRSDDYDSKKRKQRAGGEPWGAKKPRHDLPPYRVHLTPYTVDSPICDFLELQRRYRSLLVPSDFLSVHLSWLSAFPLSQPFSLHHPSRIQVSSEKEAAPDAGAEPITADSDPAYSSKVLLLSSPGLEELYRCCMLFVDDMAEPRETPEHPLKQIKFLLGRKEEEAVLVGGEWSPSLDGLDPQADPQVLVRTAIRCAQAQTGIDLSGCTKWWRFAEFQYLQPGPPRRLQTVVVYLPDVWTIMPTLEEWEALCQQKAAEAAPPTQEAQGETEPTEQAPDALEQAADTSRRNAETPEATTQQETDTDLPEAPPPPLEPAVIARPGCVNLSLHGIVEDRRPKERISFEVMVLAELFLEMLQRDFGYRVYKMLLSLPEKVVSPPEPEKEEAAKEEATKEEEAIKEEVVKEPKDEAQNEGPATESEAPLVSTLPPRAVIVLTVTAHLYPGLCSERFLCPSSFPAPLLGMD

SEQ ID NO: 888532 - protein, 357 aa, Homo sapiens
MSQFKRQRINPLPGGRNFSGTASTSLLGPPPGLLTPPVATELSQNARHLQGGEKQRVFTGIVTSLHDYFGVVDEEVFFQLSVVKGRLPQLGEKVLVKAAYNPGQAVPWNAVKVQTLSNQPLLKSPAPPLLHVAALGQKQGILGAQPQLIFQPHRIPPLFPQKPLSLFQTSHTLHLSHLNRFPARGPHGRLDQGRSDDYDSKKRKQRAGGEPWGAKKPRHDLPPYRVHLTPYTVDSPICDFLELQRRYRSLLVPSDFLSVHLSWLSAFPLSQPFSLHHPSRIQVSSEKEAAPDAGAEPITADSDPAYSSKVLLLSSPGLEELYRCCMSTSFPWLLCSECGIGSGPAFSPVTHNSCLFP

SEQ ID NO: 888533 - protein, 178 aa, Homo sapiens
MSQFKRQRINPLPGGRNFSGTASTSLLGPPPGLLTPPVATELSQNARHLQGGEKQRVFTGIVTSLHDYFGVVDEEVFFQLSVVKGRLPQLGEKVLVKAAYNPGQAVPWNAVKVQTLSNQPLLKSPAPPLLHVAALGQKQGILGAQPQLIFQPHRIPPLFPQKLSLFQTSHGIRWYELI

SEQ ID NO: 888534 - protein, 100 aa, Homo sapiens
SADWKLKPLPVNVVSAVELSLKKLVPPFAMCRWRFAEFQYLQPGPPRRLQTVVVYLPDVWTIMPTLEEWEALCQQKAAEAAPPTQEAQGVRLCLSQQRGI

SEQ ID NO: 888535 - protein, 886 aa, Homo sapiens
MSDEKNLGVSQKLVSPSRSTSSCSSKQGSRQDSWEVVEGLRGEMNYTQEPPVQKGFLLKKRKWPLKGWHKRFFYLDKGILKYAKSQTDIEREKLHGCIDVGLSVMSVKKSSKCIDLDTEEHIYHLKVKSEEVFDEWVSKLRHHRMYRQNEIAMFPHEVNHFFSGSTITDSSSGVFDSISSRKRSSISKQNLFQTGSNVSFSCGGETRVPLWLQSSEDMEKCSKDLAHCHAYLVEMSQLLQSMDVLHRTYSAPAINAIQGGSFESPKKEKRSHRRWRSRAIGKDAKGTLQVPKPFSGPVRLHSSNPNLSTLDFGEEKNYSDGSETSSEFSKMQEDLCHIAHKVYFTLRSAFNIMSAEREKLKQLMEQDASSSPSAQVIGLKNALSSALAQNTDLKERLRRIHAESLLLDSPAVAKSGDNLAEENSRDENRALVHQLSNESRLSITDSLSEFFDAQEVLLSPSSSENEISDDDSYVSDISDNLSLDNLSNDLDNERQTLGPVLDSGREAKSRRRTCLPAPCPSSSNISLWNILRNNIGKDLSKVAMPVELNEPLNTLQRLCEELEYSELLDKAAQIPSPLERMVYVAAFAISAYASSYYRAGSKPFNPVLGETYECIREDKGFQFFSEQVSHHPPISACHAESRNFVFWQDVRWKNKFWGKSMEIVPIGTTHVTLPVFGDHFEWNKVTSCIHNILSGQRWIEHYGEIVIKNLHDDSCYCKVNFIKAKYWSTNAHEIEGTVFDRSGKAVHRLFGKWHESIYCGGGSSSACVWRANPMPKGYEQYYSFTQFALELNEMDPSSKSLLPPTDTRFRPDQRFLEEGNLEEAEIQKQRIEQLQRERRRVLEENHVEHQPRFFRKSDDDSWVSNGTYLELRKDLGFSKLDHPVLW

SEQ ID NO: 888536 - protein, 59 aa, Homo sapiens
MFQALAQNTDLKERLRRIHAESLLLDSPAVAKSGDNLAEENSRDENRALVHHIDCGPAH

SEQ ID NO: 888537 - protein, 1019 aa, Homo sapiens
MSDEKNLGVSQKLVSPSRSTSSCSSKQGSRQDSWEVVEGLRGEMNYTQEPPVQKGFLLKKRKWPLKGWHKRFFYLDKGILKYAKSQTDIEREKLHGCIDVGLSVMSVKKSSKCIDLDTEEHIYHLKVKSEEVFDEWVSKLRHHRMYRQNEIAMFPHEVNHFFSGSTITDSSSGVFDSISSRKRSSISKQNLFQTGSNVSFSCGGETRVPLWLQSSEDMEKCSKDLAHCHAYLVEMSQLLQSMDVLHRTYSAPAINAIQGGSFESPKKEKRSHRRWRSRAIGKDAKGTLQVPKPFSGPVRLHSSNPNLSTLDFGEEKNYSDGSETSSEFSKMQEDLCHIAHKVYFTLRSAFNIMSAEREKLKQLMEQDASSSPSAQVIGLKNALSSALAQNTDLKERLRRIHAESLLLDSPAVAKSGDNLAEENSRDENRALVHQLSNESRLSITDSLSEFFDAQEVLLSPSSSENEISDDDSYVSDISDNLSLDNLSNDLDNERQTLGPVLDSGREAKSRRRTCLPAPCPSSSNISLWNILRNNIGKDLSKVAMPVELNEPLNTLQRLCEELEYSELLDKAAQIPSPLERMVRSQPSLATVQPRSPSHEAIHGAHQRDSPCSLRFHFDCSVNRFIYSELSGFLRLAVSSHLVRIWRRGWGASPWHLVPGVVLFCGFVLPLSPEAFWLIVPMCPAGKHVFRAVCMFIFTSLGGQNLISRAVFLIQVYVAAFAISAYASSYYRAGSKPFNPVLGETYECIREDKGFQFFSEQVSHHPPISACHAESRNFVFWQDVRWKNKFWGKSMEIVPIGTTHVTLPVFGDHFEWNKVTSCIHNILSGQRWIEHYGEIVIKNLHDDSCYCKVNFIKAKYWSTNAHEIEGTVFDRSGKAVHRLFGKWHESIYCGGGSSSACVWRANPMPKGYEQYYSFTQFALELNEMDPSSKSLLPPTDTRFRPDQRFLEEGNLEEAEIQKQRIEQLQRERRRVLEENHVEHQPRFFRKSDDDSWVSNGTYLELRKDLGFSKLDHPVLW

SEQ ID NO: 888538 - protein, 637 aa, Homo sapiens
MFQALAQNTDLKERLRRIHAESLLLDSPAVAKSGDNLAEENSRDENRALVHQLSNESRLSITDSLSEFFDAQEVLLSPSSSENEISDDDSYVSDISDNLSLDNLSNDLDNERQTLGPVLDSGREAKSRRRTCLPAPCPSSSNISLWNILRNNIGKDLSKVAMPVELNEPLNTLQRLCEELEYSELLDKAAQIPSPLERMVRSQPSLATVQPRSPSHEAIHGAHQRDSPCSLRFHFDCSVNRFIDSELSGFLRLAVSSHLVRIWRRGWGASPWHLVPGVVLFCGFVLPLSPEAFWLIVPMCPAGKHVFRAVCMFIFTSLGGQNLISRAVFLIQVYVAAFAISAYASSYYRAGSKPFNPVLGETYECIREDKGFQFFSEQVSHHPPISACHAESRNFVFWQDVRWKNKFWGKSMEIVPIGTTHVTLPVFGDHFEWNKVTSCIHNILSGQRWIEHYGEIVIKNLHDDSCYCKVNFIKAKYWSTNAHEIEGTVFDRSGKAVHRLFGKWHESIYCGGGSSSACVWRANPMPKGYEQYYSFTQFALELNEMDPSSKSLLPPTDTRFRPDQRFLEEGNLEEAEIQKQRIEQLQRERRRVLEENHVEHQPRFFRKSDDDSWVSNGTYLELRKDLGFSKLDHPVLW

SEQ ID NO: 888539 - protein, 320 aa, Homo sapiens
IYERHSALLQYKKLHEMCWEEEILRLLLPDIRKENWTSLLRLNCCYIHGRKDKEAVLCFHQVSHHPPISACHAESRNFVFWQDVRWKNKFWGKSMEIVPIGTTHVTLPVFGDHFEWNKVTSCIHNILSGQRWIEHYGEIVIKNLHDDSCYCKVNFIKAKYWSTNAHEIEGTVFDRSGKAVHRLFGKWHESIYCGGGSSSACVWRANPMPKGYEQYYSFTQFALELNEMDPSSKSLLPPTDTRFRPDQRFLEEGNLEEAEIQKQRIEQLQRERRRVLEENHVEHQPRFFRKSDDDSWVSNGTYLELRKDLGFSKLDHPVLW

SEQ ID NO: 888540 - protein, 1012 aa, Homo sapiens
MSDEKNLGVSQKLVSPSRSTSSCSSKQGSRQDSWEVVEGLRGEMNYTQEPPVQKGFLLKKRKWPLKGWHKRFFYLDKGILKYAKSQTDIEREKLHGCIDVGLSVMSVKKSSKCIDLDTEEHIYHLKVKSEEVFDEWVSKLRHHRMYRQNEIAMFPHEVNHFFSGSTITDSSSGVFDSISSRKRSSISKQNLFQTGSNVSFSCGGETRVPLWLQSSEDMEKCSKDLAHCHAYLVEMSQLLQSMDVLHRTYSAPAINAIQGGSFESPKKEKRSHRRWRSRAIGKDAKGTLQVPKPFSGPVRLHSSNPNLSTLDFGEEKNYSDGSETSSEFSKMQEDLCHIAHKVYFTLRSAFNIMSAEREKLKQLMEQDASSSPSAQVIGLKNALSSALAQNTDLKERLRRIHAESLLLDSPAVAKSGDNLAEENSRDENRALVHQLSNESRLSITDSLSEFFDAQEVLLSPSSSENEISDDDSYVSDISDNLSLDNLSNDLDNERQTLGPVLDSGREAKSRRRTCLPAPCPSSSNISLWNILRNNIGKDLSKVAMPVELNEPLNTLQRLCEELEYSELLDKAAQIPSPLERMVRSQPSLATVQPRSPSHEAIHGAHQRDSPCSLRFHFDCSVNRFIYSELSGFLRLAVSSHLVRIWRRGWGASPWHLVPGVVLFCGFVLPLSPEAFWLIVPMCPAGKHVFRAVCMFIFTSLGGQNLISRAVFLIQVYVAAFAISAYASSYYRAGSKPFNPVLGETYECIREDKGFQFFSEQVSHHPPISACHAESRNFVFWQDVRWKNKFWGKSMEIVPIGTTHVTLPVFGDHFEWNKVTSCIHNILSGQRWIEHYGEIVIKNLHDDSCYCKVNFIKAKYWSTNAHEIEGTVFDRSGKAVHRLFGKWHESIYCGGGSSSACVWRANPMPKGYEQYYSFTQFALELNEMDPSSKSLLPPTDTRFRPDQRFLEEGNLEEAEIQKQRIEQLQRERRRVLEENHVEHQPRFFSRSPIEPSALGAGVLPRCVFQTRPK

SEQ ID NO: 888541 - protein, 641 aa, Homo sapiens
MSDEKNLGVSQKLVSPSRSTSSCSSKQGSRQDSWEVVEGLRGEMNYTQEPPVQKGFLLKKRKWPLKGWHKRFFYLDKGILKYAKSQTDIEREKLHGCIDVGLSVMSVKKSSKCIDLDTEEHIYHLKVKSEEVFDEWVSKLRHHRMYRQNEIAMFPHEVNHFFSGSTITDSSSGVFDSISSRKRSSISKQNLFQTGSNVSFSCGGETRVPLWLQSSEDMEKCSKDLAHCHAYLVEMSQLLQSMDVLHRTYSAPAINAIQGGSFESPKKEKRSHRRWRSRAIGKDAKGTLQVPKPFSGPVRLHSSNPNLSTLDFGEEKNYSDGSETSSEFSKMQEDLCHIAHKVYFTLRSAFNIMSAEREKLKQLMEQDASSSPSAQVIGLKNALSSALAQNTDLKERLRRIHAESLLLDSPAVAKSGDNLAEENSRDENRALVHQLSNESRLSITDSLSEFFDAQEVLLSPSSSENEISDDDSYVSDISDNLSLDNLSNDLDNERQTLGPVLDSGREAKSRRRTCLPAPCPSSSNISLWNILRNNIGKDLSKVAMPVELNEPLNTLQRLCEELEYSELLDKAAQIPSPLERMVRSQPSLATVQPRSPSHEAIHGAHQRDSPCSLRFHFDCSVNRFITQSCLASSAWLFPVTL

SEQ ID NO: 888542 - protein, 145 aa, Homo sapiens
MNGRVDYLVTEEEINLTRGPSGLGFNIVGGTDQQYVSNDSGIYVSRIKENGAAALDGRLQEGDKILSVNGQDLKNLLHQDAVDLFRNAGYAVSLRVQHRLQVQNGPIGHRGEGDPSGIPIFMVLVPVFALTMVAAWAFMRYRQQL

SEQ ID NO: 888543 - protein, 161 aa, Homo sapiens
MNGRVDYLVTEEEINLTRGPSGLGFNIVGGTDQQYVSNDSGIYVSRIKENGAAALDGRLQEGDKILSKETQMEGQDYTLNHWQVNGQDLKNLLHQDAVDLFRNAGYAVSLRVQHRLQVQNGPIGHRGEGDPSGIPIFMVLVPVFALTMVAAWAFMRYRQQL

SEQ ID NO: 888544 - protein, 145 aa, Homo sapiens; identical to SEQ ID NO: 888542

SEQ ID NO: 888545 - protein, 145 aa, Homo sapiens; identical to SEQ ID NO: 888542

SEQ ID NO: 888546 - protein, 182 aa, Homo sapiens
MNGRVDYLVTEEEINLTRGPSGLGFNIVGGTDQQYVSNDSGIYVSRIKENGAAALDGRLQEGDKILSVNGQDLKNLLHQDAVDLFRNAGYAVSLRVQHRLLIVGGSFGLREFSQIRYDAVKSKMDPELEKKLKENKISLESEYEKIKDSKFDDWKNIRGPRPWEDPDLLQGRNPESLKTKTT

SEQ ID NO: 888547 - protein, 145 aa, Homo sapiens; identical to SEQ ID NO: 888542

SEQ ID NO: 888548 - protein, 102 aa, Homo sapiens
MASLASNLWADIQAAQAMMVTILSVNGQDLKNLLHQDAVDLFRNAGYAVSLRVQHRLQVQNGPIGHRGEGDPSGIPIFMVLVPVFALTMVAAWAFMRYRQQL

SEQ ID NO: 888549 - protein, 120 aa, Homo sapiens
MNGRVDYLVTEEEINLTRGPSGLGFNIVGGTDQQYVSNDSGIYVSRIKENGAAALDGRLQEGDKILSVNGQDLKNLLHQDAVDLFRNAGYAVSLRVQHRAENERGESKVCCQCKSIINQQ

SEQ ID NO: 888550 - protein, 221 aa, Homo sapiens
MVVVGILLAYLAGWVLEWRWLAVLGCVPPSLMLLLMCFMPETPRFLLTQHRRQEAMAALRFLWGSEQGWEDPPIGAEQQLSGVNAVMFYAETIFEEAKFKDSSLASVVVGVIQVLFTAVAALIMDRAGRRLLLVLSGGSSRPLRGAFVGWPPGFLASSRLLFHLCSVFLKLRGHTSGQFTGHLEGRCTPSLAVDTPVSPVASQSLLPGRIHPGLLGAPCVP

SEQ ID NO: 888551 - protein, 727 aa, Homo sapiens
MTPEDPEETQPLLGPPGGSAPRGRRVFLAAFAAALGPLSFGFALGYSSPAIPSLQRAAPPAPRLDDAAASWFGAVVTLGAAAGGVLGGWLVDRAGRKLSLLLCSVPFVAGFAVITAAQDVWMLLGGRLLTGLACGVASLVAPVYISEIAYPAVRGLLGSCVQLMVVVGILLAYLAGWVLEWRWLAVLGCVPPSLMLLLMCFMPETPRFLLTQHRRQEAMAALRFLWGSEQGWEDPPIGAEQSFHLALLRQPGIYKPFIIGVSLMAFQQLSGVNAVMFYAETIFEEAKFKDSSLASVVVGVIQVLFTAVAALIMDRAGRRLLLVLSGEGSPLCSLPAMRGRAFAKATTLQEEEQGAFVMTNIMDYCGHDLKQLVTKHSLQACPCQWHSHTTPLTSVVNPPEGTLTAPAYDGKTEGQEGEVTQEFVGPFGQVTFLSEPQSPPLGSGGNGSASLSTIFEEWEVIHVRPSARAAAHGHLVPSSCCEDDRRGRGLLAAASVPVPPISSAQRVCSGNFLQFAEVQGGVAATQSGLLRPRCQNTKLAVLWEPGLPLSEASRPCCCALGRSPGAPPTAALPPAGVVMVFSTSAFGAYFKLTQGGPGNSSHVAISAPVSAQPVDASVGLAWLAVGSMCLFIAGFAVGWGPIPWLLMSEIFPLHVKGVATGICVLTNWLMAFLVTKEFSSLMEVLRPYGAFWLASAFCIFSVLFTLFCVPETKGKTLEQITAHFEGR

SEQ ID NO: 888552 - protein, 477 aa, Homo sapiens
MTPEDPEETQPLLGPPGGSAPRGRRVFLAAFAAALGPLSFGFALGYSSPAIPSLQRAAPPAPRLDDAAASWFGAVVTLGAAAGGVLGGWLVDRAGRKLSLLLCSVPFVAGFAVITAAQDVWMLLGGRLLTGLACGVASLVAPVYISEIAYPAVRGLLGSCVQLMVVVGILLAYLAGWVLEWRWLAVLGCVPPSLMLLLMCFMPETPRFLLTQHRRQEAMAALRFLWGSEQGWEDPPIGAEQSFHLALLRQPGIYKPFIIGVSLMAFQQLSGVNAVMFYAETIFEEAKFKDSSLASVVVGVIQVLFTAVAALIMDRAGRRLLLVLSGVVMVFSTSAFGAYFKLTQGGPGNSSHVAISAPVSAQPVDASVGLAWLAVGSMCLFIAGFAVGWGPIPWLLMSEIFPLHVKGVATGICVLTNWLMAFLVTKEFSSLMEVLRPYGAFWLASAFCIFSVLFTLFCVPETKGKTLEQITAHFEGR

SEQ ID NO: 888553 - protein, 314 aa, Homo sapiens
MVVVGILLAYLAGWVLEWRWLAVLGCVPPSLMLLLMCFMPETPRFLLTQHRRQEAMAALRFLWGSEQGWEDPPIGAEQSFHLALLRQPGIYKPFIIGVSLMAFQQLSGVNAVMFYAETIFEEAKFKDSSLASVVVGVIQVLFTAVAALIMDRAGRRLLLVLSGVVMVFSTSAFGAYFKLTQGGPGNSSHVAISAPVSAQPVDASVGLAWLAVGSMCLFIAGFAVGWGPIPWLLMSEIFPLHVKGVATGICVLTNWLMAFLVTKEFSSLMEVLRPYGAFWLASAFCIFSVLFTLFCVPETKGKTLEQITAHFEGR

SEQ ID NO: 888554 - protein, 342 aa, Homo sapiens
MTCSLGKVYISEIAYPAVRGLLGSCVQLMVVVGILLAYLAGWVLEWRWLAVLGCVPPSLMLLLMCFMPETPRFLLTQHRRQEAMAALRFLWGSEQGWEDPPIGAEQSFHLALLRQPGIYKPFIIGVSLMAFQQLSGVNAVMFYAETIFEEAKFKDSSLASVVVGVIQVLFTAVAALIMDRAGRRLLLVLSGVVMVFSTSAFGAYFKLTQGGPGNSSHVAISAPVSAQPVDASVGLAWLAVGSMCLFIAGFAVGWGPIPWLLMSEIFPLHVKGVATGICVLTNWLMAFLVTKEFSSLMEVLRPYGAFWLASAFCIFSVLFTLFCVPETKGKTLEQITAHFEGR

SEQ ID NO: 888555 - protein, 214 aa, Homo sapiens
MAFQQLSGVNAVMFYAETIFEEAKFKDSSLASVVVGVIQVLFTAVAALIMDRAGRRLLLVLSGVVMVFSTSAFGAYFKLTQGGPGNSSHVAISAPVSAQPVDASVGLAWLAVGSMCLFIAGFAVGWGPIPWLLMSEIFPLHVKGVATGICVLTNWLMAFLVTKEFSSLMEVLRPYGAFWLASAFCIFSVLFTLFCVPETKGKTLEQITAHFEGR

SEQ ID NO: 888556 - protein, 538 aa, Homo sapiens
MVVVGILLAYLAGWVLEWRWLAVLGCVPPSLMLLLMCFMPETPRFLLTQHRRQEAMAALRFLWGSEQGWEDPPIGAEQQLSGVNAVMFYAETIFEEAKFKDSSLASVVVGVIQVLFTAVAALIMDRAGRRLLLVLSGEGSPLCSLPAMRGRAFAKATTLQEEDREQFVMTNIMDYAAMIGQQLVTKHSLQACPCQWHSHTTPLTSVVNPPEGTLTAPAYDGKTEGQEGEVTQEFVGPFGQVTFLSEPQSPPLGSGGNGSASLSTIFEEWEVIHVRPSARAAAHGHLVPSSCCEDDRRGRGLLAAASVPVPPISSAQRVCSGNFLQFAEVQGGVAATQSGLLRPRCQNTKLAVLWEPGLPLSEASRPCCCALGRSPGAPPTAALPPAGVVMVFSTSAFGAYFKLTQGGPGNSSHVAISAPVSAQPVDASVGLAWLAVGSMCLFIAGFAVGWGPIPWLLMSEIFPLHVKGVATGICVLTNWLMAFLVTKEFSSLMEVLRPYGAFWLASAFCIFSVLFTLFCVPETKGKTLEQITAHFEGR

SEQ ID NO: 888557 - protein, 214 aa, Homo sapiens; identical to SEQ ID NO: 888555

SEQ ID NO: 888558 - protein, 316 aa, Homo sapiens
MTCSLGKVYISEIAYPAVRGLLGSCVQLMVVVGILLAYLAGWVLEWRWLAVLGCVPPSLMLLLMCFMPETPRFLLTQHRRQEAMAALRFLWGSEQGWEDPPIGAEQQLSGVNAVMFYAETIFEEAKFKDSSLASVVVGVIQVLFTAVAALIMDRAGRRLLLVLSGVVMVFSTSAFGAYFKLTQGGPGNSSHVAISAPVSAQPVDASVGLAWLAVGSMCLFIAGFAVGWGPIPWLLMSEIFPLHVKGVATGICVLTNWLMAFLVTKEFSSLMEVLRPYGAFWLASAFCIFSVLFTLFCVPETKGKTLEQITAHFEGR

SEQ ID NO: 888559 - protein, 477 aa, Homo sapiens; identical to SEQ ID NO: 888552

SEQ ID NO: 888560 - protein, 477 aa, Homo sapiens; identical to SEQ ID NO: 888552

SEQ ID NO: 888561 - protein, 356 aa, Homo sapiens
MLLGGRLLTGLACGVASLVAPVYISEIAYPAVRGLLGSCVQLMVVVGILLAYLAGWVLEWRWLAVLGCVPPSLMLLLMCFMPETPRFLLTQHRRQEAMAALRFLWGSEQGWEDPPIGAEQSFHLALLRQPGIYKPFIIGVSLMAFQQLSGVNAVMFYAETIFEEAKFKDSSLASVVVGVIQVLFTAVAALIMDRAGRRLLLVLSGVVMVFSTSAFGAYFKLTQGGPGNSSHVAISAPVSAQPVDASVGLAWLAVGSMCLFIAGFAVGWGPIPWLLMSEIFPLHVKGVATGICVLTNWLMAFLVTKEFSSLMEVLRPYGAFWLASAFCIFSVLFTLFCVPETKGKTLEQITAHFEGR

SEQ ID NO: 888562 - protein, 408 aa, Homo sapiens
MTPEDPEETQPLLGPPGGSAPRGRRVFLAAFAAALGPLSFGFALGYSSPAIPSLQRAAPPAPRLDDAAASWFGVYISEIAYPAVRGLLGSCVQLMVVVGILLAYLAGWVLEWRWLAVLGCVPPSLMLLLMCFMPETPRFLLTQHRRQEAMAALRFLWGSEQGWEDPPIGAEQSFHLALLRQPGIYKPFIIGVSLMAFQQLSGVNAVMFYAETIFEEAKFKDSSLASVVVGVIQVLFTAVAALIMDRAGRRLLLVLSGVVMVFSTSAFGAYFKLTQGGPGNSSHVAISAPVSAQPVDASVGLAWLAVGSMCLFIAGFAVGWGPIPWLLMSEIFPLHVKGVATGICVLTNWLMAFLVTKEFSSLMEVLRPYGAFWLASAFCIFSVLFTLFCVPETKGKTLEQITAHFEGR

SEQ ID NO: 888563 - protein, 214 aa, Homo sapiens; identical to SEQ ID NO: 888555

SEQ ID NO: 888564 - protein, 349 aa, Homo sapiens
MAMSVANMRADVQRQRGPISEAESLRLARPRLAHPGSDASLLHPPPAGWVLEWRWLAVLGCVPPSLMLLLMCFMPETPRFLLTQHRRQEAMAALRFLWGSEQGWEDPPIGAEQSFHLALLRQPGIYKPFIIGVSLMAFQQLSGVNAVMFYAETIFEEAKFKDSSLASVVVGVIQVLFTAVAALIMDRAGRRLLLVLSGVVMVFSTSAFGAYFKLTQGGPGNSSHVAISAPVSAQPVDASVGLAWLAVGSMCLFIAGFAVGWGPIPWLLMSEIFPLHVKGVATGICVLTNWLMAFLVTKEFSSLMEVLRPYGAFWLASAFCIFSVLFTLFCVPETKGKTLEQITAHFEGR

SEQ ID NO: 888565 - protein, 437 aa, Homo sapiens
MTPEDPEETQPLLGPPGGSAPRGRRVFLAAFAAALGPLSFGFALGYSSPAIPSLQRAAPPAPRLDDAAASWFGAVVTLGAAAGGVLGGWLVDRAGRKLSLLLCSVPFVAGFAVITAAQDVWMLLGGRLLTGLACGVASLVAPVYISEIAYPAVRGLLGSCVQLMVVVGILLAYLAGWVLEWRWLAVLGCVPPSLMLLLMCFMPETPRFLLTQHRRQEAMAALRFLWGSEQGWEDPPIGAEQSFHLALLRQPGIYKPFIIGVSLMAFQQLSGVNAVMFYAETIFEEAKFKDSSLASVVVGVIQVLFTAVAALIMDRAGRRLLLVLSGVVMVFSTSAFGAYFKLTQGGPGNSSHVAISAPVSAQPVDASVGLAWLAVGSMCLFIAGFAVGWGPIPWLLMSEIFPLHVKGVATGICVLTNWLMAFLVTKEFSSLMLLLLL

SEQ ID NO: 888566 - protein, 437 aa, Homo sapiens; identical to SEQ ID NO: 888565

SEQ ID NO: 888567 - protein, 938 aa, Homo sapiens
MNWNKGGPGTKRGFGFGGFAISAGKKEEPKLPQQSHSAFGATSSSSGFGKSAPPQLPSFYKIGSKRANFDEENAYFEDEEEDSSNVDLPYIPAENSPTRQQFHSKPVDSDSDDDPLEAFMAEVEDQAARDMKRLEEKDKERKNVKGIRDDIEEEDDQEAYFRYMAENPTAGVVQEEEEDNLEYDSDGNPIAPTKKIIDPLPPIDHSEIDYPPFEKNFYNEHEEITNLTPQQLIDLRHKLNLRVSGAAPPRPGSSFAHFGFDEQLMHQIRKSEYTQPTPIQCQGVPVALSGRDMIGIAKTGSGKTAAFIWPMLIHIMDQKELEPGDGPIAVIVCPTRELCQQIHAECKRFGKAYNLRSVAVYGGGSMWEQAKALQEGAEIVVCTPGRLIDHVKKKATNLQRVSYLVFDEADRMFDMGFEYQVRSIASHVRPDRQTLLFSATFRKKIEKLARDILIDPIRVVQGDIGEANEDVTQIVEILHSGPSKWNWLTRRLVEFTSSGSVLLFVTKKANAEELANNLKQEGHNLGLLHGDMDQSERNKVISDFKKKDIPVLVATDVAARGLDIPSIKTVINYDVARDIDTHTHRIGRTGRAGEKGVAYTLLTPKDSNFAGDLVRNLEGANQHVSKELLDLAMQNAWFRKSRFKGGKGKKLNIGGGGLGYRERPGLGSENMDRGNNNVMSNYEAYKPSTGAMGDRLTAMKAAFQSQYKSHFVAASLSNQKAGSSAAGASGWTSAGSLNSVPTNSAQQGHNSPDSPVTSAAKGIPGFGNTGNISGAPVTYPSAGAQGVNNTASGNNSREGTGGSNGKRERYTENRGSSRHSHGETGNRHSDSPRHGDGGRHGDGYRHPESSSRHTDGHRHGENRHGGSAGRHGENRGANDGRNGESRKEAFNRESKMEPKMEPKVDSSKMDKVDSKTDKTADGFAVPEPPKRKKSRWDS

SEQ ID NO: 888568 - protein, 1001 aa, Homo sapiens
RWRWWRWRRRWWWWRRRRRRGRRGRSAAGPGRDSAYFGLRDSLRARGCSSCRCSHSSRSVIGTMNWNKGGPGTKRGFGFGGFAISAGKKEEPKLPQQSHSAFGATSSSSGFGKSAPPQLPSFYKIGSKRANFDEENAYFEDEEEDSSNVDLPYIPAENSPTRQQFHSKPVDSDSDDDPLEAFMAEVEDQAARDMKRLEEKDKERKNVKGIRDDIEEEDDQEAYFRYMAENPTAGVVQEEEEDNLEYDSDGNPIAPTKKIIDPLPPIDHSEIDYPPFEKNFYNEHEEITNLTPQQLIDLRHKLNLRVSGAAPPRPGSSFAHFGFDEQLMHQIRKSEYTQPTPIQCQGVPVALSGRDMIGIAKTGSGKTAAFIWPMLIHIMDQKELEPGDGPIAVIVCPTRELCQQIHAECKRFGKAYNLRSVAVYGGGSMWEQAKALQEGAEIVVCTPGRLIDHVKKKATNLQRVSYLVFDEADRMFDMGFEYQVRSIASHVRPDRQTLLFSATFRKKIEKLARDILIDPIRVVQGDIGEANEDVTQIVEILHSGPSKWNWLTRRLVEFTSSGSVLLFVTKKANAEELANNLKQEGHNLGLLHGDMDQSERNKVISDFKKKDIPVLVATDVAARGLDIPSIKTVINYDVARDIDTHTHRIGRTGRAGEKGVAYTLLTPKDSNFAGDLVRNLEGANQHVSKELLDLAMQNAWFRKSRFKGGKGKKLNIGGGGLGYRERPGLGSENMDRGNNNVMSNYEAYKPSTGAMGDRLTAMKAAFQSQYKSHFVAASLSNQKAGSSAAGASGWTSAGSLNSVPTNSAQQGHNSPDSPVTSAAKGIPGFGNTGNISGAPVTYPSAGAQGVNNTASGNNSREGTGGSNGKRERYTENRGSSRHSHGETGNRHSDSPRHGDGGRHGDGYRHPESSSRHTDGHRHGENRHGGSAGRHGENRGANDGRNGESRKEAFNRESKMEPKMEPKVDSSKMDKVDSKTDKTADGFAVPEPPKRKKSRWDS

SEQ ID NO: 888569 - protein, 938 aa, Homo sapiens; identical to SEQ ID NO: 888567

SEQ ID NO: 888570 - protein, 674 aa, Homo sapiens
MHQIRKSEYTQPTPIQCQGVPVALSGRDMIGIAKTGSGKTAAFIWPMLIHIMDQKELEPGDGPIAVIVCPTRELCQQIHAECKRFGKAYNLRSVAVYGGGSMWEQAKALQEGAEIVVCTPGRLIDHVKKKATNLQRVSYLVFDEADRMFDMGFEYQVRSIASHVRPDRQTLLFSATFRKKIEKLARDILIDPIRVVQGDIGEANEDVTQIVEILHSGPSKWNWLTRRLVEFTSSGSVLLFVTKKANAEELANNLKQEGHNLGLLHGDMDQSERNKVISDFKKKDIPVLVATDVAARGLDIPSIKTVINYDVARDIDTHTHRIGRTGRAGEKGVAYTLLTPKDSNFAGDLVRNLEGANQHVSKELLDLAMQNAWFRKSRFKGGKGKKLNIGGGGLGYRERPGLGSENMDRGNNNVMSNYEAYKPSTGAMGDRLTAMKAAFQSQYKSHFVAASLSNQKAGSSAAGASGWTSAGSLNSVPTNSAQQGHNSPDSPVTSAAKGIPGFGNTGNISGAPVTYPSAGAQGVNNTASGNNSREGTGGSNGKRERYTENRGSSRHSHGETGNRHSDSPRHGDGGRHGDGYRHPESSSRHTDGHRHGENRHGGSAGRHGENRGANDGRNGESRKEAFNRESKMEPKMEPKVDSSKMDKVDSKTDKTADGFAVPEPPKRKKSRWDS

SEQ ID NO: 888571 - protein, 947 aa, Homo sapiens
MNWNKGGPGTKRGFGFGGFAISAGKKEEPKLPQQSHSAFGATSSSSGFGKSAPPQLPSFYKIGSKRANFDEENAYFEDEEEDSSNVDLPYIPAENSPTRQQFHSKPVDSDSDDDPLEAFMAEVEDQAARDMKRLEEKDKERKNVKGIRDDIEEEDDQEAYFRYMAENPTAGVVQEEEEDNLEYDSDGNPIAPTKKIIDPLPPIDHSETNFEELDLQIDYPPFEKNFYNEHEEITNLTPQQLIDLRHKLNLRVSGAAPPRPGSSFAHFGFDEQLMHQIRKSEYTQPTPIQCQGVPVALSGRDMIGIAKTGSGKTAAFIWPMLIHIMDQKELEPGDGPIAVIVCPTRELCQQIHAECKRFGKAYNLRSVAVYGGGSMWEQAKALQEGAEIVVCTPGRLIDHVKKKATNLQRVSYLVFDEADRMFDMGFEYQVRSIASHVRPDRQTLLFSATFRKKIEKLARDILIDPIRVVQGDIGEANEDVTQIVEILHSGPSKWNWLTRRLVEFTSSGSVLLFVTKKANAEELANNLKQEGHNLGLLHGDMDQSERNKVISDFKKKDIPVLVATDVAARGLDIPSIKTVINYDVARDIDTHTHRIGRTGRAGEKGVAYTLLTPKDSNFAGDLVRNLEGANQHVSKELLDLAMQNAWFRKSRFKGGKGKKLNIGGGGLGYRERPGLGSENMDRGNNNVMSNYEAYKPSTGAMGDRLTAMKAAFQSQYKSHFVAASLSNQKAGSSAAGASGWTSAGSLNSVPTNSAQQGHNSPDSPVTSAAKGIPGFGNTGNISGAPVTYPSAGAQGVNNTASGNNSREGTGGSNGKRERYTENRGSSRHSHGETGNRHSDSPRHGDGGRHGDGYRHPESSSRHTDGHRHGENRHGGSAGRHGENRGANDGRNGESRKEAFNRESKMEPKMEPKVDSSKMDKVDSKTDKTADGFAVPEPPKRKKSRWDS

SEQ ID NO: 888572 - protein, 484 aa, Homo sapiens [sequence omitted]

SEQ ID NO: 888573 - protein, 486 aa, Homo sapiens
MNWNKGGPGTKRGFGFGGFAISAGKKEEPKLPQQSHSAFGATSSSSGFGKSAPPQLPSFYKIGSKRANFDEENAYFEDEEEDSSNVDLPYIPAENSPTRQQFHSKPVDSDSDDDPLEAFMAEVEDQAARDMKRLEEKDKERKNVKGIRDDIEEEDDQEAYFRYMAENPTAGVVQEEEEDNLEYDSDGNPIAPTKKIIDPLPPIDHSEIDYPPFEKNFYNEHEEITNLTPQQLIDLRHKLNLRVSGAAPPRPGSSFAHFGFDEQLMHQIRKSEYTQPTPIQCQGVPVALSGRDMIGIAKTGSGKTAAFIWPMLIHIMDQKELEPGDGPIAVIVCPTRELCQQIHAECKRFGKAYNLRSVAVYGGGSMWEQAKALQEGAEIVVCTPGRLIDHVKRKLPSVKKANNFLWPPIVCSRAWMSEKEPQKQDRVRIRFRLIKFRLNKKKGALEFRRPVLPFERAKEYTTRVQVQNMALHTLGMPPIQIRMQVK

SEQ ID NO: 888574 - protein, 775 aa, Homo sapiens
MAENPTAGVVQEEEEDNLEYDSDGNPIAPTKKIIDPLPPIDHSEIDYPPFEKNFYNEHEEITNLTPQQLIDLRHKLNLRVSGAAPPRPGSSFAHFGFDEQLMHQIRKSEYTQPTPIQCQGVPVALSGRDMIGIAKTGSGKTAAFIWPMLIHIMDQKELEPGDGPIAVIVCPTRELCQQIHAECKRFGKAYNLRSVAVYGGGSMWEQAKALQEGAEIVVCTPGRLIDHVKKKATNLQRVSYLVFDEADRMFDMGFEYQVRSIASHVRPDRQTLLFSATFRKKIEKLARDILIDPIRVVQGDIGEANEDVTQIVEILHSGPSKWNWLTRRLVEFTSSGSVLLFVTKKANAEELANNLKQEGHNLGLLHGDMDQSERNKVISDFKKKDIPVLVATDVAARGLDIPSIKTVINYDVARDIDTHTHRIGRTGRAGEKGVAYTLLTPKDSNFAGDLVRNLEGANQHVSKELLDLAMQNAWFRKSRFKGGKGKKLNIGGGGLGYRERPGLGSENMDRGNNNVMSNYEAYKPSTGAMGDRLTAMKAAFQSQYKSHFVAASLSNQKAGSSAAGASGWTSAGSLNSVPTNSAQQGHNSPDSPVTSAAKGIPGFGNTGNISGAPVTYPSAGAQGVNNTASGNNSREGTGGSNGKRERYTENRGSSRHSHGETGNRHSDSPRHGDGGRHGDGYRHPESSSRHTDGHRHGENRHGGSAGRHGENRGANDGRNGESRKEAFNRESKMEPKMEPKVDSSKMDKVDSKTDKTADGFAVPEPPKRKKSRWDS

SEQ ID NO: 888575 - protein, 938 aa, Homo sapiens; identical to SEQ ID NO: 888567

SEQ ID NO: 888576 - protein, 402 aa, Homo sapiens
MYEARVNLAEEDIPVLVATDVAARGLDIPSIKTVINYDVARDIDTHTHRIGRTGRAGEKGVAYTLLTPKDSNFAGDLVRNLEGANQHVSKELLDLAMQNAWFRKSRFKGGKGKKLNIGGGGLGYRERPGLGSENMDRGNNNVMSNYEAYKPSTGAMGDRLTAMKAAFQSQYKSHFVAASLSNQKAGSSAAGASGWTSAGSLNSVPTNSAQQGHNSPDSPVTSAAKGIPGFGNTGNISGAPVTYPSAGAQGVNNTASGNNSREGTGGSNGKRERYTENRGSSRHSHGETGNRHSDSPRHGDGGRHGDGYRHPESSSRHTDGHRHGENRHGGSAGRHGENRGANDGRNGESRKEAFNRESKMEPKMEPKVDSSKMDKVDSKTDKTADGFAVPEPPKRKKSRWDS

SEQ ID NO: 888577 - protein, 565 aa, Homo sapiens
GDESFQSAEGPTAAGRVAGGAPRAGPPWSEVAVSPSRGPGPAPRMGEVEAPGRLWLESPPGGAPPIFLPSDGQALVLGRGPLTQVTDRKCSRTQVELVADPETRTVAVKQLGVNPSTTGTQELKPGLEGSLGVGDTLYLVNGLHPLTLRWEETRTPESQPDTPPGTPLVSQDEKRDAELPKKRMRKSNPGWENLEKLLVFTAAGVKPQGKVAGFDLDGTLITTRSGKVFPTGPSDWRILYPEIPRKLRELEAEGYKLVIFTNQMSIGRGKLPAEEFKAKVEAVVEKLGVPFQVLVATHAGLYRKPVTGMWDHLQEQANDGTPISIGDSIFVGDAAGRPANWAPGRKKKDFSCADRLFALNLGLPFATPEEFFLKWPAAGFELPAFDPRTVSRSGPLCLPESRALLSASPEVVVAVGFPGAGKSTFLKKHLVSAGYVHVNRDTLGSWQRCVTTCETALKQGKRVAIDNTNPDAASRARYVQCARAAGVPCRCFLFTATLEQARHNNRFREMTDSSHIPVSDMVMYGYRKQFEAPTLAEGFSAILEIPFRLWVEPRLGRLYCQFSEG

SEQ ID NO: 888578 - protein, 595 aa, Homo sapiens
MDGNRPSPGPISSHIFCQGGNQFCREKYLPVPCKDQCQAILVPLSGYCMSRSQSHVEINCLLLPGCYSLKQATLPRNEGPNHTRMQILTPPLQSSVELVADPETRTVAVKQLGVNPSTTGTQELKPGLEGSLGVGDTLYLVNGLHPLTLRWEETRTPESQPDTPPGTPLVSQDEKRDAELPKKRMRKSNPGWENLEKLLVFTAAGVKPQGKVAGFDLDGTLITTRSGKVFPTGPSDWRYKRQNKGVSEAWSPPLAPGHPCRFIPAVRILYPEIPRKLRELEAEGYKLVIFTNQMSIGRGKLPAEEFKAKVEAVVEKLGVPFQVLVATHAGLYRKPVTGMWDHLQEQANDGTPISIGDSIFVGDAAGRPANWAPGRKKKDFSCADRLFALNLGLPFATPEEFFLKWPAAGFELPAFDPRTVSRSGPLCLPESRALLSASPEVVVAVGFPGAGKSTFLKKHLVSAGYVHVNRDTLGSWQRCVTTCETALKQGKRVAIDNTNPDAASRARYVQCARAAGVPCRCFLFTATLEQARHNNRFREMTDSSHIPVSDMVMYGYRKQFEAPTLAEGFSAILEIPFRLWVEPRLGRLYCQFSEG

SEQ ID NO: 888579 - protein, 550 aa, Homo sapiens
MWEEAGLPAANWGCAPLKPVYLLPRPAPRMGEVEAPGRLWLESPPGGAPPIFLPSDGQALVLGRGPLTQVTDRKCSRTQVELVADPETRTVAVKQLGVNPSTTGTQELKPGLEGSLGVGDTLYLVNGLHPLTLRWEETRTPESQPDTPPGTPLVSQDEKRDAELPKKRMRKSNPGWENLEKLLVFTAAGVKPQGKVAGFDLDGTLITTRSGKVFPTGPSDWRILYPEIPRKLRELEAEGYKLVIFTNQMSIGRGKLPAEEFKAKVEAVVEKLGVPFQVLVATHAGLYRKPVTGMWDHLQEQANDGTPISIGDSIFVGDAAGRPANWAPGRKKKDFSCADRLFALNLGLPFATPEEFFLKWPAAGFELPAFDPRTVSRSGPLCLPESRALLSASPEVVVAVGFPGAGKSTFLKKHLVSAGYVHVNRDTLGSWQRCVTTCETALKQGKRVAIDNTNPDAASRARYVQCARAAGVPCRCFLFTATLEQARHNNRFREMTDSSHIPVSDMVMYGYRKQFEAPTLAEGFSAILEIPFRLWVEPRLGRLYCQFSEG

SEQ ID NO: 888580 - protein, 521 aa, Homo sapiens
MGEVEAPGRLWLESPPGGAPPIFLPSDGQALVLGRGPLTQVTDRKCSRTQVELVADPETRTVAVKQLGVNPSTTGTQELKPGLEGSLGVGDTLYLVNGLHPLTLRWEETRTPESQPDTPPGTPLVSQDEKRDAELPKKRMRKSNPGWENLEKLLVFTAAGVKPQGKVAGFDLDGTLITTRSGKVFPTGPSDWRILYPEIPRKLRELEAEGYKLVIFTNQMSIGRGKLPAEEFKAKVEAVVEKLGVPFQVLVATHAGLYRKPVTGMWDHLQEQANDGTPISIGDSIFVGDAAGRPANWAPGRKKKDFSCADRLFALNLGLPFATPEEFFLKWPAAGFELPAFDPRTVSRSGPLCLPESRALLSASPEVVVAVGFPGAGKSTFLKKHLVSAGYVHVNRDTLGSWQRCVTTCETALKQGKRVAIDNTNPDAASRARYVQCARAAGVPCRCFLFTATLEQARHNNRFREMTDSSHIPVSDMVMYGYRKQFEAPTLAEGFSAILEIPFRLWVEPRLGRLYCQFSEG

SEQ ID NO: 888581 - protein, 574 aa, Homo sapiens
GDESFQSAEGPTAAGRVAGGAPRAGPPWSEVAVSPSRGPGPAPRMGEVEAPGRLWLESPPGGAPPIFLPSDGQALVLGRGPLTQVTDRKCSRTQVELVADPETRTVAVKQLGVNPSTTGTQELKPGLEGSLGVGDTLYLVNGLHPLTLRWEETRTPESQPDTPPGTPLVSQDEKRDAELPKKRMRKSNPGWENLEKLLVFTAAGVKPQGKVAGFDLDGTLITTRSGKVFPTGPSDWRILYPEIPRKLRELEAEGYKLVIFTNQMSIGRGKLPAEEFKAKVEAVVEKLGVPFQVLVATHAGLYRKPVTGMWDHLQEQANDGTPISIGDSIFVGDAAGRPANWAPGRKKKDFSCADRLFALNLGLPFATPEEFFLKWPAAGFELPAFDPRTVSRSGPLCLPESRALLSASPEVVVAVGFPGAGKSTFLKKHLVSAGYVHVNRDTLGSWQRCVTTCETALKQGKRVAIDNTNPDAASRARYVQCARAAGVPCRCFLFTATLEQARHNNRVSPLSPDTPRAAPPDPPPPLTPGPAAPLMFPTVSRDDGLLSYPRVRHGHVWLQVLLGIAGGRGTGWAT

SEQ ID NO: 888582 - protein, 568 aa, Homo sapiens
GDESFQSAEGPTAAGRVAGGAPRAGPPWSEVAVSPSRGPGPAPRMGEVEAPGRLWLESPPGGAPPIFLPSDGQALVLGRGPLTQVTDRKCSRTQVELVADPETRTVAVKQLGVNPSTTGTQELKPGLEGSLGVGDTLYLVNGLHPLTLRWEETRTPESQPDTPPGTPLVSQDEKRDAELPKKRMRKSNPGWENLEKLLVFTAAGVKPQGKVAGFDLDGTLITTRSGKVFPTGPSDWRILYPEIPRKLRELEAEGYKLVIFTNQMSIGRGKLPAEEFKAKVEAVVEKLGVPFQVLVATHAGLYRKPVTGMWDHLQEQANDGTPISIGDSIFVGDAAGRPANWAPGRKKKDFSCADRLFALNLGLPFATPEEFFLKWPAAGFELPAFDPRTVSRSGPLCLPESRALLSASPEVVVAVGFPGAGKSTFLKKHLVSAGYVHVNRDTLGSWQRCVTTCETALKQGKRVAIDNTNPDAASRARYVQCARAAGVPCRCFLFTATLEQARHNNRVSPLSPDTPRAAPPDPPPPLTPGPAAPLMFPTVSRDDGLLSYPRVRHGHVWLQEAVRGPNAG

SEQ ID NO: 888583 - protein, 531 aa, Homo sapiens
GDESFQSAEGPTAAGRVAGGAPRAGPPWSEVAVSPSRGPGPAPRMGEVEAPGRLWLESPPGGAPPIFLPSDGQALVLGRGPLTQVTDRKCSRTQVELVADPETRTVAVKQLGVNPSTTGTQELKPGLEGSLGVGDTLYLVNGLHPLTLRWEETRTPESQPDTPPGTPLVSQDEKRDAELPKKRMRKSNPGWENLEKLLVFTAAGVKPQGKVAGFDLDGTLITTRSGKVFPTGPSDWRILYPEIPRKLRELEAEGYKLVIFTNQMSIGRGKLPAEEFKAKVEAVVEKLGVPFQVLVATHAGLYRKPVTGMWDHLQEQANDGTPISIGDSIFVGDAAGRPANWAPGRKKKDFSCADRLFALNLGLPFATPEEFFLKWPAAGFELPAFDPRTVSRSGPLCLPESRALLSASPEVVVAVGFPGAGKSTFLKKHLVSAGYVHVNRDTLGSWQRCVTTCETALKQGKRVAIDNTNPDAASRARYVQCARAAGVPCRCFLFTATLEQARHNNRFREMTDSSHIPVSDMVMYGYRYCWG

SEQ ID NO: 888584 - protein, 443 aa, Homo sapiens
GDESFQSAEGPTAAGRVAGGAPRAGPPWSEVAVSPSRGPGPAPRMGEVEAPGRLWLESPPGGAPPIFLPSDGQALVLGRGPLTQVTDRKCSRTQVELVADPETRTVAVKQLGVNPSTTGTQELKPGLEGSLGVGDTLYLVNGLHPLTLRWEETRTPESQPDTPPGTPLVSQDEKRDAELPKKRMRKSNPGWENLEKLLVFTAAGVKPQGKVAGFDLDGTLITTRSGKVFPTGPSDWRILYPEIPRKLRELEAEGYKLVIFTNQMSIGRGKLPAEEFKAKVEAVVEKLGVPFQVLVATHAGLYRKPVTGMWDHLQEQANDGTPISIGDSIFVGDAAGRPANWAPGRKKKDFSCADRLFALNLGLPFATPEEFFLKWPAAGFELPAFDPRTVSRSGPLCLPESRALLSASPEVVVAVGFPGAGKFTFLKKHHEKDGNIHVKQGTR

SEQ ID NO: 888585 - protein, 433 aa, Homo sapiens
MSVRLYLVNGLHPLTLRWEETRTPESQPDTPPGTPLVSQDEKRDAELPKKRMRKSNPGWENLEKLLVFTAAGVKPQGKVAGFDLDGTLITTRSGKVFPTGPSDWRILYPEIPRKLRELEAEGYKLVIFTNQMSIGRGKLPAEEFKAKVEAVVEKLGVPFQVLVATHAGLYRKPVTGMWDHLQEQANDGTPISIGDSIFVGDAAGRPANWAPGRKKKDFSCADRLFALNLGLPFATPEEFFLKWPAAGFELPAFDPRTVSRSGPLCLPESRALLSASPEVVVAVGFPGAGKSTFLKKHLVSAGYVHVNRDTLGSWQRCVTTCETALKQGKRVAIDNTNPDAASRARYVQCARAAGVPCRCFLFTATLEQARHNNRFREMTDSSHIPVSDMVMYGYRKQFEAPTLAEGFSAILEIPFRLWVEPRLGRLYCQFSEG

SEQ ID NO: 888586 - protein, 345 aa, Homo sapiens
DLTDVITKVWKFSPAPVTGGYQEIPRKSESWKRGYKLVIFTNQMSIGRGKLPAEEFKAKVEAVVEKLGVPFQVLVATHAGLYRKPVTGMWDHLQEQANDGTPISIGDSIFVGDAAGRPANWAPGRKKKDFSCADRLFALNLGLPFATPEEFFLKWPAAGFELPAFDPRTVSRSGPLCLPESRALLSASPEVVVAVGFPGAGKSTFLKKHLVSAGYVHVNRDTLGSWQRCVTTCETALKQGKRVAIDNTNPDAASRARYVQCARAAGVPCRCFLFTATLEQARHNNRFREMTDSSHIPVSDMVMYGYRKQFEAPTLAEGFSAILEIPFRLWVEPRLGRLYCQFSEG

SEQ ID NO: 888587 - protein, 499 aa, Homo sapiens
GDESFQSAEGPTAAGRVAGGAPRAGPPWSEVAVSPSRGPGPAPRMGEVEAPGRLWLESPPGGAPPIFLPSDGQALVLGRGPLTQVTDRKCSRTQVELVADPETRTVAVKQLGVNPSTTGTQELKPGLEGSLGVGDTLYLVNGLHPLTLRWEETRTPESQPDTPPGTPLVSQDEKRDAELPKKRMRKSNPGWENLEKLLVFTAAGVKPQGKVAGFDLDGTLITTRSGKVFPTGPSDWRILYPEIPRKLRELEAEGYKLVIFTNQMSIGRGKLPAEEFKAKVEAVVEKLGVPFQVLVATHAGLYRKPVTGMWDHLQEQANDGTPISIGDSIFVGDAAGRPANWAPGRKKKDFSCADRLFALNLGLPFATPEEFFLKWPAAGFELPAFDPRTVSRSGPLCLPESRALLSASPEVVVAVGFPGAGKSTFLKKHLVSAGYVHVNRVRPVCPSRGRPLPLLPLHRHSGAGAPQQPVSRDDGLLSYPRVRHGHVWLQEAVRGPNAG

SEQ ID NO: 888588 - protein, 592 aa, Homo sapiens
GRVISIGRGTDRRRPGCRRGTSGRTSLVGSGREPKPRSRAGTQDGRGGGPGPLVAREPPWGSAPHLPALGRASPGPGQGTPDPGYGPEVLQNSSLKQATLPRNEGPNHTRMQILTPPLQSSVELVADPETRTVAVKQLGVNPSTTGTQELKPGLEGSLGVGDTLYLVNGLHPLTLRWEETRTPESQPDTPPGTPLVSQDEKRDAELPKKRMRKSNPGWENLEKLLVFTAAGVKPQGKVAGFDLDGTLITTRSGKVFPTGPSDWRILYPEIPRKLRELEAEGYKLVIFTNQMSIGRGKLPAEEFKAKVEAVVEKLGVPFQVLVATHAGLYRKPVTGMWDHLQEQANDGTPISIGDSIFVGDAAGRPANWAPGRKKKDFSCADRLFALNLGLPFATPEEFFLKWPAAGFELPAFDPRTVSRSGPLCLPESRALLSASPEVVVAVGFPGAGKSTFLKKHLVSAGYVHVNRDTLGSWQRCVTTCETALKQGKRVAIDNTNPDAASRARYVQCARAAGVPCRCFLFTATLEQARHNNRFREMTDSSHIPVSDMVMYGYRKQFEAPTLAEGFSAILEIPFRLWVEPRLGRLYCQFSEG

SEQ ID NO: 888589 - protein, 477 aa, Homo sapiens
GDESFQSAEGPTAAGRVAGGAPRAGPPWSEVAVSPSRGPGPAPRMGEVEAPGRLWLESPPGGAPPIFLPSDGQALVLGRGPLTQVTDRKCSRTQVELVADPETRTVAVKQLGVNPSTTGTQELKPGLEGSLGVGDTLYLVNGLHPLTLRWEETRTPESQPDTPPGTPLVSQDEKRDAELPKKRMRKSNPGWENLEKLLVFTAAGVKPQGKVAGFDLDGTLITTRSGKVFPTGPSDWRILYPEIPRKLRELEAEGYKLVIFTNQMSIGRGKLPAEEFKAKVEAVVEKLGVPFQVLVATHAGLYRKPVTGMWDHLQEQANDGTPISIGDSIFVGDAAGRPANWAPGRKKKDFSCADRLFALNLGLPFATPEEFFLKWPAAGFELPAFDPRTVSRSGPLCLPESRALLSASPEVVVAVGFPGAGKSTFLKKHLVSAGYVHVNRDTLGSWQRCVTTCETALKQGKRVAIDNTNPDAASRAR

SEQ ID NO: 888590 - protein, 441 aa, Homo sapiens
GDESFQSAEGPTAAGRVAGGAPRAGPPWSEVAVSPSRGPGPAPRMGEVEAPGRLWLESPPGGAPPIFLPSDGQALVLGRGPLTQVTDRKCSRTQVELVADPETRTVAVKQLGVNPSTTGTQELKPGLEGSLGVGDTLYLVNGLHPLTLRWEETRTPESQPDTPPGTPLVSQDEKRDAELPKKRMRKSNPGWENLEKLLVFTAAGVKPQGKVAGFDLDGTLITTRSGKVFPTGPSDWRILYPEIPRKLRELEAEGYKLVIFTNQMSIGRGKLPAEEFKAKVEAVVEKLGVPFQVLVATHAGLYRKPVTGMWDHLQEQANDGTPISIGDSIFVGDAAGRPANWAPGRKKKDFSCADRLFALNLGLPFATPEEFFLKWPAAGFELPAFDPRTVSRSGPLCLPESRALLSASPEVVVAVGFPGAGKSTFLKKHLVSAGYVHVNRV

SEQ ID NO: 888591 - protein, 382 aa, Homo sapiens [sequence omitted]

SEQ ID NO: 888592 - protein, 334 aa, Homo sapiens
MAAAAPRRPTQQGTVTFEDVAVNFSQEEWCLLSEAQRCLYRDVMLENLALISSLGCWCGSKDEEAPCKQRISVQRESQSRTPRAGVSPKKAHPCEMCGLILEDVFHFADHQETHHKQKLNRSGACGKNLDDTAYLHQHQKQHIGEKFYRKSVREASFVKKRKLRVSQEPFVFREFGKDVLPSSGLCQEAAAVEKTDSETMHGPPFQEGKTNYSCGKRTKAFSTKHSVIPHQKLFTRDGCYVCSDCGKSFSRYVSFSNHQRDHTAKGPYDCGECGKSYSRKSSLIQHQRVHTGKTAYPCEECGKSFSQKGSLISHQRVHTGERPYECRECGKKVT

SEQ ID NO: 888593 - protein, 71 aa, Homo sapiens
VSVTRVFPQFVAPECWGGTAVTEPEKVERNRPRCPEAALQPRDGDHCSRAVLPQVVRWQRLRRGARLSRAL

SEQ ID NO: 888594 - protein, 114 aa, Homo sapiens
AVVQSWLTATWASQVQVILLPQPPKELRLRVHHTMPGQILGFQYHKSYELVIHFMWNHKCPQVTIRIDCWAVKQLRCHRSLLSIQHLSKITLLFLLFQVCISSEFSHMERIHTL

SEQ ID NO: 888595 - protein, 456 aa, Homo sapiens
MAAAAPRRPTQQGTVTFEDVAVNFSQEEWCLLSEAQRCLYRDVMLENLALISSLGCWCGSKDEEAPCKQRISVQRESQSRTPRAGVSPKKAHPCEMCGLILEDVFHFADHQETHHKQKLNRSGACGKNLDDTAYLHQHQKQHIGEKFYRKSVREASFVKKRKLRVSQEPFVFREFGKDVLPSSGLCQEAAAVEKTDSETMHGPPFQEGKTNYSCGKRTKAFSTKHSVIPHQKLFTRDGCYVCSDCGKSFSRYVSFSNHQRDHTAKGPYDCGECGKSYSRKSSLIQHQRVHTGKTAYPCEECGKSFSQKGSLISHQLFTLEKGLMSVENMGNLLVKRVTSFNISKVTLERELITVGNVGNLFVRSSALLTISVFTLEKGLTSVENVENLLVKRATSFNISEVILEKGPMSARNVGNHLGTDPTSLNTRDFTLGKDLTIVGNVGNYLTGSIIFSFMRE

SEQ ID NO: 888596 - protein, 175 aa, Homo sapiens
GECGKSFGQKGNLVQHQRGHTGERPYECKECGKSFRYRSHLTEHQRLHTGERPYNCRECGKLFNRKYHLLVHERVHTGERPYACEVCGKLFGNKNCVTIHQRIHTGERPYECNECGKSFLSSSALHVHKRVHSGQKPYKCSECGKSFAECSSLIKHRRIHTGERPYECTKCGKTF

SEQ ID NO: 888597 - protein, 132 aa, Homo sapiens
MGRTWCGMWRRRRPGRRSAVPRWPHLSSQSGVEPPDRWTGTPGWPSRDQEAPGSMMPPAAAQPSAHGALVPPATAHEPVDHPALHWLACCCCLSLPGQLPLAIRLGWDLDLEAGPSSGKLCPRARRWQPLPS

SEQ ID NO: 888598 - protein, 123 aa, Homo sapiens
VDVCACICVYPPGTSFFLSPSCEFLGPRCARSLYNVLTHQEAPGSMMPPAAAQPSAHGALVPPATAHEPVDHPALHWLACCCCLSLPGQLPLAIRLGWDLDLEAGPSSGKLCPRARRWQPLPS

SEQ ID NO: 888599 - protein, 105 aa, Homo sapiens
SPSCEFLGPRCARSLYNVLTHQEAPGSMMPPAAAQPSAHGALVPPATAHEPVDHPALHWLACCCCLSLPGQLPLAIRLGWDLDLEAGPSSGKLCPRARRWQPLPS

SEQ ID NO: 888600 - protein, 155 aa, Homo sapiens
MSCDSLSFEKVVGFNAFVGGTHGYFVAEPSWGHRGGLGPRSHSRGASRGRLCKPRICNYTEPCNYVWVGAALRPQYRQGFRGPLGQGGPEEGENVPGESIIQGPLRALPGVLTGGSARPSVLELLLLHLVRTSSRGRGPQDLQAWQPQRGCGKRA

SEQ ID NO: 888601 - protein, 67 aa, Homo sapiens
MLPDGVEKLGDWDKQKAANNPEAHPQKTGEMIEECMGTVALCSITNTSQKQRGMKKQDSSYSMMPFL

SEQ ID NO: 888602 - protein, 294 aa, Homo sapiens [sequence omitted]

SEQ ID NO: 888603 - protein, 382 aa, Homo sapiens
MDFGLALLLAGLLGLLLGQSLQVKPLQVEPPEPVVAVALGASRQLTCRLACADRGASVQWRGLDTSLGAVQSDTGRSVLTVRNASLSAAGTRVCVGSCGGRTFQHTVQLLVYAFPDQLTVSPAALVPGDPEVACTAHKVTPVDPNALSFSLLVGGQELEGAQALGPEVQEEEEEPQGDEDVLFRVTERWRLPPLGTPVPPALYCQATMRLPGLELSHRQAIPVLHSPTSPEPPDTTSPESPDTTSPESPDTTSQEPPDTTSPEPPDKTSPEPAPQQGSTHTPRSPGSTRTRRPEISQAGPTQGEVIPTGSSKPAGDQLPAALWTSSAVLGLLLLALPTYHLWKRCRHLAEDDTHPPASLRLLPQVSAWAGLRGTGQVGISPS

SEQ ID NO: 888604 - protein, 653 aa, Homo sapiens
MAAAAASHLNLDALREVLECPICMESFTEEQLRPKLLHCGHTICRQCLEKLLASSINGVRCPFCSKITRITSLTQLTDNLTVLKIIDTAGLSEAVGLLMCRSCGRRLPRQFCRSCGLVLCEPCREADHQPPGHCTLPVKEAAEERRRDFGEKLTRLRELMGELQRRKAALEGVSKDLQARYKAVLQEYGHEERRVQDELARSRKFFTGSLAEVEKSNSQVVEEQSYLLNIAEVQAVSRCDYFLAKIKQADVALLEETADEEEPELTASLPRELTLQDVELLKVGHVGPLQIGQAVKKPRTVNVEDSWAMEATASAASTSVTFREMDMSPEEVVASPRASPAKQRGPEAASNIQQCLFLKKMGAKGSTPGMFNLPVSLYVTSQGEVLVADRGNYRIQVFTRKGFLKEIRRSPSGIDSFVLSFLGADLPNLTPLSVAMNCQGLIGVTDSYDNSLKVYTLDGHCVACHRSQLSKPWGITALPSGQFVVTDVEGGKLWCFTVDRGSGVVKYSCLCSAVRPKFVTCDAEGTVYFTQGLGLNLENRQNEHHLEGGFSIGSVGPDGQLGRQISHFFSENEDFRCIAGMCVDARGDLIVADSSRKEILHFPKGGGYSVLIREGLTCPVGIALTPKGQLLVLDCWDHCIKIYSYHLRRYSTP

SEQ ID NO: 888605 - protein, 653 aa, Homo sapiens; identical to SEQ ID NO: 888604

SEQ ID NO: 888606 - protein, 653 aa, Homo sapiens; identical to SEQ ID NO: 888604

SEQ ID NO: 888607 - protein, 653 aa, Homo sapiens; identical to SEQ ID NO: 888604

SEQ ID NO: 888608 - protein, 653 aa, Homo sapiens; identical to SEQ ID NO: 888604

SEQ ID NO: 888609 - protein, 148 aa, Homo sapiens
TSIFIPAFESETKVRVNSNMRTEEVIKQLLQKFKIENSPQDFALHIIFATGEQRRLKKTDIPLLQRLLQGPSEKNARIFLMDKDAEEISSDVAQYINFHFSLLESILQRLNEEEKREIQRIVTKFNKEKAIILKCLQNKLVIKTETTV

SEQ ID NO: 888610 - protein, 524 aa, Homo sapiens
MKEPRIFPRERPTPWTRAPLPPRGRLDGSLGPQGGPVLNTGHPLGVNSDPFLMAAGSLGGNLTPFPRNPSPFPASSGSLASNPAPFPAGARDPSMASFPRGMNPTGTGAVSFPRPGGLLGPGPGPGPTLNPRTGALPGPGPLSNPRLGGLPGPGPMSNPRAGGLLGAGPDPRGGGPMGPGSGPNLRAGVLLTSGNGPPNPRPVGLGPGPNPNLRSGFLGTNPAPRSGVFPGPGLGPNPRPSGLGPGPNLDARAGGLLGTGSGLNLRMAGPQGLDLAPILRAAGLLGANSASFSQASGNMGTSPSSMARVPGPMGPNSGPSSRGIGLPGPNPSPMSRAPGPIGPNSAHFSRPVGPMGVNANPFPRGAGSSAFSQSSGTLASNPATFQRSAGLQGSNPTIFPRASGPLGPNPANFPRATGLQGPSPTTFPRSTGPLGPGQVTFPRPAAGHLGPSPAGPVGINPAPFTRPTGTLGLNPASFPRMNGPAGKSFVPFPRVGSLPGTNPAAFPRPGGPMAAMYPNGMLPP

SEQ ID NO: 888611 - protein, 524 aa, Homo sapiens; identical to SEQ ID NO: 888610

SEQ ID NO: 888612 - protein, 524 aa, Homo sapiens; identical to SEQ ID NO: 888610

SEQ ID NO: 888613 - protein, 524 aa, Homo sapiens; identical to SEQ ID NO: 888610

SEQ ID NO: 888614 - protein, 524 aa, Homo sapiens; identical to SEQ ID NO: 888610

SEQ ID NO: 888615 - protein, 524 aa, Homo sapiens; identical to SEQ ID NO: 888610

SEQ ID NO: 888616 - protein, 369 aa, Homo sapiens [sequence omitted]

SEQ ID NO: 888617 - protein, 167 aa, Homo sapiens
SEVRRQCSRRRRRRREVRLSPVGRAAPRSAAAIAACFHLLFKDRKLMVQIVISSARAGGLAEWVLMELQGEIEARYSTGLAGNLLGDLHYTTEGIPVLIVGHHILYGKIIHLEKPFAVLVKHTPGDQDCDELGRETGTRYLVTALIKDKILFKTRPKPIITSVPKKV

SEQ ID NO: 888618 - protein, 107 aa, Homo sapiens
MGSRVLEVLPGFLKSEHGKDSGGRLMAVPGAGSGTALPCFHLLFKDRKLMVQIVISSARAGGLAEWVLMELQGEIEARYSTGLAGNLLGDLHYTTEGYIGLQVPVHM

SEQ ID NO: 888619 - protein, 167 aa, Homo sapiens; identical to SEQ ID NO: 888617

SEQ ID NO: 888620 - protein, 167 aa, Homo sapiens; identical to SEQ ID NO: 888617

SEQ ID NO: 888621 - protein, 69 aa, Homo sapiens
KLWGLGYWRSCRVVLKSEHGKDSGGRLMAVPGAGSGTHCLVFTCFLKTESSWCKLLFPVRGLEAWQNGC

SEQ ID NO: 888622 - protein, 524 aa, Homo sapiens; identical to SEQ ID NO: 888610

SEQ ID NO: 888623 - protein, 524 aa, Homo sapiens; identical to SEQ ID NO: 888610

SEQ ID NO: 888624 - protein, 524 aa, Homo sapiens; identical to SEQ ID NO: 888610

SEQ ID NO: 888625 - protein, 524 aa, Homo sapiens; identical to SEQ ID NO: 888610

SEQ ID NO: 888626 - protein, 524 aa, Homo sapiens; identical to SEQ ID NO: 888610

SEQ ID NO: 888627 - protein, 524 aa, Homo sapiens; identical to SEQ ID NO: 888610

SEQ ID NO: 888628 - protein, 109 aa, Homo sapiens
SEVRRQCSRRRRRRREVRLSPVGRAAPRSAAAIAACFHLLFKDRKLMVQIVISSARAGGLAEWVLMELQGEIEARYSTGLAGNLLGDLHYTTEIRLIGFKSSTFPGWCS

SEQ ID NO: 888629 - protein, 133 aa, Homo sapiens
MGSRVLEVLPGFLKSEHGKDSGGRLMAVPGAGSGTALPCFHLLFKDRKLMVQIVISSARAGGLAEWVFRPTAFCPLFLTSFLNCSCGLFLSSSDLGSLDLVILYCHTFPWGLEHRTGRWTTTSKKDPPNAVSA

SEQ ID NO: 888630 - protein, 130 aa, Homo sapiens
ERGGAGEGRKGWPSAGGGRRRGRRGPESRACFHLLFKDRKLMVQIVISSARAGGLAEWVLMELQGEIEARYSTGLAGNLLGDLHYTTEGIPVLIVGHHILYGKIIHLEKPFAVLVKHTPGDQDCDELGQI

SEQ ID NO: 888631 - protein, 326 aa, Homo sapiens
MDYSHQTSLVPCGQDKYISKNELLLHLKTYNLYYEGQNLQLRHREEEDEFIVEGLLNISWGLRRPIRLQMQDDNERIRPPPSSSSWHSGCNLGAQGTTLKPLTVPKVQISEVDAPPEGDQMPSSTDSRGLKPLQEDTPQLMRTRSDVGVRRRGNVRTPSDQRRIRRHRFSINGHFYNHKTSVFTPAYGSVTNVRINSTMTTPQVLKLLLNKFKIENSAEEFALYVVHTSGEKQKLKATDYPLIARILQGPCEQISKVFLMEKDQVEEVTYDVAQYIKFEMPVLKSFIQKLQEEEDREVKKLMRKYTVLRLMIRQRLEEIAETPATI

SEQ ID NO: 888632 - protein, 326 aa, Homo sapiens; identical to SEQ ID NO: 888631

SEQ ID NO: 888633 - protein, 326 aa, Homo sapiens; identical to SEQ ID NO: 888631

SEQ ID NO: 888634 - protein, 157 aa, Homo sapiens
MSLNWNLTLQNEWPLLEFSKTTLKPLTVPKVQISEVDAPPEGDQMPSSTDSRGLKPLQEDTPQLMRTRSDVGVRRRGNVRTPSDQRRIRRHRFSINGHFYNHKTSVFTPAYGSVTNVRINSTMTTPQVLKLLLNKFKIENSAEEFALYVVHTSGGPM

SEQ ID NO: 888635 - protein, 326 aa, Homo sapiens; identical to SEQ ID NO: 888631

SEQ ID NO: 888636 - protein, 326 aa, Homo sapiens; identical to SEQ ID NO: 888631

SEQ ID NO: 888637 - protein, 91 aa, Homo sapiens
PGGAADHALFCAYSEGDWWEARSLSSGKTGCIPTYDVAQYIKFEMPVLKSFIQKLQEEEDREVKKLMRKYTVLRLMIRQRLEEIAETPATI

SEQ ID NO: 888638 - protein, 326 aa, Homo sapiens; identical to SEQ ID NO: 888631

SEQ ID NO: 888639 - protein, 326 aa, Homo sapiens; identical to SEQ ID NO: 888631

SEQ ID NO: 888640 - protein, 326 aa, Homo sapiens; identical to SEQ ID NO: 888631

SEQ ID NO: 888641 - protein, 702 aa, Homo sapiens [sequence omitted]

SEQ ID NO: 888642 - protein, 731 aa, Homo sapiens [sequence omitted]

SEQ ID NO: 888643 - protein, 731 aa, Homo sapiens [sequence omitted]

SEQ ID NO: 888644 - protein, 695 aa, Homo sapiens [sequence omitted]

SEQ ID NO: 888645 - protein, 743 aa, Homo sapiens
MASCPDSDNSWVLAGSESLPVETLGPASRMDPESERALQAPHSPSKTDGKELAGTMDGEGTLFQTESPQSGSILTEETEVKGTLEGDVCGVEPPGPGDTVVQGDLQETTVVTGLGPDTQDLEGQSPPQSLPSTPKAVTITALSLSFPLAWIREEGRCSSSDDDTDVDMEGLRRRRGREAGPPQPMVPLAVENQAGGEGAGGELGISLNMCLLGALVLLGLGVLLFSGEWYSEAGGPMEEVERQVLPDPEVLEAVGDRQDGLREQLQAPVPPDSVPSLQNMGLLLDKLAKENQDIRLLQAQLQAQKEELQSLMHQPKGLEEENAQLRGALQQGEAFQRALESELQQLRARLQGLEADCVRGPDGVCLSGDRGPQGDKAIREQGPREQEPELSFLKQKEQLEAEAQALRQELERQRRLLGSVQQDLERSLQDASRGDPAHAGLAELGHRLAQKLQGLENWGQDPGVSANASKAWHQKSHFQNSREWSGKEKWWDGQRDRKAEHWKHKKEESGRERKKNWGGQEDREPAGRWKEGRPRVEESGSKKEGKRQGPKEPPRKSGSFHSSGEKQKQPRWREGTKDSHDPLPSWAELLRPKYRAPQGCSGVDECARQEGLTFFGTELAPVRQQELASLLRTYLARLPWAGQLTKELPLSPAFFGEDGIFRHDRLRFRDFVDALEDSLEEVAVQQTGDDDEVDDFEDFIFSHFFGDKALKKRSGKKDKHSQSPRAAGPREGHSHSHHHHHRG

SEQ ID NO: 888646 - protein, 731 aa, Homo sapiens [sequence omitted]

SEQ ID NO: 888647 - protein, 171 aa, Homo sapiens
MTPTWTWRVCGDGGAGRPAHLSPWCPWLWRTRLGVRVQAGSWASPSTCASLGPWFCLAWGSSSSQVAISESETGPMEERGADRVLPEPEVLGRLWSGHAGCGYGNSCKAQIAPYQCAQDFNNHGSFMSGPRLGKEETRRLRLLPATSCQTQKRRSQKPYDQTHGLDGGNCQ

SEQ ID NO: 888648 - protein, 662 aa, Homo sapiens
MASCPDSDNSWVLAGSESLPVETLGPASRMDPESERALQAPHSPSKTDGKELAGTMDGEGTLFQTESPQSGSILTEETEVKGTLEGDVCGVEPPGPGDTVVQGDLQETTVVTGLGPDTQDLEGQSPPQSLPSTPKAAWIREEGRCSSSDDDTDVDMEGLRRRRGREAGPPQPMVPLAVENQAGGEGAGGELGISLNMCLLGALVLLGLGVLLFSGGLSESETGPMEEVERQVLPDPEVLEAVGDRQDGLREQLQAPVPPDSVPSLQNMGLLLDKLAKENQDIRLLQAQLQAQKEELQSLMHQPKGLEEENAQLRGALQQGEAFQRALESELQQLRARLQGLEADCVRGPDGVCLSGDRGPQGDKAIREQGPREQEPELSFLKQKEQLEAEAQALRQELERQRRLLGSVQQDLERSLQDASRGDPAHAGLAELGHRLAQKLQGLENWGQDPGVSANASKAWHQKSHFQNSREWSGKEKWWDGQRDRKAEHWKHKKEESGRERKKNWGGQEDREPAGRWKEGRPRVEESGSKKEGKRQGPKEPPRKSGSFHSSGEKQKQPRWREGTKELPLSPAFFGEDGIFRHDRLRFRDFVDALEDSLEEVAVQQTGDDDEVDDFEDFIFSHFFGDKALKKRSGKKDKHSQSPRAAGPREGHSHSHHHHHRG

SEQ ID NO: 888649 - protein, 731 aa, Homo sapiens [sequence omitted]

SEQ ID NO: 888650 - protein, 731 aa, Homo sapiens [sequence omitted]

SEQ ID NO: 888651 - protein, 731 aa, Homo sapiens [sequence omitted]

SEQ ID NO: 888652 - protein, 215 aa, Homo sapiens
MASCPDSDNSWVLAGSESLPVETLGPASRMDPESERALQAPHSPSKTDGKELAGTMDGEGTLFQTESPQSGSILTEETEVKGTLEGDVCGVEPPGPGDTVVQGDLQETTVVTGLGPDTQDLEGQSPPQSLPSTPKAAWIREEGRCSSSDDDTDVDMEGLRRRRGREAGPPQPMVPLAVENQAGGEGAGGELGISLNMCLLGALVLLGLGVLLFSG

SEQ ID NO: 888653 - protein, 110 aa, Homo sapiens
MQAALEVTARYCGRELEQYGQCVAAKPESWQRDCHYLKMSIAQCTSSHPIIRQIRQACAQPFEAFEECLRQNEAAVGNCAEHMRRFLQCAEQVQPPRSPATVEAQPLPAS

SEQ ID NO: 888654 - protein, 118 aa, Homo sapiens
MQAALEVTARYCGRELEQYGQCVAAKPESWQRDCHYLKMSIAQCTSSHPIIRQIRQACAQPFEAFEECLRQNEAAVGNCAEHMRRFLQCAEQVQPPRSPATVEAPLLPVCWCLLEVPS

SEQ ID NO: 888655 - protein, 145 aa, Homo sapiens
MARKKPGWAGRRHDNRYRKRRVVPPGQPYAGKGLEMQAALEVTARYCGRELEQYGQCVAAKPESWQRDCHYLKMSIAQCTSSHPIIRQIRQACAQPFEAFEECLRQNEAAVGNCAEHMRRFLQCAEQVQPPRSPATVEAQPLPAS

SEQ ID NO: 888656 - protein, 118 aa, Homo sapiens
DPQPILSHRQAALEVTARYCGRELEQYGQCVAAKPESWQRDCHYLKMSIAQCTSSHPIIRQIRQACAQPFEAFEECLRQNEAAVGNCAEHMRRFLQCAEQVQPPRSPATVEAQPLPAS

SEQ ID NO: 888657 - protein, 138 aa, Homo sapiens
MQAALEVTARYCGRELEQYGQCVAAKPESWQRDCHYLKMSIAQCTSSQWVRASMRQCGGGQWGGNLPGAELPYPHSPIIRQIRQACAQPFEAFEECLRQNEAAVGNCAEHMRRFLQCAEQVQPPRSPATVEAQPLPAS

SEQ ID NO: 888658 - protein, 110 aa, Homo sapiens; identical to SEQ ID NO: 888653

SEQ ID NO: 888659 - protein, 110 aa, Homo sapiens; identical to SEQ ID NO: 888653

SEQ ID NO: 888660 - protein, 111 aa, Homo sapiens
MSLSDPGLGYHPTCWTRRTHCLFPSRLGTLVSPRVAMDPNCSCAAAGVSCTCASSCKCKECKCTSCKKSCCSCCPVGCCQVCPGLHLQRGIGEVQLLRLMSGQPCSQVQIE

SEQ ID NO: 888661 - protein, 106 aa, Homo sapiens
SGRLLLLNSRPRRTHCLFPSRLGTLVSPRVAMDPNCSCAAAGVSCTCASSCKCKECKCTSCKKSCCSCCPVGCCQVCPGLHLQRGIGEVQLLRLMSGQPCSQVQIE

SEQ ID NO: 888662 - protein, 106 aa, Homo sapiens; identical to SEQ ID NO: 888661

SEQ ID NO: 888663 - protein, 90 aa, Homo sapiens
SGRLLLLNSRPRDVAMDPNCSCAAAGVSCTCASSCKCKECKCTSCKKSCCSCCPVGCCQVCPGLHLQRGIGEVQLLRLMSGQPCSQVQIE

SEQ ID NO: 888664 - protein, 111 aa, Homo sapiens; identical to SEQ ID NO: 888660

SEQ ID NO: 888665 - protein, 111 aa, Homo sapiens
MERTWGFSSSALSGKGALRAGSAQRRGKWTLIDPLLYLLHLTHRSLAFSLLAGVSCTCASSCKCKECKCTSCKKSECGAISRNLGLWLRLGGNPRLSLSACFWGTGLPLSL

SEQ ID NO: 888666 - protein, 111 aa, Homo sapiens; identical to SEQ ID NO: 888665

SEQ ID NO: 888667 - protein, 72 aa, Homo sapiens
RWLLGSTPPSSRTHCLFPSRLGTLVSPRVAMDPNCSCAAGKGRPGSVPWDAKFPDTIESVPGFEEVVFCYQR

SEQ ID NO: 888668 - protein, 366 aa, Homo sapiens
GADTKSGAERQLRGEPAAAAAAQGSGAPPARPAVRGQCPSSSSSSAAASSVAAASSVAAARAARALRAPLSPRRAAPAPSHAGGAGPGRGARSQPRSMHWGVGFASSRPCVVDLSWNQSISFFGWWAGSEEPFSFYGDIIAFPLQDYGGIMAGLGSDPWWKKTLYLTGGALLAAAAYLLHELLVIRKQQEIDSKDAIILHQFARPNNGVPSLSPFCLKMETYLRMADLPYQVMKKYIMGPKLSTLDATVFGHLAQAMWTLPGTRPERLIKGELINLAMYCERIRRKFWPEWHHDDDNTIYESEESSEGSKTHTPLLDFSFYSRTETFEDEGAENSFSRTPDTDFTGHSLFDSDVDMDDYTDHEQCK

SEQ ID NO: 888669 - protein, 376 aa, Homo sapiens
PRLVASPARSSAPPQDYGGIMAGLGSDPWWKKTLYLTGGALLAAAAYLLHELLVIRKQQEIDSKDAIILHQFARPNNGVPSLSPFCLKMETYLRMADLPYQNYFGGKLSAQGKMPWIEYNHEKVSGTEFIIDFLEEKLGVNLNKNLGPHERAISRAVTKMVEEHFYWTLAYCQWVDNLNETRKMLSLSGGGPFSNLLRWVVCHITKGIVKREMHGHGIGRFSEEEIYMLMEKDMRSLAGLLGDKKYIMGPKLSTLDATVFGHLAQAMWTLPGTRPERLIKGELINLAMYCERIRRKFWPEWHHDDDNTIYESEESSEGSKTHTPLLDFSFYSRTETFEDEGAENSFSRTPDTDFTGHSLFDSDVDMDDYTDHEQCK

SEQ ID NO: 888670 - protein, 336 aa, Homo sapiens
RRRPDRGDAGRGQGAGKQQEIDSKDAIILHQFARPNNGVPSLSPFCLKMETYLRMADLPYQNYFGGKLSAQGKMPWIEYNHEKVSGTEFIIDFLEEKLGVNLNKNLGPHERAISRAVTKMVEEHFYWTLAYCQWVDNLNETRKMLSLSGGGPFSNLLRWVVCHITKGIVKREMHGHGIGRFSEEEIYMLMEKDMRSLAGLLGDKKYIMGPKLSTLDATVFGHLAQAMWTLPGTRPERLIKGELINLAMYCERIRRKFWPEWHHDDDNTIYESEESSEGSKTHTPLLDFSFYSRTETFEDEGAENSFSRTPDTDFTGHSLFDSDVDMDDYTDHEQCK

SEQ ID NO: 888671 - protein, 88 aa, Homo sapiens
TLGVRISTLEFWGNTDHRSGRLLPLRTNPCFPYHTAGELINLAMYCERIRRKFWPEWHHDDDNTIYESEESSEGSKTHTPLLDFSFYS

SEQ ID NO: 888672 - protein, 506 aa, Homo sapiens
GADTKSGAERQLRGEPAAAAAAQGSGAPPARPAVRGQCPSSSSSSAAASSVAAASSVAAARAARALRAPLSPRRAAPAPSHAGGAGPGRGARSQPRSMHWGVGFASSRPCVVDLSWNQSISFFGWWAGSEEPFSFYGDIIAFPLQDYGGIMAGLGSDPWWKKTLYLTGGALLAAAAYLLHELLVIRKQQEIDSKDAIILHQFARPNNGVPSLSPFCLKMETYLRMADLPYQNYFGGKLSAQGKMPWIEYNHEKVSGTEFIIDFLEEKLGVNLNKNLGPHERAISRAVTKMVEEHFYWTLAYCQWVDNLNETRKMLSLSGGGPFSNLLRWVVCHITKGIVKREMHGHGIGRFSEEEIYMLMEKDMRSLAGLLGDKKYIMGPKLSTLDATVFGHLAQAMWTLPGTRPERLIKGELINLAMYCERIRRKFWPEWHHDDDNTIYESEESSEGSKTHTPLLDFSFYSRTETFEDEGAENSFSRTPDTDFTGHSLFDSDVDMDDYTDHEQCK

SEQ ID NO: 888673 - protein, 107 aa, Homo sapiens
MRTNEVNMNSTGELINLAMYCERIRRKFWPEWHHDDDNTIYESEESSEGSKTHTPLLDFSFYSRTETFEDEGAENSFSRTPDTDFTGHSLFDSDVDMDDYTDHEQCK

SEQ ID NO: 888674 - protein, 103 aa, Homo sapiens
MYVIFYKCELINLAMYCERIRRKFWPEWHHDDDNTIYESEESSEGSKTHTPLLDFSFYSRTETFEDEGAENSFSRTPDTDFTGHSLFDSDVDMDDYTDHEQCK

SEQ ID NO: 888675 - protein, 105 aa, Homo sapiens
GKGSGRKRIHGRTAKQQPPTRFVSLRRYRGLSGSGWHGVTGWAGAEVEAEGDGGVVRGALGSRGEALVGARQGEGEEEEPAARAAAALGFSVGPRLGAGGGGGGD

SEQ ID NO: 888676 - protein, 233 aa, Homo sapiens
MAASALYACTKCTQRYPFEELSQGQQLCKECRIAHPIVKCTYCRSEFQQESKTNTICKKCAQNVKQFGTPKPCQYCNIIAAFIGTKCQRCTNSEKKYGPPQTCEQCKQQCAFDRKEEGRRKVDGKLLCWLCTLSYKRVLQKTKEQRKSLGSSHSNSSSSSLTEKDQHHPKHHHHHHHHHHRHSSSHHKISNLSPEEEQGLWKQSHKSSATIQNETPKKKPKLESKPSNGDRCM

SEQ ID NO: 888677 - protein, 105 aa, Homo sapiens; identical to SEQ ID NO: 888675

SEQ ID NO: 888678 - protein, 67 aa, Homo sapiens
TEGRASSSKKRGRVVVSPVATEGSNGDKTKAKAKLKHSTSSLGLNAGESVNLPRGRLSRNVGLHILL

SEQ ID NO: 888679 - protein, 100 aa, Homo sapiens
RGSRPLGHLRPVNSANSNVLLIGRRKEEERLMESYYAGSVLYRTKEFYRRRKNKGRAWDLHIQIHLLHLLLRKTSIIQNIITTIITITIVTAVAITKSAI

SEQ ID NO: 888680 - protein, 105 aa, Homo sapiens; identical to SEQ ID NO: 888675

SEQ ID NO: 888681 - protein, 231 aa, Homo sapiens
MAASALYACTKCTQRYPFEELSQGQQLCKECRIAHPIVKCTYCRSEFQQESKTNTICKKCAQNVKQFGTPKPCQYCNIIAAFIGTKCQRCTNSEKKYGPPQTCEQCKQQCAFDRKEEGRRKVDGKLLCWLCTLSYKRVLQKTKEQRKSLGSSHSNSSSSSLTEKDQHHPKHHHHHHHHHHRHSSSHHKISNLSPEEEQGLWKQSHKSSATIQNETPKKKPKLESKPSNGDR

SEQ ID NO: 888682 - protein, 33 aa, Homo sapiens
MTHNLKWTSNPVQMTWHVELQRQLRLYAIQSTA

SEQ ID NO: 888683 - protein, 125 aa, Homo sapiens
SPPQTQSCAPRPQRQAVTLLLLPLAMSTSTSCPIPGGRDQLPDCYSTTPGGTLYATTPGGTRIIYDRKFLLECKNSPIARTPPCCLPQIPGVTTPPTAPLSKLEELKEQETEEEIPDDAQFEMDI

SEQ ID NO: 888684 - protein, 206 aa, Homo sapiens
MVRPVRHKKPVNYSQFDHSDSDDDFVSATVPLNKKSRTAPKELKQDKPKPNLNNLRKEEIPVQEKTPKKRMALDDKLYQRDLEVALALSVKELPTVTTNVQNSQDKSIEKHGSSKIETMNKSPHISNCSVASDYLDLDKITVEDDVGGVQGKRKAASKAAAQQRKILLEGSDGDSANDTEPDFAPGEDSEDDSDFVRVRIMTKTSL

SEQ ID NO: 888685 - protein, 206 aa, Homo sapiens; identical to SEQ ID NO: 888684

SEQ ID NO: 888686 - protein, 188 aa, Homo sapiens
MVRPVRHKKPVNYSQFDHSDSDDDFVSATVPLNKKSRTAPKELKQDKPKPNLNNLRKEEIPVQEKTPKKRMALDDKLYQRDLEVALALSVKELPTVTTNVQNSQDKSIEKHGSSKIETMNKSPHISNCSVASDYLDLDKITVEDDVGGVQGKSDGDSANDTEPDFAPGEDSEDDSDFVRVRIMTKTSL

SEQ ID NO: 888687 - protein, 223 aa, Homo sapiens
MVRPVRHKKPVNYSQFDHSDSDDDFVSATVPLNKKSRTAPKELKQDKPKPNLNNLRKEEIPVQEKTPKKRLPEGTFSIPASAVPCTKMALDDKLYQRDLEVALALSVKELPTVTTNVQNSQDKSIEKHGSSKIETMNKSPHISNCSVASDYLDLDKITVEDDVGGVQGKRKAASKAAAQQRKILLEGSDGDSANDTEPDFAPGEDSEDDSDFVRVRIMTKTSL

SEQ ID NO: 888688 - protein, 129 aa, Homo sapiens
MRKSKVKEIKKKEVKVKSPVEKKEKKSKSKCNALVTSVDSAPAAVKSESQSLPKKVSLSSDTTRKPLEIRSPSAESKKPKWVPPAASGGSRSSSSPLVVVSVKSPNQSLRLGLSRLARVKPLHPNATST

SEQ ID NO: 888689 - protein, 136 aa, Homo sapiens
MALDDKLYQRDLEVALALSVKELPTVTTNVQNSQDKSIEKHGSSKIETMNKSPHISNCSVASDYLDLDKITVEDDVGGVQGKRKAASKAAAQQRKILLEGSDGDSANDTEPDFAPGEDSEDDSDFVRVRIMTKTSL

SEQ ID NO: 888690 - protein, 206 aa, Homo sapiens; identical to SEQ ID NO: 888684

SEQ ID NO: 888691 - protein, 206 aa, Homo sapiens; identical to SEQ ID NO: 888684

SEQ ID NO: 888692 - protein, 79 aa, Homo sapiens
MVRPVRHKKPVNYSQFDHSDSDDDFVSATVPLNKKSRTAPKYTKQEPTRRSARLSAKPAPPKPEPKPRKTSAKKEPGAK

SEQ ID NO: 888693 - protein, 708 aa, Homo sapiens
MNPTETKAIPVSQQMEGPHLPNKKKHKKQAVKTEPEKKSQSTKLSVVHEKKSQEGKPKEHTEPKSLPKQASDTGSNDAHNKKAVSRSAEQQPSEKSTEPKTKPQDMISAGGESVAGITAISGKPGDKKKEKKSLTPAVPVESKPDKPSGKSGMDAALDDLIDTLGGPEETEEENTTYTGPEVSDPMSSTYIEELGKREVTIPPKYRELLAKKEGITGPPADSSKPIGPDDAIDALSSDFTCGSPTAAGKKTEKEESTEVLKAQSAGTVRSAAPPQEKKRKVEKDTMSDQALEALSASLGTRQAEPELDLRSIKEVDEAKAKEEKLEKCGEDDETIPSEYRLKPATDKDGKPLLPEPEEKPKPRSESELIDELSEDFDRSECKEKPSKPTEKTEESKAAAPAPVSEAVCRTSMCSIQSAPPEPATLKGTVPDDAVEALADSLGKKEADPEDGKPVMDKVKEKAKEEDREKLGEKEETIPPDYRLEEVKDKDGKPLLPKESKEQLPPMSEDFLLDALSEDFSGPQNASSLKFEDAKLAAAISEVVSQTPASTTQAGAPPRDTSQSDKDLDDALDKLSDSLGQRQPDPDENKPMEDKVKEKAKAEHRDKLGERDDTIPPEYRHLLDDNGQDKPVKPPTKKSEDSKKPADDQDPIDALSGDLDSCPSTTETSQNTAKDKCKKAASSSKAPKNGGKAKDSAKTTEETSKPKDD

SEQ ID NO: 888694 - protein, 178 aa, Homo sapiens
GARVPPRAGRGGPIGARGTPAQTWGGVGKAVSSPAPGPSAPPASLPLSLAGLPARPPRHSPRRIPGGSGRSGLAMSQPGQKPAASPRPRRAAAARRTHEHVSEKTSESPSKPGEKKGSDEKKAASLGSSQSSRTYAGGTASATKVSFLWCNSKSSSMNPTEPSCKTDLKEYSQQLSVV

SEQ ID NO: 888695 - protein, 148 aa, Homo sapiens
EPGSLRGQEGEGPSGLGEPRRRPGVGSEKLFHRPLPGPPLLLPPSLSPWQDSPPGLPATLRGAFREAAAAAASPCPSPARSPPPPRGPGEQPPPAAPMSMSVKKPVNRLPNQEKRKDQMRKKQQASAAVNPPEPMLVEQPRPPRSVIS

SEQ ID NO: 888696 - protein, 138 aa, Homo sapiens
EPGSLRGQEGEGPSGLGEPRRRPGVGSEKLFHRPLPGPPLLLPPSLSPWQDSPPGLPATLRGAFREAAAAAASPCPSPARSPPPPRGPGEQPPPAAPMSMSVKKPVNRLPNQEKRKDQMRCRGITGPKVAWTNKPKIK

SEQ ID NO: 888697 - protein, 461 aa, Homo sapiens
AVTSCSESSGKGSLPDFQQQSLSLGLPWPKMGQFLSSTFLEGSPATVWHDKLCDGERRGAREAVRIFQDQAKAKEEKLEKCGEDDETIPSEYRLKPATDKDGKPLLPEPEEKPKPRSESELIDELSEDFDRSECKEKPSKPTEKTEESKAAAPAPVSEAVCRTSMCSIQSAPPEPATLKGTVPDDAVEALADSLGKKEADPEDGKPVMDKVKEKAKEEDREKLGEKEETIPPDYRLEEVKDKDGKPLLPKESKEQLPPMSEDFLLDALSEDFSGPQNASSLKFEDAKLAAAISEVVSQTPASTTQAGAPPRDTSQSDKDLDDALDKLSDSLGQRQPDPDENKPMEDKVKEKAKAEHRDKLGERDDTIPPEYRHLLDDNGQDKPVKPPTKKSEDSKKPADDQDPIDALSGDLDSCPSTTETSQNTAKDKCKKAASSSKAPKNGGKAKDSAKTTEETSKPKDD

SEQ ID NO: 888698 - protein, 110 aa, Homo sapiens
YNFSQEKAKEEDREKLGEKEETIPPDYRLEEVKDKDGKPLLPKESKEQLPPMSEDFLLDALSEDFSGPQNASSLSLNFEGLLKLCWLAILLKVVSPKTPGTKKGTRVSEF

SEQ ID NO: 888699 - protein, 590 aa, Homo sapiens
MISAGGESVAGITAISGKPGDKKKEKKSLTPAVPVESKPDKPSGKSGMDAALDDLIDTLGGPEETEEENTTYTGPEVSDPMSSTYIEELGKREVTIPPKYRELLAKPIGPDDAIDALSSDFTCGSPTAAGKKTEKEESTEVLKAQSAGTVRSAAPPQEKKRKVEKDTMSDQALEALSASLGTRQAEPELDLRSIKEVDEAKAKEEKLEKCGEDDETIPSEYRLKPATDKDGKPLLPEPEEKPKPRSESELIDELSEDFDRSECKEKPSKPTEKTEESKAAAPAPVSEAVCRTSMCSIQSAPPEPATLKGTVPDDAVEALADSLGKKEADPEDGKPVMDKVKEKAKEEDREKLGEKEETIPPDYRLEEVKDKDGKPLLPKESKEQLPPMSEDFLLDALSEDFSGPQNASSLKFEDAKLAAAISEVVSQTPASTTQAGAPPRDTSQSDKDLDDALDKLSDSLGQRQPDPDENKPMEDKVKEKAKAEHRDKLGERDDTIPPEYRHLLDDNGQDKPVKPPTKKSEDSKKPADDQDPIDALSGDLDSCPSTTETSQNTAKDKCKKAASSSKAPKNGGKAKDSAKTTEETSKPKDD

SEQ ID NO: 888700 - protein, 824 aa, Homo sapiens
GARVPPRAGRGGPIGARGTPAQTWGGVGKAVSSPAPGPSAPPASLPLSLAGLPARPPRHSPRRIPGGSGRSGLAMSQPGQKPAASPRPRRAAAARRTHEHVSEKTSESPSKPGEKKGSDEKKAASLGSSQSSRTYAGGTASATKVSASSGATSKSSSMNPTETKAVKTEPEKKSQSTKPKSLPKQASDTGSNDAHNKKAVSRSAEQQPSEKSTEPKTKPQDMISAGGESVAGITAISGKPGDKKKEKKSLTPAVPVESKPDKPSGKSGMDAALDDLIDTLGGPEETEEENTTYTGPEVSDPMSSTYIEELGKREVTIPPKYRELLAKKEGITGPPADSSKPIGPDDAIDALSSDFTCGSPTAAGKKTEKEESTEVLKAQSAGTVRSAAPPQEKKRKVEKDTMSDQALEALSASLGTRQAEPELDLRSIKEVDEAKAKEEKLEKCGEDDETIPSEYRLKPATDKDGKPLLPEPEEKPKPRSESELIDELSEDFDRSECKEKPSKPTEKTEESKAAAPAPVSEAVCRTSMCSIQSAPPEPATLKGTVPDDAVEALADSLGKKEADPEDGKPVMDKVKEKAKEEDREKLGEKEETIPPDYRLEEVKDKDGKPLLPKESKEQLPPMSEDFLLDALSEDFSGPQNASSLKFEDAKLAAAISEVVSQTPASTTQAGAPPRDTSQSDKDLDDALDKLSDSLGQRQPDPDENKPMEDKVKEKAKAEHRDKLGERDDTIPPEYRHLLDDNGQDKPVKPPTKKSEDSKKPADDQDPIDALSGDLDSCPSTTETSQNTAKDKCKKAASSSKAPKNGGKAKDSAKTTEETSKPKDD

SEQ ID NO: 888701 - protein, 843 aa, Homo sapiens
GARVPPRAGRGGPIGARGTPAQTWGGVGKAVSSPAPGPSAPPASLPLSLAGLPARPPRHSPRRIPGGSGRSGLAMSQPGQKPAASPRPRRAAAARRTHEHVSEKTSESPSKPGEKKGSDEKKAASLGSSQSSRTYAGGTASATKVSASSGATSKSSSMNPTETKAVKTEPEKKSQSTKLSVVHEKKSQEGKPKEHTEPKSLPKQASDTGSNDAHNKKAVSRSAEQQPSEKSTEPKTKPQDMISAGGESVAGITAISGKPGDKKKEKKSLTPAVPVESKPDKPSGKSGMDAALDDLIDTLGGPEETEEENTTYTGPEVSDPMSSTYIEELGKREVTIPPKYRELLAKKEGITGPPADSSKPIGPDDAIDALSSDFTCGSPTAAGKKTEKEESTEVLKAQSAGTVRSAAPPQEKKRKVEKDTMSDQALEALSASLGTRQAEPELDLRSIKEVDEAKAKEEKLEKCGEDDETIPSEYRLKPATDKDGKPLLPEPEEKPKPRSESELIDELSEDFDRSECKEKPSKPTEKTEESKAAAPAPVSEAVCRTSMCSIQSAPPEPATLKGTVPDDAVEALADSLGKKEADPEDGKPVMDKVKEKAKEEDREKLGEKEETIPPDYRLEEVKDKDGKPLLPKESKEQLPPMSEDFLLDALSEDFSGPQNASSLKFEDAKLAAAISEVVSQTPASTTQAGAPPRDTSQSDKDLDDALDKLSDSLGQRQPDPDENKPMEDKVKEKAKAEHRDKLGERDDTIPPEYRHLLDDNGQDKPVKPPTKKSEDSKKPADDQDPIDALSGDLDSCPSTTETSQNTAKDKCKKAASSSKAPKNGGKAKDSAKTTEETSKPKDD

SEQ ID NO: 888702 - protein, 824 aa, Homo sapiens; identical to SEQ ID NO: 888700

SEQ ID NO: 888703 - protein, 830 aa, Homo sapiens
GARVPPRAGRGGPIGARGTPAQTWGGVGKAVSSPAPGPSAPPASLPLSLAGLPARPPRHSPRRIPGGSGRSGLAMSQPGQKPAASPRPRRAAAARRTHEHVSEKTSESPSKPGEKKGSDEKKAASLGSSQSSRTYAGGTASATKVSASSGATSKSSSMNPTETKAVKTEPEKKSQSTKLSVVHEKKSQEGKPKEHTEPKSLPKQASDTGSNDAHNKKAVSRSAEQQPSEKSTEPKTKPQDMISAGGESVAGITAISGKPGDKKKEKKSLTPAVPVESKPDKPSGKSGMDAALDDLIDTLGGPEETEEENTTYTGPEVSDPMSSTYIEELGKREVTIPPKYRELLAKPIGPDDAIDALSSDFTCGSPTAAGKKTEKEESTEVLKAQSAGTVRSAAPPQEKKRKVEKDTMSDQALEALSASLGTRQAEPELDLRSIKEVDEAKAKEEKLEKCGEDDETIPSEYRLKPATDKDGKPLLPEPEEKPKPRSESELIDELSEDFDRSECKEKPSKPTEKTEESKAAAPAPVSEAVCRTSMCSIQSAPPEPATLKGTVPDDAVEALADSLGKKEADPEDGKPVMDKVKEKAKEEDREKLGEKEETIPPDYRLEEVKDKDGKPLLPKESKEQLPPMSEDFLLDALSEDFSGPQNASSLKFEDAKLAAAISEVVSQTPASTTQAGAPPRDTSQSDKDLDDALDKLSDSLGQRQPDPDENKPMEDKVKEKAKAEHRDKLGERDDTIPPEYRHLLDDNGQDKPVKPPTKKSEDSKKPADDQDPIDALSGDLDSCPSTTETSQNTAKDKCKKAASSSKAPKNGGKAKDSAKTTEETSKPKDD

SEQ ID NO: 888704 - protein, 824 aa, Homo sapiens; identical to SEQ ID NO: 888700

SEQ ID NO: 888705 - protein, 865 aa, Homo sapiens
GARVPPRAGRGGPIGARGTPAQTWGGVGKAVSSPAPGPSAPPASLPLSLAGLPARPPRHSPRRIPGGSGRSGLAMSQPGQKPAASPRPRRAAAARRTHEHVSEKTSESPSKPGEKKGSDEKKAASLGSSQSSRTYAGGTASATKVSASSGATSKSSSMNPTETKAIPVSQQMEGPHLPNKKKHKKQAVKTEPEKKSQSTKLSVVHEKKSQEGKPKEHTEPKSLPKQASDTGSNDAHNKKAVSRSAEQQPSEKSTEPKTKPQDMISAGGESVAGITAISGKPGDKKKEKKSLTPAVPVESKPDKPSGKSGMDAALDDLIDTLGGPEETEEENTTYTGPEVSDPMSSTYIEELGKREVTIPPKYRELLAKKEGITGPPADSSKPIGPDDAIDALSSDFTCGSPTAAGKKTEKEESTEVLKAQSAGTVRSAAPPQEKKRKVEKDTMSDQALEALSASLGTRQAEPELDLRSIKEVDEAKAKEEKLEKCGEDDETIPSEYRLKPATDKDGKPLLPEPEEKPKPRSESELIDELSEDFDRSECKEKPSKPTEKTEESKAAAPAPVSEAVCRTSMCSIQSAPPEPATLKGTVPDDAVEALADSLGKKEADPEDGKPVMDKVKEKAKEEDREKLGEKEETIPPDYRLEEVKDKDGKPLLPKESKEQLPPMSEDFLLDALSEDFSGPQNASSLKFEDAKLAAAISEVVSQTPASTTQAGAPPRDTSQSDKDLDDALDKLSDSLGQRQPDPDENKPMEDKVKEKAKAEHRDKLGERDDTIPPEYRHLLDDNGQDKPVKPPTKKSEDSKKPADDQDPIDALSGDLDSCPSTTETSQNTAKDKCKKAASSSKAPKNGGKAKDSAKTTEETSKPKDD

SEQ ID NO: 888706 - protein, 740 aa, Homo sapiens
SDTARKFGMRGLRGPVSRRVSASSGATSKSSSMNPTETKAIPVSQQMEGPHLPNKKKHKKQAVKTEPEKKSQSTKLSVVHEKKSQEGKPKEHTEPKSLPKQASDTGSNDAHNKKAVSRSAEQQPSEKSTEPKTKPQDMISAGGESVAGITAISGKPGDKKKEKKSLTPAVPVESKPDKPSGKSGMDAALDDLIDTLGGPEETEEENTTYTGPEVSDPMSSTYIEELGKREVTIPPKYRELLAKKEGITGPPADSSKPIGPDDAIDALSSDFTCGSPTAAGKKTEKEESTEVLKAQSAGTVRSAAPPQEKKRKVEKDTMSDQALEALSASLGTRQAEPELDLRSIKEVDEAKAKEEKLEKCGEDDETIPSEYRLKPATDKDGKPLLPEPEEKPKPRSESELIDELSEDFDRSECKEKPSKPTEKTEESKAAAPAPVSEAVCRTSMCSIQSAPPEPATLKGTVPDDAVEALADSLGKKEADPEDGKPVMDKVKEKAKEEDREKLGEKEETIPPDYRLEEVKDKDGKPLLPKESKEQLPPMSEDFLLDALSEDFSGPQNASSLKFEDAKLAAAISEVVSQTPASTTQAGAPPRDTSQSDKDLDDALDKLSDSLGQRQPDPDENKPMEDKVKEKAKAEHRDKLGERDDTIPPEYRHLLDDNGQDKPVKPPTKKSEDSKKPADDQDPIDALSGDLDSCPSTTETSQNTAKDKCKKAASSSKAPKNGGKAKDSAKTTEETSKPKDD

SEQ ID NO: 888707 - protein, 708 aa, Homo sapiens; identical to SEQ ID NO: 888693

SEQ ID NO: 888708 - protein, 686 aa, Homo sapiens
MNPTETKAVKTEPEKKSQSTKLSVVHEKKSQEGKPKEHTEPKSLPKQASDTGSNDAHNKKAVSRSAEQQPSEKSTEPKTKPQDMISAGGESVAGITAISGKPGDKKKEKKSLTPAVPVESKPDKPSGKSGMDAALDDLIDTLGGPEETEEENTTYTGPEVSDPMSSTYIEELGKREVTIPPKYRELLAKKEGITGPPADSSKPIGPDDAIDALSSDFTCGSPTAAGKKTEKEESTEVLKAQSAGTVRSAAPPQEKKRKVEKDTMSDQALEALSASLGTRQAEPELDLRSIKEVDEAKAKEEKLEKCGEDDETIPSEYRLKPATDKDGKPLLPEPEEKPKPRSESELIDELSEDFDRSECKEKPSKPTEKTEESKAAAPAPVSEAVCRTSMCSIQSAPPEPATLKGTVPDDAVEALADSLGKKEADPEDGKPVMDKVKEKAKEEDREKLGEKEETIPPDYRLEEVKDKDGKPLLPKESKEQLPPMSEDFLLDALSEDFSGPQNASSLKFEDAKLAAAISEVVSQTPASTTQAGAPPRDTSQSDKDLDDALDKLSDSLGQRQPDPDENKPMEDKVKEKAKAEHRDKLGERDDTIPPEYRHLLDDNGQDKPVKPPTKKSEDSKKPADDQDPIDALSGDLDSCPSTTETSQNTAKDKCKKAASSSKAPKNGGKAKDSAKTTEETSKPKDD

SEQ ID NO: 888709 - protein, 667 aa, Homo sapiens
MNPTETKAVKTEPEKKSQSTKPKSLPKQASDTGSNDAHNKKAVSRSAEQQPSEKSTEPKTKPQDMISAGGESVAGITAISGKPGDKKKEKKSLTPAVPVESKPDKPSGKSGMDAALDDLIDTLGGPEETEEENTTYTGPEVSDPMSSTYIEELGKREVTIPPKYRELLAKKEGITGPPADSSKPIGPDDAIDALSSDFTCGSPTAAGKKTEKEESTEVLKAQSAGTVRSAAPPQEKKRKVEKDTMSDQALEALSASLGTRQAEPELDLRSIKEVDEAKAKEEKLEKCGEDDETIPSEYRLKPATDKDGKPLLPEPEEKPKPRSESELIDELSEDFDRSECKEKPSKPTEKTEESKAAAPAPVSEAVCRTSMCSIQSAPPEPATLKGTVPDDAVEALADSLGKKEADPEDGKPVMDKVKEKAKEEDREKLGEKEETIPPDYRLEEVKDKDGKPLLPKESKEQLPPMSEDFLLDALSEDFSGPQNASSLKFEDAKLAAAISEVVSQTPASTTQAGAPPRDTSQSDKDLDDALDKLSDSLGQRQPDPDENKPMEDKVKEKAKAEHRDKLGERDDTIPPEYRHLLDDNGQDKPVKPPTKKSEDSKKPADDQDPIDALSGDLDSCPSTTETSQNTAKDKCKKAASSSKAPKNGGKAKDSAKTTEETSKPKDD

SEQ ID NO: 888710 - protein, 846 aa, Homo sapiens
GARVPPRAGRGGPIGARGTPAQTWGGVGKAVSSPAPGPSAPPASLPLSLAGLPARPPRHSPRRIPGGSGRSGLAMSQPGQKPAASPRPRRAAAARRTHEHVSEKTSESPSKPGEKKGSDEKKAASLGSSQSSRTYAGGTASATKVSASSGATSKSSSMNPTETKAIPVSQQMEGPHLPNKKKHKKQAVKTEPEKKSQSTKPKSLPKQASDTGSNDAHNKKAVSRSAEQQPSEKSTEPKTKPQDMISAGGESVAGITAISGKPGDKKKEKKSLTPAVPVESKPDKPSGKSGMDAALDDLIDTLGGPEETEEENTTYTGPEVSDPMSSTYIEELGKREVTIPPKYRELLAKKEGITGPPADSSKPIGPDDAIDALSSDFTCGSPTAAGKKTEKEESTEVLKAQSAGTVRSAAPPQEKKRKVEKDTMSDQALEALSASLGTRQAEPELDLRSIKEVDEAKAKEEKLEKCGEDDETIPSEYRLKPATDKDGKPLLPEPEEKPKPRSESELIDELSEDFDRSECKEKPSKPTEKTEESKAAAPAPVSEAVCRTSMCSIQSAPPEPATLKGTVPDDAVEALADSLGKKEADPEDGKPVMDKVKEKAKEEDREKLGEKEETIPPDYRLEEVKDKDGKPLLPKESKEQLPPMSEDFLLDALSEDFSGPQNASSLKFEDAKLAAAISEVVSQTPASTTQAGAPPRDTSQSDKDLDDALDKLSDSLGQRQPDPDENKPMEDKVKEKAKAEHRDKLGERDDTIPPEYRHLLDDNGQDKPVKPPTKKSEDSKKPADDQDPIDALSGDLDSCPSTTETSQNTAKDKCKKAASSSKAPKNGGKAKDSAKTTEETSKPKDD

SEQ ID NO: 888711 - protein, 732 aa, Homo sapiens
RLLAASEHVSEKTSESPSKPGEKKGSDEKKAASLGSSQSSRTYAGGTASATKVSASSGATSKSSSMNPTETKAVKTEPEKKSQSTKPKSLPKQASDTGSNDAHNKKAVSRSAEQQPSEKSTEPKTKPQDMISAGGESVAGITAISGKPGDKKKEKKSLTPAVPVESKPDKPSGKSGMDAALDDLIDTLGGPEETEEENTTYTGPEVSDPMSSTYIEELGKREVTIPPKYRELLAKKEGITGPPADSSKPIGPDDAIDALSSDFTCGSPTAAGKKTEKEESTEVLKAQSAGTVRSAAPPQEKKRKVEKDTMSDQALEALSASLGTRQAEPELDLRSIKEVDEAKAKEEKLEKCGEDDETIPSEYRLKPATDKDGKPLLPEPEEKPKPRSESELIDELSEDFDRSECKEKPSKPTEKTEESKAAAPAPVSEAVCRTSMCSIQSAPPEPATLKGTVPDDAVEALADSLGKKEADPEDGKPVMDKVKEKAKEEDREKLGEKEETIPPDYRLEEVKDKDGKPLLPKESKEQLPPMSEDFLLDALSEDFSGPQNASSLKFEDAKLAAAISEVVSQTPASTTQAGAPPRDTSQSDKDLDDALDKLSDSLGQRQPDPDENKPMEDKVKEKAKAEHRDKLGERDDTIPPEYRHLLDDNGQDKPVKPPTKKSEDSKKPADDQDPIDALSGDLDSCPSTTETSQNTAKDKCKKAASSSKAPKNGGKAKDSAKTTEETSKPKDD

SEQ ID NO: 888712 - protein, 819 aa, Homo sapiens
GARVPPRAGRGGPIGARGTPAQTWGGVGKAVSSPAPGPSAPPASLPLSLAGLPARPPRHSPRRIPGGSGRSGLAMSQPGQKPAASPRPRRAAAARRTHEHVSEKTSESPSKPGEKKGSDEVSASSGATSKSSSMNPTETKAVKTEPEKKSQSTKLSVVHEKKSQEGKPKEHTEPKSLPKQASDTGSNDAHNKKAVSRSAEQQPSEKSTEPKTKPQDMISAGGESVAGITAISGKPGDKKKEKKSLTPAVPVESKPDKPSGKSGMDAALDDLIDTLGGPEETEEENTTYTGPEVSDPMSSTYIEELGKREVTIPPKYRELLAKKEGITGPPADSSKPIGPDDAIDALSSDFTCGSPTAAGKKTEKEESTEVLKAQSAGTVRSAAPPQEKKRKVEKDTMSDQALEALSASLGTRQAEPELDLRSIKEVDEAKAKEEKLEKCGEDDETIPSEYRLKPATDKDGKPLLPEPEEKPKPRSESELIDELSEDFDRSECKEKPSKPTEKTEESKAAAPAPVSEAVCRTSMCSIQSAPPEPATLKGTVPDDAVEALADSLGKKEADPEDGKPVMDKVKEKAKEEDREKLGEKEETIPPDYRLEEVKDKDGKPLLPKESKEQLPPMSEDFLLDALSEDFSGPQNASSLKFEDAKLAAAISEVVSQTPASTTQAGAPPRDTSQSDKDLDDALDKLSDSLGQRQPDPDENKPMEDKVKEKAKAEHRDKLGERDDTIPPEYRHLLDDNGQDKPVKPPTKKSEDSKKPADDQDPIDALSGDLDSCPSTTETSQNTAKDKCKKAASSSKAPKNGGKAKDSAKTTEETSKPKDD

SEQ ID NO: 888713 - protein, 706 aa, Homo sapiens
MATERPHHFLVGGRGIKSSSMNPTETKAVKTEPEKKSQSTKLSVVHEKKSQEGKPKEHTEPKSLPKQASDTGSNDAHNKKAVSRSAEQQPSEKSTEPKTKPQDMISAGGESVAGITAISGKPGDKKKEKKSLTPAVPVESKPDKPSGKSGMDAALDDLIDTLGGPEETEEENTTYTGPEVSDPMSSTYIEELGKREVTIPPKYRELLAKKEGITGPPADSSKPIGPDDAIDALSSDFTCGSPTAAGKKTEKEESTEVLKAQSAGTVRSAAPPQEKKRKVEKDTMSDQALEALSASLGTRQAEPELDLRSIKEVDEAKAKEEKLEKCGEDDETIPSEYRLKPATDKDGKPLLPEPEEKPKPRSESELIDELSEDFDRSECKEKPSKPTEKTEESKAAAPAPVSEAVCRTSMCSIQSAPPEPATLKGTVPDDAVEALADSLGKKEADPEDGKPVMDKVKEKAKEEDREKLGEKEETIPPDYRLEEVKDKDGKPLLPKESKEQLPPMSEDFLLDALSEDFSGPQNASSLKFEDAKLAAAISEVVSQTPASTTQAGAPPRDTSQSDKDLDDALDKLSDSLGQRQPDPDENKPMEDKVKEKAKAEHRDKLGERDDTIPPEYRHLLDDNGQDKPVKPPTKKSEDSKKPADDQDPIDALSGDLDSCPSTTETSQNTAKDKCKKAASSSKAPKNGGKAKDSAKTTEETSKPKDD

SEQ ID NO: 888714 - protein, 673 aa, Homo sapiens
MNPTETKAVKTEPEKKSQSTKLSVVHEKKSQEGKPKEHTEPKSLPKQASDTGSNDAHNKKAVSRSAEQQPSEKSTEPKTKPQDMISAGGESVAGITAISGKPGDKKKEKKSLTPAVPVESKPDKPSGKSGMDAALDDLIDTLGGPEETEEENTTYTGPEVSDPMSSTYIEELGKREVTIPPKYRELLAKPIGPDDAIDALSSDFTCGSPTAAGKKTEKEESTEVLKAQSAGTVRSAAPPQEKKRKVEKDTMSDQALEALSASLGTRQAEPELDLRSIKEVDEAKAKEEKLEKCGEDDETIPSEYRLKPATDKDGKPLLPEPEEKPKPRSESELIDELSEDFDRSECKEKPSKPTEKTEESKAAAPAPVSEAVCRTSMCSIQSAPPEPATLKGTVPDDAVEALADSLGKKEADPEDGKPVMDKVKEKAKEEDREKLGEKEETIPPDYRLEEVKDKDGKPLLPKESKEQLPPMSEDFLLDALSEDFSGPQNASSLKFEDAKLAAAISEVVSQTPASTTQAGAPPRDTSQSDKDLDDALDKLSDSLGQRQPDPDENKPMEDKVKEKAKAEHRDKLGERDDTIPPEYRHLLDDNGQDKPVKPPTKKSEDSKKPADDQDPIDALSGDLDSCPSTTETSQNTAKDKCKKAASSSKAPKNGGKAKDSAKTTEETSKPKDD

SEQ ID NO: 888715 - protein, 824 aa, Homo sapiens; identical to SEQ ID NO: 888700

SEQ ID NO: 888716 - protein, 824 aa, Homo sapiens; identical to SEQ ID NO: 888700

SEQ ID NO: 888717 - protein, 824 aa, Homo sapiens; identical to SEQ ID NO: 888700

SEQ ID NO: 888718 - protein, 824 aa, Homo sapiens; identical to SEQ ID NO: 888700

SEQ ID NO: 888719 - protein, 824 aa, Homo sapiens; identical to SEQ ID NO: 888700

SEQ ID NO: 888720 - protein, 796 aa, Homo sapiens
GARVPPRAGRGGPIGARGTPAQTWGGVGKAVSSPAPGPSAPPASLPLSLAGLPARPPRHSPRRIPGGSGRSGLAMSQPGQKPAASPRPRRAAAARRTHEHVSEKTSESPSKPGEKKGSDEKKAASLGSSQSSRTYAGGTASATKVSASSGATSKSSSMNPTETKAVKTEPEKKSQSTKLSVVHEKKSQEGKPKEHTEPKSLPKQASDTGSNDAHNKKAVSRSAEQQPSEKSTEPKTKPQDMISAGGESVAGITAISGKPGDKKKEKKSLTPAVPVESKPDKPSGKSGMDAALDDLIDTLGGPEETEEENTTYTGPEVSDPMSSTYIEELGKREVTIPPKYRELLAKKEGITGPPADSSKPIGPDDAIDALSSDFTCGSPTAAGKKTEKEESTEVLKAQSAGTVRSAAPPQEKKRKVEKDTMSDQALEALSASLGTRQAEPELDLRSIKEVDEAKAKEEKLEKCGEDDETIPSEYRLKPATDKDGKPLLPEPEEKPKPRSESELIDELSEDFDRSECKEKPSKPTEKTEESKAAAPAPVSEAVCRTSMCSIQSAPPEPATLKGTVPDDAVEALADSLGKKEADPEDGKPVMDKVKEKAKEEDREKLGEKEETIPPDYRLEEVKDKDGKPLLPKESKEQLPPMSEDFLLDALSEDFSGPQNASSLKFEDAKLAAAISEVVSQTPASTTQAGAPPRDTSQSDKDLDDALDKLSDSLGQRQPDPDENKPMEDKVKEKAKAEHRDKLGERDDTIPPEYRHLLDDNGQDKPVKPPTKKSEDSKKPADDLDPIDALTAEDQAG

SEQ ID NO: 888721 - protein, 693 aa, Homo sapiens
GARVPPRAGRGGPIGARGTPAQTWGGVGKAVSSPAPGPSAPPASLPLSLAGLPARPPRHSPRRIPGGSGRSGLAMSQPGQKPAASPRPRRAAAARRTHEHVSEKTSESPSKPGEKKGSDEKKAASLGSSQSSRTYAGGTASATKVSASSGATSKSSSMNPTETKAVKTEPEKKSQSTKLSVVHEKKSQEGKPKEHTEPKSLPKQASDTGSNDAHNKKAVSRSAEQQPSEKSTEPKTKPQDMISAGGESVAGITAISGKPGDKKKEKKSLTPAVPVESKPDKPSGKSGMDAALDDLIDTLGGPEETEEENTTYTGPEVSDPMSSTYIEELGKREVTIPPKYRELLAKKEGITGPPADSSKPIGPDDAIDALSSDFTCGSPTAAGKKTEKEESTEVLKAQSAGTVRSAAPPQEKKRKVEKDTMSDQALEALSASLGTRQAEPELDLRSIKEVDEAKAKEEKLEKCGEDDETIPSEYRLKPATDKDGKPLLPEPEEKPKPRSESELIDELSEDFDRSECKEKPSKPTEKTEESKAAAPAPVSEAVCRTSMCSIQSAPPEPATLKGTVPDDAVEALADSLGKKEADPEDGKPVMDKVKEKAKEEDREKLGEKEETIPPDYRLEEVKDKDGKPLLPKESKEQLPPMSEDFLLDALSEDFSGPQNASSLLQRPKLEPHPVIPRRVTKTSMMPWINSLTV

SEQ ID NO: 888722 - protein, 143 aa, Homo sapiens
LLPSLFSKKSGGGMVGSVDPYETNPVEDKVKEKAKAEHRDKLGERDDTIPPEYRHLLDDNGQDKPVKPPTKKSEDSKKPADDQDPIDALSGDLDSCPSTTETSQNTAKDKCKKAASSSKAPKNGGKAKDSAKTTEETSKPKDD

SEQ ID NO: 888723 - protein, 843 aa, Homo sapiens; identical to SEQ ID NO: 888701

SEQ ID NO: 888724 - protein, 121 aa, Homo sapiens
YKRNSAWGDRAYWIDPDGVLMSSLSYRILHHVRSIAETRISTLAAPPMKKSEDSKKPADDQDPIDALSGDLDSCPSTTETSQNTAKDKCKKAASSSKAPKNGGKAKDSAKTTEETSKPKDD

SEQ ID NO: 888725 - protein, 843 aa, Homo sapiens; identical to SEQ ID NO: 888701

SEQ ID NO: 888726 - protein, 843 aa, Homo sapiens; identical to SEQ ID NO: 888701

SEQ ID NO: 888727 - protein, 567 aa, Homo sapiens
GARVPPRAGRGGPIGARGTPAQTWGGVGKAVSSPAPGPSAPPASLPLSLAGLPARPPRHSPRRIPGGSGRSGLAMSQPGQKPAASPRPRRAAAARRTHEHVSEKTSESPSKPGEKKGSDEKKAASLGSSQSSRTYAGGTASATKVSASSGATSKSSSMNPTETKAVKTEPEKKSQSTKLSVVHEKKSQEGKPKEHTEPKSLPKQASDTGSNDAHNKKAVSRSAEQQPSEKSTEPKTKPQDMISAGGESVAGITAISGKPGDKKKEKKSLTPAVPVESKPDKPSGKSGMDAALDDLIDTLGGPEETEEENTTYTGPEVSDPMSSTYIEELGKREVTIPPKYRELLAKKEGITGPPADSSKPIGPDDAIDALSSDFTCGSPTAAGKKTEKEESTEVLKAQSAGTVRSAAPPQEKKRKVEKDTMSDQALEALSASLGTRQAEPELDLRSIKEVDEAKAKEEKLEKCGEDDETIPSEYRLKPATDKDGKPLLPEPEEKPKPRSESELIDELSEDFDRSECKEKPSKPTEKTEESKAAAPAPVSEAVCRTSMCSIQSAPPEPATLVSDSLGI

SEQ ID NO: 888728 - protein, 531 aa, Homo sapiens
GARVPPRAGRGGPIGARGTPAQTWGGVGKAVSSPAPGPSAPPASLPLSLAGLPARPPRHSPRRIPGGSGRSGLAMSQPGQKPAASPRPRRAAAARRTHEHVSEKTSESPSKPGEKKGSDEKKAASLGSSQSSRTYAGGTASATKVSASSGATSKSSSMNPTETKAVKTEPEKKSQSTKLSVVHEKKSQEGKPKEHTEPKSLPKQASDTGSNDAHNKKAVSRSAEQQPSEKSTEPKTKPQDMISAGGESVAGITAISGKPGDKKKEKKSLTPAVPVESKPDKPSGKSGMDAALDDLIDTLGGPEETEEENTTYTGPEVSDPMSSTYIEELGKREVTIPPKYRELLAKKEGITGPPADSSKPIGPDDAIDALSSDFTCGSPTAAGKKTEKEESTEVLKAQSAGTVRSAAPPQEKKRKVEKDTMSDQALEALSASLGTRQAEPELDLRSIKEVDEAKAKEEKLEKCGEDDETIPSEYRLKPATDKDGKPLLPEPEEKPKPRSESELIDELSEDFDRSECKEKPSKPTEKTEVCF

SEQ ID NO: 888729 - protein, 157 aa, Homo sapiens
EPGSLRGQEGEGPSGLGEPRRRPGVGSEKLFHRPLPGPPLLLPPSLSPWQDSPPGLPATLRGAFREAAAAAASPCPSPARSPPPPRGPGEQPPPAAPMSMSVKKPVNRLPNQEKRKDQMRKKQQASAAVNPPEPMLVEQPRPPRCQLPLVQPASLPV

SEQ ID NO: 888730 - protein, 824 aa, Homo sapiens; identical to SEQ ID NO: 888700

SEQ ID NO: 888731 - protein, 842 aa, Homo sapiens
GARVPPRAGRGGPIGARGTPAQTWGGVGKAVSSPAPGPSAPPASLPLSLAGLPARPPRHSPRRIPGGSGRSGLAMSQPGQKPAASPRPRRAAAARRTHEHVSEKTSESPSKPGEKKGSDEKKAASLGSSQSSRTYAGGTASATKVSASSGATSKSSSMNPTETKAVKTEPEKKSQSTKLSVVHEKKSQEGKPKEHTEPKSLPKQASDTGSNDAHNKKAVSRSAEQQPSEKSTEPKTKPQDMISAGGESVAGITAISGKPGDKKKEKKSLTPAVPVESKPDKPSGKSGMDAALDDLIDTLGGPEETEEENTTYTGPEVSDPMSSTYIEELGKREVTIPPKYRELLAKKEGITGPPADSSKPIGPDDAIDALSSDFTCGSPTAAGKKTEKEESTEVLKAQSAGTVRSAAPPQEKKRKVEKDTMSDQALEALSASLGTRQAEPELDLRSIKEVDEAKAKEEKLEKCGEDDETIPSEYRLKPATDKDGKPLLPEPEEKPKPRSESELIDELSEDFDRSECKEKPSKPTEKTEESKAAAPAPVSEAVCRTSMCSIQSAPPEPATLKGTVPDDAVEALADSLGKKEADPEDGKPVMDKVKEKAKEEDREKLGEKEETIPPDYRLEEVKDKDGKPLLPKESKEQLPPMSEDFLLDALSEDFSGPQNASSLKFEDAKLAAAISEVVSQTPASTTQAGAPPRDTSQSDKDLDDALDKLSDSLGQRQPDPDENKPMEDKVKEKAKAEHRDKLGERDDTIPPEYRHLLDDNGQDKPVKPPTKKSEDSKKPADDQDPIDALSGDLDSCPSTTETSQNTAKDKCKKAASSSKAPKNGGKAKDSAKGKWSSKYTTN

SEQ ID NO: 888732 - protein, 260 aa, Homo sapiens
GVLEDPVYICQEKAKEEDREKLGEKEETIPPDYRLEEVKDKDGKPLLPKESKEQLPPMSEDFLLDALSEDFSGPQNASSLKFEDAKLAAAISEVVSQTPASTTQAGAPPRDTSQSDKDLDDALDKLSDSLGQRQPDPDENKPMEDKVKEKAKAEHRDKLGERDDTIPPEYRHLLDDNGQDKPVKPPTKKSEDSKKPADDQDPIDALSGDLDSCPSTTETSQNTAKDKCKKAASSSKAPKNGGKAKDSAKTTEETSKPKDD

SEQ ID NO: 888733 - protein, 843 aa, Homo sapiens; identical to SEQ ID NO: 888701

SEQ ID NO: 888734 - protein, 830 aa, Homo sapiens; identical to SEQ ID NO: 888703

SEQ ID NO: 888735 - protein, 91 aa, Homo sapiens
REFIILLREFIILLREFIILLEDSKKPADDQDPIDALSGDLDSCPSTTETSQNTAKDKCKKAASSSKAPKNGGKAKDSAKTTEETSKPKDD

SEQ ID NO: 888736 - protein, 666 aa, Homo sapiens
GARVPPRAGRGGPIGARGTPAQTWGGVGKAVSSPAPGPSAPPASLPLSLAGLPARPPRHSPRRIPGGSGRSGLAMSQPGQKPAASPRPRRAAAARRTHEHVSEKTSESPSKPGEKKGSDEKKAASLGSSQSSRTYAGGTASATKVSASSGATSKSSSMNPTETKAVKTEPEKKSQSTKLSVVHEKKSQEGKPKEHTEPKSLPKQASDTGSNDAHNKKAVSRSAEQQPSEKSTEPKTKPQDMISAGGESVAGITAISGKPGDKKKEKKSLTPAVPVESKPDKPSGKSGMDAALDDLIDTLGGPEETEEENTTYTGPEVSDPMSSTYIEELGKREVTIPPKYRELLAKKEGITGPPADSSKPIGPDDAIDALSSDFTCGSPTAAGKKTEKEESTEVLKAQSAGTVRSAAPPQEKKRKVEKDTMSDQALEALSASLGTRQAEPELDLRSIKEVDEAKAKEEKLEKCGEDDETIPSEYRLKPATDKDGKPLLPEPEEKPKPRSESELIDELSEDFDRSECKEKPSKPTEKTEESKAAAPAPVSEAVCRTSMCSIQSAPPEPATLKGTVPDDAVEALADSLGKKEADPEDGKPVMDKVKEKAKEEDREKLGEKEETIPPDYRLEEVKVRWKATPAQKSLRNSVPPMSEDFPLDACRDDFSGPNASLLIEEC

SEQ ID NO: 888737 - protein, 157 aa, Homo sapiens; identical to SEQ ID NO: 888729

SEQ ID NO: 888738 - protein, 962 aa, Homo sapiens
MASNSTKSFLADAGYGEQELDANSALMELDKGLRSGKLGEQCEAVVRFPRLFQKYPFPILINSAFLKLADVFRVGNNFLRLCVLKVTQQSEKHLEKILNVDEFVKRIFSVIHSNDPVARAITLRMLGSLASIIPERKNAHHSIRQSLDSHDNVEVEAAVFAAANFSAQSKDFAVGICNKISEMIQGLATPVDLKLKLIPILQHMHHDAILASSARQLLQQLVTSYPSTKMVIVSLHTFTLLAASSLVDTPKQIQLLLQYLKNDPRKAVKRLAIQDLKLLANKTPHTWSRENIQALCECALQTPYDSLKLGMLSVLSTLSGTIAIKHYFSIVPGNVSSSPRSSDLVKLAQECCYHNNRGIAAHGVRVLTNITVSCQEKDLLALEQDAVFGLESLLVLCSQDDSPGAQATLKIALNCMVKLAKGRPHLSQSVVETLLTQLHSAQDAARILMCHCLAAIAMQLPVLGDGMLGDLMELYKVIGRSATDKQQELLVSLATVIFVASQKALSVESKAVIKQQLESVSNGWTVYRIARQASRMGNHDMAKELYQSLLTQVASEHFYFWLNSLKEFSHAEQCLTGLQEENYSSALSCIAESLKFYHKGIASLTAASTPLNPLSFQCEFVKLRIDLLQAFSQLICTCNSLKTSPPPAIATTIAMTLGNDLQRCGRISNQMKQSMEEFRSLASRYGDLYQASFDADSATLRNVELQQQSCLLISHAIEALILDPESASFQEYGSTGTAHADSEYERRMMSVYNHVLEEVESLNRKYTPVSYMHTACLCNAIIALLKVPLSFQRYFFQKLQSTSIKLALSPSPRNPAEPIAVQNNQQLALKVEGVVQHGSKPGLFRKIQSVCLNVSSTLQSKSGQDYKIPIDNMTNEMEQRVEPHNDYFSTQFLLNFAILGTHNITVESSVKDANGIVWKTGPRTTIFVKSLEDPYSQQIRLQQQQAQQPLQQQQQRNAYTRF

SEQ ID NO: 888739 - protein, 962 aa, Homo sapiens; identical to SEQ ID NO: 888738

SEQ ID NO: 888740 - protein, 942 aa, Homo sapiens
MASNSTKSFLADAGYGEQELDANSALMELDKGLRSGKLGEQCEAVVRFPRLFQKYPFPILINSAFLKLADVFRVGNNFLRLCVLKVTQQSEKHLEKILNVDEFVKRIFSVIHSNDPVARAITLRMLGSLASIIPERKNAHHSIRQSLDSHDNVEVEAAVFAAANFSAQSKDFAVGICNKISEMIQGLATPVDLKLKLIPILQHMHHDAILASSARQLLQQLVTSYPSTKMVIVSLHTFTLLAASSLVDTPKQIQLLLQYLKNDPRKAVKRLAIQDLKLLANKTPHTWSRENIQALCECALQTPYDSLKLGMLSVLSTLSGTIAIKHYFSIVPGNVSSSPRSSDLVKLAQECCYHNNRGIAAHGVRVLTNITVSCQEKDLLALEQDAVFGLESLLVLCSQDDSPGAQATLKIALNCMVKLAKGRPHLSQSVVETLLTQLHSAQDAARILMCHCLAAIAMQLPVLGDGMLGDLMELYKVIGRSATDKQQELLVSLATVIFVASQKALSVESKAVIKQQLESVSNGWTVYRIARQASRMGNHDMAKELYQSLLTQVASEHFYFWLNSLKEFSHAEQCLTGLQEENYSSALSCIAESLKFYHKGIASLTAASTPLNPLSFQCEFVKLRIDLLQAFSQLICTCNSLKTSPPPAIATTIAMTLGNDLQRCGRISNQMKQSMEEFRSLASRYGDLYQASFDADSATLRNVELQQQSCLLISHAIEALILDPESASFQEYGSTGTAHADSEYERRMMSVYNHVLEEVESLNRKYTPVSYMRYFFQKLQSTSIKLALSPSPRNPAEPIAVQNNQQLALKVEGVVQHGSKPGLFRKIQSVCLNVSSTLQSKSGQDYKIPIDNMTNEMEQRVEPHNDYFSTQFLLNFAILGTHNITVESSVKDANGIVWKTGPRTTIFVKSLEDPYSQQIRLQQQQAQQPLQQQQQRNAYTRF

SEQ ID NO: 888741 - protein, 502 aa, Homo sapiens
MASNSTKSFLADAGYGEQELDANSALMELDKGLRSGKLGEQCEAVVRFPRLFQKYPFPILINSAFLKLADVFRVGNNFLRLCVLKVTQQSEKHLEKILNVDEFVKRIFSVIHSNDPVARAITLRMLGSLASIIPERKNAHHSIRQSLDSHDNVEVEAAVFAAANFSAQSKDFAVGICNKISEMIQGLATPVDLKLKLIPILQHMHHDAILASSARQLLQQLVTSYPSTKMVIVSLHTFTLLAASSLVDTPKQIQLLLQYLKNDPRKAVKRLAIQDLKLLANKTPHTWSRENIQALCECALQTPYDSLKLGMLSVLSTLSGTIAIKHYFSIVPGNVSSSPRSSDLVKLAQECCYHNNRGIAAHGVRVLTNITVSCQEKDLLALEQDAVFGLESLLVLCSQDDSPGAQATLKIALNCMVKLAKGRPHLSQSVVETLLTQLHSAQDAARILMCHCLAAIAMQLPVLGDGMLGDLMELYKVIGRSATDKQQELLFPGIWIYWNSPC

SEQ ID NO: 888742 - protein, 308 aa, Homo sapiens [sequence omitted]

SEQ ID NO: 888743 - protein, 811 aa, Homo sapiens
MASNSTKSFLADAGYGEQELDANSALMELDKGLRSGKLGEQCEAVVRFPRLFQKYPFPILINSAFLKLADVFRVGNNFLRLCVLKVTQQSEKHLEKILNVDEFVKRIFSVIHSNDPVARAITLRMLGSLASIIPERKNAHHSIRQSLDSHDNVEVEAAVFAAANFSAQSKDFAVGICNKISEMIQGLATPVDLKLKLIPILQHMHHDAILASSARQLLQQLVTSYPSTKMVIVSLHTFTLLAASSLVDTPKQIQLLLQYLKNDPRKAVKRLAIQDLKLLANKTPHTWSRENIQALCECALQTPYDSLKLGMLSVLSTLSGTIAIKHYFSIVPGNVSSSPRSSDLVKLAQECCYHNNRGIAAHGVRVLTNITVSCQEKDLLALEQDAVFGLESLLVLCSQDDSPGAQATLKIALNCMVKLAKGRPHLSQSVVETLLTQLHSAQDAARILMCHCLAAIAMQLPVLGDGMLGDLMELYKVIGRSATDKQQELLVSLATVIFVASQKALSVESKAVIKQQLESVSNGWTVYRIARQASRMGNHDMAKELYQSLLTQVASEHFYFWLNSLKEFSHAEQCLTGLQEENYSSALSCIAESLKFYHKGIASLTAASTPLNPLSFQCEFVKLRIDLLQAFSQLICTCNSLKTSPPPAIATTIAMTLGNDLQRCGRISNQMKQSMEEFRSLASRYGDLYQASFDADSATLRNVELQQQSCLLISHAIEALILDPESASFQEYGSTGTAHADSEYERRMMSVYNHVLEEVESLNRKYTPVSYMASGICFIELLLYGCGFFIHLWHLLCEFNKLTFLCLFPYP

SEQ ID NO: 888744 - protein, 249 aa, Homo sapiens
SNPPKIAAVCPPRALFQEYGSTGTAHADSEYERRMMSVYNHVLEEVESLNRKYTPVSYMHTACLCNAIIALLKVPLSFQRYFFQKLQSTSIKLALSPSPRNPAEPIAVQNNQQLALKVEGVVQHGSKPGLFRKIQSVCLNVSSTLQSKSGQDYKIPIDNMTNEMEQRVEPHNDYFSTQFLLNFAILGTHNITVESSVKDANGIVWKTGPRTTIFVKSLEDPYSQQIRLQQQQAQQPLQQQQQRNAYTRF

SEQ ID NO: 888745 - protein, 640 aa, Homo sapiens
MASNSTKSFLADAGYGEQELDANSALMELDKGLRSGKLGEQCEAVVRFPRLFQKYPFPILINSAFLKLADVFRVGNNFLRLCVLKVTQQSEKHLEKILNVDEFVKRIFSVIHSNDPVARAITLRMLGSLASIIPERKNAHHSIRQSLDSHDNVEVEAAVFAAANFSAQSKDFAVGICNKISEMIQGLATPVDLKLKLIPILQHMHHDAILASSARQLLQQLVTSYPSTKMVIVSLHTFTLLAASSLVDTPKQIQLLLQYLKNDPRKAVKRLAIQDLKLLANKTPHTWSRENIQALCECALQTPYDSLKLGMLSVLSTLSGTIAIKHYFSIVPGNVSSSPRSSDLVKLAQECCYHNNRGIAAHGVRVLTNITVSCQEKDLLALEQDAVFGLESLLVLCSQDDSPGAQATLKIALNCMVKLAKGRPHLSQSVVETLLTQLHSAQDAARILMCHCLAAIAMQLPVLGDGMLGDLMELYKVIGRSATDKQQELLVSLATVIFVASQKALSVESKAVIKQQLESVSNGWTVYRIARQASRMGNHDMAKELYQSLLTQVASEHFYFWLNSLKEFSHAEQCLTGLQEENYSSALSCIAESLKFYHKGIASLTVSPLNSPLVVMIYVRVLSLLFLDCPISTNLRNLLI

SEQ ID NO: 888746 - protein, 838 aa, Homo sapiens
MLGSLASIIPERKNAHHSIRQSLDSHDNVEVEAAVFAAANFSAQSKDFAVGICNKISEMIQGLATPVDLKLKLIPILQHMHHDAILASSARQLLQQLVTSYPSTKMVIVSLHTFTLLAASSLVDTPKQIQLLLQYLKNDPRKAVKRLAIQDLKLLANKTPHTWSRENIQALCECALQTPYDSLKLGMLSVLSTLSGTIAIKHYFSIVPGNVSSSPRSSDLVKLAQECCYHNNRGIAAHGVRVLTNITVSCQEKDLLALEQDAVFGLESLLVLCSQDDSPGAQATLKIALNCMVKLAKGRPHLSQSVVETLLTQLHSAQDAARILMCHCLAAIAMQLPVLGDGMLGDLMELYKVIGRSATDKQQELLVSLATVIFVASQKALSVESKAVIKQQLESVSNGWTVYRIARQASRMGNHDMAKELYQSLLTQVASEHFYFWLNSLKEFSHAEQCLTGLQEENYSSALSCIAESLKFYHKGIASLTAASTPLNPLSFQCEFVKLRIDLLQAFSQLICTCNSLKTSPPPAIATTIAMTLGNDLQRCGRISNQMKQSMEEFRSLASRYGDLYQASFDADSATLRNVELQQQSCLLISHAIEALILDPESASFQEYGSTGTAHADSEYERRMMSVYNHVLEEVESLNRKYTPVSYMHTACLCNAIIALLKVPLSFQRYFFQKLQSTSIKLALSPSPRNPAEPIAVQNNQQLALKVEGVVQHGSKPGLFRKIQSVCLNVSSTLQSKSGQDYKIPIDNMTNEMEQRVEPHNDYFSTQFLLNFAILGTHNITVESSVKDANGIVWKTGPRTTIFVKSLEDPYSQQIRLQQQQAQQPLQQQQQRNAYTRF

SEQ ID NO: 888747 - protein, 962 aa, Homo sapiens; identical to SEQ ID NO: 888738

SEQ ID NO: 888748 - protein, 617 aa, Homo sapiens
MASNSTKSFLADAGYGEQELDANSALMELDKGLRSGKLGEQCEAVVRFPRLFQKYPFPILINSAFLKLADVFRVGNNFLRLCVLKVTQQSEKHLEKILNVDEFVKRIFSVIHSNDPVARAITLRMLGSLASIIPERKNAHHSIRQSLDSHDNVEVEAAVFAAANFSAQSKDFAVGICNKISEMIQGLATPVDLKLKLIPILQHMHHDAILASSARQLLQQLVTSYPSTKMVIVSLHTFTLLAASSLVDTPKQIQLLLQYLKNDPRKAVKRLAIQDLKLLANKTPHTWSRENIQALCECALQTPYDSLKLGMLSVLSTLSGTIAIKHYFSIVPGNVSSSPRSSDLVKLAQECCYHNNRGIAAHGVRVLTNITVSCQEKDLLALEQDAVFGLESLLVLCSQDDSPGAQATLKIALNCMVKLAKGRPHLSQSVVETLLTQLHSAQDAARILMCHCLAAIAMQLPVLGDGMLGDLMELYKVIGRSATDKQQELLVSLATVIFVASQKALSVESKAVIKQQLESVSNGWTVYRIARQASRMGNHDMAKELYQSLLTQVASEHFYFWLNSLKEFSHAEQCLTGLQEENYSSALSCIAESLKFYHKGIASLTFPGIWIYWNSPC

SEQ ID NO: 888749 - protein, 728 aa, Homo sapiens [sequence omitted]

SEQ ID NO: 888750 - protein, 736 aa, Homo sapiens [sequence omitted]

SEQ ID NO: 888751 - protein, 249 aa, Homo sapiens
MYVSSHTQKQLREPYFQEYGSTGTAHADSEYERRMMSVYNHVLEEVESLNRKYTPVSYMHTACLCNAIIALLKVPLSFQRYFFQKLQSTSIKLALSPSPRNPAEPIAVQNNQQLALKVEGVVQHGSKPGLFRKIQSVCLNVSSTLQSKSGQDYKIPIDNMTNEMEQRVEPHNDYFSTQFLLNFAILGTHNITVESSVKDANGIVWKTGPRTTIFVKSLEDPYSQQIRLQQQQAQQPLQQQQQRNAYTRF

SEQ ID NO: 888752 - protein, 107 aa, Homo sapiens [sequence omitted]

SEQ ID NO: 888753 - protein, 73 aa, Homo sapiens
GSAGSVGRPRNLIRDAAAQSEGGPKSRDSKRPVATRGAKEHSAFKRIGVRCSPLLPGVFCLLPEEEGSTGGFL

SEQ ID NO: 888754 - protein, 320 aa, Homo sapiens [sequence omitted]

SEQ ID NO: 888755 - protein, 70 aa, Homo sapiens
GSAGSVGRPRNLIRDAAAQSEGGPKSRDSKRPVATRGAKEHSAFKRIGVRCSPLLPGVFCLLPEEEGSTV

SEQ ID NO: 888756 - protein, 484 aa, Homo sapiens
MKTLETQPLAPDCCPSDQDPAPAHPSPHASPMNKNADSELMPPPPERGDPPRLSPDPVAGSAVSQELREGDPVSLSTPLETEFGSPSELSPRIEEQELSENTSLPAEEANGSLSEEEANGPELGSGKAMEDTSGEPAAEDEGDTAWNYSFSQLPRFLSGSWSEFSTQPENFLKGCKWAPDGSCILTNSADNILRIYNLPPELYHEGEQVEYAEMVPVLRMVEGDTIYDYCWYSLMSSAQPDTSYVASSSRENPIHIWDAFTGELRASFRAYNHLDELTAAHSLCFSPDGSQLFCGFNRTVRVFSTARPGRDCEVRATFAKKQGQSGIISCIAFSPAQPLYACGSYGRSLGLYAWDDGSPLALLGGHQGGITHLCFHPDGNRFFSGARKDAELLCWDLRQSGYPLWSLGREVTTNQRIYFDLDPTGQFLVSGSTSGAVSVWDTDGPGNDGKPEPVLSFLPQKDCTNGVRSSVQFQRCWGLGWGGR

SEQ ID NO: 888757 - protein, 111 aa, Homo sapiens
MLGNSYRHQTEGKLGAWTTGYRTCSSSQVLAQAQCKHSPSGLSVSVRFWNPFLCVRESDRIDDVPLELGNPCVYSRRELTITSLVFFACLGEIQSLRNGKGSSWISLEGRH

SEQ ID NO: 888758 - protein, 111 aa, Homo sapiens; identical to SEQ ID NO: 888757

SEQ ID NO: 888759 - protein, 111 aa, Homo sapiens; identical to SEQ ID NO: 888757

SEQ ID NO: 888760 - protein, 111 aa, Homo sapiens; identical to SEQ ID NO: 888757

SEQ ID NO: 888761 - protein, 111 aa, Homo sapiens; identical to SEQ ID NO: 888757

SEQ ID NO: 888762 - protein, 111 aa, Homo sapiens; identical to SEQ ID NO: 888757

SEQ ID NO: 888763 - protein, 491 aa, Homo sapiens
MAGQGLPLHVATLLTGLLECLGFAGVLFGWPSLVFVFKNEDYFKDLCGPDAGPIGNATGQADCKAQDERFSLIFTLGSFMNNFMTFPTGYIFDRFKTTVARLIAIFFYTTATLIIAFTSAGSAVLLFLAMPMLTIGGILFLITNLQIGNLFGQHRSTIITLYNGAFDSSSAVFLIIKLLYEKGISLRASFIFISVCSTWHVARTFLLMPRGHIPYPLPPNYSYGLCPGNGTTKEEKETAEHENRELQSKEFLSAKEETPGAGQKQELRSFWSYAFSRRFAWHLVWLSVIQLWHYLFIGTLNSLLTNMAGGDMARVSTYTNAFAFTQFGVLCAPWNGLLMDRLKQKYQKEARKTGSSTLAVALCSTVPSLALTSLLCLGFALCASVPILPLQYLTFILQVISRSFLYGSNAAFLTLAFPSEHFGKLFGLVMALSAVVSLLQFPIFTLIKGSLQNDPFYVNVMFMLAILLTFFHPFLVYRECRTWKESPSAIA

SEQ ID NO: 888764 - protein, 152 aa, Homo sapiens
DFFLLLLQLLYEKGISLRASFIFISVCSTWHVARTFLLMPRGHIPYPLPPNYSYGLCPGNGTTKEEKETAEHENRELQSKEFLSAKEETPGAGQKQELRSFWSYAFSRRFAWHLVWLSVIQLWHYLFIATRSLIRVAMSLRREGREVSRGRL

SEQ ID NO: 888765 - protein, 503 aa, Homo sapiens
MAGQGLPLHVATLLTGLLECLGFAGVLFGWPSLVFVFKNEDYFKDLCGPDAGPIGNATGQADCKAQDERFSLIFTLGSFMNNFMTFPTGYIFDRFKTTVARLIAIFFYTTATLIIAFTSAGSAVLLFLAMPMLTIGGILFLITNLQIGNLFGQHRSTIITLYNGAFDSSSAVFLIIKLLYEKGISLRASFIFISVCSTWHVARTFLLMPRGHIPYPLPPNYSYGPWPCWWGFCFHSLCPGNGTTKEEKETAEHENRELQSKEFLSAKEETPGAGQKQELRSFWSYAFSRRFAWHLVWLSVIQLWHYLFIGTLNSLLTNMAGGDMARVSTYTNAFAFTQFGVLCAPWNGLLMDRLKQKYQKEARKTGSSTLAVALCSTVPSLALTSLLCLGFALCASVPILPLQYLTFILQVISRSFLYGSNAAFLTLAFPSEHFGKLFGLVMALSAVVSLLQFPIFTLIKGSLQNDPFYVNVMFMLAILLTFFHPFLVYRECRTWKESPSAIA

SEQ ID NO: 888766 - protein, 491 aa, Homo sapiens; identical to SEQ ID NO: 888763

SEQ ID NO: 888767 - protein, 105 aa, Homo sapiens
YIQREREREREHTHTHTHTHTQNKDTQGRLRSKKRISVAKQIDITQTQSKGMWNFFISKQKCLLALSLGRPLTPGEMTWGRKCVNYFFRPVWLRSLYVPGSSATG

SEQ ID NO: 888768 - protein, 134 aa, Homo sapiens
MAGQGLPLHVATLLTGLLECLGFAGVLFGWPSLVFVFKNEDYFKDLCGPDAGPIGNATGQADCKAQDERFSLIFTLGSFMNNFMTFPTGYIFDRFKTTVARLIAIFFYTTATLIIAFTSAGAVAHSCNPSTLGG

SEQ ID NO: 888769 - protein, 491 aa, Homo sapiens; identical to SEQ ID NO: 888763

SEQ ID NO: 888770 - protein, 491 aa, Homo sapiens; identical to SEQ ID NO: 888763

SEQ ID NO: 888771 - protein, 491 aa, Homo sapiens; identical to SEQ ID NO: 888763

SEQ ID NO: 888772 - protein, 504 aa, Homo sapiens
MAGQGLPLHVATLLTGLLECLGFAGVLFGWPSLVFVFKNEDYFKDLCGPDAGPIGNATGQAGRLGCMGDLFSTPDCKAQDERFSLIFTLGSFMNNFMTFPTGYIFDRFKTTVARLIAIFFYTTATLIIAFTSAGSAVLLFLAMPMLTIGGILFLITNLQIGNLFGQHRSTIITLYNGAFDSSSAVFLIIKLLYEKGISLRASFIFISVCSTWHVARTFLLMPRGHIPYPLPPNYSYGLCPGNGTTKEEKETAEHENRELQSKEFLSAKEETPGAGQKQELRSFWSYAFSRRFAWHLVWLSVIQLWHYLFIGTLNSLLTNMAGGDMARVSTYTNAFAFTQFGVLCAPWNGLLMDRLKQKYQKEARKTGSSTLAVALCSTVPSLALTSLLCLGFALCASVPILPLQYLTFILQVISRSFLYGSNAAFLTLAFPSEHFGKLFGLVMALSAVVSLLQFPIFTLIKGSLQNDPFYVNVMFMLAILLTFFHPFLVYRECRTWKESPSAIA

SEQ ID NO: 888773 - protein, 491 aa, Homo sapiens; identical to SEQ ID NO: 888763

SEQ ID NO: 888774 - protein, 366 aa, Homo sapiens
MAGQGLPLHVATLLTGLLECLGFAGVLFGWPSLVFVFKNEDYFKDLCGPDAGPIGNATGQADCKAQDERFSLIFTLGSFMNNFMTFPTGYIFDRFKTTVARLIAIFFYTTATLIIAFTSAGSAVLLFLAMPMLTIGGILFLITNLQIGNLFGQHRSTIITLYNGAFDSSSAVFLIIKLLYEKGISLRASFIFISVCSTWHVARTFLLMPRGHIPYPLPPNYSYGLCPGNGTTKEEKETAEHENRELQSKEFLSAKEETPGAGQKQELRSFWSYAFSRRFAWHLVWLSVIQLWHYLFIGTLNSLLTNMAGGDMARVSTYTNAFAFTQFGVLCAPWNGLLMDRLKQKYQKEARKTVSLQSTLASSLGW

SEQ ID NO: 888775 - protein, 105 aa, Homo sapiens
MPYLERKSLCNCIVQKPSLFSPEDGFVHLPPPLRTSCPKRLCLSQQNTHTHTHTHKIKTHKDVCAARKESQLPSRLISHRLKAKACGTSLFQNRSVSLHLALADP

SEQ ID NO: 888776 - protein, 196 aa, Homo sapiens
SGGSRSEEPGAGNRESGSREPGLAAAAMSTVDLARVGACILKHAVTGEAVELRSLWREHACVVAGLRRFGCVVCRWIAQDLSSLAGLLDQHGVRLVGVGPEALGLQEFLDGDYFAGELYLDESKQLYKELGFKRYNSLSILPAALGKPVRDVAAKAKAVGIQGNLSGDLLQSGGLLVVSKGGSREGPRPLPQGGPC

SEQ ID NO: 888777 - protein, 195 aa, Homo sapiens
GQQLSRKARIEEAGGTEAGGPRIWRRDLEAWPGAVELRSLWREHACVVAGLRRFGCVVCRWIAQDLSSLAGLLDQHGVRLVGVGPEALGLQEFLDGDYFAGELYLDESKQLYKELGFKRYNSLSILPAALGKPVRDVAAKAKAVGIQGNLSGDLLQSGGLLVVSKEVPRRLRPQGAHPAGPGHLCGGLCQRPASV

SEQ ID NO: 888778 - protein, 210 aa, Homo sapiens
GQQLSRKARIEEAGGTEAGGPRIWRRDLEAWPGAVELRSLWREHACVVAGLRRFGCVVCRWIAQDLSSLAGLLDQHGVRLVGVGPEALGLQEFLDGDYFAGELYLDESKQLYKELGFKRYNSLSILPAALGKPVRDVAAKAKAVGIQGNLSGDLLQSGGLLVVSKGGDKVLLHFVQKSPGDYVPKEHILQVLGISAEVCASDPPQCDREV

SEQ ID NO: 888779 - protein, 249 aa, Homo sapiens
SGGSRSEEPGAGNRESGSREPGLAAAAMSTVDLARVGACILKHAVTGEAVELRSLWREHACVVAGLRRFGCVVCRWIAQDLSSLAGLLDQHGVRLVGVGPEALGLQEFLDGDYFAGELYLDESKQLYKELGFKRYNSLSILPAALGKPVRDVAAKAVPTPDRPRLLASRGTCLGTCCRAEGCWWSAKVVIKCSCISSRSPQATTSPRSTSCRSWASLRRSVPATRLSVTERCEGGEGPGLRGSGWRLLP

SEQ ID NO: 888780 - protein, 217 aa, Homo sapiens
SGGSRSEEPGAGNRESGSREPGLAAAAMSTVDLARVGACILKHAVTGEAVELRSLWREHACVVAGLRRFGCVVCRWIAQDLSSLAGLLDQHGVRLVGVGPEALGLQEFLDGDYFAGELYLDESKQLYKELGFKRYNSLSILPAALGKPVRDVAAKVVIKCSCISSRSPQATTSPRSTSCRSWASLRRSVPATRLSVTERCEGGEGPGLRGSGWRLLP

SEQ ID NO: 888781 - protein, 172 aa, Homo sapiens
QYEPVVIGRVGRTVPEALGRDAEPLLIRRQQRAIKTAVPDHALLRRLRALHPPQPPPCSLLGPQGGQGGCESQVSSSCSATFSGDLGPLACGALGMVTSLPRHSLQRRQTQAHVRRGAWGQLQQGRGQCLCLVGATQESWVFRAEMGLIPPGGVGGPWRLSGDGPACPKALY

SEQ ID NO: 888782 - protein, 225 aa, Homo sapiens
SGGSRSEEPGAGNRESGSREPGLAAAAMSTVDLARVGACILKHAVTGEAVELRSLWREHACVVAGLRRFGCVVCRWIAQDLSSLAGLLDQHGVRLVGVGPEALGLQEFLDGDYFAGELYLDESKQLYKELGFKRYNSLSILPAALGKPVRDVAAKAKAVGIQGNLSGDLLQSGGLLVVSKGGDKVLLHFVQKSPGDYVPKEHILQVLGISAEVCASDPPQCDREV

SEQ ID NO: 888783 - protein, 225 aa, Homo sapiens; identical to SEQ ID NO: 888782

SEQ ID NO: 888784 - protein, 225 aa, Homo sapiens; identical to SEQ ID NO: 888782

SEQ ID NO: 888785 - protein, 245 aa, Homo sapiens
GQQLSRKARIEEAGGTEAGGPRIWRRDLEAWPGAVELRSLWREHACVVAGLRRFGCVVCRWIAQDLSSLAGLLDQHGVRLVGVGPEALGLQEFLDGDYFAGELYLDESKQLYKELGFKRYNSLSILPAALGKPVRDVAAKVCAGQGCTGRGVVGAPRAFLLGLTQAVPTPDRPRLLASRGTCLGTCCRAEGCWWSAKVGRGRGLGHCLKEGLAELGGPAQALSLACQSHHSPSAAMWPGSACLLG

SEQ ID NO: 888786 - protein, 225 aa, Homo sapiens; identical to SEQ ID NO: 888782

SEQ ID NO: 888787 - protein, 217 aa, Homo sapiens
AGLGATGRAHDPAARQAVELRSLWREHACVVAGLRRFGCVVCRWIAQDLSSLAGLLDQHGVRLVGVGPEALGLQEFLDGDYFAGELYLDESKQLYKELGFKRYNSLSILPAALGKPVRDVAAKAVPTPDRPRLLASRGTCLGTCCRAEGCWWSAKVVIKCSCISSRSPQATTSPRSTSCRSWASLRRSVPATRLSVTERCEGGEGPGLRGSGWRLLP

SEQ ID NO: 888788 - protein, 195 aa, Homo sapiens; identical to SEQ ID NO: 888777

SEQ ID NO: 888789 - protein, 3703 aa, Homo sapiens
MEGCDSPVVSGKDNGCGIPQHQQWTELNSTHLPDKPSSMEQSTGESHGPLDSLRAPFNERLAESTASAGPPSEPASKEVTCNECSASFASLQTYMEHHCPSARPPPPLREESASDTGEEGDEESDVENLAGEIVYQPDGSAYIVESLSQLTQGGGACGSGSGSGPLPSLFLNSLPGAGGKQGDPSCAAPVYPQIINTFHIASSFGKWFEGPDQAFPNTSALAGLSPVLHSFRVFDVRHKSNKDYLNSDGSAKSSCVSKDVPNNVDLSKFDGFVLYGKRKPILMCFLCKLSFGYVRSFVTHAVHDHRMTLSEDERKILSNKNISAIIQGIGKDKEPLVSFLEPKNKNFQHPLVSTANLIGPGHSFYGKFSGIRMEGEEALPAGSAAGPEQPQAGLLTPSTLLNLGGLTSSVLKTPITSVPLGPLASSPTKSSEGKDSGAAEGEKQEVGDGDCFSEKVEPAEEEAEEEEEEEEAEEEEEEEEEEEEEEEDEGCKGLFPSELDEELEDRPHEEPGAAAGSSSKKDLALSNQSISNSPLMPNVLQTLSRGTASTSSNSASSFVVFDGANRRNRLSFNSEGVRANVAEGGRRLDFADESANKDNATAPEPNESTEGDDGGFVPHHQHAGSLCELGVGECPSGSGVECPKCDTVLGSSRSLGGHMTMMHSRNSCKTLKCPKCNWHYKYQQTLEAHMKEKHPEPGGSCVYCKSGQPHPRLARGESYTCGYKPFRCEVCNYSTTTKGNLSIHMQSDKHLNNMQNLQNGGGEQVFSHTAGAAAAAVAAAAAAANISSSCGAPSPTKPKTKPTWRCEVCDYETNVARNLRIHMTSEKHMHNMMLLQQNMTQIQHNRHLGLGSLPSPAEAELYQYYLAQNMNLPNLKMDSAASDAQFMMSGFQLDPAGPMAAMTPALVGGEIPLDMRLGGGQLVSEELMNLGESFIQTNDPSLKLFQCAVCNKFTTDNLDMLGLHMNVERSLSEDEWKAVMGDSYQCKLCRYNTQLKANFQLHCKTDKHVQKYQLVAHIKEGGKANEWRLKCVAIGNPVHLKCNACDYYTNSLEKLRLHTVNSRHEASLKLYKHLQQHESGVEGESCYYHCVLCNYSTKAKLNLIQHVRSMKHQRSESLRKLQRLQKGLPEEDEDLGQIFTIRRCPSTDPEEAIEDVEGPSETAADPEELAKDQEGGASSSQAEKELTDSPATSKRISFPGSSESPLSSKRPKTAEEIKPEQMYQCPYCKYSNADVNRLRVHAMTQHSVQPMLRCPLCQDMLNNKIHLQLHLTHLHSVAPDCVEKLIMTVTTPEMVMPSSMFLPAAVPDRDGNSNLEEAGKQPETSEDLGKNILPSASTEQSGDLKPSPADPGSVREDSGFICWKKGCNQVFKTSAALQTHFNEVHAKRPQLPVSDRHVYKYRCNQCSLAFKTIEKLQLHSQYHVIRAATMCCLCQRSFRTFQALKKHLETSHLELSEADIQQLYGGLLANGDLLAMGDPTLAEDHTIIVEEDKEEESDLEDKQSPTGSDSGSVQEDSGSEPKRALPFRKGPNFTMEKFLDPSRPYKCTVCKESFTQKNILLVHYNSVSHLHKLKRALQESATGQPEPTSSPDNKPFKCNTCNVAYSQSSTLEIHMRSVLHQTKARAAKLEAASGSSNGTGNSSSISLSSSTPSPVSTSGSNTFTTSNPSSAGIAPSSNLLSQVPTESVGMPPLGNPIGANIASPSEPKEANRKKLADMIASRQQQQQQQQQQQQQQQQQQQAQTLAQAQAQVQAHLQQELQQQAALIQSQLFNPTLLPHFPMTTETLLQLQQQQHLLFPFYIPSAEFQLNPEVSLPVTSGALTLTGTGPGLLEDLKAQVQVPQQSHQQILPQQQQNQLSIAQSHSALLQPSQHPEKKNKLVIKEKEKESQRERDSAEGGEGNTGPKETLPDALKAKEKKELAPGGGSEPSMLPPRIASDARGNATKALLENFGFELVIQYNENKQKVQKKNGKTDQGENLEKLECDSCGKLFSNILILKSHQEHVHQNYFPFKQLERFAKQYRDHYDKLYPLRPQTPEPPPPPPPPPPPPLPAAPPQPASTPAIPASAPPITSPTIAPAQPSVPLTQLSMPMELPIFSPLMMQTMPLQTLPAQLPPQLGPVEPLPADLAQLYQHQLNPTLLQQQNKRPRTRITDDQLRVLRQYFDINNSPSEEQIKEMADKSGLPQKVIKHWFRNTLFKERQRNKDSPYNFSNPPITSLEELKIDSRPPSPEPPKQEYWGSKRSSRTRFTDYQLRVLQDFFDANAYPKDDEFEQLSNLLNLPTRVIVVWFQNARQKARKNYENQGEGKDGERRELTNDRYIRTSNLNYQCKKCSLVFQRIFDLIKHQKKLCYKDEDEEGQDDSQNEDSMDAMEILTPTSSSCSTPMPSQAYSAPAPSANNTASSAFLQLTAEAEELATFNSKTEAGDEKPKLAEAPSAQPNQTQEKQGQPKPELQQQEQPEQKTNTPQQKLPQLVSLPSLPQPPPQAPPPQCPLPQSSPSPSQLSHLPLKPLHTSTPQQLANLPPQLIPYQCDQCKLAFPSFEHWQEHQQLHFLSAQNQFIHPQFLDRSLDMPFMLFDPSNPLLASQLLSGAIPQIPASSATSPSTPTSTMNTLKRKLEEKASASPGENDSGTGGEEPQRDKRLRTTITPEQLEILYQKYLLDSNPTRKMLDHIAHEVGLKKRVVQVWFQNTRARERKGQFRAVGPAQAHRRCPFCRALFKAKTALEAHIRSRHWHEAKRAGYNLTLSAMLLDCDGGLQMKGDIFDGTSFSHLPPSSSDGQGVPLSPVSKTMELSPRTLLSPSSIKVEGIEDFESPSMSSVNLNFDQTKLDNDDCSSVNTAITDTTTGDEGNADNDSATGIATETKSSSAPNEGLTKAAMMAMSEYEDRLSSGLVSPAPSFYSKEYDNEGTVDYSETSSLADPCSPSPGASGSAGKSGDSGDRPGQKRFRTQMTNLQLKVLKSCFNDYRTPTMLECEVLGNDIGLPKRVVQVWFQNARAKEKKSKLSMAKHFGINQTSYEGPKTECTLCGIKYSARLSVRDHIFSQQHISKVKDTIGSQLDKEKEYFDPATVRQLMAQQELDRIKKANEVLGLAAQQQGMFDNTPLQALNLPTAYPALQGIPPVLLPGLNSPSLPGFTPSNTALTSPKPNLMGLPSTTVPSPGLPTSGLPNKPSSASLSSPTPAQATMAMGPQQPPQQQQQQQQPQVQQPPPPPAAQPPPTPQLPLQQQQQRKDKDSEKVKEKEKAHKGKGEPLPVPKKEKGEAPTATAATISAPLPTMEYAVDPAQLQALQAALTSDPTALLTSQFLPYFVPGFSPYYAPQIPGALQSGYLQPMYGMEGLFPYSPALSQALMGLSPGSLLQQYQQYQQSLQEAIQQQQQRQLQQQQQQKVQQQQPKASQTPVPPGAPSPDKDPAKESPKPEEQKNTPREVSPLLPKLPEEPEAESKSADSLYDPFIVPKVQYKLVCRKCQAGFSDEEAARSHLKSLCFFGQSVVNLQEMVLHVPTGGGGGGSGGGGGGGGGGGGGGSYHCLACESALCGEEALSQHLESALHKHRTITRAARNAKEHPSLLPHSACFPDPSTASTSQSAAHSNDSPPPPSAAAPSSASPHASRKSWPQVVSRASAAKPPSFPPLSSSSTVTSSSCSTSGVQPSMPTDDYSEESDTDLSQKSDGPASPVEGPKDPSCPKDSGLTSVGTDTFRL

SEQ ID NO: 888790 - protein, 3703 aa, Homo sapiens; identical to SEQ ID NO: 888789

SEQ ID NO: 888791 - protein, 552 aa, Homo sapiens [sequence omitted]

SEQ ID NO: 888792 - protein, 1232 aa, Homo sapiens
MEGCDSPVVSGKDNGCGIPQHQQWTELNSTHLPDKPSSMEQSTGESHGPLDSLRAPFNERLAESTASAGPPSEPASKEVTCNECSASFASLQTYMEHHCPSARPPPPLREESASDTGEEGDEESDVENLAGEIVYQPDGSAYIVESLSQLTQGGGACGSGSGSGPLPSLFLNSLPGAGGKQGDPSCAAPVYPQIINTFHIASSFGKWFEGPDQAFPNTSALAGLSPVLHSFRVFDVRHKSNKDYLNSDGSAKSSCVSKDVPNNVDLSKFDGFVLYGKRKPILMCFLCKLSFGYVRSFVTHAVHDHRMTLSEDERKILSNKNISAIIQGIGKDKEPLVSFLEPKNKNFQHPLVSTANLIGPGHSFYGKFSGIRMEGEEALPAGSAAGPEQPQAGLLTPSTLLNLGGLTSSVLKTPITSVPLGPLASSPTKSSEGKDSGAAEGEKQEVGDGDCFSEKVEPAEEEAEEEEEEEEAEEEEEEEEEEEEEEEDEGCKGLFPSELDEELEDRPHEEPGAAAGSSSKKDLALSNQSISNSPLMPNVLQTLSRGTASTSSNSASSFVVFDGANRRNRLSFNSEGVRANVAEGGRRLDFADESANKDNATAPEPNESTEGDDGGFVPHHQHAGSLCELGVGECPSGSGVECPKCDTVLGSSRSLGGHMTMMHSRNSCKTLKCPKCNWHYKYQQTLEAHMKEKHPEPGGSCVYCKSGQPHPRLARGESYTCGYKPFRCEVCNYSTTTKGNLSIHMQSDKHLNNMQNLQNGGGEQVFSHTAGAAAAAVAAAAAAANISSSCGAPSPTKPKTKPTWRCEVCDYETNVARNLRIHMTSEKHMHNMMLLQQNMTQIQHNRHLGLGSLPSPAEAELYQYYLAQNMNLPNLKMDSAASDAQFMMSGFQLDPAGPMAAMTPALVGGEIPLDMRLGGGQLVSEELMNLGESFIQTNDPSLKLFQCAVCNKFTTDNLDMLGLHMNVERSLSEDEWKAVMGDSYQCKLCRYNTQLKANFQLHCKTDKHVQKYQLVAHIKEGGKANEWRLKCVAIGNPVHLKCNACDYYTNSLEKLRLHTVNSRHEASLKLYKHLQQHESGVEGESCYYHCVLCNYSTKAKLNLIQHVRSMKHQRSESLRKLQRLQKGLPEEDEDLGQIFTIRRCPSTDPEEAIEDVEGPSETAADPEELAKDQEGGASSSQAEKELTDSPATSKRISFPGSSESPLSSKRPKTAEEIKPEQVRLEGTLLVGR

SEQ ID NO: 888793 - protein, 2781 aa, Homo sapiens
MRLGGGQLVSEELMNLGESFIQTNDPSLKLFQCAVCNKFTTDNLDMLGLHMNVERSLSEDEWKAVMGDSYQCKLCRYNTQLKANFQLHCKTDKHVQKYQLVAHIKEGGKANEWRLKCVAIGNPVHLKCNACDYYTNSLEKLRLHTVNSRHEASLKLYKHLQQHESGVEGESCYYHCVLCNYSTKAKLNLIQHVRSMKHQRSESLRKLQRLQKGLPEEDEDLGQIFTIRRCPSTDPEEAIEDVEGPSETAADPEELAKDQEGGASSSQAEKELTDSPATSKRISFPGSSESPLSSKRPKTAEEIKPEQMYQCPYCKYSNADVNRLRVHAMTQHSVQPMLRCPLCQDMLNNKIHLQLHLTHLHSVAPDCVEKLIMTVTTPEMVMPSSMFLPAAVPDRDGNSNLEEAGKQPETSEDLGKNILPSASTEQSGDLKPSPADPGSVREDSGFICWKKGCNQVFKTSAALQTHFNEVHAKRPQLPVSDRHVYKYRCNQCSLAFKTIEKLQLHSQYHVIRAATMCCLCQRSFRTFQALKKHLETSHLELSEADIQQLYGGLLANGDLLAMGDPTLAEDHTIIVEEDKEEESDLEDKQSPTGSDSGSVQEDSGSEPKRALPFRKGPNFTMEKFLDPSRPYKCTVCKESFTQKNILLVHYNSVSHLHKLKRALQESATGQPEPTSSPDNKPFKCNTCNVAYSQSSTLEIHMRSVLHQTKARAAKLEAASGSSNGTGNSSSISLSSSTPSPVSTSGSNTFTTSNPSSAGIAPSSNLLSQVPTESVGMPPLGNPIGANIASPSEPKEANRKKLADMIASRQQQQQQQQQQQQQQQQQQQAQTLAQAQAQVQAHLQQELQQQAALIQSQLFNPTLLPHFPMTTETLLQLQQQQHLLFPFYIPSAEFQLNPEVSLPVTSGALTLTGTGPGLLEDLKAQVQVPQQSHQQILPQQQQNQLSIAQSHSALLQPSQHPEKKNKLVIKEKEKESQRERDSAEGGEGNTGPKETLPDALKAKEKKELAPGGGSEPSMLPPRIASDARGNATKALLENFGFELVIQYNENKQKVQKKNGKTDQGENLEKLECDSCGKLFSNILILKSHQEHVHQNYFPFKQLERFAKQYRDHYDKLYPLRPQTPEPPPPPPPPPPPPLPAAPPQPASTPAIPASAPPITSPTIAPAQPSVPLTQLSMPMELPIFSPLMMQTMPLQTLPAQLPPQLGPVEPLPADLAQLYQHQLNPTLLQQQNKRPRTRITDDQLRVLRQYFDINNSPSEEQIKEMADKSGLPQKVIKHWFRNTLFKERQRNKDSPYNFSNPPITSLEELKIDSRPPSPEPPKQEYWGSKRSSRTRFTDYQLRVLQDFFDANAYPKDDEFEQLSNLLNLPTRVIVVWFQNARQKARKNYENQGEGKDGERRELTNDRYIRTSNLNYQCKKCSLVFQRIFDLIKHQKKLCYKDEDEEGQDDSQNEDSMDAMEILTPTSSSCSTPMPSQAYSAPAPSANNTASSAFLQLTAEAEELATFNSKTEAGDEKPKLAEAPSAQPNQTQEKQGQPKPELQQQEQPEQKTNTPQQKLPQLVSLPSLPQPPPQAPPPQCPLPQSSPSPSQLSHLPLKPLHTSTPQQLANLPPQLIPYQCDQCKLAFPSFEHWQEHQQLHFLSAQNQFIHPQFLDRSLDMPFMLFDPSNPLLASQLLSGAIPQIPASSATSPSTPTSTMNTLKRKLEEKASASPGENDSGTGGEEPQRDKRLRTTITPEQLEILYQKYLLDSNPTRKMLDHIAHEVGLKKRVVQVWFQNTRARERKGQFRAVGPAQAHRRCPFCRALFKAKTALEAHIRSRHWHEAKRAGYNLTLSAMLLDCDGGLQMKGDIFDGTSFSHLPPSSSDGQGVPLSPVSKTMELSPRTLLSPSSIKVEGIEDFESPSMSSVNLNFDQTKLDNDDCSSVNTAITDTTTGDEGNADNDSATGIATETKSSSAPNEGLTKAAMMAMSEYEDRLSSGLVSPAPSFYSKEYDNEGTVDYSETSSLADPCSPSPGASGSAGKSGDSGDRPGQKRFRTQMTNLQLKVLKSCFNDYRTPTMLECEVLGNDIGLPKRVVQVWFQNARAKEKKSKLSMAKHFGINQTSYEGPKTECTLCGIKYSARLSVRDHIFSQQHISKVKDTIGSQLDKEKEYFDPATVRQLMAQQELDRIKKANEVLGLAAQQQGMFDNTPLQALNLPTAYPALQGIPPVLLPGLNSPSLPGFTPSNTALTSPKPNLMGLPSTTVPSPGLPTSGLPNKPSSASLSSPTPAQATMAMGPQQPPQQQQQQQQPQVQQPPPPPAAQPPPTPQLPLQQQQQRKDKDSEKVKEKEKAHKGKGEPLPVPKKEKGEAPTATAATISAPLPTMEYAVDPAQLQALQAALTSDPTALLTSQFLPYFVPGFSPYYAPQIPGALQSGYLQPMYGMEGLFPYSPALSQALMGLSPGSLLQQYQQYQQSLQEAIHSSSSKKCSSSSPKQAKPQSPPGLLPQTKTLPKNPPNQKNRKTPPVRCPPSCRNSLKSQKQKAKVLDSLYDPFIVPKVQYKLVCRKCQAGFSDEEAARSHLKSLCFFGQSVVNLQEMVLHVPTGGGGGGSGGGGGGGGGGGGGGSYHCLACESALCGEEALSQHLESALHKHRTITRAARNAKEHPSLLPHSACFPDPSTASTSQSAAHSNDSPPPPSAAAPSSASPHASRKSWPQVVSRASAAKPPSFPPLSSSSTVTSSSCSTSGVQPSMPTDDYSEESDTDLSQKSDGPASPVEGPKDPSCPKDSGLTSVGTDTFRL

SEQ ID NO: 888794 - protein, 3681 aa, Homo sapiens
MEGCDSPVVSGKDNGCGIPQHQQWTELNSTHLPDKPSSMEQSTGESHGPLDSLRAPFNERLAESTASAGPPSEPASKEVTCNECSASFASLQTYMEHHCPSARPPPPLREESASDTGEEGDEESDVENLAGEIVYQPDGSAYIVESLSQLTQGGGACGSGSGSGPLPSLFLNSLPGAGGKQGDPSCAAPVYPQIINTFHIASSFGKWFEGPDQAFPNTSALAGLSPVLHSFRVFDVRHKSNKDYLNSDGSAKSSCVSKDVPNNVDLSKFDGFVLYGKRKPILMCFLCKLSFGYVRSFVTHAVHDHRMTLSEDERKILSNKNISAIIQGIGKDKEPLVSFLEPKNKNFQHPLVSTANLIGPGHSFYGKFSGIRMEGEEALPAGSAAGPEQPQAGLLTPSTLLNLGGLTSSVLKTPITSVPLGPLASSPTKSSEGKDSGAAEGEKQEVGDGDCFSEKVEPAEEEAEEEEEEEEAEEEEEEEEEEEEEEEDEGCKGLFPSELDEELEDRPHEEPGAAAGSSSKKDLALSNQSISNSPLMPNVLQTLSRGTASTSSNSASSFVVFDGANRRNRLSFNSEGVRANVAEGGRRLDFADESANKDNATAPEPNESTEGDDGGFVPHHQHAGSLCELGVGECPSGSGVECPKCDTVLGSSRSLGGHMTMMHSRNSCKTLKCPKCNWHYKYQQTLEAHMKEKHPEPGGSCVYCKSGQPHPRLARGESYTCGYKPFRCEVCNYSTTTKGNLSIHMQSDKHLNNMQNLQNGGGEQVFSHTAGAAAAAVAAAAAAANISSSCGAPSPTKPKTKPTWRCEVCDYETNVARNLRIHMTSEKHMHNMMLLQQNMTQIQHNRHLGLGSLPSPAEAELYQYYLAQNMNLPNLKMDSAASDAQFMMSGFQLDPAGPMAAMTPALVGGEIPLDMRLGGGQLVSEELMNLGESFIQTNDPSLKLFQCAVCNKFTTDNLDMLGLHMNVERSLSEDEWKAVMGDSYQCKLCRYNTQLKANFQLHCKTDKHVQKYQLVAHIKEGGKANEWRLKCVAIGNPVHLKCNACDYYTNSLEKLRLHTVNSRHEASLKLYKHLQQHESGVEGESCYYHCVLCNYSTKAKLNLIQHVRSMKHQRSESLRKLQRLQKGLPEEDEDLGQIFTIRRCPSTDPEEAIEDVEGPSETAADPEELAKDQEGGASSSQAEKELTDSPATSKRISFPGSSESPLSSKRPKTAEEIKPEQMYQCPYCKYSNADVNRLRVHAMTQHSVQPMLRCPLCQDMLNNKIHLQLHLTHLHSVAPDCVEKLIMTVTTPEMVMPSSMFLPAAVPDRDGNSNLEEAGKQPETSEDLGKNILPSASTEQSGDLKPSPADPGSVREDSGFICWKKGCNQVFKTSAALQTHFNEVHAKRPQLPVSDRHVYKYRCNQCSLAFKTIEKLQLHSQYHVIRAATMCCLCQRSFRTFQALKKHLETSHLELSEADIQQLYGGLLANGDLLAMGDPTLAEDHTIIVEEDKEEESDLEDKQSPTGSDSGSVQEDSGSEPKRALPFRKGPNFTMEKFLDPSRPYKCTVCKESFTQKNILLVHYNSVSHLHKLKRALQESATGQPEPTSSPDNKPFKCNTCNVAYSQSSTLEIHMRSVLHQTKARAAKLEAASGSSNGTGNSSSISLSSSTPSPVSTSGSNTFTTSNPSSAGIAPSSNLLSQVPTESVGMPPLGNPIGANIASPSEPKEANRKKLADMIASRQQQQQQQQQQQQQQQQQQQAQTLAQAQAQVQAHLQQELQQQAALIQSQLFNPTLLPHFPSAEFQLNPEVSLPVTSGALTLTGTGPGLLEDLKAQVQVPQQSHQQILPQQQQNQLSIAQSHSALLQPSQHPEKKNKLVIKEKEKESQRERDSAEGGEGNTGPKETLPDALKAKEKKELAPGGGSEPSMLPPRIASDARGNATKALLENFGFELVIQYNENKQKVQKKNGKTDQGENLEKLECDSCGKLFSNILILKSHQEHVHQNYFPFKQLERFAKQYRDHYDKLYPLRPQTPEPPPPPPPPPPPPLPAAPPQPASTPAIPASAPPITSPTIAPAQPSVPLTQLSMPMELPIFSPLMMQTMPLQTLPAQLPPQLGPVEPLPADLAQLYQHQLNPTLLQQQNKRPRTRITDDQLRVLRQYFDINNSPSEEQIKEMADKSGLPQKVIKHWFRNTLFKERQRNKDSPYNFSNPPITSLEELKIDSRPPSPEPPKQEYWGSKRSSRTRFTDYQLRVLQDFFDANAYPKDDEFEQLSNLLNLPTRVIVVWFQNARQKARKNYENQGEGKDGERRELTNDRYIRTSNLNYQCKKCSLVFQRIFDLIKHQKKLCYKDEDEEGQDDSQNEDSMDAMEILTPTSSSCSTPMPSQAYSAPAPSANNTASSAFLQLTAEAEELATFNSKTEAGDEKPKLAEAPSAQPNQTQEKQGQPKPELQQQEQPEQKTNTPQQKLPQLVSLPSLPQPPPQAPPPQCPLPQSSPSPSQLSHLPLKPLHTSTPQQLANLPPQLIPYQCDQCKLAFPSFEHWQEHQQLHFLSAQNQFIHPQFLDRSLDMPFMLFDPSNPLLASQLLSGAIPQIPASSATSPSTPTSTMNTLKRKLEEKASASPGENDSGTGGEEPQRDKRLRTTITPEQLEILYQKYLLDSNPTRKMLDHIAHEVGLKKRVVQVWFQNTRARERKGQFRAVGPAQAHRRCPFCRALFKAKTALEAHIRSRHWHEAKRAGYNLTLSAMLLDCDGGLQMKGDIFDGTSFSHLPPSSSDGQGVPLSPVSKTMELSPRTLLSPSSIKVEGIEDFESPSMSSVNLNFDQTKLDNDDCSSVNTAITDTTTGDEGNADNDSATGIATETKSSSAPNEGLTKAAMMAMSEYEDRLSSGLVSPAPSFYSKEYDNEGTVDYSETSSLADPCSPSPGASGSAGKSGDSGDRPGQKRFRTQMTNLQLKVLKSCFNDYRTPTMLECEVLGNDIGLPKRVVQVWFQNARAKEKKSKLSMAKHFGINQTSYEGPKTECTLCGIKYSARLSVRDHIFSQQHISKVKDTIGSQLDKEKEYFDPATVRQLMAQQELDRIKKANEVLGLAAQQQGMFDNTPLQALNLPTAYPALQGIPPVLLPGLNSPSLPGFTPSNTALTSPKPNLMGLPSTTVPSPGLPTSGLPNKPSSASLSSPTPAQATMAMGPQQPPQQQQQQQQPQVQQPPPPPAAQPPPTPQLPLQQQQQRKDKDSEKVKEKEKAHKGKGEPLPVPKKEKGEAPTATAATISAPLPTMEYAVDPAQLQALQAALTSDPTALLTSQFLPYFVPGFSPYYAPQIPGALQSGYLQPMYGMEGLFPYSPALSQALMGLSPGSLLQQYQQYQQSLQEAIQQQQQRQLQQQQQQKVQQQQPKASQTPVPPGAPSPDKDPAKESPKPEEQKNTPREVSPLLPKLPEEPEAESKSADSLYDPFIVPKVQYKLVCRKCQAGFSDEEAARSHLKSLCFFGQSVVNLQEMVLHVPTGGGGGGSGGGGGGGGGGGGGGSYHCLACESALCGEEALSQHLESALHKHRTITRAARNAKEHPSLLPHSACFPDPSTASTSQSAAHSNDSPPPPSAAAPSSASPHASRKSWPQVVSRASAAKPPSFPPLSSSSTVTSSSCSTSGVQPSMPTDDYSEESDTDLSQKSDGPASPVEGPKDPSCPKDSGLTSVGTDTFRL

SEQ ID NO: 888795 - protein, 3651 aa, Homo sapiens
MEGCDSPVVSGKDNGCGIPQHQQWTELNSTHLPDKPSSMEQSTGESHGPLDSLRAPFNERLAESTASAGPPSEPASKEVTCNECSASFASLQTYMEHHCPSARPPPPLREESASDTGEEGDEESDVENLAGEIVYQPDGSAYIVESLSQLTQGGGACGSGSGSGPLPSLFLNSLPGAGGKQGDPSCAAPVYPQIINTFHIASSFGKWFEGPDQAFPNTSALAGLSPVLHSFRVFDVRHKSNKDYLNSDGSAKSSCVSKDVPNNVDLSKFDGFVLYGKRKPILMCFLCKLSFGYVRSFVTHAVHDHRMTLSEDERKILSNKNISAIIQGIGKDKEPLVSFLEPKNKNFQHPLVSTANLIGPGHSFYGKFSGIRMEGEEALPAGSAAGPEQPQAGLLTPSTLLNLGGLTSSVLKTPITSVPLGPLASSPTKSSEGKDSGAAEGEKQEVGDGDCFSEKVEPAEEEAEEEEEEEEAEEEEEEEEEEEEEEEDEGCKGLFPSELDEELEDRPHEEPGAAAGSSSKKDLALSNQSISNSPLMPNVLQTLSRGTASTSSNSASSFVVFDGANRRNRLSFNSEGVRANVAEGGRRLDFADESANKDNATAPEPNESTEGDDGGFVPHHQHAGSLCELGVGECPSGSGVECPKCDTVLGSSRSLGGHMTMMHSRNSCKTLKCPKCNWHYKYQQTLEAHMKEKHPEPGGSCVYCKSGQPHPRLARGESYTCGYKPFRCEVCNYSTTTKGNLSIHMQSDKHLNNMQNLQNGGGEQVFSHTAGAAAAAVAAAAAAANISSSCGAPSPTKPKTKPTWRCEVCDYETNVARNLRIHMTSEKHMHNMMLLQQNMTQIQHNRHLGLGSLPSPAEAELYQYYLAQNMNLPNLKMDSAASDAQFMMSGFQLDPAGPMAAMTPALVGGEIPLDMRLGGGQLVSEELMNLGESFIQTNDPSLKLFQCAVCNKFTTDNLDMLGLHMNVERSLSEDEWKAVMGDSYQCKLCRYNTQLKANFQLHCKTDKHVQKYQLVAHIKEGGKANEWRLKCVAIGNPVHLKCNACDYYTNSLEKLRLHTVNSRHEASLKLYKHLQQHESGVEGESCYYHCVLCNYSTKAKLNLIQHVRSMKHQRSESLRKLQRLQKGLPEEDEDLGQIFTIRRCPSTDPEEAIEDVEGPSETAADPEELAKDQEGGASSSQAEKELTDSPATSKRISFPGSSESPLSSKRPKTAEEIKPEQMYQCPYCKYSNADVNRLRVHAMTQHSVQPMLRCPLCQDMLNNKIHLQLHLTHLHSVAPDCVEKLIMTVTTPEMVMPSSMFLPAAVPDRDGNSNLEEAGKQPETSEDLGKNILPSASTEQSGDLKPSPADPGSVREDSGFICWKKGCNQVFKTSAALQTHFNEVHAKRPQLPVSDRHVYKYRCNQCSLAFKTIEKLQLHSQYHVIRAATMCCLCQRSFRTFQALKKHLETSHLELSEADIQQLYGGLLANGDLLAMGDPTLAEDHTIIVEEDKEEESDLEDKQSPTGSDSGSVQEDSGSEPKRALPFRKGPNFTMEKFLDPSRPYKCTVCKESFTQKNILLVHYNSVSHLHKLKRALQESATGQPEPTSSPDNKPFKCNTCNVAYSQSSTLEIHMRSVLHQTKARAAKLEAASGSSNGTGNSSSISLSSSTPSPVSTSGSNTFTTSNPSSAGIAPSSNLLSQVPTESVGMPPLGNPIGANIASPSEPKEANRKKLADMIASRQQQQQQQQQQQQQQQQQQQAQTLAQAQAQVQAHLQQELQQQAALIQSQLFNPTLLPHFPMTTETLLQLQQQQHLLFPFYIPSAEFQLNPEVSLPVTSGALTLTGTGPGLLEDLKAQVQVPQQSHQQILPQQQQNQLSIAQSHSALLQPSQHPEKKNKLVIKEKEKESQRERDSAEGGEGNTGPKETLPDALKAKEKKELAPGGGSEPSMLPPRIASDARGNATKALLENFGFELVIQYNENKQKVQKKNGKTDQGENLEKLECDSCGKLFSNILILKSHQEHVHQNYFPFKQLERFAKQYRDHYDKLYPLRPQTPEPPPPPPPPPPPPLPAAPPQPASTPAIPASAPPITSPTIAPAQPSVPLTQLSMPMELPIFSPLMMQTMPLQTLPAQLPPQLGPVEPLPADLAQLYQHQLNPTLLQQQNKRPRTRITDDQLRVLRQYFDINNSPSEEQIKEMADKSGLPQKVIKHWFRNTLFKERQRNKDSPYNFSNPPITSLEELKIDSRPPSPEPPKQEYWGSKRSSRTRFTDYQLRVLQDFFDANAYPKDDEFEQLSNLLNLPTRVIVVWFQNARQKARKNYENQGEGKDGERRELTNDRYIRTSNLNYQCKKCSLVFQRIFDLIKHQKKLCYKDEDEEGQDDSQNEDSMDAMEILTPTSSSCSTPMPSQAYSAPAPSANNTASSAFLQLTAEAEELATFNSKTEAGDEKPKLAEAPSAQPNQTQEKQGQPKPELQQQEQPEQKTNTPQQKLPQLVSLPSLPQPPPQAPPPQCPLPQSSPSPSQLSHLPLKPLHTSTPQQLANLPPQLIPYQCDQCKLAFPSFEHWQEHQQLHFLSAQNQFIHPQFLDRSLDMPFMLFDPSNPLLASQLLSGAIPQIPASSATSPSTPTSTMNTLKRKLEEKASASPGENDSGTGGEEPQRDKRLRTTITPEQLEILYQKYLLDSNPTRKMLDHIAHEVGLKKRVVQVWFQNTRARERKGQFRAVGPAQAHRRCPFCRALFKAKTALEAHIRSRHWHEAKRAGYNLTLSAMLLDCDGGLQMKGDIFDGTSFSHLPPSSSDGQGVPLSPVSKTMELSPRTLLSPSSIKVEGIEDFESPSMSSVNLNFDQTKLDNDDCSSVNTAITDTTTGDEGNADNDSATGIATETKSSSAPNEGLTKAAMMAMSEYEDRLSSGLVSPAPSFYSKEYDNEGTVDYSETSSLADPCSPSPGASGSAGKSGDSGDRPGQKRFRTQMTNLQLKVLKSCFNDYRTPTMLECEVLGNDIGLPKRVVQVWFQNARAKEKKSKLSMAKHFGINQTSYEGPKTECTLCGIKYSARLSVRDHIFSQQHISKVKDTIGSQLDKEKEYFDPATVRQLMAQQELDRIKKANEVLGLAAQQQGMFDNTPLQALNLPTAYPALQGIPPVLLPGLNSPSLPGFTPSNTALTSPKPNLMGLPSTTVPSPGLPTSGLPNKPSSASLSSPTPAQATMAMGPQQPPQQQQQQQQPQVQQPPPPPAAQPPPTPQLPLQQQQQRKDKDSEKVKEKEKAHKGKGEPLPVPKKEKGEAPTATAATISAPLPTMEYAVDPAQLQALQAALTSDPTALLTSQFLPYFVPGFSPYYAPQIPGALQSGYLQPMYGMEGLFPYSPALSQALMGLSPGSLLQQYQQYQQSLQEAIQQQQQRQLQQQQQQKVQQQQPKASQTPVPPGAPSPDKDPAKESPKPEEQKNTPREVSPLLPKLPEEPEAESKSADSLYDPFIVPKVQYKLVCRKCQAGFSDEEAARSHLKSLCFFGQSVVNLQEMVLHVPTGGGGGGSGGGGGGGGGGGGGGSYHCLACESALCGEEALSQHLESALHKHRTITRAARNAKEHPSLLPHSACFPDPSTASTSQSAAHSNDSPPRLQEVLAASGLPGFGSEAPFFSSSLLIFNGYLKFMQHLRGSALDANRRLFGGV

SEQ ID NO: 888796 - protein, 161 aa, Homo sapiens
HSSAPTSSASLRPLQPPPPPPPPPPPPGGGGGGGGGGSYHCLACESALCGEEALSQHLESALHKHRTITRAARNAKEHPSLLPHSACFPDPSTASTSQSAAHSNDSPPRLQEVLAASGLPGFGSEAPFFSSSLLIFNGYLKFMQHLRGSALDANRRLFGGV

SEQ ID NO: 888797 - protein, 743 aa, Homo sapiens
MEAVAVAAAVGVLLLAGAGGAAGDEAREAAAVRALVARLLGPGPAADFSVSVERALAAKPGLDTYSLGGGGAARVRVRGSTGVAAAAGLHRYLRDFCGCHVAWSGSQLRLPRPLPAVPGELTEATPNRYRYYQNVCTQSYSFVWWDWARWEREIDWMALNGINLALAWSGQEAIWQRVYLALGLTQAEINEFFTGPAFLAWGRMGNLHTWDGPLPPSWHIKQLYLQHRVLDQMRSFGMTPVLPAFAGHVPEAVTRVFPQVNVTKMGSWGHFNCSYSCSFLLAPEDPIFPIIGSLFLRELIKEFGTDHIYGADTFNEMQPPSSEPSYLAAATTAVYEAMTAVDTEAVWLLQGWLFQHQPQFWGPAQIRAVLGAVPRGRLLVLDLFAESQPVYTRTASFQGQPFIWCMLHNFGGNHGLFGALEAVNGGPEAARLFPNSTMVGTGMAPEGISQNEVVYSLMAELGWRKDPVPDLAAWVTSFAARRYGVSHPDAGAAWRLLLRSVYNCSGEACRGHNRSPLVRRPSLQMNTSIWYNRSDVFEAWRLLLTSAPSLATSPAFRYDLLDLTRQAVQELVSLYYEEARSAYLSKELASLLRAGGVLAYELLPALDEVLASDSRFLLGSWLEQARAAAVSEAEADFYEQNSRYQLTLWGPEGNILDYANKQLAGLVANYYTPRWRLFLEALVDSVAQGIPFQQHQFDKNVFQLEQAFVLSKQRYPSQPRGDTVDLAKKIFLKYYPGWVAGSW

SEQ ID NO: 888798 - protein, 255 aa, Homo sapiens
MEAVAVAAAVGVLLLAGAGGAAGDEAREAAAVRALVARLLGPGPAADFSVSVERALAAKPGLDTYSLGGGGAARVRVRGSTGVAAAAGLHRYLRDFCGCHVAWSGSQLRLPRPLPAVPGELTEATPNRYRYYQNVCTQSYSFVWWDWARWEREIDWMALNGINLALAWSGQEAIWQRVYLALGLTQAEINEFFTGPAFLAWGRMGNLHTWDGPLPPSWHIKQLYLQHRVLDQMRSFGMTPVLPAFAGHVPEAVTR

SEQ ID NO: 888799 - protein, 540 aa, Homo sapiens
MGNLHTWDGPLPPSWHIKQLYLQHRVLDQMRSFGMTPVLPAFAGHVPEAVTRVFPQVNVTKMGSWGHFNCSYSCSFLLAPEDPIFPIIGSLFLRELIKEFGTDHIYGADTFNEMQPPSSEPSYLAAATTAVYEAMTAVDTEAVWLLQGWLFQHQPQFWGPAQIRAVLGAVPRGRLLVLDLFAESQPVYTRTASFQGQPFIWCMLHNFGGNHGLFGALEAVNGGPEAARLFPNSTMVGTGMAPEGISQNEVVYSLMAELGWRKDPVPDLAAWVTSFAARRYGVSHPDAGAAWRLLLRSVYNCSGEACRGHNRSPLVRRPSLQMNTSIWYNRSDVFEAWRLLLTSAPSLATSPAFRYDLLDLTRQAVQELVSLYYEEARSAYLSKELASLLRAGGVLAYELLPALDEVLASDSRFLLGSWLEQARAAAVSEAEADFYEQNSRYQLTLWGPEGNILDYANKQLAGLVANYYTPRWRLFLEALVDSVAQGIPFQQHQFDKNVFQLEQAFVLSKQRYPSQPRGDTVDLAKKIFLKYYPGWVAGSW

SEQ ID NO: 888800 - protein, 309 aa, Homo sapiens
MEAVAVAAAVGVLLLAGAGGAAGDEAREAAAVRALVARLLGPGPAADFSVSVERALAAKPGLDTYSLGGGGAARVRVRGSTGVAAAAGLHRYLRDFCGCHVAWSGSQLRLPRPLPAVPGELTEATPNRYRYYQNVCTQSYSFVWWDWARWEREIDWMALNGINLALAWSGQEAIWQRVYLALGLTQAEINEFFTGPAFLAWGRMGNLHTWDGPLPPSWHIKQLYLQHRVLDQMRSFGMTPVLPAFAGHVPEAVTRRLRQENCLNLGGRRCSESRSRHCTPAWVTSETLSQTNKQALDVGLGLISDSATN

SEQ ID NO: 888801 - protein, 243 aa, Homo sapiens
MEAVAVAAAVGVLLLAGAGGAAGDEAREAAAVRALVARLLGPGPAADFSVSVERALAAKPGLDTYSLGGGGAARVRVRGSTGVAAAAGLHRYLRDFCGCHVAWSGSQLRLPRPLPAVPGELTEATPNRYRYYQNVCTQSYSFVWWDWARWEREIDWMALNGINLALAWSGQEAIWQRVRAHCPFPTLLYGGSHRRCFHPPPSMGAVSLSRSAFSVHSGLGLLKTEASGRARWLTPVIPALREA

SEQ ID NO: 888802 - protein, 743 aa, Homo sapiens; identical to SEQ ID NO: 888797

SEQ ID NO: 888803 - protein, 230 aa, Homo sapiens [sequence omitted]

SEQ ID NO: 888804 - protein, 90 aa, Homo sapiens
PFLLFLQHRVLDQMRSFGMTPVLPAFAGHVPEAVTRRLRQENCLNLGGRRCSESRSRHCTPAWVTSETLSQTNKQALDVGLGLISDSATN

SEQ ID NO: 888805 - protein, 338 aa, Homo sapiens
MAASQVLGEKINILSGETVKAGDRDPLGNDCPEQDRLPQRSWRQKCASYVLALRPWSFSASLTPVALGSALAYRSHGVLDPRLLVGCAVAVLAVHGAGNLVNTYYDFSKGIDHKKSDDRTLVDRILEPQDVVRFGVFLYTLGCVCAACLYYLSPLKLEHLALIYFGGLSGSFLYTGGIGFKYVALGDLIILITFGPLAVMFAYAIQVGSLAIFPLVYAIPLALSTEAILHSNNTRDMESDREAGIVTLAILIGPTFSYILYNTLLFLPYLVFSILATHCTISLALPLLTIPMAFSLERQFRSQAFNKLPQRTAKLNLLLGLFYVFGIILAPAGSLPKI

SEQ ID NO: 888806 - protein, 338 aa, Homo sapiens; identical to SEQ ID NO: 888805

SEQ ID NO: 888807 - protein, 179 aa, Homo sapiens
MAASQVLGEKINILSGETVKAGDRDPLGNDCPEQDRLPQRSWRQKCASYVLALRPWSFSASLTPVALGSALAYRSHGVLDPRLLVGCAVAVLAVHGAGNLVNTYYDFSKGIDHKKSDDRTLVDRILEPQDVVRFGVFLYTLGCVCAACLYYLSPLKLEHLALIYFGGLSGSFLYTGVLI

SEQ ID NO: 888808 - protein, 211 aa, Homo sapiens
MAASQVLGEKINILSGETVKAGDRDPLGNDCPEQDRLPQRSWRQKCASYVLALRPWSFSASLTPVALGSALAYRSHGVLDPRLLVGCAVAVLAVHGAGNLVNTYYDFSKGIDHKKSDDRTLVDRILEPQDVVRFGVFLYTLGCVCAACLYYLSPLKLEHLALIYFGGLSGSFLYTGGIGFKYVALGDLIILITFGPLAVMFAYAIQSSSSH

SEQ ID NO: 888809 - protein, 237 aa, Homo sapiens
MAASQVLGEKINILSGETVKAGDRDPLGNDCPEQDRLPQRSWRQKCASYVLALRPWSFSASLTPVALGSALAYRSHGVLDPRLLVGCAVAVLAVHGAGNLVNTYYDFSKGIDHKKSDDRTLVDRILEPQDVVRFGVFLYTLGCVCAACLYYLSPLKLEHLALIYFGGLSGSFLYTGGIGFKYVALGDLIILITFGPLAVMFAYAIQAGVQWCNLSSLQPLPPGFKRFSCLSLLSSWD

SEQ ID NO: 888810 - protein, 2250 aa, Homo sapiens
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQPIMNHNPWMLLYFISFLLIVAFFVLNMFVGVVVENFHKCRQHQEEEEARRREEKRLRRLEKKRRSKEKQMAEAQCKPYYSDYSRFRLLVHHLCTSHYLDLFITGVIGLNVVTMAMEHYQQPQILDEALKICNYIFTVIFVLESVFKLVAFGFRRFFQDRWNQLDLAIVLLSIMGITLEEIEVNASLPINPTIIRIMRVLRIARVLKLLKMAVGMRALLDTVMQALPQVGNLGLLFMLLFFIFAALGVELFGDLECDETHPCEGLGRHATFRNFGMAFLTLFRVSTGDNWNGIMKDTLRDCDQESTCYNTVISPIYFVSFVLTAQFVLVNVVIAVLMKHLEESNKEAKEEAELEAELELEMKTLSPQPHSPLGSPFLWPGVEGPDSPDSPKPGALHPAAHARSASHFSLEHPTMQPHPTELPGPDLLTVRKSGVSRTHSLPNDSYMCRHGSTAEGPLGHRGWGLPKAQSGSVLSVHSQPADTSYILQLPKDAPHLLQPHSAPTWGTIPKLPPPGRSPLAQRPLRRQAAIRTDSLDVQGLGSREDLLAEVSGPSPPLARAYSFWGQSSTQAQQHSRSHSKISKHMTPPAPCPGPEPNWGKGPPETRSSLELDTELSWISGDLLPPGGQEEPPSPRDLKKCYSVEAQSCQRRPTSWLDEQRRHSIAVSCLDSGSQPHLGTDPSNLGGQPLGGPGSRPKKKLSPPSITIDPPESQGPRTPPSPGICLRRRAPSSDSKDPLASGPPDSMAASPSPKKDVLSLSGLSSDPADLDP

SEQ ID NO: 888811 - protein, 2250 aa, Homo sapiens; identical to SEQ ID NO: 888810

SEQ ID NO: 888812 - protein, 2377 aa, Homo sapiens
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEEISKREDASGQLSCIQLPVDSQGGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQPIMNHNPWMLLYFISFLLIVAFFVLNMFVGVVVENFHKCRQHQEEEEARRREEKRLRRLEKKRRNLMLDDVIASGSSASAASEAQCKPYYSDYSRFRLLVHHLCTSHYLDLFITGVIGLNVVTMAMEHYQQPQILDEALKICNYIFTVIFVLESVFKLVAFGFRRFFQDRWNQLDLAIVLLSIMGITLEEIEVNASLPINPTIIRIMRVLRIARVLKLLKMAVGMRALLDTVMQALPQVGNLGLLFMLLFFIFAALGVELFGDLECDETHPCEGLGRHATFRNFGMAFLTLFRVSTGDNWNGIMKDTLRDCDQESTCYNTVISPIYFVSFVLTAQFVLVNVVIAVLMKHLEESNKEAKEEAELEAELELEMKTLSPQPHSPLGSPFLWPGVEGPDSPDSPKPGALHPAAHARSASHFSLEHPTDRQLFDTISLLIQGSLEWELKLMDELAGPGGQPSAFPSAPSLGGSDPQIPLAEMEALSLTSEIVSEPSCSLALTDDSLPDDMHTLLLSALESNMQPHPTELPGPDLLTVRKSGVSRTHSLPNDSYMCRHGSTAEGPLGHRGWGLPKAQSGSVLSVHSQPADTSYILQLPKDAPHLLQPHSAPTWGTIPKLPPPGRSPLAQRPLRRQAAIRTDSLDVQGLGSREDLLAEVSGPSPPLARAYSFWGQSSTQAQQHSRSHSKISKHMTPPAPCPGPEPNWGKGPPETRSSLELDTELSWISGDLLPPGGQEEPPSPRDLKKCYSVEAQSCQRRPTSWLDEQRRHSIAVSCLDSGSQPHLGTDPSNLGGQPLGGPGSRPKKKLSPPSITIDPPESQGPRTPPSPGICLRRRAPSSDSKDPLASGPPDSMAASPSPKKDVLSLSGLSSDPADLDP

SEQ ID NO: 888813 - protein, 2261 aa, Homo sapiens
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQPIMNHNPWMLLYFISFLLIVAFFVLNMFVGVVVENFHKCRQHQEEEEARRREEKRLRRLEKKRRNLMLDDVIASGSSASAASEAQCKPYYSDYSRFRLLVHHLCTSHYLDLFITGVIGLNVVTMAMEHYQQPQILDEALKICNYIFTVIFVLESVFKLVAFGFRRFFQDRWNQLDLAIVLLSIMGITLEEIEVNASLPINPTIIRIMRVLRIARVLKLLKMAVGMRALLDTVMQALPQVGNLGLLFMLLFFIFAALGVELFGDLECDETHPCEGLGRHATFRNFGMAFLTLFRVSTGDNWNGIMKDTLRDCDQESTCYNTVISPIYFVSFVLTAQFVLVNVVIAVLMKHLEESNKEAKEEAELEAELELEMKTLSPQPHSPLGSPFLWPGVEGPDSPDSPKPGALHPAAHARSASHFSLEHPTMQPHPTELPGPDLLTVRKSGVSRTHSLPNDSYMCRHGSTAEGPLGHRGWGLPKAQSGSVLSVHSQPADTSYILQLPKDAPHLLQPHSAPTWGTIPKLPPPGRSPLAQRPLRRQAAIRTDSLDVQGLGSREDLLAEVSGPSPPLARAYSFWGQSSTQAQQHSRSHSKISKHMTPPAPCPGPEPNWGKGPPETRSSLELDTELSWISGDLLPPGGQEEPPSPRDLKKCYSVEAQSCQRRPTSWLDEQRRHSIAVSCLDSGSQPHLGTDPSNLGGQPLGGPGSRPKKKLSPPSITIDPPESQGPRTPPSPGICLRRRAPSSDSKDPLASGPPDSMAASPSPKKDVLSLSGLSSDPADLDP

SEQ ID NO: 888814 - protein, 2298 aa, Homo sapiens
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQPIMNHNPWMLLYFISFLLIVAFFVLNMFVGVVVENFHKCRQHQEEEEARRREEKRLRRLEKKRRSKEKQMAEAQCKPYYSDYSRFRLLVHHLCTSHYLDLFITGVIGLNVVTMAMEHYQQPQILDEALKICNYIFTVIFVLESVFKLVAFGFRRFFQDRWNQLDLAIVLLSIMGITLEEIEVNASLPINPTIIRIMRVLRIARVLKLLKMAVGMRALLDTVMQALPQVGNLGLLFMLLFFIFAALGVELFGDLECDETHPCEGLGRHATFRNFGMAFLTLFRVSTGDNWNGIMKDTLRDCDQESTCYNTVISPIYFVSFVLTAQFVLVNVVIAVLMKHLEESNKEAKEEAELEAELELEMKTLSPQPHSPLGSPFLWPGVEGPDSPDSPKPGALHPAAHARSASHFSLEHPTDRQLFDTISLLIQGSLEWELKLMDELAGPGGQPSAFPSAPSLGGSDPQMQPHPTELPGPDLLTVRKSGVSRTHSLPNDSYMCRHGSTAEGPLGHRGWGLPKAQSGSVLSVHSQPADTSYILQLPKDAPHLLQPHSAPTWGTIPKLPPPGRSPLAQRPLRRQAAIRTDSLDVQGLGSREDLLAEVSGPSPPLARAYSFWGQSSTQAQQHSRSHSKISKHMTPPAPCPGPEPNWGKGPPETRSSLELDTELSWISGDLLPPGGQEEPPSPRDLKKCYSVEAQSCQRRPTSWLDEQRRHSIAVSCLDSGSQPHLGTDPSNLGGQPLGGPGSRPKKKLSPPSITIDPPESQGPRTPPSPGICLRRRAPSSDSKDPLASGPPDSMAASPSPKKDVLSLSGLSSDPADLDP

SEQ ID NO: 888815 - protein, 2284 aa, Homo sapiens
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEEISKREDASGQLSCIQLPVDSQGGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQPIMNHNPWMLLYFISFLLIVAFFVLNMFVGVVVENFHKCRQHQEEEEARRREEKRLRRLEKKRRNLMLDDVIASGSSASAASEAQCKPYYSDYSRFRLLVHHLCTSHYLDLFITGVIGLNVVTMAMEHYQQPQILDEALKICNYIFTVIFVLESVFKLVAFGFRRFFQDRWNQLDLAIVLLSIMGITLEEIEVNASLPINPTIIRIMRVLRIARVLKLLKMAVGMRALLDTVMQALPQVGNLGLLFMLLFFIFAALGVELFGDLECDETHPCEGLGRHATFRNFGMAFLTLFRVSTGDNWNGIMKDTLRDCDQESTCYNTVISPIYFVSFVLTAQFVLVNVVIAVLMKHLEESNKEAKEEAELEAELELEMKTLSPQPHSPLGSPFLWPGVEGPDSPDSPKPGALHPAAHARSASHFSLEHPTMQPHPTELPGPDLLTVRKSGVSRTHSLPNDSYMCRHGSTAEGPLGHRGWGLPKAQSGSVLSVHSQPADTSYILQLPKDAPHLLQPHSAPTWGTIPKLPPPGRSPLAQRPLRRQAAIRTDSLDVQGLGSREDLLAEVSGPSPPLARAYSFWGQSSTQAQQHSRSHSKISKHMTPPAPCPGPEPNWGKGPPETRSSLELDTELSWISGDLLPPGGQEEPPSPRDLKKCYSVEAQSCQRRPTSWLDEQRRHSIAVSCLDSGSQPHLGTDPSNLGGQPLGGPGSRPKKKLSPPSITIDPPESQGPRTPPSPGICLRRRAPSSDSKDPLASGPPDSMAASPSPKKDVLSLSGLSSDPADLDP

SEQ ID NO: 888816 - protein, 2273 aa, Homo sapiens
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEEISKREDASGQLSCIQLPVDSQGGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQPIMNHNPWMLLYFISFLLIVAFFVLNMFVGVVVENFHKCRQHQEEEEARRREEKRLRRLEKKRRSKEKQMAEAQCKPYYSDYSRFRLLVHHLCTSHYLDLFITGVIGLNVVTMAMEHYQQPQILDEALKICNYIFTVIFVLESVFKLVAFGFRRFFQDRWNQLDLAIVLLSIMGITLEEIEVNASLPINPTIIRIMRVLRIARVLKLLKMAVGMRALLDTVMQALPQVGNLGLLFMLLFFIFAALGVELFGDLECDETHPCEGLGRHATFRNFGMAFLTLFRVSTGDNWNGIMKDTLRDCDQESTCYNTVISPIYFVSFVLTAQFVLVNVVIAVLMKHLEESNKEAKEEAELEAELELEMKTLSPQPHSPLGSPFLWPGVEGPDSPDSPKPGALHPAAHARSASHFSLEHPTMQPHPTELPGPDLLTVRKSGVSRTHSLPNDSYMCRHGSTAEGPLGHRGWGLPKAQSGSVLSVHSQPADTSYILQLPKDAPHLLQPHSAPTWGTIPKLPPPGRSPLAQRPLRRQAAIRTDSLDVQGLGSREDLLAEVSGPSPPLARAYSFWGQSSTQAQQHSRSHSKISKHMTPPAPCPGPEPNWGKGPPETRSSLELDTELSWISGDLLPPGGQEEPPSPRDLKKCYSVEAQSCQRRPTSWLDEQRRHSIAVSCLDSGSQPHLGTDPSNLGGQPLGGPGSRPKKKLSPPSITIDPPESQGPRTPPSPGICLRRRAPSSDSKDPLASGPPDSMAASPSPKKDVLSLSGLSSDPADLDP

SEQ ID NO: 888817 - protein, 2266 aa, Homo sapiens
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEEISKREDASGQLSCIQLPVDSQGGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQPIMNHNPWMLLYFISFLLIVAFFVLNMFVGVVVENFHKCRQHQEEEEARRREEKRLRRLEKKRRKAQCKPYYSDYSRFRLLVHHLCTSHYLDLFITGVIGLNVVTMAMEHYQQPQILDEALKICNYIFTVIFVLESVFKLVAFGFRRFFQDRWNQLDLAIVLLSIMGITLEEIEVNASLPINPTIIRIMRVLRIARVLKLLKMAVGMRALLDTVMQALPQVGNLGLLFMLLFFIFAALGVELFGDLECDETHPCEGLGRHATFRNFGMAFLTLFRVSTGDNWNGIMKDTLRDCDQESTCYNTVISPIYFVSFVLTAQFVLVNVVIAVLMKHLEESNKEAKEEAELEAELELEMKTLSPQPHSPLGSPFLWPGVEGPDSPDSPKPGALHPAAHARSASHFSLEHPTMQPHPTELPGPDLLTVRKSGVSRTHSLPNDSYMCRHGSTAEGPLGHRGWGLPKAQSGSVLSVHSQPADTSYILQLPKDAPHLLQPHSAPTWGTIPKLPPPGRSPLAQRPLRRQAAIRTDSLDVQGLGSREDLLAEVSGPSPPLARAYSFWGQSSTQAQQHSRSHSKISKHMTPPAPCPGPEPNWGKGPPETRSSLELDTELSWISGDLLPPGGQEEPPSPRDLKKCYSVEAQSCQRRPTSWLDEQRRHSIAVSCLDSGSQPHLGTDPSNLGGQPLGGPGSRPKKKLSPPSITIDPPESQGPRTPPSPGICLRRRAPSSDSKDPLASGPPDSMAASPSPKKDVLSLSGLSSDPADLDP

SEQ ID NO: 888818 - protein, 2321 aa, Homo sapiens
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEEISKREDASGQLSCIQLPVDSQGGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQPIMNHNPWMLLYFISFLLIVAFFVLNMFVGVVVENFHKCRQHQEEEEARRREEKRLRRLEKKRRSKEKQMAEAQCKPYYSDYSRFRLLVHHLCTSHYLDLFITGVIGLNVVTMAMEHYQQPQILDEALKICNYIFTVIFVLESVFKLVAFGFRRFFQDRWNQLDLAIVLLSIMGITLEEIEVNASLPINPTIIRIMRVLRIARVLKLLKMAVGMRALLDTVMQALPQVGNLGLLFMLLFFIFAALGVELFGDLECDETHPCEGLGRHATFRNFGMAFLTLFRVSTGDNWNGIMKDTLRDCDQESTCYNTVISPIYFVSFVLTAQFVLVNVVIAVLMKHLEESNKEAKEEAELEAELELEMKTLSPQPHSPLGSPFLWPGVEGPDSPDSPKPGALHPAAHARSASHFSLEHPTDRQLFDTISLLIQGSLEWELKLMDELAGPGGQPSAFPSAPSLGGSDPQMQPHPTELPGPDLLTVRKSGVSRTHSLPNDSYMCRHGSTAEGPLGHRGWGLPKAQSGSVLSVHSQPADTSYILQLPKDAPHLLQPHSAPTWGTIPKLPPPGRSPLAQRPLRRQAAIRTDSLDVQGLGSREDLLAEVSGPSPPLARAYSFWGQSSTQAQQHSRSHSKISKHMTPPAPCPGPEPNWGKGPPETRSSLELDTELSWISGDLLPPGGQEEPPSPRDLKKCYSVEAQSCQRRPTSWLDEQRRHSIAVSCLDSGSQPHLGTDPSNLGGQPLGGPGSRPKKKLSPPSITIDPPESQGPRTPPSPGICLRRRAPSSDSKDPLASGPPDSMAASPSPKKDVLSLSGLSSDPADLDP

SEQ ID NO: 888819 - protein, 2171 aa, Homo sapiens
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQPIMNHNPWMLLYFISFLLIVAFFVLNMFVGVVVENFHKCRQHQEEEEARRREEKRLRRLEKKRRSKEKQMAEAQCKPYYSDYSRFRLLVHHLCTSHYLDLFITGVIGLNVVTMAMEHYQQPQILDEALKICNYIFTVIFVLESVFKLVAFGFRRFFQDRWNQLDLAIVLLSIMGITLEEIEVNASLPINPTIIRIMRVLRIARVLKLLKMAVGMRALLDTVMQALPQVGNLGLLFMLLFFIFAALGVELFGDLECDETHPCEGLGRHATFRNFGMAFLTLFRVSTGDNWNGIMKDTLRDCDQESTCYNTVISPIYFVSFVLTAQFVLVNVVIAVLMKHLEESNKEAKEEAELEAELELEMKTLSPQPHSPLGSPFLWPGVEGPDSPDSPKPGALHPAAHARSASHFSLEHPTMQPHPTELPGPDLLTVRKSGVSRTHSLPNDSYMCRHGSTAEGPLGHRGWGLPKAQSGSVLSVHSQPADTSYILQLPKDAPHLLQPHSAPTWGTIPKLPPPGRSPLAQRPLRRQAAIRTDSLDVQGLGSREDLLAEEEPPSPRDLKKCYSVEAQSCQRRPTSWLDEQRRHSIAVSCLDSGSQPHLGTDPSNLGGQPLGGPGSRPKKKLSPPSITIDPPESQGPRTPPSPGICLRRRAPSSDSKDPLASGPPDSMAASPSPKKDVLSLSGLSSDPADLDP

SEQ ID NO: 888820 - protein, 2243 aa, Homo sapiens
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQPIMNHNPWMLLYFISFLLIVAFFVLNMFVGVVVENFHKCRQHQEEEEARRREEKRLRRLEKKRRKAQCKPYYSDYSRFRLLVHHLCTSHYLDLFITGVIGLNVVTMAMEHYQQPQILDEALKICNYIFTVIFVLESVFKLVAFGFRRFFQDRWNQLDLAIVLLSIMGITLEEIEVNASLPINPTIIRIMRVLRIARVLKLLKMAVGMRALLDTVMQALPQVGNLGLLFMLLFFIFAALGVELFGDLECDETHPCEGLGRHATFRNFGMAFLTLFRVSTGDNWNGIMKDTLRDCDQESTCYNTVISPIYFVSFVLTAQFVLVNVVIAVLMKHLEESNKEAKEEAELEAELELEMKTLSPQPHSPLGSPFLWPGVEGPDSPDSPKPGALHPAAHARSASHFSLEHPTMQPHPTELPGPDLLTVRKSGVSRTHSLPNDSYMCRHGSTAEGPLGHRGWGLPKAQSGSVLSVHSQPADTSYILQLPKDAPHLLQPHSAPTWGTIPKLPPPGRSPLAQRPLRRQAAIRTDSLDVQGLGSREDLLAEVSGPSPPLARAYSFWGQSSTQAQQHSRSHSKISKHMTPPAPCPGPEPNWGKGPPETRSSLELDTELSWISGDLLPPGGQEEPPSPRDLKKCYSVEAQSCQRRPTSWLDEQRRHSIAVSCLDSGSQPHLGTDPSNLGGQPLGGPGSRPKKKLSPPSITIDPPESQGPRTPPSPGICLRRRAPSSDSKDPLASGPPDSMAASPSPKKDVLSLSGLSSDPADLDP

SEQ ID NO: 888821 - protein, 1555 aa, Homo sapiens
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEEISKREDASGQLSCIQLPVDSQGGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQVSPRLRGGAVVKEAGGGTGPCLVIPADSGGGGLHEEISPSHPLLSNHQHVAKPSPSHSAPKSGPMGSLAVLKDEETEAQRG

SEQ ID NO: 888822 - protein, 2306 aa, Homo sapiens
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQPIMNHNPWMLLYFISFLLIVAFFVLNMFVGVVVENFHKCRQHQEEEEARRREEKRLRRLEKKRRNLMLDDVIASGSSASAASEAQCKPYYSDYSRFRLLVHHLCTSHYLDLFITGVIGLNVVTMAMEHYQQPQILDEALKICNYIFTVIFVLESVFKLVAFGFRRFFQDRWNQLDLAIVLLSIMGITLEEIEVNASLPINPTIIRIMRVLRIARVLKLLKMAVGMRALLDTVMQALPQVGNLGLLFMLLFFIFAALGVELFGDLECDETHPCEGLGRHATFRNFGMAFLTLFRVSTGDNWNGIMKDTLRDCDQESTCYNTVISPIYFVSFVLTAQFVLVNVVIAVLMKHLEESNKEAKEEAELEAELELEMKTLSPQPHSPLGSPFLWPGVEGPDSPDSPKPGALHPAAHARSASHFSLEHPTIPLAEMEALSLTSEIVSEPSCSLALTDDSLPDDMHTLLLSALESNMQPHPTELPGPDLLTVRKSGVSRTHSLPNDSYMCRHGSTAEGPLGHRGWGLPKAQSGSVLSVHSQPADTSYILQLPKDAPHLLQPHSAPTWGTIPKLPPPGRSPLAQRPLRRQAAIRTDSLDVQGLGSREDLLAEVSGPSPPLARAYSFWGQSSTQAQQHSRSHSKISKHMTPPAPCPGPEPNWGKGPPETRSSLELDTELSWISGDLLPPGGQEEPPSPRDLKKCYSVEAQSCQRRPTSWLDEQRRHSIAVSCLDSGSQPHLGTDPSNLGGQPLGGPGSRPKKKLSPPSITIDPPESQGPRTPPSPGICLRRRAPSSDSKDPLASGPPDSMAASPSPKKDVLSLSGLSSDPADLDP

SEQ ID NO: 888823 - protein, 2343 aa, Homo sapiens
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQPIMNHNPWMLLYFISFLLIVAFFVLNMFVGVVVENFHKCRQHQEEEEARRREEKRLRRLEKKRRSKEKQMAEAQCKPYYSDYSRFRLLVHHLCTSHYLDLFITGVIGLNVVTMAMEHYQQPQILDEALKICNYIFTVIFVLESVFKLVAFGFRRFFQDRWNQLDLAIVLLSIMGITLEEIEVNASLPINPTIIRIMRVLRIARVLKLLKMAVGMRALLDTVMQALPQVGNLGLLFMLLFFIFAALGVELFGDLECDETHPCEGLGRHATFRNFGMAFLTLFRVSTGDNWNGIMKDTLRDCDQESTCYNTVISPIYFVSFVLTAQFVLVNVVIAVLMKHLEESNKEAKEEAELEAELELEMKTLSPQPHSPLGSPFLWPGVEGPDSPDSPKPGALHPAAHARSASHFSLEHPTDRQLFDTISLLIQGSLEWELKLMDELAGPGGQPSAFPSAPSLGGSDPQIPLAEMEALSLTSEIVSEPSCSLALTDDSLPDDMHTLLLSALESNMQPHPTELPGPDLLTVRKSGVSRTHSLPNDSYMCRHGSTAEGPLGHRGWGLPKAQSGSVLSVHSQPADTSYILQLPKDAPHLLQPHSAPTWGTIPKLPPPGRSPLAQRPLRRQAAIRTDSLDVQGLGSREDLLAEVSGPSPPLARAYSFWGQSSTQAQQHSRSHSKISKHMTPPAPCPGPEPNWGKGPPETRSSLELDTELSWISGDLLPPGGQEEPPSPRDLKKCYSVEAQSCQRRPTSWLDEQRRHSIAVSCLDSGSQPHLGTDPSNLGGQPLGGPGSRPKKKLSPPSITIDPPESQGPRTPPSPGICLRRRAPSSDSKDPLASGPPDSMAASPSPKKDVLSLSGLSSDPADLDP

SEQ ID NO: 888824 - protein, 2332 aa, Homo sapiens
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEEISKREDASGQLSCIQLPVDSQGGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQPIMNHNPWMLLYFISFLLIVAFFVLNMFVGVVVENFHKCRQHQEEEEARRREEKRLRRLEKKRRNLMLDDVIASGSSASAASEAQCKPYYSDYSRFRLLVHHLCTSHYLDLFITGVIGLNVVTMAMEHYQQPQILDEALKICNYIFTVIFVLESVFKLVAFGFRRFFQDRWNQLDLAIVLLSIMGITLEEIEVNASLPINPTIIRIMRVLRIARVLKLLKMAVGMRALLDTVMQALPQVGNLGLLFMLLFFIFAALGVELFGDLECDETHPCEGLGRHATFRNFGMAFLTLFRVSTGDNWNGIMKDTLRDCDQESTCYNTVISPIYFVSFVLTAQFVLVNVVIAVLMKHLEESNKEAKEEAELEAELELEMKTLSPQPHSPLGSPFLWPGVEGPDSPDSPKPGALHPAAHARSASHFSLEHPTDRQLFDTISLLIQGSLEWELKLMDELAGPGGQPSAFPSAPSLGGSDPQMQPHPTELPGPDLLTVRKSGVSRTHSLPNDSYMCRHGSTAEGPLGHRGWGLPKAQSGSVLSVHSQPADTSYILQLPKDAPHLLQPHSAPTWGTIPKLPPPGRSPLAQRPLRRQAAIRTDSLDVQGLGSREDLLAEVSGPSPPLARAYSFWGQSSTQAQQHSRSHSKISKHMTPPAPCPGPEPNWGKGPPETRSSLELDTELSWISGDLLPPGGQEEPPSPRDLKKCYSVEAQSCQRRPTSWLDEQRRHSIAVSCLDSGSQPHLGTDPSNLGGQPLGGPGSRPKKKLSPPSITIDPPESQGPRTPPSPGICLRRRAPSSDSKDPLASGPPDSMAASPSPKKDVLSLSGLSSDPADLDP

SEQ ID NO: 888825 - protein, 1546 aa, Homo sapiens
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQVGLRWAGSICGLRSLSMGCFQDRKSKAGWQNAMKEASYFTAEAVAGSLWAKSGHVLLVYNMFNMF

SEQ ID NO: 888826 - protein, 739 aa, Homo sapiens
MAPQKHGGGGGGGSGPSAGSGGGGFGGSAAVAAATASGGKSGGGSCGGGGSYSASSSSSAAAAAGAAVLPVKKPKMEHVQADHELFLQAFEKPTQIYRFLRTRNLIAPIFLHRTLTYMSHRNSRTNIKRKTFKVDDMLSKVEKMKGEQESHSLSAHLQLTFTGFFHKNDKPSPNSENEQNSVTLEVLLVKVCHKKRKDVSCPIRQVPTGKKQVPLNPDLNQTKPGNFPSLAVSSNEFEPSNSHMVKSYSLLFRVTRPGRREFNGMINGETNENIDVNEELPARRKRNREDGEKTFVAQMTVFDKNRRLQLLDGEYEVAMQEMEECPISKKRATWETILDGKRLPPFETFSQGPTLQFTLRWTGETNDKSTAPIAKPLATRNSESLHQENKPGSVKPTQTIAVKESLTTDLQTRKEKDTPNENRQKLRIFYQFLYNNNTRQQTEARDDLHCPWCTLNCRKLYSLLKHLKLCHSRFIFNYVYHPKGARIDVSINECYDGSYAGNPQDIHRQPGFAFSRNGPVKRTPITHILVCRPKRTKASMSEFLESEDGEVEQQRTYSSGHNRLYFHSDTCLPLRPQEMEVDSEDEKDPEWLREKTITQIEEFSDVNEGEKEVMKLWNLHVMKHGFIADNQMNHACMLFVENYGQKIIKKNLCRNFMLHLVSMHDFNLISIMSIDKAVTKLREMQQKLEKGESASPANEEITEEQNGTANGFSEINSKEKALETDSVSGVSKQSKKQKL

SEQ ID NO: 888827 - protein, 807 aa, Homo sapiens
MAPQKHGGGGGGGSGPSAGSGGGGFGGSAAVAAATASGGKSGGGSCGGGGSYSASSSSSAAAAAGAAVLPVKKPKMEHVQADHELFLQAFEKPTQIYRFLRTRNLIAPIFLHRTLTYMSHRNSRTNIKRKTFKVDDMLSKVEKMKGEQESHSLSAHLQLTFTGFFHKNDKPSPNSENEQNSVTLEVLLVKVCHKKRKDVSCPIRQVPTGKKQVPLNPDLNQTKPGNFPSLAVSSNEFEPSNSHMVKSYSLLFRVTRPGRREFNGMINGETNENIDVNEELPARRKRNREDGEKTFVAQMTVFDKNRRLQLLDGEYEVAMQEMEECPISKKRATWETILDGKRLPPFETFSQGPTLQFTLRWTGETNDKSTAPIAKPLATRNSESLHQENKPGSVKPTQTIAVKESLTTDLQTRKEKDTPNENRQKLRIFYQFLYNNNTRQQTEARDDLHCPWCTLNCRKLYSLLKHLKLCHSRFIFNYVYHPKGARIDVSINECYDGSYAGNPQDIHRQPGFAFSRNGPVKRTPITHILVCRPKRTKASMSEFLESEDGEVEQQRTYSSGHNRLYFHSDTCLPLRPQEMEVDSEDEKDPEWLREKTITQIEEFSDVNEGEKEVMKLWNLHVMKHGFIADNQMNHACMLFVENYGQKIIKKNLCRNFMLHLVSMHDFNLISIMSIDKAVTKLREMQQKLEKGESASPANEEITEEQNGTANGFSEINSKEKALETDSVSGVSKQSKKQKGIHPLRIMFLFLIICSKQALLDEVNDFNKDICIRVLLHFIMQHYMYITFIDVIKTFCTLSMKSNISKYF

SEQ ID NO: 888828 - protein, 739 aa, Homo sapiens; identical to SEQ ID NO: 888826

SEQ ID NO: 888829 - protein, 620 aa, Homo sapiens
MAPQKHGGGGGGGSGPSAGSGGGGFGGSAAVAAATASGGKSGGGSCGGGGSYSASSSSSAAAAAGAAVLPVKKPKMEHVQADHELFLQAFEKPTQIYRFLRTRNLIAPIFLHRTLTYMSHRNSRTNIKRKTFKVDDMLSKVEKMKGEQESHSLSAHLQLTFTGFFHKNDKPSPNSENEQNSVTLEVLLVKVCHKKRKDVSCPIRQVPTGKKQVPLNPDLNQTKPGNFPSLAVSSNEFEPSNSHMVKSYSLLFRVTRPGRREFNGMINGETNENIDVNEELPARRKRNREDGEKTFVAQMTVFDKNRRLQLLDGEYEVAMQEMEECPISKKRATWETILDGKRLPPFETFSQGPTLQFTLRWTGETNDKSTAPIAKPLATRNSESLHQENKPGSVKPTQTIAVKESLTTDLQTRKEKDTPNENRQKLRIFYQFLYNNNTRQQTEARDDLHCPWCTLNCRKLYSLLKHLKLCHSRFIFNYVYHPKGARIDVSINECYDGSYAGNPQDIHRQPGFAFSRNGPVKRTPITHILVCRPKRTKASMSEFLESEDGEVEQQRTYSSGHNRLYFHSDTCLPLRPQEMEVDSEDEKDPEWLREKTITVIIIIFIGNYLGILFCFENCLL

SEQ ID NO: 888830 - protein, 475 aa, Homo sapiens
SSEEREYDDDENMKYDVMRAQQKKRIVEDGKDIVPMTVLKNRRLQLLDGEYEVAMQEMEECPISKKRATWETILDGKRLPPFETFSQGPTLQFTLRWTGETNDKSTAPIAKPLATRNSESLHQENKPGSVKPTQTIAVKESLTTDLQTRKEKDTPNENRQKLRIFYQFLYNNNTRQQTEARDDLHCPWCTLNCRKLYSLLKHLKLCHSRFIFNYVYHPKGARIDVSINECYDGSYAGNPQDIHRQPGFAFSRNGPVKRTPITHILVCRPKRTKASMSEFLESEDGEVEQQRTYSSGHNRLYFHSDTCLPLRPQEMEVDSEDEKDPEWLREKTITQIEEFSDVNEGEKEVMKLWNLHVMKHGFIADNQMNHACMLFVENYGQKIIKKNLCRNFMLHLVSMHDFNLISIMSIDKAVTKLREMQQKLEKGESASPANEEITEEQNGTANGFSEINSKEKALETDSVSGVSKQSKKQKL

SEQ ID NO: 888831 - protein, 739 aa, Homo sapiens; identical to SEQ ID NO: 888826

SEQ ID NO: 888832 - protein, 127 aa, Homo sapiens
SGDWPPSLRLPPEFHPHLGWNLVFGALACFPQPPSLCVFHRRNGKVQHCRIHSRQDAGTPKFFLTDNLVFDSLYDLITHYQQVPLRCNEFEMRLSEPVPQTNAHESKEWYHASLTRATDGMRAKDGS

SEQ ID NO: 888833 - protein, 1291 aa, Homo sapiens
MAGAASPCANGCGPGAPSDAEVLHLCRSLEVGTVMTLFYSKKSQRPERKTFQVKLETRQITWSRGADKIEGAIDIREIKEIRPGKTSRDFDRYQEDPAFRPDQSHCFVILYGMEFRLKTLSLQATSEDEVNMWIKGLTWLMEDTLQAPTPLQIERWLRKQFYSVDRNREDRISAKDLKNMLSQVNYRVPNMRFLRERLTDLEQRSGDITYGQFAQLYRSLMYSAQKTMDLPFLEASTLRAGERPELCRVSLPEFQQFLLDYQGELWAVDRLQVQEFMLSFLRDPLREIEEPYFFLDEFVTFLFSKENSVWNSQLDAVCPDTMNNPLSHYWISSSHNTYLTGDQFSSESSLEAYARCLRMGCRCIELDCWDGPDGMPVIYHGHTLTTKIKFSDVLHTIKEHAFVASEYPVILSIEDHCSIAQQRNMAQYFKKVLGDTLLTKPVEISADGLPSPNQLKRKILIKHKKLAEGSAYEEVPTSMMYSENDISNSIKNGILYLEDPVNHEWYPHYFVLTSSKIYYSEETSSDQGNEDEEEPKEVSSSTELHSNEKWFHGKLGAGRDGRHIAERLLTEYCIETGAPDGSFLVRESETFVGDYTLSFWRNGKVQHCRIHSRQDAGTPKFFLTDNLVFDSLYDLITHYQQVPLRCNEFEMRLSEPVPQTNAHESKEWYHASLTRAQAEHMLMRVPRDGAFLVRKRNEPNSYAISFRAEGKIKHCRVQQEGQTVMLGNSEFDSLVDLISYYEKHPLYRKMKLRYPINEEALEKIGTAEPDYGALYEGRNPGFYVEANPMPTFKCAVKALFDYKAQREDELTFIKSAIIQNVEKQEGGWWRGDYGGKKQLWFPSNYVEEMVNPVALEPEREHLDENSPLGDLLRGVLDVPACQIAIRPEGKNNRLFVFSISMASVAHWSLDVAADSQEELQDWVKKIREVAQTADARLTEGKIMERRKKIALELSELVVYCRPVPFDEEKIGTERACYRDMSSFPETKAEKYVNKAKGKKFLQYNRLQLSRIYPKGQRLDSSNYDPLPMWICGSQLVALNFQTPDKPMQMNQALFMTGRHCGYVLQPSTMRDEAFDPFDKSSLRGLEPCAISIEVLGARHLPKNGRGIVCPFVEIEVAGAEYDSTKQKTEFVVDNGLNPVWPAKPFHFQISNPEFAFLRFVVYEEDMFSDQNFLAQATFPVKGLKTGYRAVPLKNNYSEDLELASLLIKIDIFPAKQENGDLSPFSGTSLRERGSDASGQLFHGRAREGSFESRYQQPFEDFRISQEHLADHFDSRERRAPRRTRVNGDNRL

SEQ ID NO: 888834 - protein, 1344 aa, Homo sapiens
MAGAASPCANGCGPGAPSDAEVLHLCRSLEVGTVMTLFYSKKSQRPERKTFQVKLETRQITWSRGADKIEGAIDIREIKEIRPGKTSRDFDRYQEDPAFRPDQSHCFVILYGMEFRLKTLSLQATSEDEVNMWIKGLTWLMEDTLQAPTPLQIERWLRKQFYSVDRNREDRISAKDLKNMLSQVNYRVPNMRFLRERLTDLEQRSGDITYGQFAQLYRSLMYSAQKTMDLPFLEASTLRAGERPELCRVSLPEFQQFLLDYQGELWAVDRLQVQEFMLSFLRDPLREIEEPYFFLDEFVTFLFSKENSVWNSQLDAVCPDTMNNPLSHYWISSSHNTYLTGDQFSSESSLEAYARCLRMGCRCIELDCWDGPDGMPVIYHGHTLTTKIKFSDVLHTIKEHAFVASEYPVILSIEDHCSIAQQRNMAQYFKKVLGDTLLTKPVEISADGLPSPNQLKRKILIKHKKLAEGSAYEEVPTSMMYSENDISNSIKNGILYLEDPVNHEWYPHYFVLTSSKIYYSEETSSDQGNEDEEEPKEVSSSTELHSNEKWFHGKLGAGRDGRHIAERLLTEYCIETGAPDGSFLVRESETFVGDYTLSFWRNGKVQHCRIHSRQDAGTPKFFLTDNLVFDSLYDLITHYQQVPLRCNEFEMRLSEPVPQTNAHESKEWYHASLTRAQAEHMLMRVPRDGAFLVRKRNEPNSYAISFRAEGKIKHCRVQQEGQTVMLGNSEFDSLVDLISYYEKHPLYRKMKLRYPINEEALEKIGTAEPDYGALYEGRNPGFYVEANPMPTFKCAVKALFDYKAQREDELTFIKSAIIQNVEKQEGGWWRGDYGGKKQLWFPSNYVEEMVNPVALEPEREHLDENSPLGDLLRGVLDVPACQIAIRPEGKNNRLFVFSISMASVAHWSLDVAADSQEELQDWVKKIREVAQTADARLTEGKIMERRKKIALELSELVVYCRPVPFDEEKIGTERACYRDMSSFPETKAEKYVNKAKGKKFLQYNRLQLSRIYPKGQRLDSSNYDPLPMWICGSQLVALNFQTPDKPMQMNQALFMTGRHCGYVLQPSTMRDEAFDPFDKSSLRGLEPCAISIEVLGARHLPKNGRGIVCPFVEIEVAGAEYDSTKQKTEFVVDNGLNPVWPAKPFHFQISNPEFAFLRFVVYEEDMFSDQNFLAQATFPVKGLKTGYRAVPLKNNYSEDLELASLLIKIDIFPAKQENGDLSPFSGTSLRERGSDASGQLFHGRAREGSFESRYQQPFEDFRISQEHLADHFDSRERSKDTLPFCPGPQEGLGSMETTASSCTPASLESSRCCAPCRMPRTGFFGSSPLWRPSGSRSLKPGFQQ

SEQ ID NO: 888835 - protein, 1078 aa, Homo sapiens
SLPLKEHPGVFAQLSPRPLAEILLPYFFLDEFVTFLFSKENSVWNSQLDAVCPDTMNNPLSHYWISSSHNTYLTGDQFSSESSLEAYARCLRMGCRCIELDCWDGPDGMPVIYHGHTLTTKIKFSDVLHTIKEHAFVASEYPVILSIEDHCSIAQQRNMAQYFKKVLGDTLLTKPVEISADGLPSPNQLKRKILIKHKKLAEGSAYEEVPTSMMYSENDISNSIKNGILYLEDPVNHEWYPHYFVLTSSKIYYSEETSSDQGNEDEEEPKEVSSSTELHSNEKWFHGKLGAGRDGRHIAERLLTEYCIETGAPDGSFLVRESETFVGDYTLSFWRNGKVQHCRIHSRQDAGTPKFFLTDNLVFDSLYDLITHYQQVPLRCNEFEMRLSEPVPQTNAHESKEWYHASLTRAQAEHMLMRVPRDGAFLVRKRNEPNSYAISFRAEGKIKHCRVQQEGQTVMLGNSEFDSLVDLISYYEKHPLYRKMKLRYPINEEALEKIGTAEPDYGALYEGRNPGFYVEANPMPTFKCAVKALFDYKAQREDELTFIKSAIIQNVEKQEGGWWRGDYGGKKQLWFPSNYVEEMVNPVALEPEREHLDENSPLGDLLRGVLDVPACQIAIRPEGKNNRLFVFSISMASVAHWSLDVAADSQEELQDWVKKIREVAQTADARLTEGKIMERRKKIALELSELVVYCRPVPFDEEKIGTERACYRDMSSFPETKAEKYVNKAKGKKFLQYNRLQLSRIYPKGQRLDSSNYDPLPMWICGSQLVALNFQTPDKPMQMNQALFMTGRHCGYVLQPSTMRDEAFDPFDKSSLRGLEPCAISIEVLGARHLPKNGRGIVCPFVEIEVAGAEYDSTKQKTEFVVDNGLNPVWPAKPFHFQISNPEFAFLRFVVYEEDMFSDQNFLAQATFPVKGLKTGYRAVPLKNNYSEDLELASLLIKIDIFPAKQENGDLSPFSGTSLRERGSDASGQLFHGRAREGSFESRYQQPFEDFRISQEHLADHFDSRERSKDTLPFCPGPQEGLGSMETTASSCTPASLESSRCCAPCRMPRTGFFGSSPLWRPSGSRSLKPGFQQ

SEQ ID NO: 888836 - protein, 906 aa, Homo sapiens
MAGAASPCANGCGPGAPSDAEVLHLCRSLEVGTVMTLFYSKKSQRPERKTFQVKLETRQITWSRGADKIEGAIDIREIKEIRPGKTSRDFDRYQEDPAFRPDQSHCFVILYGMEFRLKTLSLQATSEDEVNMWIKGLTWLMEDTLQAPTPLQIERWLRKQFYSVDRNREDRISAKDLKNMLSQVNYRVPNMRFLRERLTDLEQRSGDITYGQFAQLYRSLMYSAQKTMDLPFLEASTLRAGERPELCRVSLPEFQQFLLDYQGELWAVDRLQVQEFMLSFLRDPLREIEEPYFFLDEFVTFLFSKENSVWNSQLDAVCPDTMNNPLSHYWISSSHNTYLTGDQFSSESSLEAYARCLRMGCRCIELDCWDGPDGMPVIYHGHTLTTKIKFSDVLHTIKEHAFVASEYPVILSIEDHCSIAQQRNMAQYFKKVLGDTLLTKPVEISADGLPSPNQLKRKILIKHKKLAEGSAYEEVPTSMMYSENDISNSIKNGILYLEDPVNHEWYPHYFVLTSSKIYYSEETSSDQGNEDEEEPKEVSSSTELHSNEKWFHGKLGAGRDGRHIAERLLTEYCIETGAPDGSFLVRESETFVGDYTLSFWRNGKVQHCRIHSRQDAGTPKFFLTDNLVFDSLYDLITHYQQVPLRCNEFEMRLSEPVPQTNAHESKEWYHASLTRAQAEHMLMRVPRDGAFLVRKRNEPNSYAISFRAEGKIKHCRVQQEGQTVMLGNSEFDSLVDLISYYEKHPLYRKMKLRYPINEEALEKIGTAEPDYGALYEGRNPGFYVEANPMPTFKCAVKALFDYKAQREDELTFIKSAIIQNVEKQEGGWWRGDYGGKKQLWFPSNYVEEMVNPVALEPEREHLDENSPLGDLLRGVLDVPACQIAWRRWPTGPWMLLPTHRRSCRTG

SEQ ID NO: 888837 - protein, 1291 aa, Homo sapiens; identical to SEQ ID NO: 888833

SEQ ID NO: 888838 - protein, 974 aa, Homo sapiens
MAGAASPCANGCGPGAPSDAEVLHLCRSLEVGTVMTLFYSKKSQRPERKTFQVKLETRQITWSRGADKIEGAIDIREIKEIRPGKTSRDFDRYQEDPAFRPDQSHCFVILYGMEFRLKTLSLQATSEDEVNMWIKGLTWLMEDTLQAPTPLQIERWLRKQFYSVDRNREDRISAKDLKNMLSQVNYRVPNMRFLRERLTDLEQRSGDITYGQFAQLYRSLMYSAQKTMDLPFLEASTLRAGERPELCRVSLPEFQQFLLDYQGELWAVDRLQVQEFMLSFLRDPLREIEEPYFFLDEFVTFLFSKENSVWNSQLDAVCPDTMNNPLSHYWISSSHNTYLTGDQFSSESSLEAYARCLRMGCRCIELDCWDGPDGMPVIYHGHTLTTKIKFSDVLHTIKEHAFVASEYPVILSIEDHCSIAQQRNMAQYFKKVLGDTLLTKPVEISADGLPSPNQLKRKILIKHKKLAEGSAYEEVPTSMMYSENDISNSIKNGILYLEDPVNHEWYPHYFVLTSSKIYYSEETSSDQGNEDEEEPKEVSSSTELHSNEKWFHGKLGAGRDGRHIAERLLTEYCIETGAPDGSFLVRESETFVGDYTLSFWRNGKVQHCRIHSRQDAGTPKFFLTDNLVFDSLYDLITHYQQVPLRCNEFEMRLSEPVPQTNAHESKEWYHASLTRAQAEHMLMRVPRDGAFLVRKRNEPNSYAISFRAEGKIKHCRVQQEGQTVMLGNSEFDSLVDLISYYEKHPLYRKMKLRYPINEEALEKIGTAEPDYGALYEGRNPGFYVEANPMPTFKCAVKALFDYKAQREDELTFIKSAIIQNVEKQEGGWWRGDYGGKKQLWFPSNYVEEMVNPVALEPEREHLDENSPLGDLLRGVLDVPACQIAIRPEGKNNRLFVFSISMASVAHWSLDVAADSQEELQDWVKKIREVAQTADARVRFCWNLLGGSVWARQAAEASSSQHRPPQSSGAADGLC

SEQ ID NO: 888839 - protein, 848 aa, Homo sapiens
MAGAASPCANGCGPGAPSDAEVLHLCRSLEVGTVMTLFYSKKSQRPERKTFQVKLETRQITWSRGADKIEGAIDIREIKEIRPGKTSRDFDRYQEDPAFRPDQSHCFVILYGMEFRLKTLSLQATSEDEVNMWIKGLTWLMEDTLQAPTPLQIERWLRKQFYSVDRNREDRISAKDLKNMLSQVNYRVPNMRFLRERLTDLEQRSGDITYGQFAQLYRSLMYSAQKTMDLPFLEASTLRAGERPELCRVSLPEFQQFLLDYQGELWAVDRLQVQEFMLSFLRDPLREIEEPYFFLDEFVTFLFSKENSVWNSQLDAVCPDTMNNPLSHYWISSSHNTYLTGDQFSSESSLEAYARCLRMGCRCIELDCWDGPDGMPVIYHGHTLTTKIKFSDVLHTIKEHAFVASEYPVILSIEDHCSIAQQRNMAQYFKKVLGDTLLTKPVEISADGLPSPNQLKRKILIKHKKLAEGSAYEEVPTSMMYSENDISNSIKNGILYLEDPVNHEWYPHYFVLTSSKIYYSEETSSDQGNEDEEEPKEVSSSTELHSNEKWFHGKLGAGRDGRHIAERLLTEYCIETGAPDGSFLVRESETFVGDYTLSFWRNGKVQHCRIHSRQDAGTPKFFLTDNLVFDSLYDLITHYQQVPLRCNEFEMRLSEPVPQTNAHESKEWYHASLTRAQAEHMLMRVPRDGAFLVRKRNEPNSYAISFRAEGKIKHCRVQQEGQTVMLGNSEFDSLVDLISYYEKHPLYRKMKLRYPINEEALEKIGTAEPDYGALYEGRNPGFYVEANPMPTFKCAVKALFDYKAQREDELTFIKSAIIQNVEKQEGGCRRSTRFLFFLTVIKIFIGHL

SEQ ID NO: 888840 - protein, 711 aa, Homo sapiens
MAGAASPCANGCGPGAPSDAEVLHLCRSLEVGTVMTLFYSKKSQRPERKTFQVKLETRQITWSRGADKIEGAIDIREIKEIRPGKTSRDFDRYQEDPAFRPDQSHCFVILYGMEFRLKTLSLQATSEDEVNMWIKGLTWLMEDTLQAPTPLQIERWLRKQFYSVDRNREDRISAKDLKNMLSQVNYRVPNMRFLRERLTDLEQRSGDITYGQFAQLYRSLMYSAQKTMDLPFLEASTLRAGERPELCRVSLPEFQQFLLDYQGELWAVDRLQVQEFMLSFLRDPLREIEEPYFFLDEFVTFLFSKENSVWNSQLDAVCPDTMNNPLSHYWISSSHNTYLTGDQFSSESSLEAYARCLRMGCRCIELDCWDGPDGMPVIYHGHTLTTKIKFSDVLHTIKEHAFVASEYPVILSIEDHCSIAQQRNMAQYFKKVLGDTLLTKPVEISADGLPSPNQLKRKILIKHKKLAEGSAYEEVPTSMMYSENDISNSIKNGILYLEDPVNHEWYPHYFVLTSSKIYYSEETSSDQGNEDEEEPKEVSSSTELHSNEKWFHGKLGAGRDGRHIAERLLTEYCIETGAPDGSFLVRESETFVGDYTLSFWRNGKVQHCRIHSRQDAGTPKFFLTDNLVFDSLYDLITHYQQVPLRCNEFEMRLSEPVPQTNAHESKEWYHASLTRAQAEHMLMRVPRDGAFLVTKGDGHTKGDGHTKGDGH

SEQ ID NO: 888841 - protein, 1291 aa, Homo sapiens; identical to SEQ ID NO: 888833

SEQ ID NO: 888842 - protein, 1291 aa, Homo sapiens; identical to SEQ ID NO: 888833

SEQ ID NO: 888843 - protein, 1414 aa, Homo sapiens
MAGAASPCANGCGPGAPSDAEVLHLCRSLEVGTVMTLFYSKKSQRPERKTFQVKLETRQITWSRGADKIEGAIDIREIKEIRPGKTSRDFDRYQEDPAFRPDQSHCFVILYGMEFRLKTLSLQATSEDEVNMWIKGLTWLMEDTLQAPTPLQIERWLRKQFYSVDRNREDRISAKDLKNMLSQVNYRVPNMRFLRERLTDLEQRSGDITYGQFAQLYRSLMYSAQKTMDLPFLEASTLRFGLEWGGGVFPGPPSSLHWAILDPGGRQWEEGTMLDHSGKLCWLGVGFCLPWGTLLSVDHTSYLTFSPCRAGERPELCRVSLPEFQQFLLDYQGELWAVDRLQVQEFMLSFLRDPLREIEEPYFFLDEFVTFLFSKENSVWNSQLDAVCPDTMNNPLSHYWISSSHNTYLTGDQFSSESSLEAYARCLRMGCRCIELDCWDGPDGMPVIYHGHTLTTKIKFSDVLHTIKEHAFVASEYPVILSIEDHCSIAQQRNMAQYFKKVLGDTLLTKPVEISADGLPSPNQLKRKILIKHKKLAEGSAYEEVPTSMMYSENDISNSIKNGILYLEDPVNHEWYPHYFVLTSSKIYYSEETSSDQGNEDEEEPKEVSSSTELHSNEKWFHGKLGAGRDGRHIAERLLTEYCIETGAPDGSFLVRESETFVGDYTLSFWRNGKVQHCRIHSRQDAGTPKFFLTDNLVFDSLYDLITHYQQVPLRCNEFEMRLSEPVPQTNAHESKEWYHASLTRAQAEHMLMRVPRDGAFLVRKRNEPNSYAISFRAEGKIKHCRVQQEGQTVMLGNSEFDSLVDLISYYEKHPLYRKMKLRYPINEEALEKIGTAEPDYGALYEGRNPGFYVEANPMPTFKCAVKALFDYKAQREDELTFIKSAIIQNVEKQEGGWWRGDYGGKKQLWFPSNYVEEMVNPVALEPEREHLDENSPLGDLLRGVLDVPACQIAIRPEGKNNRLFVFSISMASVAHWSLDVAADSQEELQDWVKKIREVAQTADARLTEGKIMERRKKIALELSELVVYCRPVPFDEEKIGTERACYRDMSSFPETKAEKYVNKAKGKKFLQYNRLQLSRIYPKGQRLDSSNYDPLPMWICGSQLVALNFQTPDKPMQMNQALFMTGRHCGYVLQPSTMRDEAFDPFDKSSLRGLEPCAISIEVLGARHLPKNGRGIVCPFVEIEVAGAEYDSTKQKTEFVVDNGLNPVWPAKPFHFQISNPEFAFLRFVVYEEDMFSDQNFLAQATFPVKGLKTGYRAVPLKNNYSEDLELASLLIKIDIFPAKQENGDLSPFSGTSLRERGSDASGQLFHGRAREGSFESRYQQPFEDFRISQEHLADHFDSRERSKDTLPFCPGPQEGLGSMETTASSCTPASLESSRCCAPCRMPRTGFFGSSPLWRPSGSRSLKPGFQQ

SEQ ID NO: 888844 - protein, 568 aa, Homo sapiens
PTRPLISYYEKHPLYRKELGKKGAPFEGLRYPINEEALEKIGTAEPDYGALYEGRNPGFYVEANPMPTFKCAVKALFDYKAQREDELTFIKSAIIQNVEKQEGGWWRGDYGGKKQLWFPSNYVEEMVNPVALEPEREHLDENSPLGDLLRGVLDVPACQIAIRPEGKNNRLFVFSISMASVAHWSLDVAADSQEELQDWVKKIREVAQTADARLTEGKIMERRKKIALELSELVVYCRPVPFDEEKIGTERACYRDMSSFPETKAEKYVNKAKGKKFLQYNRLQLSRIYPKGQRLDSSNYDPLPMWICGSQLVALNFQTPDKPMQMNQALFMTGRHCGYVLQPSTMRDEAFDPFDKSSLRGLEPCAISIEVLGARHLPKNGRGIVCPFVEIEVAGAEYDSTKQKTEFVVDNGLNPVWPAKPFHFQISNPEFAFLRFVVYEEDMFSDQNFLAQATFPVKGLKTGYRAVPLKNNYSEDLELASLLIKIDIFPAKQENGDLSPFSGTSLRERGSDASGQLFHGRAREGSFESRYQQPFEDFRISQEHLADHFDSRERRAPRRTRVNGDNRL

SEQ ID NO: 888845 - protein, 133 aa, Homo sapiens
VSSPYLQVGMSQPWAMCLVLCLLLRQAEPFSMQAYIPLPWSRPNCRGSSFSPCPALDEGKNCTVFRIKHTHLALTSGDGSFHLVGPGPWPKPLGERGCLSQWHRRLQGATDIPKSGGGGGALLGQGNKVYIVL

SEQ ID NO: 888846 - protein, 949 aa, Homo sapiens
MAGAASPCANGCGPGAPSDAEVLHLCRSLEVGTVMTLFYSKKSQRPERKTFQVKLETRQITWSRGADKIEGAIDIREIKEIRPGKTSRDFDRYQEDPAFRPDQSHCFVILYGMEFRLKTLSLQATSEDEVNMWIKGLTWLMEDTLQAPTPLQIERWLRKQFYSVDRNREDRISAKDLKNMLSQVNYRVPNMRFLRERLTDLEQRSGDITYGQFAQLYRSLMYSAQKTMDLPFLEASTLRAGERPELCRVSLPEFQQFLLDYQGELWAVDRLQVQEFMLSFLRDPLREIEEPYFFLDEFVTFLFSKENSVWNSQLDAVCPDTMNNPLSHYWISSSHNTYLTGDQFSSESSLEAYARCLRMGCRCIELDCWDGPDGMPVIYHGHTLTTKIKFSDVLHTIKEHAFVASEYPVILSIEDHCSIAQQRNMAQYFKKVLGDTLLTKPVEISADGLPSPNQLKRKILIKHKKLAEGSAYEEVPTSMMYSENDISNSIKNGILYLEDPVNHEWYPHYFVLTSSKIYYSEETSSDQGNEDEEEPKEVSSSTELHSNEKWFHGKLGAGRDGRHIAERLLTEYCIETGAPDGSFLVRESETFVGDYTLSFWRNGKVQHCRIHSRQDAGTPKFFLTDNLVFDSLYDLITHYQQVPLRCNEFEMRLSEPVPQTNAHESKEWYHASLTRAQAEHMLMRVPRDGAFLVRKRNEPNSYAISFRAEGKIKHCRVQQEGQTVMLGNSEFDSLVDLISYYEKHPLYRKMKLRYPINEEALEKIGTAEPDYGALYEGRNPGFYVEANPMPTFKCAVKALFDYKAQREDELTFIKSAIIQNVEKQEGGWWRGDYGGKKQLWFPSNYVEEMVNPVALEPEREHLDENSPLGDLLRGVLDVPACQIAIRPEGKNNRLFVFSISMASVAHWSLDVAADSQEELQDWVKKIREVAQTADARDLAAEISGPFQHS

SEQ ID NO: 888847 - protein, 600 aa, Homo sapiens
MAGAASPCANGCGPGAPSDAEVLHLCRSLEVGTVMTLFYSKKSQRPERKTFQVKLETRQITWSRGADKIEGAIDIREIKEIRPGKTSRDFDRYQEDPAFRPDQSHCFVILYGMEFRLKTLSLQATSEDEVNMWIKGLTWLMEDTLQAPTPLQIERWLRKQFYSVDRNREDRISAKDLKNMLSQVNYRVPNMRFLRERLTDLEQRSGDITYGQFAQLYRSLMYSAQKTMDLPFLEASTLRAGERPELCRVSLPEFQQFLLDYQGELWAVDRLQVQEFMLSFLRDPLREIEEPYFFLDEFVTFLFSKENSVWNSQLDAVCPDTMNNPLSHYWISSSHNTYLTGDQFSSESSLEAYARCLRMGCRCIELDCWDGPDGMPVIYHGHTLTTKIKFSDVLHTIKEHAFVASEYPVILSIEDHCSIAQQRNMAQYFKKVLGDTLLTKPVEISADGLPSPNQLKRKILIKHKKLAEGSAYEEVPTSMMYSENDISNSIKNGILYLEDPVNHEWYPHYFVLTSSKIYYSEETSSDQGNEDEEEPKEVSSSTELHSNEKWFHGKLGAGRDGRHIAERLLTEYCIETGAPDGSFLVRESETFVGDYTLSFW

SEQ ID NO: 888848 - protein, 106 aa, Homo sapiens
TIRATEDALLGSWSQANTARGVYYNQYRSTIRLSTAGAIDRRGVRDRASSLPCFASGRENASPRIPGTHFSSTAFPRRVWDRGGHGSAEVPPIGSKGEHRTEETSD

SEQ ID NO: 888849 - protein, 673 aa, Homo sapiens
MDPQRSPLLEVKGNIELKRPLIKAPSQLPLSGSRLKRRPDQMEDGLEPEKKRTRGLGATTKITTSHPRVPSLTTVPQTQGQTTAQKVSKKTGPRCSTAIATGLKNQKPVPAVPVQKSGTSGVPPMAGGKKPSKRPAWDLKGQLCDLNAELKRCRERTQTLDQENQQLQDQLRDAQQQVKALGTERTTLEGHLAKVQAQAEQGQQELKNLRACVLELEERLSTQEGLVQELQKKQVELQEERRGLMSQLEEKERRLQTSEAALSSSQAEVASLRQETVAQAALLTEREERLHGLEMERRRLHNQLQELKGNIRVFCRVRPVLPGEPTPPPGLLLFPSGPGGPSDPPTRLSLSRSDERRGTLSGAPAPPTRHDFSFDRVFPPGSGQDEVFEEIAMLVQSALDGYPVCIFAYGQTGSGKTFTMEGGPGGDPQLEGLIPRALRHLFSVAQELSGQGWTYSFVASYVEIYNETVRDLLATGTRKGQGGECEIRRAGPGSEELTVTNARYVPVSCEKEVDALLHLARQNRAVARTAQNERSSRSHSVFQLQISGEHSSRGLQCGAPLSLVDLAGSERLDPGLALGPGERERLRETQAINSSLSTLGLVIMALSNKESHVPYRNSKLTYLLQNSLGGSAKMLMFVNISPLEENVSESLNSLRFASKVNQCVIGTAQANRK

SEQ ID NO: 888850 - protein, 673 aa, Homo sapiens; identical to SEQ ID NO: 888849

SEQ ID NO: 888851 - protein, 673 aa, Homo sapiens; identical to SEQ ID NO: 888849

SEQ ID NO: 888852 - protein, 687 aa, Homo sapiens
MLTISSKVIFPLCLMFFCFFLSLGGFLRALMIGAEAEGTTSIWACLFSMVSFTVILRPFQSPVALAMSSPTFFGDRPRGPILGARQKWHRLHLWCTSAQKVSKKTGPRCSTAIATGLKNQKPVPAVPVQKSGTSGVPPMAGGKKPSKRPAWDLKGQLCDLNAELKRCRERTQTLDQENQQLQDQLRDAQQQVKALGTERTTLEGHLAKVQAQAEQGQQELKNLRACVLELEERLSTQEGLVQELQKKQVELQEERRGLMSQLEEKERRLQTSEAALSSSQAEVASLRQETVAQAALLTEREERLHGLEMERRRLHNQLQELKGNIRVFCRVRPVLPGEPTPPPGLLLFPSGPGGPSDPPTRLSLSRSDERRGTLSGAPAPPTRHDFSFDRVFPPGSGQDEVFEEIAMLVQSALDGYPVCIFAYGQTGSGKTFTMEGGPGGDPQLEGLIPRALRHLFSVAQELSGQGWTYSFVASYVEIYNETVRDLLATGTRKGQGGECEIRRAGPGSEELTVTNARYVPVSCEKEVDALLHLARQNRAVARTAQNERSSRSHSVFQLQISGEHSSRGLQCGAPLSLVDLAGSERLDPGLALGPGERERLRETQAINSSLSTLGLVIMALSNKESHVPYRNSKLTYLLQNSLGGSAKMLMFVNISPLEENVSESLNSLRFASKVNQCVIGTAQANRK

SEQ ID NO: 888853 - protein, 133 aa, Homo sapiens
MDPQRSPLLEVKGNIELKRPLIKAPSQLPLSGSRLKRRPDQMEDGLEPEKKRTRGLGATTKITTSHPRVPSLTTVPQTQGQTTAQKVSKKTGPRCSTAIATVSQGYQIKNSLVFFLNKGFISICPRRQILSYL

SEQ ID NO: 888854 - protein, 673 aa, Homo sapiens; identical to SEQ ID NO: 888849

SEQ ID NO: 888855 - protein, 674 aa, Homo sapiens
MDPQRSPLLEVKGNIELKRPLIKAPSQLPLSGSRLKRRPDQMEDGLEPEKKRTRGLGATTKITTSHPRVPSLTTVPQTQGQTTAQKVSKKTGPRCSTAIATGLKNQKPVPAVPVQKSGTSGVPPMAGGKKPSKRPAWDLKGQLCDLNAELKRCRERTQTLDQENQQLQDQLRDAQQQVKALGTERTTLEGHLAKVQAQAEQGQQELKNLRACVLELEERLSTQEGLVQELQKKQVELQEERRGLMSQLEEKERRLQTSEAALSSSQAEVASLRQETVAQAALLTEREERLHGLEMERRRLHNQLQELKGNIRVFCRVRPVLPGEPTPPPGLLLFPSGPGGPSDPPTRLSLSRSDERRGTLSGAPAPPTRHDFSFDRVFPPGSGQDEVFEEIAMLVQSALDGYPVCIFAYGQTGSGKTFTMEGGPGGDPQLEGLIPRALRHLFSVAQELSGQGWTYSFVASYVEIYNETVRDLLATGTRKGQGGECEIRRAGPGSEELTVTNARYVPVSCEKEVDALLHLARQNRAVARTAQNERSSRSHSVFQLQISGEHSSRGLQCGAPLSLVDLAGSERLDPGLALGPGERERLRETQAINSSLSTLGLVIMALSNKESHVPYRNSKLTYLLQNSLGGSAKMLMFVNISPLEENVSESLNSLRFASKVRLPPVSLVRTRGWL

SEQ ID NO: 888856 - protein, 249 aa, Homo sapiens
MDPQRSPLLEVKGNIELKRPLIKAPSQLPLSGSRLKRRPDQMEDGLEPEKKRTRGLGATTKITTSHPRVPSLTTVPQTQGQTTAQKVSKKTGPRCSTAIATGLKNQKPVPAVPVQKSGTSGVPPMAGGKKPSKRPAWDLKGQLCDLNAELKRCRERTQTLDQENQQLQDQLRDAQQQVKALGTERTTLEGHLAKVQAQAEQGQQELKNLRACVLELEERLSTQEGLVQELQKKQVELQEAGRSRKQGSW

SEQ ID NO: 888857 - protein, 549 aa, Homo sapiens [sequence omitted]

SEQ ID NO: 888858 - protein, 120 aa, Homo sapiens
ENQQLQDQLRDAQQQVKALGTERTTLEGHLAKVQAQAEQGQQELKNLRACVLELEERLSTQEGLVQELQKKQVELQEERRGLMSQLEEKEVRARFSPDVSPAFLAEVMPPLPSRYPSSLG

SEQ ID NO: 888859 - protein, 216 aa, Homo sapiens
WWRIRHEALPAVYARKMAASQQQASAASSAAGVSGPSSAGGPGPQQQPQPPAQLVGPAQSGLLQQQQQDFDPVQRYKMLIPQLKESLQTLMKVAAQNLIQNTNIDNGQKSSDGPIQRFDKCLEEFYALCDQLELCLRLAHECLSQSCDSAKHSPTLVPTATKPDAVQPDSLPYPQYLAVIKAQISCAKDIHTALLDCANKVTGKTPAPPAGPGGTL

SEQ ID NO: 888860 - protein, 200 aa, Homo sapiens
MAASQQQASAASSAAGVSGPSSAGGPGPQQQPQPPAQLVGPAQSGLLQQQQQDFDPVQRYKMLIPQLKESLQTLMKVAAQNLIQNTNIDNGQKSSDGPIQRFDKCLEEFYALCDQLELCLRLAHECLSQSCDSAKHSPTLVPTATKPDAVQPDSLPYPQYLAVIKAQISCAKDIHTALLDCANKVTGKTPAPPAGPGGTL

SEQ ID NO: 888861 - protein, 233 aa, Homo sapiens
AGLTSKRGLEIGMLKSNGERRSRNALPAVYARKMAASQQQASAASSAAGVSGPSSAGGPGPQQQPQPPAQLVGPAQSGLLQQQQQDFDPVQRYKMLIPQLKESLQTLMKVAAQNLIQNTNIDNGQKSSDGPIQRFDKCLEEFYALCDQLELCLRLAHECLSQSCDSAKHSPTLVPTATKPDAVQPDSLPYPQYLAVIKAQISCAKDIHTALLDCANKVTGKTPAPPAGPGGTL

SEQ ID NO: 888862 - protein, 233 aa, Homo sapiens; identical to SEQ ID NO: 888861

SEQ ID NO: 888863 - protein, 216 aa, Homo sapiens; identical to SEQ ID NO: 888859

SEQ ID NO: 888864 - protein, 121 aa, Homo sapiens
MRRSLKTSHFSEEPSTCLFLNHRNGSTDPTIILHISEPMFNGGKREMHGKRTPPFLLSLKFKDVCFGMPSLLPIHRLLKSLIYSRHMCLLCPKCITFLLVMADFGCVCVRHAVNNEMKAIA

SEQ ID NO: 888865 - protein, 298 aa, Homo sapiens
TGKPEVKSWQPPRPPQCSPPFYVSYSFIWVTNLFLLVQREEKQLEASLDALLSQVADLKNSLGSFICKLENEYGRLTCFALLSGQLNTLNKVLKHEKTPLFRNQVIIPLVLSPDRDEDLMRQTEGRVPVFSHEVVPDHLRTKPDPEVEEQEKQLTTDAARIGADAAQKQIQSLNKMCSNLLEKISKEERESESGGLRPNKQTFNPTDTNALVAAVAFGKGLSNWRPSGSSGPGQAGQPGAGTILAGTSGLQQVQMAGAPSQQQPMLSGVQMAQAGQPGKMPSGIKTNIKSASMHPYQR

SEQ ID NO: 888866 - protein, 225 aa, Homo sapiens
TGKPEVKSWQPPRPPQCSPPFYVSYSFIWVTNLFLLVQREEKQLEASLDALLSQVADLKNSLGSFICKLENEYGRLTWPSVLDSFALLSGQLNTLNKVLKHEKTPLFRNQVIIPLVLSPDRDEDLMRQTEGRVPVFSHEVVPDHLRTKPDPEVEEQEKQLTTDAARIGADAAQKQIQSLNKMCSNLLEKISKEERESESGVSGSFPTNHTFNPSDNFGFVGLFAL

SEQ ID NO: 888867 - protein, 304 aa, Homo sapiens
TGKPEVKSWQPPRPPQCSPPFYVSYSFIWVTNLFLLVQREEKQLEASLDALLSQVADLKNSLGSFICKLENEYGRLTWPSVLDSFALLSGQLNTLNKVLKHEKTPLFRNQVIIPLVLSPDRDEDLMRQTEGRVPVFSHEVVPDHLRTKPDPEVEEQEKQLTTDAARIGADAAQKQIQSLNKMCSNLLEKISKEERESESGGLRPNKQTFNPTDTNALVAAVAFGKGLSNWRPSGSSGPGQAGQPGAGTILAGTSGLQQVQMAGAPSQQQPMLSGVQMAQAGQPGKMPSGIKTNIKSASMHPYQR

SEQ ID NO: 888868 - protein, 179 aa, Homo sapiens
MRQTEGRVPVFSHEVVPDHLRTKPDPEVEEQEKQLTTDAARIGADAAQKQIQSLNKMCSNLLEKISKEERESESGGLRPNKQTFNPTDTNALVAAVAFGKGLSNWRPSGSSGPGQAGQPGAGTILAGTSGLQQVQMAGAPSQQQPMLSGVQMAQAGQPGKMPSGIKTNIKSASMHPYQR

SEQ ID NO: 888869 - protein, 284 aa, Homo sapiens
DWKTGSEIVAAASAAAMQREEKQLEASLDALLSQVADLKNSLGSFICKLENEYGRLTWPSVLDSFALLSGQLNTLNKVLKHEKTPLFRNQVIIPLVLSPDRDEDLMRQTEGRVPVFSHEVVPDHLRTKPDPEVEEQEKQLTTDAARIGADAAQKQIQSLNKMCSNLLEKISKEERESESGGLRPNKQTFNPTDTNALVAAVAFGKGLSNWRPSGSSGPGQAGQPGAGTILAGTSGLQQVQMAGAPSQQQPMLSGVQMAQAGQPGKMPSGIKTNIKSASMHPYQR

SEQ ID NO: 888870 - protein, 298 aa, Homo sapiens; identical to SEQ ID NO: 888865

SEQ ID NO: 888871 - protein, 265 aa, Homo sapiens
MDAQTLASHSLTRHVIVSAAAFSLYDTRYAENEYGRLTWPSVLDSFALLSGQLNTLNKVLKHEKTPLFRNQVIIPLVLSPDRDEDLMRQTEGRVPVFSHEVVPDHLRTKPDPEVEEQEKQLTTDAARIGADAAQKQIQSLNKMCSNLLEKISKEERESESGGLRPNKQTFNPTDTNALVAAVAFGKGLSNWRPSGSSGPGQAGQPGAGTILAGTSGLQQVQMAGAPSQQQPMLSGVQMAQAGQPGKMPSGIKTNIKSASMHPYQR

SEQ ID NO: 888872 - protein, 187 aa, Homo sapiens
DWKTGSEIVAAASAAAMQREEKQLEASLDALLSQVADLKNSLGSFICKLENEYGRLTWPSVLDSFALLSGQLNTLNKVLKHEKTPLFRNQVIIPLVLSPDRDEDLMRQTEGRVPVFSHEVVPDHLRTKPDPEVEEQEKQLTTDAARIGADAAQKQIQSLNKMCSNLLEKISKEERESESGGYDGTGG

SEQ ID NO: 888873 - protein, 317 aa, Homo sapiens
DWKTGSEIVAAASAAAMQREEKQLEASLDALLSQVADLKNSLGSFICKLENEYGRLTWPSVLDSFALLSGQLNTLNKVLKHEKTPLFRNQVIIPLVLSPDRDEDLMRQTEGRVPVFSHEVVPDHLRTKPDPEVEEQEKQLTTDAARIGADAAQKQIQSLNKMCSNLLEKISKEERESESGGLRPNKQTFNPTDTNALVAAVAFGKGLSNWRPSGSSGPGQAGQPGAGTILAGTSGLQQVQMAGAPSQQQPMLSGVQMAQAGQPGKMPSGIKTNIKSASMHPYQRPSCLGFILAIPLRRKVKKLLGQEGKKNAHLQLW

SEQ ID NO: 888874 - protein, 257 aa, Homo sapiens
DWKTGSEIVAAASAAAMQREEKQLEASLDALLSQVADLKNSLGSFICKLENEYGRLTWPSVLDSFALLSGQLNTLNKVLKHEKTPLFRNQVIIPLVLSPDRDEDLMRQTEGRVPVFSHEVVPDHLRTKPDPEVEEQEKQLTTDAARIGADAAQKQIQSLNKMCSNLLEVSGRTSRPLTLQTLMPWWQLLPLGKDYLIGDLQAAVVLARQASQELGRSLQEPQDYSRCRWQELQASSSQCSVGYKWLRQVNQGKCQVE

SEQ ID NO: 888875 - protein, 143 aa, Homo sapiens
GRGTTFLHLVTTTRPSVLDSFALLSGQLNTLNKVLKHEKTPLFRNQVIIPLVLSPDRDEDLMRQTEGRVPVFSHEVVPDHLRTKPDPEVEEQEKQLTTDAARIGADAAQKQIQSLNKMCSNLLEKISKEERESESGGYDGTGG

SEQ ID NO: 888876 - protein, 337 aa, Homo sapiens
TGKPEVKSWQPPRPPQCSPPFYVSYSFIWVTNLFLLVQREEKQLEASLDALLSQVADLKNSLGSFICKLENEYGRLTWPSVLDSFALLSGQLNTLNKVLKHEKTPLFRNQVIIPLVLSPDRDEDLMRQTEGRVPVFSHEVVPDHLRTKPDPEVEEQEKQLTTDAARIGADAAQKQIQSLNKMCSNLLEKISKEERESESGGLRPNKQTFNPTDTNALVAAVAFGKGLSNWRPSGSSGPGQAGQPGAGTILAGTSGLQQVQMAGAPSQQQPMLSGVQMAQAGQPGKMPSGIKTNIKSASMHPYQRPSCLGFILAIPLRRKVKKLLGQEGKKNAHLQLW

SEQ ID NO: 888877 - protein, 255 aa, Homo sapiens
DWKTGSEIVAAASAAAMQREEKQLEASLDALLSQVADLKNSLGSFICKLENEYGRLTWPSVLDSFALLSGQLNTLNKVLKHEKTPLFRNQVIIPLVLSPDRDEDLMRQTEGRVPVFSHEVVPDHLRTKPDPEVEEQEKQLTTDAARIGADAAQKQIQSLNKMCSNLLEKISKEERESESGGLRPNKQTFNPTDTNAQWGTNGSGRSTRENAKWNKNQHQVGFHASLPAVSVAGNLDSLVLFAELGSEITFCSRLT

SEQ ID NO: 888878 - protein, 366 aa, Homo sapiens
DWKTGSEIVAAASAAAMQREEKQLEASLDALLSQVADLKNSLGSFICKLENEYGRLTWPSVLDSFALLSGQLNTLNKVLKHEKTPLFRNQVIIPLVLSPDRDEDLMRQTEGRVPVFSHEVVPDHLRTKPDPEVEEQEKQLTTDAARIGADAAQKQIQSLNKMCSNLLEKISKEERESESGGLRPNKQTFNPTDTNALVAAVAFGKGLSNWRPSGSSGPGQAGQPGAGTILAGTSGLQQVQMAGAPSQQQPMLSGVQMAQAGQPGKMPSGIKTNIKSASMHPYQRVLSQDGGCCELVPRGDEARRSPDPGYPLMGSPLLMTSILLTYVYFVLSLGPRIMANRKPFQLRGFMIVYNFSLVALSLYIVY

SEQ ID NO: 888879 - protein, 284 aa, Homo sapiens; identical to SEQ ID NO: 888869

SEQ ID NO: 888880 - protein, 179 aa, Homo sapiens; identical to SEQ ID NO: 888868

SEQ ID NO: 888881 - protein, 179 aa, Homo sapiens; identical to SEQ ID NO: 888868

SEQ ID NO: 888882 - protein, 240 aa, Homo sapiens
GRGTTFLHLVTTTRPSVLDSFALLSGQLNTLNKVLKHEKTPLFRNQVIIPLVLSPDRDEDLMRQTEGRVPVFSHEVVPDHLRTKPDPEVEEQEKQLTTDAARIGADAAQKQIQSLNKMCSNLLEKISKEERESESGGLRPNKQTFNPTDTNALVAAVAFGKGLSNWRPSGSSGPGQAGQPGAGTILAGTSGLQQVQMAGAPSQQQPMLSGVQMAQAGQPGKMPSGIKTNIKSASMHPYQR

SEQ ID NO: 888883 - protein, 119 aa, Homo sapiens
TGKPEVKSWQPPRPPQCSPPFYVSYSFIWVTNLFLLVQREEKQLEASLDALLSQVADLKNSLGSFICKLENEYGRLTWPSVLDSFALLSGQLNTLNKVLKHEKTPLGRLKDGCLFSAMR

SEQ ID NO: 888884 - protein, 277 aa, Homo sapiens
TGKPEVKSWQPPRPPQCSPPFYVSYSFIWVTNLFLLVQREEKQLEASLDALLSQVADLKNSLGSFICKLENEYGRLTWPSVLDSFALLSGQLNTLNKVLKHEKTPLFRNQVIIPLVLSPDRDEDLMRQTEGRVPVFSHEVVPDHLRTKPDPEVEEQEKQLTTDAARIGADAAQKQIQSLNKMCSNLLEVSGRTSRPLTLQTLMPWWQLLPLGKDYLIGDLQAAVVLARQASQELGRSLQEPQDYSRCRWQELQASSSQCSVGYKWLRQVNQGKCQVE

SEQ ID NO: 888885 - protein, 284 aa, Homo sapiens; identical to SEQ ID NO: 888869

SEQ ID NO: 888886 - protein, 284 aa, Homo sapiens; identical to SEQ ID NO: 888869

SEQ ID NO: 888887 - protein, 257 aa, Homo sapiens
MPERDSEPFSNPLAPDGHDVDDPHSFHQSKLTNEDFRKLLMTPRAAPTSAPPSKSRHHEMPREYNEDEDPAARRRKKKSYYAKLRQQEIERERELAEKYRDRAKERRDGVNKDYEETELISTTANYRAVGPTAEADKSAAEKRRQLIQESKFLGGDMEHTHLVKGLDFALLQKVRAEIASKEKEEEELMEKPQKETKKDEDPENKIEFKTRLGEYSFYTSDYAFWMNCTEFNALGRICFSFPPTSFLLSFFLRQCLT

SEQ ID NO: 888888 - protein, 557 aa, Homo sapiens
MPERDSEPFSNPLAPDGHDVDDPHSFHQSKLTNEDFRKLLMTPRAAPTSAPPSKSRHHEMPREYNEDEDPAARRRKKKSYYAKLRQQEIERERELAEKYRDRAKERRDGVNKDYEETELISTTANYRAVGPTAEADKSAAEKRRQLIQESKFLGGDMEHTHLVKGLDFALLQKVRAEIASKEKEEEELMEKPQKETKKDEDPENKIEFKTRLGRNVYRMLFKSKAYERNELFLPGRMAYVVDLDDEYADTDIPTTLIRSKADCPTMEAQTTLTTNDIVISKLTQILSYLRQGTRNKKLKKKDKGKLEEKKPPEADMNIFEDIGDYVPSTTKTPRDKERERYRERERDRERDRDRDRERERERDRERERERDREREEEKKRHSYFEKPKVDDEPMDVDKGPGSTKELIKSINEKFAGSAGWEGTESLKKPEDKKQLGDFFGMSNSYAECYPATMDDMAVDSDEEVDYSKMDQGNKKGPLGRWDFDTQEEYSEYMNNKEALPKAAFQYGIKMSEGRKTRRFKETNDKAELDRQWKKISAIIEKRKKMEADGVEVKRPKY

SEQ ID NO: 888889 - protein, 557 aa, Homo sapiens; identical to SEQ ID NO: 888888

SEQ ID NO: 888890 - protein, 474 aa, Homo sapiens
MPERDSEPFSNPLAPDGHDVDDPHSFHQSKLTNEDFRKLLMTPRAAPTSAPPSKSRHHEMPREYNEDEDPAARRRKKKSYYAKLRQQEIERERELAEKYRDRAKERRDGVNKDYEETELISTTANYRAVGPTAEADKSAAEKRRQLIQESKFLGGDMEHTHLVKGLDFALLQKVRAEIASKEKEEEELMEKPQKETKKDEDPENKIEFKTRLGRNVYRMLFKSKAYERNELFLPGRMAYVVDLDDEYADTDIPTTLIRSKADCPTMEAQTTLTTNDIVISKLTQILSYLRQGTRNKKLKKKDKGKLEEKKPPEADMNIFEDIGDYVPSTTKTPRDKERERYRERERDRERDRDRDRERERERDRERERERDREREEEKKRHSYFEKPKVDDEPMDVDKGPGSTKELIKSINEKFAGSAGWEGTESLKKPEDKKQLGDFFGMSNSYAECYPATMDDMAVDSDEEVDYSKMDQVCS

SEQ ID NO: 888891 - protein, 474 aa, Homo sapiens; identical to SEQ ID NO: 888890

SEQ ID NO: 888892 - protein, 549 aa, Homo sapiens [sequence omitted]

SEQ ID NO: 888893 - protein, 551 aa, Homo sapiens
MPERDSEPFSNPLAPDGHDVDDPHSFHQSKLTNEDFRKLLMTPRAAPTSAPPSKSRHHEMPREYNEDEDPAARRRKKKSYYAKLRQQEIERERELAEKYRDRAKERRDGVNKDYEETELISTTANYRAVGPTAEADKSAAEKRRQLIQESKFLGGDMEHTHLVKGLDFALLQKVRAEIASKEKEEEELMEKPQKETKKDEDPENKIEFKTRLGRNVYRMLFKSKAYERNELFLPGRMAYVVDLDDEYADTDIPTTLIRSKADCPTMEAQTTLTTNDIVISKLTQILSYLRQGTRNKKLKKKDKGKLEEKKPPEADMNIFEDIGDYVPSTTKTPRDKERERYRERERDRERDRDRDRERERERDRERERERDREREEEKKRHSYFEKPKVDDEPMDVDKGPGSTKELIKSINEKFAGSAGWEGTESLKKPEDKKQLGDFFGMSNSYAECYPATMDDMAVDSDEEVDYSKMDQGNKKGPLGRWDFDTQEEYSEYMNNKEALPKAAFQYGIKMSEGRKTRRFKETNDKAELDRQWKKISALIAEEGEGWKLMGV

SEQ ID NO: 888894 - protein, 546 aa, Homo sapiens
MPERDSEPFSNPLAPDGHDVDDPHSFHQSKLTNEDFRKLLMTPRAAPTSAPPSKSRHHEMPREYNEDEDPAARRRKKKSYYAKLRQQEIERERELAEKYRDRAKERRDGVNKDYEETELISTTANYRAVGPTAEADKSAAEKRRQLIQESKFLGGDMEHTHLVKGLDFALLQKVRAEIASKEKEEEELMEKPQKETKKDEDPENKIEFKTRLGRNVYRMLFKSKAYERNELFLPGRMAYVVDLDDEYADTDIPTTLIRSKADCPTMEAQTTLTTNDIVISKLTQILSYLRQGTRNKKLKKKDKGKLEEKKPPEADMNIFEDIGDYVPSTTKTPRDKERERYRERERDRERDRDRDRERERERDRERERERDREREEEKKRHSYFEKPKVDDEPMDVDKGPGSTKELIKSINEKFAGSAGWEGTESLKKPEDKKQLGDFFGMSNSYAECYPATMDDMAVDSDEEVDYSKMDQGNKKGPLGRWDFDTQEEYSEYMNNKEALPKAAFQYGTAGGGNQGPGNPGNKPDARDRLRDPGDQRTEGEARTPTS

SEQ ID NO: 888895 - protein, 466 aa, Homo sapiens
MPERDSEPFSNPLAPDGHDVDDPHSFHQSKLTNEDFRKLLMTPRAAPTSAPPSKSRHHEMPREYNEDEDPAARRRKKKSYYAKLRQQEIERERELAEKYRDRAKERRDGVNKDYEETELISTTANYRAVGPTAEADKSAAEKRRQLIQESKFLGGDMEHTHLVKGLDFALLQKVRAEIASKEKEEEELMEKPQKETKKDEDPENKIEFKTRLGRNVYRMLFKSKAYERNELFLPGRMAYVVDLDDEYADTDIPTTLIRSKADCPTMEAQTTLTTNDIVISKLTQILSYLRQGTRNKKLKKKDKGKLEEKKPPEADMNIFEDIGDYVPSTTKTPRDKERERYRERERDRERDRDRDRERERERDRERERERDREREEEKKRHSYFEKPKVDDEPMDVDKGPGSTKELIKSINEKFAGSAGWEGTESLKKPEDKKQLGDFFGMSNSYAECYPATMDDMAVCGGSTLYV

SEQ ID NO: 888896 - protein, 474 aa, Homo sapiens
MPERDSEPFSNPLAPDGHDVDDPHSFHQSKLTNEDFRKLLMTPRAAPTSAPPSKSRHHEMPREYNEDEDPAARRRKKKSYYAKLRQQEIERERELAEKYRDRAKERRDGVNKDYEETELISTTANYRAVGPTAEADKSAAEKRRQLIQESKFLGGDMEHTHLVKGLDFALLQKVRAEIASKEKEEEELMEKPQKETKKDEDPENKIEFKTRLGRNVYRMLFKSKAYERNELFLPGRMAYVVDLDDEYADTDIPTTLIRSKADCPTMEAQTTLTTNDIVISKLTQILSYLRQGTRNKKLKKKDKGKLEEKKPPEADMNIFEDIGDYVPSTTKTPRDKERERYRERERDRERDRDRDRERERERDRERERERDREREEEKKRHSYFEKPKVDDEPMDVDKGPGSTKELIKSINEKFAGSAGWEGTESLKKPEDKKQLGDFFFLSLTTDSSSLSTEGVVLGMMAEAVSDPLSLFFPL

SEQ ID NO: 888897 - protein, 517 aa, Homo sapiens [sequence omitted]

SEQ ID NO: 888898 - protein, 651 aa, Homo sapiens
MPERDSEPFSNPLAPDGHDVDDPHSFHQSKLTNEDFRKLLMTPRAAPTSAPPSKSRHHEMPREYNEDEDPAARRRKKKSFLKSSLVSYDGSEIGSRSTIALVAGWNGMWMEASLLATEIQKVIEGEDCSENLLERQCLELTIFTGLLSHDHHEMPREYKEDEDPAAQKEERRNYYAKLRQQEIERERELAEKYRDRAKERRDGVNKDYEETELISTTANYRAVGPTAEADKSAAEKRRQLIQESKFLGGDMEHTHLVKGLDFALLQKVRAEIASKEKEEEELMEKPQKETKKDEDPENKIEFKTRLGRNVYRMLFKSKAYERNELFLPGRMAYVVDLDDEYADTDIPTTLIRSKADCPTMEAQTTLTTNDIVISKLTQILSYLRQGTRNKKLKKKDKGKLEEKKPPEADMNIFEDIGDYVPSTTKTPRDKERERYRERERDRERDRDRDRERERERDRERERERDREREEEKKRHSYFEKPKVDDEPMDVDKGPGSTKELIKSINEKFAGSAGWEGTESLKKPEDKKQLGDFFGMSNSYAECYPATMDDMAVDSDEEVDYSKMDQGNKKGPLGRWDFDTQEEYSEYMNNKEALPKAAFQYGIKMSEGRKTRRFKETNDKAELDRQWKKISAIIEKRKKMEADGVEVKRPKY

SEQ ID NO: 888899 - protein, 493 aa, Homo sapiens
LDTPTRSTLTLGVTFQHEIEDKYPDYIHLLEGTGTSAPGNSDPGIGLGILLLHLMPTPQPHRSPFVPPAEADKSAAEKRRQLIQESKFLGGDMEHTHLVKGLDFALLQKVRAEIASKEKEEEELMEKPQKETKKDEDPENKIEFKTRLGRNVYRMLFKSKAYERNELFLPGRMAYVVDLDDEYADTDIPTTLIRSKADCPTMEAQTTLTTNDIVISKLTQILSYLRQGTRNKKLKKKDKGKLEEKKPPEADMNIFEDIGDYVPSTTKTPRDKERERYRERERDRERDRDRDRERERERDRERERERDREREEEKKRHSYFEKPKVDDEPMDVDKGPGSTKELIKSINEKFAGSAGWEGTESLKKPEDKKQLGDFFGMSNSYAECYPATMDDMAVDSDEEVDYSKMDQGNKKGPLGRWDFDTQEEYSEYMNNKEALPKAAFQYGIKMSEGRKTRRFKETNDKAELDRQWKKISAIIEKRKKMEADGVEVKRPKY

SEQ ID NO: 888900 - protein, 339 aa, Homo sapiens [sequence omitted]

SEQ ID NO: 888901 - protein, 304 aa, Homo sapiens
VSKYHVSSGGSSLPAPFIFLFKLLVTGSLTQILSYLRQGTRNKKLKKKDKGKLEEKKPPEADMNIFEDIGDYVPSTTKTPRDKERERYRERERDRERDRDRDRERERERDRERERERDREREEEKKRHSYFEKPKVDDEPMDVDKGPGSTKELIKSINEKFAGSAGWEGTESLKKPEDKKQLGDFFGMSNSYAECYPATMDDMAVDSDEEVDYSKMDQGNKKGPLGRWDFDTQEEYSEYMNNKEALPKAAFQYGIKMSEGRKTRRFKETNDKAELDRQWKKISAIIEKRKKMEADGVEVKRPKY

SEQ ID NO: 888902 - protein, 242 aa, Homo sapiens
MNIFEDIGDYVPSTTKTPRDKERERYRERERDRERDRDRDRERERERDRERERERDREREEEKKRHSYFEKPKVDDEPMDVDKGPGSTKELIKSINEKFAGSAGWEGTESLKKPEDKKQLGDFFGMSNSYAECYPATMDDMAVDSDEEVDYSKMDQGNKKGPLGRWDFDTQEEYSEYMNNKEALPKAAFQYGIKMSEGRKTRRFKETNDKAELDRQWKKISAIIEKRKKMEADGVEVKRPKY

SEQ ID NO: 888903 - protein, 279 aa, Homo sapiens
MSAQEVLLFQLPLSFFLSFLLRVPCLRYERIWVSLLMTCIFEDIGDYVPSTTKTPRDKERERYRERERDRERDRDRDRERERERDRERERERDREREEEKKRHSYFEKPKVDDEPMDVDKGPGSTKELIKSINEKFAGSAGWEGTESLKKPEDKKQLGDFFGMSNSYAECYPATMDDMAVDSDEEVDYSKMDQGNKKGPLGRWDFDTQEEYSEYMNNKEALPKAAFQYGIKMSEGRKTRRFKETNDKAELDRQWKKISAIIEKRKKMEADGVEVKRPKY

SEQ ID NO: 888904 - protein, 251 aa, Homo sapiens
QYTEMETSSPLLLEQGKHNRGGNTGQSRDKERERYRERERDRERDRDRDRERERERDRERERERDREREEEKKRHSYFEKPKVDDEPMDVDKGPGSTKELIKSINEKFAGSAGWEGTESLKKPEDKKQLGDFFGMSNSYAECYPATMDDMAVDSDEEVDYSKMDQGNKKGPLGRWDFDTQEEYSEYMNNKEALPKAAFQYGIKMSEGRKTRRFKETNDKAELDRQWKKISAIIEKRKKMEADGVEVKRPKY

SEQ ID NO: 888905 - protein, 117 aa, Homo sapiens
MSNSYAECYPATMDDMAVDSDEEVDYSKMDQGNKKGPLGRWDFDTQEEYSEYMNNKEALPKAAFQYGIKMSEGRKTRRFKETNDKAELDRQWKKISAIIEKRKKMEADGVEVKRPKY

SEQ ID NO: 888906 - protein, 133 aa, Homo sapiens
MLKKPEDKKQLGDFFGMSNSYAECYPATMDDMAVDSDEEVDYSKMDQGNKKGPLGRWDFDTQEEYSEYMNNKEALPKAAFQYGIKMSEGRKTRRFKETNDKAELDRQWKKISAIIEKRKKMEADGVEVKRPKY

SEQ ID NO: 888907 - protein, 135 aa, Homo sapiens
MPERDSEPFSNPLAPDGHDVDDPHSFHQSKLTNEDFRKLLMTPRAAPTSAPPSKSRHHEMPREYNEDEDPAARRRKKKSYYAKLRQQEIERERELAEKYRDRAKERRDGVNKDYEETELISTTANYRAVGPTAEA

SEQ ID NO: 888908 - protein, 156 aa, Homo sapiens
MDVDKGPGSTKELIKSINEKFAGSAGWEGTESLKKPEDKKQLGDFFGMSNSYAECYPATMDDMAVDSDEEVDYSKMDQGNKKGPLGRWDFDTQEEYSEYMNNKEALPKAAFQYGIKMSEGRKTRRFKETNDKAELDRQWKKISAIIEKRKKMEADG

SEQ ID NO: 888909 - protein, 557 aa, Homo sapiens; identical to SEQ ID NO: 888888

SEQ ID NO: 888910 - protein, 557 aa, Homo sapiens; identical to SEQ ID NO: 888888

SEQ ID NO: 888911 - protein, 963 aa, Homo sapiens
RPGRGGKMAAAVGVRGRYELPPCSGPGWLLSLSALLSVAARGAFATTHWVVTEDGKIQQQVDSPMNLKHPHDLVILMRQEATVNYLKELEKQLVAQKIHIEENEDRDTGLEQRHNKEDPDCIKAKVPLGDLDLYDGTYITLESKDISPEDYIDTESPVPPDPEQPDCTKILELPYSIHAFQHLRGVQERVNLSAPLLPKEDPIFTYLSKRLGRSIDDIGHLIHEGLQKNTSSWVLYNMASFYWRIKNEPYQVVECAMRALHFSSRHNKDIALVNLANVLHRAHFSADAAVVVHAALDDSDFFTSYYTLGNIYAMLGEYNHSVLCYDHALQARPGFEQAIKRKHAVLCQQKLEQKLEAQHRSLQRTLNELKEYQKQHDHYLRQQEILEKHKLIQEEQILRNIIHETQMAKEAQLGNHQICRLVNQQHSLHCQWDQPVRYHRGDIFENVDYVQFGEDSSTSSMMSVNFDVQSNQSDINDSVKSSPVAHSILWIWGRDSDAYRDKQHILWPKRADCTESYPRVPVGGELPTYFLPPENKGLRIHELSSDDYSTEEEAQTPDCSITDFRKSHTLSYLVKELEVRMDLKAKMPDDHARKILLSRINNYTIPEEEIGSFLFHAINKPNAPIWLILNEAGLYWRAVGNSTFAIACLQRALNLAPLQYQDVPLVNLANLLIHYGLHLDATKLLLQALAINSSEPLTFLSLGNAYLALKNISGALEAFRQALKLTTKCPECENSLKLIRCMQFYPFLYNITSSVCSGNCHEKTLDNSHDKQKYFDNSQSLDAAEEEPSERGTEEDPVFSVENSGRDSDALRLESTVVEESNGSDEMENSDETKMSEEILALVDEFQQAWPLEGFGGALEMKGRRLDLQGIRVLKKGPQDGVARSSCYGDCRSEDDEATEWITFQVKRVKKPKGDHKKTPGKKVETGQIENGHRYQANLEITGPKVASPGPQGLLDWKTRKVP

SEQ ID NO: 888912 - protein, 1205 aa, Homo sapiens
RPGRGGKMAAAVGVRGRYELPPCSGPGWLLSLSALLSVAARGAFATTHWVVTEDGKIQQQVDSPMNLKHPHDLVILMRQEATVNYLKELEKQLVAQKIHIEENEDRDTGLEQRHNKEDPDCIKAKVPLGDLDLYDGTYITLESKDISPEDYIDTESPVPPDPEQPDCTKILELPYSIHAFQHLRGVQERVNLSAPLLPKEDPIFTYLSKRLGRSIDDIGHLIHEGLQKNTSSWVLYNMASFYWRIKNEPYQVVECAMRALHFSSRHNKDIALVNLANVLHRAHFSADAAVVVHAALDDSDFFTSYYTLGNIYAMLGEYNHSVLCYDHALQARPGFEQAIKRKHAVLCQQKLEQKLEAQHRSLQRTLNELKEYQKQHDHYLRQQEILEKHKLIQEEQILRNIIHETQMAKEAQLGNHQICRLVNQQHSLHCQWDQPVRYHRGDIFENVDYVQFGEDSSTSSMMSVNFDVQSNQSDINDSVKSSPVAHSILWIWGRDSDAYRDKQHILWPKRADCTESYPRVPVGGELPTYFLPPENKGLRIHELSSDDYSTEEEAQTPDCSITDFRKSHTLSYLVKELEVRMDLKAKMPDDHARKILLSRINNYTIPEEEIGSFLFHAINKPNAPIWLILNEAGLYWRAVGNSTFAIACLQRALNLAPLQYQDVPLVNLANLLIHYGLHLDATKLLLQALAINSSEPLTFLSLGNAYLALKNISGALEAFRQALKLTTKCPECENSLKLIRCMQFYPFLYNITSSVCSGNCHEKTLDNSHDKQKYFDNSQSLDAAEEEPSERGTEEDPVFSVENSGRDSDALRLESTVVEESNGSDEMENSDETKMSEEILALVDEFQQAWPLEGFGGALEMKGRRLDLQGIRVLKKGPQDGVARSSCYGDCRSEDDEATEWITFQVKRVKKPKGDHKKTPGKKVETGQIENGHRYQANLEITGPKVASPGPQGKKRDYQRLGWPSPDECLKLRWVELTAIVSTWLAVSSKNIDITEHIDFATPIQQPAMEPLCNGNLPTSMHTLDHLHGVSNRASLHYTGESQLTEVLQNLGKDQYPQQSLEQIGTRIAKVLEKNQTSWVLSSMAALYWRVKGQGKKAIDCLRQALHYAPHQMKDVPLISLANILHNAKLWNDAVIVATMAVEIAPHFAVNHFTLGNVYVAMEEFEKALVWYESTLKLQPEFVPAKNRIQTIQCHLMLKKGRRSP

SEQ ID NO: 888913 - protein, 1188 aa, Homo sapiens
RPGRGGKMAAAVGVRGRYELPPCSGPGWLLSLSALLSVAARGAFATTHWVVTEDGKIQQQVDSPMNLKHPHDLVILMRQEATVNYLKELEKQLVAQKIHIEENEDRDTGLEQRHNKEDPDCIKAKVPLGDLDLYDGTYITLESKDISPEDYIDTESPVPPDPEQPDCTKILELPYSIHAFQHLRGVQERVNLSAPLLPKEDPIFTYLSKRLGRSIDDIGHLIHEGLQKNTSSWVLYNMASFYWRIKNEPYQVVECAMRALHFSSRHNKDIALVNLANVLHRAHFSADAAVVVHAALDDSDFFTSYYTLGNIYAMLGEYNHSVLCYDHALQARPGFEQAIKRKHAVLCQQKLEQKLEAQHRSLQRTLNELKEYQKQHDHYLRQQEILEKHKLIQEEQILRNIIHETQMAKEAQLGNHQICRLVNQQHSLHCQWDQPVRYHRGDIFENVDYVQFGEDSSTSSMMSVNFDVQSNQSDINDSVKSSPVAHSILWIWGRDSDAYRDKQHILWPKRADCTESYPRVPVGGELPTYFLPPENKGLRIHELSSDDYSTEEEAQTPDCSITDFRKSHTLSYLVKELEVRMDLKAKMPDDHARKSFLFHAINKPNAPIWLILNEAGLYWRAVGNSTFAIACLQRALNLAPLQYQDVPLVNLANLLIHYGLHLDATKLLLQALAINSSEPLTFLSLGNAYLALKNISGALEAFRQALKLTTKCPECENSLKLIRCMQFYPFLYNITSSVCSGNCHEKTLDNSHDKQKYFDNSQSLDAAEEEPSERGTEEDPVFSVENSGRDSDALRLESTVVEESNGSDEMENSDETKMSEEILALVDEFQQAWPLEGFGGALEMKGRRLDLQGIRVLKKGPQDGVARSSCYGDCRSEDDEATEWITFQVKRVKKPKGDHKKTPGKKVETGQIENGHRYQANLEITGPKVASPGPQGKKRDYQRLGWPSPDECLKLRWVELTAIVSTWLAVSSKNIDITEHIDFATPIQQPAMEPLCNGNLPTSMHTLDHLHGVSNRASLHYTGESQLTEVLQNLGKDQYPQQSLEQIGTRIAKVLEKNQTSWVLSSMAALYWRVKGQGKKAIDCLRQALHYAPHQMKDVPLISLANILHNAKLWNDAVIVATMAVEIAPHFAVNHFTLGNVYVAMEEFEKALVWYESTLKLQPEFVPAKNRIQTIQCHLMLKKGRRSP

SEQ ID NO: 888914 - protein, 1257 aa, Homo sapiens
RPGRGGKMAAAVGVRGRYELPPCSGPGWLLSLSALLSVAARGAFATTHWVVTEDGKIQQQVDSPMNLKHPHDLVILMRQEATVNYLKELEKQLVAQKIHIEENEDRDTGLEQRHNKEDPDCIKAKVPLGDLDLYDGTYITLESKDISPEDYIDTESPVPPDPEQPDCTKILELPYSIHAFQHLRGVQERVNLSAPLLPKEDPIFTYLSKRLGRSIDDIGHLIHEGLQKNTSSWVLYNMASFYWRIKNEPYQVVECAMRALHFSSRHNKDIALVNLANVLHRAHFSADAAVVVHAALDDSDFFTSYYTLGNIYAMLGEYNHSVLCYDHALQARPGFEQAIKRKHAVLCQQKLEQKLEAQHRSLQRTLNELKEYQKQHDHYLRQQEILEKHKLIQEEQILRNIIHETQMAKEAQLGNHQICRLVNQQHSLHCQWDQPVRYHRGDIFENVDYVQFGEDSSTSSMMSVNFDVQSNQSDINDSVKSSPVAHSILWIWGRDSDAYRDKQHILWPKRADCTESYPRVPVGGELPTYFLPPENKGLRQVVMDLAKHLILHDCHQRFFESTSLGLEKLSLYLEVTQNFENMNLVPFSCARIHELSSDDYSTEEEAQTPDCSITDFRKSHTLSYLVKELEVRMDLKAKMPDDHARKILLSRINNYTIPEEEIGSFLFHAINKPNAPIWLILNEAGLYWRAVGNSTFAIACLQRALNLAPLQYQDVPLVNLANLLIHYGLHLDATKLLLQALAINSSEPLTFLSLGNAYLALKNISGALEAFRQALKLTTKCPECENSLKLIRCMQFYPFLYNITSSVCSGNCHEKTLDNSHDKQKYFDNSQSLDAAEEEPSERGTEEDPVFSVENSGRDSDALRLESTVVEESNGSDEMENSDETKMSEEILALVDEFQQAWPLEGFGGALEMKGRRLDLQGIRVLKKGPQDGVARSSCYGDCRSEDDEATEWITFQVKRVKKPKGDHKKTPGKKVETGQIENGHRYQANLEITGPKVASPGPQGKKRDYQRLGWPSPDECLKLRWVELTAIVSTWLAVSSKNIDITEHIDFATPIQQPAMEPLCNGNLPTSMHTLDHLHGVSNRASLHYTGESQLTEVLQNLGKDQYPQQSLEQIGTRIAKVLEKNQTSWVLSSMAALYWRVKGQGKKAIDCLRQALHYAPHQMKDVPLISLANILHNAKLWNDAVIVATMAVEIAPHFAVNHFTLGNVYVAMEEFEKALVWYESTLKLQPEFVPAKNRIQTIQCHLMLKKGRRSP

SEQ ID NO: 888915 - protein, 1141 aa, Homo sapiens
MNLKHPHDLVILMRQEATVNYLKELEKQLVAQKIHIEENEDRDTGLEQRHNKEDPDCIKAKVPLGDLDLYDGTYITLESKDISPEDYIDTESPVPPDPEQPDCTKILELPYSIHAFQHLRGVQERVNLSAPLLPKEDPIFTYLSKRLGRSIDDIGHLIHEGLQKNTSSWVLYNMASFYWRIKNEPYQVVECAMRALHFSSRHNKDIALVNLANVLHRAHFSADAAVVVHAALDDSDFFTSYYTLGNIYAMLGEYNHSVLCYDHALQARPGFEQAIKRKHAVLCQQKLEQKLEAQHRSLQRTLNELKEYQKQHDHYLRQQEILEKHKLIQEEQILRNIIHETQMAKEAQLGNHQICRLVNQQHSLHCQWDQPVRYHRGDIFENVDYVQFGEDSSTSSMMSVNFDVQSNQSDINDSVKSSPVAHSILWIWGRDSDAYRDKQHILWPKRADCTESYPRVPVGGELPTYFLPPENKGLRIHELSSDDYSTEEEAQTPDCSITDFRKSHTLSYLVKELEVRMDLKAKMPDDHARKILLSRINNYTIPEEEIGSFLFHAINKPNAPIWLILNEAGLYWRAVGNSTFAIACLQRALNLAPLQYQDVPLVNLANLLIHYGLHLDATKLLLQALAINSSEPLTFLSLGNAYLALKNISGALEAFRQALKLTTKCPECENSLKLIRCMQFYPFLYNITSSVCSGNCHEKTLDNSHDKQKYFDNSQSLDAAEEEPSERGTEEDPVFSVENSGRDSDALRLESTVVEESNGSDEMENSDETKMSEEILALVDEFQQAWPLEGFGGALEMKGRRLDLQGIRVLKKGPQDGVARSSCYGDCRSEDDEATEWITFQVKRVKKPKGDHKKTPGKKVETGQIENGHRYQANLEITGPKVASPGPQGKKRDYQRLGWPSPDECLKLRWVELTAIVSTWLAVSSKNIDITEHIDFATPIQQPAMEPLCNGNLPTSMHTLDHLHGVSNRASLHYTGESQLTEVLQNLGKDQYPQQSLEQIGTRIAKVLEKNQTSWVLSSMAALYWRVKGQGKKAIDCLRQALHYAPHQMKDVPLISLANILHNAKLWNDAVIVATMAVEIAPHFAVNHFTLGNVYVAMEEFEKALVWYESTLKLQPEFVPAKNRIQTIQCHLMLKKGRRSP

SEQ ID NO: 888916 - protein, 968 aa, Homo sapiens
MASFYWRIKNEPYQVVECAMRALHFSSRHNKDIALVNLANVLHRAHFSADAAVVVHAALDDSDFFTSYYTLGNIYAMLGEYNHSVLCYDHALQARPGFEQAIKRKHAVLCQQKLEQKLEAQHRSLQRTLNELKEYQKQHDHYLRQQEILEKHKLIQEEQILRNIIHETQMAKEAQLGNHQICRLVNQQHSLHCQWDQPVRYHRGDIFENVDYVQFGEDSSTSSMMSVNFDVQSNQSDINDSVKSSPVAHSILWIWGRDSDAYRDKQHILWPKRADCTESYPRVPVGGELPTYFLPPENKGLRIHELSSDDYSTEEEAQTPDCSITDFRKSHTLSYLVKELEVRMDLKAKMPDDHARKILLSRINNYTIPEEEIGSFLFHAINKPNAPIWLILNEAGLYWRAVGNSTFAIACLQRALNLAPLQYQDVPLVNLANLLIHYGLHLDATKLLLQALAINSSEPLTFLSLGNAYLALKNISGALEAFRQALKLTTKCPECENSLKLIRCMQFYPFLYNITSSVCSGNCHEKTLDNSHDKQKYFDNSQSLDAAEEEPSERGTEEDPVFSVENSGRDSDALRLESTVVEESNGSDEMENSDETKMSEEILALVDEFQQAWPLEGFGGALEMKGRRLDLQGIRVLKKGPQDGVARSSCYGDCRSEDDEATEWITFQVKRVKKPKGDHKKTPGKKVETGQIENGHRYQANLEITGPKVASPGPQGKKRDYQRLGWPSPDECLKLRWVELTAIVSTWLAVSSKNIDITEHIDFATPIQQPAMEPLCNGNLPTSMHTLDHLHGVSNRASLHYTGESQLTEVLQNLGKDQYPQQSLEQIGTRIAKVLEKNQTSWVLSSMAALYWRVKGQGKKAIDCLRQALHYAPHQMKDVPLISLANILHNAKLWNDAVIVATMAVEIAPHFAVNHFTLGNVYVAMEEFEKALVWYESTLKLQPEFVPAKNRIQTIQCHLMLKKGRRSP

SEQ ID NO: 888917 - protein, 1166 aa, Homo sapiens
VNGERSDLIMSLLNKPKSEMTPEELQKREEEVNLTPVHSLCSHSQSRTIPNVLINCRNNKKLLGRCEGLSDRHCNMVLENVKEMWTEVPKSGKAKKKSKPVNKDRYISKMFLQLGTLCHLWSCGTRSSPASRGRLSVDEHLGIVLGVQERVNLSAPLLPKEDPIFTYLSKRLGRSIDDIGHLIHEGLQKNTSSWVLYNMASFYWRIKNEPYQVVECAMRALHFSSRHNKDIALVNLANVLHRAHFSADAAVVVHAALDDSDFFTSYYTLGNIYAMLGEYNHSVLCYDHALQARPGFEQAIKRKHAVLCQQKLEQKLEAQHRSLQRTLNELKEYQKQHDHYLRQQEILEKHKLIQEEQILRNIIHETQMAKEAQLGNHQICRLVNQQHSLHCQWDQPVRYHRGDIFENVDYVQFGEDSSTSSMMSVNFDVQSNQSDINDSVKSSPVAHSILWIWGRDSDAYRDKQHILWPKRADCTESYPRVPVGGELPTYFLPPENKGLRIHELSSDDYSTEEEAQTPDCSITDFRKSHTLSYLVKELEVRMDLKAKMPDDHARKILLSRINNYTIPEEEIGSFLFHAINKPNAPIWLILNEAGLYWRAVGNSTFAIACLQRALNLAPLQYQDVPLVNLANLLIHYGLHLDATKLLLQALAINSSEPLTFLSLGNAYLALKNISGALEAFRQALKLTTKCPECENSLKLIRCMQFYPFLYNITSSVCSGNCHEKTLDNSHDKQKYFDNSQSLDAAEEEPSERGTEEDPVFSVENSGRDSDALRLESTVVEESNGSDEMENSDETKMSEEILALVDEFQQAWPLEGFGGALEMKGRRLDLQGIRVLKKGPQDGVARSSCYGDCRSEDDEATEWITFQVKRVKKPKGDHKKTPGKKVETGQIENGHRYQANLEITGPKVASPGPQGKKRDYQRLGWPSPDECLKLRWVELTAIVSTWLAVSSKNIDITEHIDFATPIQQPAMEPLCNGNLPTSMHTLDHLHGVSNRASLHYTGESQLTEVLQNLGKDQYPQQSLEQIGTRIAKVLEKNQTSWVLSSMAALYWRVKGQGKKAIDCLRQALHYAPHQMKDVPLISLANILHNAKLWNDAVIVATMAVEIAPHFAVNHFTLGNVYVAMEEFEKALVWYESTLKLQPEFVPAKNRIQTIQCHLMLKKGRRSP

SEQ ID NO: 888918 - protein, 197 aa, Homo sapiens
MEPLCNGNLPTSMHTLDHLHGVSNRASLHYTGESQLTEVLQNLGKDQYPQQSLEQIGTRIAKVLEKNQTSWVLSSMAALYWRVKGQGKKAIDCLRQALHYAPHQMKDVPLISLANILHNAKLWNDAVIVATMAVEIAPHFAVNHFTLGNVYVAMEEFEKALVWYESTLKLQPEFVPAKNRIQTIQCHLMLKKGRRSP

SEQ ID NO: 888919 - protein, 122 aa, Homo sapiens
MAALYWRVKGQGKKAIDCLRQALHYAPHQMKDVPLISLANILHNAKLWNDAVIVATMAVEIAPHFAVNHFTLGNVYVAMEEFEKALVWYESTLKLQPEFVPAKNRIQTIQCHLMLKKGRRSP

SEQ ID NO: 888920 - protein, 963 aa, Homo sapiens; identical to SEQ ID NO: 888911

SEQ ID NO: 888921 - protein, 115 aa, Homo sapiens
MITKNKNESSKPNFPFSPFSFFSQDVPLISLANILHNAKLWNDAVIVATMAVEIAPHFAVNHFTLGNVYVAMEEFEKALVWYESTLKLQPEFVPAKNRIQTIQCHLMLKKGRRSP

SEQ ID NO: 888922 - protein, 950 aa, Homo sapiens
RPGRGGKMAAAVGVRGRYELPPCSGPGWLLSLSALLSVAARGAFATTHWVVTEDGKIQQQVDSPMNLKHPHDLVILMRQEATVNYLKELEKQLVAQKIHIEENEDRDTGLEQRHNKEDPDCIKAKVPLGDLDLYDGTYITLESKDISPEDYIDTESPVPPDPEQPDCTKILELPYSIHAFQHLRGVQERVNLSAPLLPKEDPIFTYLSKRLGRSIDDIGHLIHEGLQKNTSSWVLYNMASFYWRIKNEPYQVVECAMRALHFSSRHNKDIALVNLANVLHRAHFSADAAVVVHAALDDSDFFTSYYTLGNIYAMLGEYNHSVLCYDHALQARPGFEQAIKRKHAVLCQQKLEQKLEAQHRSLQRTLNELKEYQKQHDHYLRQQEILEKHKLIQEEQILRNIIHETQMAKEAQLGNHQICRLVNQQHSLHCQWDQPVRYHRGDIFENVDYVQFGEDSSTSSMMSVNFDVQSNQSDINDSVKSSPVAHSILWIWGRDSDAYRDKQHILWPKRADCTESYPRVPVGGELPTYFLPPENKGLRIHELSSDDYSTEEEAQTPDCSITDFRKSHTLSYLVKELEVRMDLKAKMPDDHARKILLSRINNYTIPEEEIGSFLFHAINKPNAPIWLILNEAGLYWRAVGNSTFAIACLQRALNLAPLQYQDVPLVNLANLLIHYGLHLDATKLLLQALAINSSEPLTFLSLGNAYLALKNISGALEAFRQALKLTTKCPECENSLKLIRCMQFYPFLYNITSSVCSGNCHEKTLDNSHDKQKYFDNSQSLDAAEEEPSERGTEEDPVFSVENSGRDSDALRLESTVVEESNGSDEMENSDETKMSEEILALVDEFQQAWPLEGFGGALEMKGRRLDLQGIRVLKKGPQDGVARSSCYGDCRSEDDEATEWITFQVKRVKKPKGDHKKTPGKKVETGQIENGHRYQATRLEDQESAIDIM

SEQ ID NO: 888923 - protein, 963 aa, Homo sapiens; identical to SEQ ID NO: 888911

SEQ ID NO: 888924 - protein, 1138 aa, Homo sapiens
RPGRGGKMAAAVGVRGRYELPPCSGPGWLLSLSALLSVAARGAFATTHWVVTEDGKIQQQVDSPMNLKHPHDLVILMRQEATVNYLKELEKQLVAQKIHIEENEDRDTGLEQRHNKEDPDCIKAKVPLGDLDLYDGTYITLESKDISPEDYIDTESPVPPDPEQPDCTKILELPYSIHAFQHLRGVQERVNLSAPLLPKEDPIFTYLSKRLGRSIDDIGHLIHEGLQKNTSSWVLYNMASFYWRIKNEPYQVVECAMRALHFSSRHNKDIALVNLANVLHRAHFSADAAVVVHAALDDSDFFTSYYTLGNIYAMLGEYNHSVLCYDHALQARPGFEQAIKRKHAVLCQQKLEQKLEAQHRSLQRTLNELKEYQKQHDHYLRQQEILEKHKLIQEEQILRNIIHETQMAKEAQLGNHQICRLVNQQHSLHCQWDQPVRYHRGDIFENVDYVQFGEDSSTSSMMSVNFDVQSNQSDINDSVKSSPVAHSILWIWGRDSDAYRDKQHILWPKRADCTESYPRVPVGGELPTYFLPPENKGLRIHELSSDDYSTEEEAQTPDCSITDFRKSHTLSYLVKELEVRMDLKAKMPDDHARKILLSRINNYTIPEEEIGSFLFHAINKPNAPIWLILNEAGLYWRAVGNSTFAIACLQRALNLAPLQYQDVPLVNLANLLIHYGLHLDATKLLLQALAINSSEPLTFLSLGNAYLALKNISGALEAFRQALKLTTKCPECENSLKLIRCMQFYPFLYNITSSVCSGNCHEKTLDNSHDKQKYFDNSQSLDAAEEEPSERGTEEDPVFSVENSGRDSDALRLESTVVEESNGSDEMENSDETKMSEEILALVDEFQQAWPLEGFGGALEMKGRRLDLQGIRVLKKGPQDGVARSSCYGDCRSEDDEATEWITFQVKRVKKPKGDHKKTPGKKVETGQIENGHRYQANLEITGPKVASPGPQGKKRDYQRLGWPSPDECLKLRWVELTAIVSTWLAVSSKNIDITEHIDFATPIQQPAMEPLCNGNLPTSMHTLDHLHGVSNRASLHYTGESQLTEVLQNLGKDQYPQQSLEQIGTRIAKVLEKNQTSWVLSSMAALYWRVKGQGKKAIDCLRQALHYAPHQMKVSGTQKVGTSAPLSFPFPMVYSAL

SEQ ID NO: 888925 - protein, 950 aa, Homo sapiens; identical to SEQ ID NO: 888922

SEQ ID NO: 888926 - protein, 963 aa, Homo sapiens; identical to SEQ ID NO: 888911

SEQ ID NO: 888927 - protein, 933 aa, Homo sapiens
RPGRGGKMAAAVGVRGRYELPPCSGPGWLLSLSALLSVAARGAFATTHWVVTEDGKIQQQVDSPMNLKHPHDLVILMRQEATVNYLKELEKQLVAQKIHIEENEDRDTGLEQRHNKEDPDCIKAKVPLGDLDLYDGTYITLESKDISPEDYIDTESPVPPDPEQPDCTKILELPYSIHAFQHLRGVQERVNLSAPLLPKEDPIFTYLSKRLGRSIDDIGHLIHEGLQKNTSSWVLYNMASFYWRIKNEPYQVVECAMRALHFSSRHNKDIALVNLANVLHRAHFSADAAVVVHAALDDSDFFTSYYTLGNIYAMLGEYNHSVLCYDHALQARPGFEQAIKRKHAVLCQQKLEQKLEAQHRSLQRTLNELKEYQKQHDHYLRQQEILEKHKLIQEEQILRNIIHETQMAKEAQLGNHQICRLVNQQHSLHCQWDQPVRYHRGDIFENVDYVQFGEDSSTSSMMSVNFDVQSNQSDINDSVKSSPVAHSILWIWGRDSDAYRDKQHILWPKRADCTESYPRVPVGGELPTYFLPPENKGLRIHELSSDDYSTEEEAQTPDCSITDFRKSHTLSYLVKELEVRMDLKAKMPDDHARKILLSRINNYTIPEEEIGSFLFHAINKPNAPIWLILNEAGLYWRAVGNSTFAIACLQRALNLAPLQYQDVPLVNLANLLIHYGLHLDATKLLLQALAINSSEPLTFLSLGNAYLALKNISGALEAFRQALKLTTKCPECENSLKLIRCMQFYPFLYNITSSVCSGNCHEKTLDNSHDKQKYFDNSQSLDAAEEEPSERGTEEDPVFSVENSGRDSDALRLESTVVEESNGSDEMENSDETKMSEEILALVDEFQQAWPLEGFGGALEMKGRRLDLQGIRVLKKGPQDGVARSSCYGDCRSEDDEATEWPVPPLPSAVLKYHSSLNFKIKCHLFLVTFRQN

SEQ ID NO: 888928 - protein, 979 aa, Homo sapiens
RPGRGGKMAAAVGVRGRYELPPCSGPGWLLSLSALLSVAARGAFATTHWVVTEDGKIQQQVDSPMNLKHPHDLVILMRQEATVNYLKELEKQLVAQKIHIEENEDRDTGLEQRHNKEDPDCIKAKVPLGDLDLYDGTYITLESKDISPEDYIDTESPVPPDPEQPDCTKILELPYSIHAFQHLRGVQERVNLSAPLLPKEDPIFTYLSKRLGRSIDDIGHLIHEGLQKNTSSWVLYNMASFYWRIKNEPYQVVECAMRALHFSSRHNKDIALVNLANVLHRAHFSADAAVVVHAALDDSDFFTSYYTLGNIYAMLGEYNHSVLCYDHALQARPGFEQAIKRKHAVLCQQKLEQKLEAQHRSLQRTLNELKEYQKQHDHYLRQQEILEKHKLIQEEQILRNIIHETQMAKEAQLGNHQICRLVNQQHSLHCQWDQPVRYHRGDIFENVDYVQFGEDSSTSSMMSVNFDVQSNQSDINDSVKSSPVAHSILWIWGRDSDAYRDKQHILWPKRADCTESYPRVPVGGELPTYFLPPENKGLRIHELSSDDYSTEEEAQTPDCSITDFRKSHTLSYLVKELEVRMDLKAKMPDDHARKILLSRINNYTIPEEEIGSFLFHAINKPNAPIWLILNEAGLYWRAVGNSTFAIACLQRALNLAPLQYQDVPLVNLANLLIHYGLHLDATKLLLQALAINSSEPLTFLSLGNAYLALKNISGALEAFRQALKLTTKCPECENSLKLIRCMQFYPFLYNITSSVCSGNCHEKTLDNSHDKQKYFDNSQSLDAAEEEPSERGTEEDPVFSVENSGRDSDALRLESTVVEESNGSDEMENSDETKMSEEILALVDEFQQAWPLEGFGGALEMKGRRLDLQGIRVLKKGPQDGVARSSCYGDCRSEDDEATEWITFQVKRVKKPKGDHKKTPGKKVETGQIENGHRYQANLEITGPKVASPGPQGKFECLICQFLVLDVTISFLTKVVFVT

SEQ ID NO: 888929 - protein, 732 aa, Homo sapiens
RPGRGGKMAAAVGVRGRYELPPCSGPGWLLSLSALLSVAARGAFATTHWVVTEDGKIQQQVDSPMNLKHPHDLVILMRQEATVNYLKELEKQLVAQKIHIEENEDRDTGLEQRHNKEDPDCIKAKVPLGDLDLYDGTYITLESKDISPEDYIDTESPVPPDPEQPDCTKILELPYSIHAFQHLRGVQERVNLSAPLLPKEDPIFTYLSKRLGRSIDDIGHLIHEGLQKNTSSWVLYNMASFYWRIKNEPYQVVECAMRALHFSSRHNKDIALVNLANVLHRAHFSADAAVVVHAALDDSDFFTSYYTLGNIYAMLGEYNHSVLCYDHALQARPGFEQAIKRKHAVLCQQKLEQKLEAQHRSLQRTLNELKEYQKQHDHYLRQQEILEKHKLIQEEQILRNIIHETQMAKEAQLGNHQICRLVNQQHSLHCQWDQPVRYHRGDIFENVDYVQFGEDSSTSSMMSVNFDVQSNQSDINDSVKSSPVAHSILWIWGRDSDAYRDKQHILWPKRADCTESYPRVPVGGELPTYFLPPENKGLRIHELSSDDYSTEEEAQTPDCSITDFRKSHTLSYLVKELEVRMDLKAKMPDDHARKILLSRINNYTIPEEEIGSFLFHAINKPNAPIWLILNEAGLYWRAVGNSTFAIACLQRALNLAPLQYQDVPLVNLANLLIHYGLHLDATKLLLQALAINSSEPLTFLSLGNAYLALKNISGALEAFRQALKLTTKCPEC

SEQ ID NO: 888930 - protein, 732 aa, Homo sapiens; identical to SEQ ID NO: 888929

SEQ ID NO: 888931 - protein, 484 aa, Homo sapiens
RPGRGGKMAAAVGVRGRYELPPCSGPGWLLSLSALLSVAARGAFATTHWVVTEDGKIQQQVDSPMNLKHPHDLVILMRQEATVNYLKELEKQLVAQKIHIEENEDRDTGLEQRHNKEDPDCIKAKVPLGDLDLYDGTYITLESKDISPEDYIDTESPVPPDPEQPDCTKILELPYSIHAFQHLRGVQERVNLSAPLLPKEDPIFTYLSKRLGRSIDDIGHLIHEGLQKNTSSWVLYNMASFYWRIKNEPYQVVECAMRALHFSSRHNKDIALVNLANVLHRAHFSADAAVVVHAALDDSDFFTSYYTLGNIYAMLGEYNHSVLCYDHALQARPGFEQAIKRKHAVLCQQKLEQKLEAQHRSLQRTLNELKEYQKQHDHYLRQQEILEKHKLIQEEQILRNIIHETQMAKEAQLGNHQICRLVNQQHSLHCQWDQPVRYHRGDIFENVDYVQVFFLVQSNSYKRLLYKDFLKLLFFLLILCIFDP

SEQ ID NO: 888932 - protein, 475 aa, Homo sapiens
RPGRGGKMAAAVGVRGRYELPPCSGPGWLLSLSALLSVAARGAFATTHWVVTEDGKIQQQVDSPMNLKHPHDLVILMRQEATVNYLKELEKQLVAQKIHIEENEDRDTGLEQRHNKEDPDCIKAKVPLGDLDLYDGTYITLESKDISPEDYIDTESPVPPDPEQPDCTKILELPYSIHAFQHLRGVQERVNLSAPLLPKEDPIFTYLSKRLGRSIDDIGHLIHEGLQKNTSSWVLYNMASFYWRIKNEPYQVVECAMRALHFSSRHNKDIALVNLANVLHRAHFSADAAVVVHAAYYTLGNIYAMLGEYNHSVLCYDHALQARPGFEQAIKRKHAVLCQQKLEQKLEAQHRSLQRTLNELKEYQKQHDHYLRQQEILEKHKLIQEEQILRNIIHETQMAKEAQLGNHQICRLVNQQHSLHCQWDQPVRYHRGDIFENVDYVQVFFLVQSNSYKRLLYKDFLKLLFFLLILCIFDP

SEQ ID NO: 888933 - protein, 239 aa, Homo sapiens
RPGRGGKMAAAVGVRGRYELPPCSGPGWLLSLSALLSVAARGAFATTHWVVTEDGKIQQQVDSPMNLKHPHDLVILMRQEATVNYLKELEKQLVAQKIHIEENEDRDTGLEQRHNKEDPDCIKAKVPLGDLDLYDGTYITLESKDISPEDYIDTESPVPPDPEQPDCTKILELPYSIHAFQHLRGVQERVNLSAPLLPKEDPIFTYLSKRLGRSIDDIGHLIHEGLQKVSHQSLKEPAG

SEQ ID NO: 888934 - protein, 265 aa, Homo sapiens
RPGRGGKMAAAVGVRGRYELPPCSGPGWLLSLSALLSVAARGAFATTHWVVTEDGKIQQQVDSPMNLKHPHDLVILMRQEATVNYLKELEKQLVAQKIHIEENEDRDTGLEQRHNKEDPDCIKAKVPLGDLDLYDGTYITLESKDISPEDYIDTESPVPPDPEQPDCTKILELPYSIHAFQHLRGVQERVNLSAPLLPKEDPIFTYLSKRLGRSIDDIGHLIHEGLQKNTSSWVLYNMASFYWRIKNEPYQVVECAMRALHFSSR

SEQ ID NO: 888935 - protein, 233 aa, Homo sapiens
RPGRGGKMAAAVGVRGRYELPPCSGPGWLLSLSALLSVAARGAFATTHWVVTEDGKIQQQVDSPMNLKHPHDLVILMRQEATVNYLKELEKQLVAQKIHIEENEDRDTGLEQRHNKEDPDCIKAKVPLGDLDLYDGTYITLESKDISPEDYIDTESPVPPDPEQPDCTKILELPYSIHAFQHLRGVQERVNLSAPLLPKEDPIFTYLSKRPACTSNSFLLFVNSYNIKSAIQN

SEQ ID NO: 888936 - protein, 100 aa, Homo sapiens
RPGRGGKMAAAVGVRGRYELPPCSGPGWLLSLSALLSVAARGAFATTHWVVTEDGKIQQQFSQEPMRISLKSGSWAAIFANLYFSKPQRRCKPMMVRLES

SEQ ID NO: 888937 - protein, 1867 aa, Homo sapiens
GSLKNAGDTLTSLVLPTSEFYTSGMYCEDPNMSLCTNCFNFVFDLGWYRGYTLRKKSKKGIFPASYIHLKEAIVEGKGQHETVIPGDLPLIQEVTTTLREWSTIWRQLYVQDNREMFRSVRHMIYDLIEWRSQILSGTLPQDELKELKKKVTAKIDYGNRILDLDLVVRDEDGNILDPELTSTISLFRAHEIASKQVEERLQEEKSQKQNIDINRQAKFAATPSLALFVNLKNVVCKIGEDAEVLMSLYDPVESKFISENYLVRWSSSGLPKDIDRLHNLRAVFTDLGSKDLKREKISFVCQIVRVGRMELRDNNTRKLTSGLRRPFGVAVMDVTDIINGKVDDEDKQHFIPFQPVAGENDFLQTVINKVIAAKEVNHKGQGLWVTLKLLPGDIHQIRKEFPHLVDRTTAVARKTGFPEIIMPGDVRNDIYVTLVQGDFDKGSKTTAKNVEVTVSVYDEDGKRLEHVIFPGAGDEAISEYKSVIYYQVKQPRWFETVKVAIPIEDVNRSHLRFTFRHRSSQDSKDKSEKIFALAFVKLMRYDGTTLRDGEHDLIVYKAEAKKLEDAATYLSLPSTKAELEEKGHSATGKSMQSLGSCTISKDSFQISTLVCSTKLTQNVDLLGLLKWRSNTSLLQQNLRQLMKVDGGEVVKFLQDTLDALFNIMMENSESETFDTLVFDALVFIIGLIADRKFQHFNPVLETYIKKHFSATLAYTKLTKVLKNYVDGAEKPGVNEQLYKAMKALESIFKFIVRSRILFNQLYENKGEADFVESLLQLFRSINDMMSSMSDQTVRVKGAALKYLPTIVNDVKLVFDPKELSKMFTEFILNVPMGLLTIQKLYCLIEIVHSDLFTQHDCREILLPMMTDQLKYHLERQEDLEACCQLLSHILEVLYRKDVGPTQRHVQIIMEKLLRTVNRTVISMGRDSELIGNFVACMTAILRQMEDYHYAHLIKTFGKMRTDVVDFLMETFIMFKNLIGKNVYPFDWVIMNMVQNKVFLRAINQYADMLNKKFLDQANFELQLWNNYFHLAVAFLTQESLQLENFSSAKRAKILNKYGDMRRQIGFEIRDMWYNLGQHKIKFIPEMVGPILEMTLIPETELRKATIPIFFDMMQCEFHSTRSFQMFENEIITKLDHEVEGGRGDEQYKVLFDKILLEHCRKHKYLAKTGETFVKLVVRLMERLLDYRTIMHDENKENRMSCTVNVLNFYKEIEREEMYIRYLYKLCDLHKECDNYTEAAYTLLLHAKLLKWSEDVCVAHLTQRDGYQATTQGQLKEQLYQEIIHYFDKGKMWEEAIALGKELAEQYENEMFDYEQLSELLKKQAQFYENIVKVIRPKPDYFAVGYYGQGFPTFLRGKVFIYRGKEYERREDFEARLLTQFPNAEKMKTTSPPGDDIKNSPGQYIQCFTVKPKLDLPPKFHRPVSEQIVSFYRVNEVQRFEYSRPIRKGEKNPDNEFANMWIERTIYTTAYKLPGILRWFEVKSVFMVEISPLENAIETMQLTNDKINSMVQQHLDDPSLPINPLSMLLNGIVDPAVMGGFANYEKAFFTDRYLQEHPEAHEKIEKLKDLIAWQIPFLAEGIRIHGDKVTEALRPFHERMEACFKQLKEKVEKEYGVRIMPSSLDDRRGSRPRSMVRSFTMPSSSRPLSVASVSSLSSDSTPSRPGSDGFALEPLLPKKMHSRSQDKLDKDDLEKEKKDKKKEKRNSKHQEIFEKEFKPTDISLQQSEAVILSETISPLRPQRPKSQVMNVIGSERRFSVSPSSPSSQQTPPPVTPRAKLSFSMQSSLELNGMTGADVADVPPPLPLKGSVADYGNLMENQDLLGSPTPPPPPPHQRHLPPPLPSKTPPPPPPKTTRKQTSVDSGIVQ

SEQ ID NO: 888938 - protein, 1857 aa, Homo sapiens
GSLKNAGDTLTSLVLPTSEFYTSGMYCEDPNMSLCTNCFNFVFDLGWYRGYTLRKKSKKGIFPASYIHLKEAIVEGKGQHETVIPGDLPLIQEVTTTLREWSTIWRQLYVQDNREMFRSVRHMIYDLIEWRSQILSGTLPQDELKELKKKVTAKIDYGNRILDLDLVVRDEDGNILDPELTSTISLFRAHEIASKQVEERLQEEKSQKQNIDINRQAKFAATPSLALFVNLKNVVCKIGEDAEVLMSLYDPVESKFISENYLVRWSSSGLPKDIDRLHNLRAVFTDLGSKDLKREKISFVCQIVRVGRMELRDNNTRKLTSGLRRPFGVAVMDVTDIINGKVDDEDKQHFIPFQPVAGENDFLQTVINKVIAAKEVNHKGQGLWVTLKLLPGDIHQIRKEFPHLVDRTTAVARKTGFPEIIMPGDVRNDIYVTLVQGDFDKGSKTTAKNVEVTVSVYDEDGKRLEHVIFPGAGDEAISEYKSVIYYQVKQPRWFETVKVAIPIEDVNRSHLRFTFRHRSSQDSKDKSEKIFALAFVKLMRYDGTTLRDGEHDLIVYKAEAKKLEDAATYLSLPSTKAELEEKGHSATGKSMQSLGSCTISKDSFQISTLVCSTKLTQNVDLLGLLKWRSNTSLLQQNLRQLMKVDGGEVVKFLQDTLDALFNIMMENSESETFDTLVFDALVFIIGLIADRKFQHFNPVLETYIKKHFSATLAYTKLTKVLKNYVDGAEKPGVNEQLYKAMKALESIFKFIVRSRILFNQLYENKGEADFVESLLQLFRSINDMMSSMSDQTVRVKGAALKYLPTIVNDVKLVFDPKELSKMFTEFILNVPMGLLTIQKLYCLIEIVHSDLFTQHDCREILLPMMTDQLKYHLERQEDLEACCQLLSHILEVLYRKDVGPTQRHVQIIMEKLLRTVNRTVISMGRDSELIGNFVACMTAILRQMEDYHYAHLIKTFGKMRTDVVDFLMETFIMFKNLIGKNVYPFDWVIMNMVQNKVFLRAINQYADMLNKKFLDQANFELQLWNNYFHLAVAFLTQESLQLENFSSAKRAKILNKYGDMRRQIGFEIRDMWYNLGQHKIKFIPEMVGPILEMTLIPETELRKATIPIFFDMMQCEFHSTRSFQMFENEIITKLDHEVEGGRGDEQYKVLFDKILLEHCRKHKYLAKTGETFVKLVVRLMERLLDYRTIMHDENKENRMSCTVNVLNFYKEIEREEMYIRYLYKLCDLHKECDNYTEAAYTLLLHAKLLKWSEDVCVAHLTQRDGYQATTQGQLKEQLYQEIIHYFDKGKMWEEAIALGKELAEQYENEMFDYEQLSELLKKQAQFYENIVKVIRPKPDYFAVGYYGQGFPTFLRGKVFIYRGKEYERREDFEARLLTQFPNAEKMKTTSPPGDDIKNSPGQYIQCFTVKPKLDLPPKFHRPVSEQIVSFYRVNEVQRFEYSRPIRKGEKNPDNEFANMWIERTIYTTAYKLPGILRWFEVKSVFMVEISPLENAIETMQLTNDKINSMVQQHLDDPSLPINPLSMLLNGIVDPAVMGGFANYEKAFFTDRYLQEHPEAHEKIEKLKDLIAWQIPFLAEGIRIHGDKVTEALRPFHERMEACFKQLKEKPSSLDDRRGSRPRSMVRSFTMPSSSRPLSVASVSSLSSDSTPSRPGSDGFALEPLLPKKMHSRSQDKLDKDDLEKEKKDKKKEKRNSKHQEIFEKEFKPTDISLQQSEAVILSETISPLRPQRPKSQVMNVIGSERRFSVSPSSPSSQQTPPPVTPRAKLSFSMQSSLELNGMTGADVADVPPPLPLKGSVADYGNLMENQDLLGSPTPPPPPPHQRHLPPPLPSKTPPPPPPKTTRKQTSVDSGIVQ

SEQ ID NO: 888939 - protein, 1849 aa, Homo sapiens
GSLKNAGDTLTSLVLPTSEFYTSGMYCEDPNMSLCTNCFNFVFDLGWYRGYTLRKKSKKGIFPASYIHLKEAIVEGKGQHETVIPGDLPLIQEVTTTLREWSTIWRQLYVQDNREMFRSVRHMIYDLIEWRSQILSGTLPQDELKELKKKVTAKIDYGNRILDLDLVVRDEDGNILDPELTSTISLFRAHEIASKQVEERLQEEKSQKQNIDINRQAKFAATPSLALFVNLKNVVCKIGEDAEVLMSLYDPVESKFISENYLVRWSSSGLPKDIDRLHNLRAVFTDLGSKDLKREKISFVCQIVRVGRMELRDNNTRKLTSGLRRPFGVAVMDVTDIINGKVDDEDKQHFIPFQPVAGENDFLQTVINKVIAAKEVNHKGQGLWVTLKLLPGDIHQIRKEFPHLVDRTTAVARKTGFPEIIMPGDVRNDIYVTLVQGDFDKGSKTTAKNVEVTVSVYDEDGKRLEHVIFPGAGDEAISEYKSVIYYQVKQPRWFETVKVAIPIEDVNRSHLRFTFRHRSSQDSKDKSEKIFALAFVKLMRYDGTTLRDGEHDLIVYKAEAKKLEDAATYLSLPSTKAELEEKGHSATGKSMQSLGSCTISKDSFQISTLVCSTKLTQNVDLLGLLKWRSNTSLLQQNLRQLMKVDGGEVVKFLQDTLDALFNIMMENSESETFDTLVFDALVFIIGLIADRKFQHFNPVLETYIKKHFSATLAYTKLTKVLKNYVDGAEKPGVNEQLYKAMKALESIFKFIVRSRILFNQLYENKGEADFVESLLQLFRSINDMMSSMSDQTVRVKGAALKYLPTIVNDVKLVFDPKELSKMFTEFILNVPMGLLTIQKLYCLIEIVHSDLFTQHDCREILLPMMTDQLKYHLERQEDLEACCQLLSHILEVLYRKDVGPTQRHVQIIMEKLLRTVNRTVISMGRDSELIGNFVACMTAILRQMEDYHYAHLIKTFGKMRTDVVDFLMETFIMFKNLIGKNVYPFDWVIMNMVQNKVFLRAINQYADMLNKKFLDQANFELQLWNNYFHLAVAFLTQESLQLENFSSAKRAKILNKYGDMRRQIGFEIRDMWYNLGQHKIKFIPEMVGPILEMTLIPETELRKATIPIFFDMMQCEFHSTRSFQMFENEIITKLDHEVEGGRGDEQYKVLFDKILLEHCRKHKYLAKTGETFVKLVVRLMERLLDYRTIMHDENKENRMSCTVNVLNFYKEIEREEMYIRYLYKLCDLHKECDNYTEAAYTLLLHAKLLKWSEDVCVAHLTQRDGYQATTQGQLKEQLYQEIIHYFDKGKMWEEAIALGKELAEQYENEMFDYEQLSELLKKQAQFYENIVKVIRPKPDYFAVGYYGQGFPTFLRGKVFIYRGKEYERREDFEARLLTQFPNAEKMKTTSPPGDDIKNSPGQYIQCFTVKPKLDLPPKFHRPVSEQIVSFYRVNEVQRFEYSRPIRKGEKNPDNEFANMWIERTIYTTAYKLPGILRWFEVKSVFMVEISPLENAIETMQLTNDKINSMVQQHLDDPSLPINPLSMLLNGIVDPAVMGGFANYEKAFFTDRYLQEHPEAHEKIEKLKDLIAWQIPFLAEGIRIHGDKVTEALRPFHERMEACFKQLKEKVEKEYGVRIMPSSLDDRRGSRPRSMVRSFTMPSSSRPLSVASVSSLSSDSTPSRPGSDGFALEPLLPKKMHSRSQDKLDKDDLEKEKKDKKKEKRNSKHQEIFEKEFKPTDISLQQSEAVILSETISPLRPQRPKSQVMNVIGSERRFSVSPSSPSSQQTPPPVTPRAKLSFSMQSSLELNGMTGADVADVPPPLPLKGSVADYGNLMENQDLLGSPTPPPPPPHQRHLPPPLPSSGIVQ

SEQ ID NO: 888940 - protein, 1867 aa, Homo sapiens; identical to SEQ ID NO: 888937

SEQ ID NO: 888941 - protein, 1414 aa, Homo sapiens
MFRSVRHMIYDLIEWRSQILSGTLPQDELKELKKKVTAKIDYGNRILDLDLVVRDEDGNILDPELTSTISLFRAHEIASKQVEERLQEEKSQKQNIDINRQAKFAATPSLALFVNLKNVVCKIGEDAEVLMSLYDPVESKFISENYLVRWSSSGLPKDIDRLHNLRAVFTDLGSKDLKREKISFVCQIVRVGRMELRDNNTRKLTSGLRRPFGVAVMDVTDIINGKVDDEDKQHFIPFQPVAGENDFLQTVINKVIAAKEVNHKGQGLWVTLKLLPGDIHQIRKEFPHLVDRTTAVARKTGFPEIIMPGDVRNDIYVTLVQGDFDKGSKTTAKNVEVTVSVYDEDGKRLEHVIFPGAGDEAISEYKSVIYYQVKQPRWFETVKVAIPIEDVNRSHLRFTFRHRSSQDSKDKSEKIFALAFVKLMRYDGTTLRDGEHDLIVYKAEAKKLEDAATYLSLPSTKAELEEKGHSATGKSMQSLGSCTISKDSFQISTLVCSTKLTQNVDLLGLLKWRSNTSLLQQNLRQLMKVDGGEVVKFLQDTLDALFNIMMENSESETFDTLVFDALVFIIGLIADRKFQHFNPVLETYIKKHFSATLAYTKLTKVLKNYVDGAEKPGVNEQLYKAMKALESIFKFIVRSRILFNQLYENKGEADFVESLLQLFRSINDMMSSMSDQTVRVKGAALKYLPTIVNDVKLVFDPKELSKMFTEFILNVPMGLLTIQKLYCLIEIVHSDLFTQHDCREILLPMMTDQLKYHLERQEDLEACCQLLSHILEVLYRKDVGPTQRHVQIIMEKLLRTVNRTVISMGRDSELIGNFVACMTAILRQMEDYHYAHLIKTFGKMRTDVVDFLMETFIMFKNLIGKNVYPFDWVIMNMVQNKVFLRAINQYADMLNKKFLDQANFELQLWNNYFHLAVAFLTQESLQLENFSSAKRAKILNKYGDMRRQIGFEIRDMWYNLGQHKIKFIPEMVGPILEMTLIPETELRKATIPIFFDMMQCEFHSTRSFQMFENEIITKLDHEVEGGRGDEQYKVLFDKILLEHCRKHKYLAKTGETFVKLVVRLMERLLDYRTIMHDENKENRMSCTVNVLNFYKEIEREEMYIRYLYKLCDLHKECDNYTEAAYTLLLHAKLLKWSEDVCVAHLTQRDGYQATTQGQLKEQLYQEIIHYFDKGKMWEEAIALGKELAEQYENEMFDYEQLSELLKKQAQFYENIVKVIRPKPDYFAVGYYGQGFPTFLRGKVFIYRGKEYERREDFEARLLTQFPNAEKMKTTSPPGDDIKNSPGQYIQCFTVKPKLDLPPKFHRPVSEQIVSFYRVNEVQRFEYSRPIRKGEKNPDNEFANMWIERTIYTTAYKLPGILRWFEVKSVFMVRMAPPQKELSVPFLNTVCHAFFTCSCPVVTVAACTQQTLQFP

SEQ ID NO: 888942 - protein, 983 aa, Homo sapiens
MFRSVRHMIYDLIEWRSQILSGTLPQDELKELKKKVTAKIDYGNRILDLDLVVRDEDGNILDPELTSTISLFRAHEIASKQVEERLQEEKSQKQNIDINRQAKFAATPSLALFVNLKNVVCKIGEDAEVLMSLYDPVESKFISENYLVRWSSSGLPKDIDRLHNLRAVFTDLGSKDLKREKISFVCQIVRVGRMELRDNNTRKLTSGLRRPFGVAVMDVTDIINGKVDDEDKQHFIPFQPVAGENDFLQTVINKVIAAKEVNHKGQGLWVTLKLLPGDIHQIRKEFPHLVDRTTAVARKTGFPEIIMPGDVRNDIYVTLVQGDFDKGSKTTAKNVEVTVSVYDEDGKRLEHVIFPGAGDEAISEYKSVIYYQVKQPRWFETVKVAIPIEDVNRSHLRFTFRHRSSQDSKDKSEKIFALAFVKLMRYDGTTLRDGEHDLIVYKAEAKKLEDAATYLSLPSTKAELEEKGHSATGKSMQSLGSCTISKDSFQISTLVCSTKLTQNVDLLGLLKWRSNTSLLQQNLRQLMKVDGGEVVKFLQDTLDALFNIMMENSESETFDTLVFDALVFIIGLIADRKFQHFNPVLETYIKKHFSATLAYTKLTKVLKNYVDGAEKPGVNEQLYKAMKALESIFKFIVRSRILFNQLYENKGEADFVESLLQLFRSINDMMSSMSDQTVRVKGAALKYLPTIVNDVKLVFDPKELSKMFTEFILNVPMGLLTIQKLYCLIEIVHSDLFTQHDCREILLPMMTDQLKYHLERQEDLEACCQLLSHILEVLYRKDVGPTQRHVQIIMEKLLRTVNRTVISMGRDSELIGNFVACMTAILRQMEDYHYAHLIKTFGKMRTDVVDFLMETFIMFKNLIGKNVYPFDWVIMNMVQNKVFLRAINQYADMLNKKFLDQANFELQLWNNYFHLAVAFLTQESLQLENFSSAKRAKILNKSFEWTEAAPSIIVNKPLQSSMKAEILAGPSSSVTPVCIMHRS

SEQ ID NO: 888943 - protein, 912 aa, Homo sapiens
MFRSVRHMIYDLIEWRSQILSGTLPQDELKELKKKVTAKIDYGNRILDLDLVVRDEDGNILDPELTSTISLFRAHEIASKQVEERLQEEKSQKQNIDINRQAKFAATPSLALFVNLKNVVCKIGEDAEVLMSLYDPVESKFISENYLVRWSSSGLPKDIDRLHNLRAVFTDLGSKDLKREKISFVCQIVRVGRMELRDNNTRKLTSGLRRPFGVAVMDVTDIINGKVDDEDKQHFIPFQPVAGENDFLQTVINKVIAAKEVNHKGQGLWVTLKLLPGDIHQIRKEFPHLVDRTTAVARKTGFPEIIMPGDVRNDIYVTLVQGDFDKGSKTTAKNVEVTVSVYDEDGKRLEHVIFPGAGDEAISEYKSVIYYQVKQPRWFETVKVAIPIEDVNRSHLRFTFRHRSSQDSKDKSEKIFALAFVKLMRYDGTTLRDGEHDLIVYKAEAKKLEDAATYLSLPSTKAELEEKGHSATGKSMQSLGSCTISKDSFQISTLVCSTKLTQNVDLLGLLKWRSNTSLLQQNLRQLMKVDGGEVVKFLQDTLDALFNIMMENSESETFDTLVFDALVFIIGLIADRKFQHFNPVLETYIKKHFSATLAYTKLTKVLKNYVDGAEKPGVNEQLYKAMKALESIFKFIVRSRILFNQLYENKGEADFVESLLQLFRSINDMMSSMSDQTVRVKGAALKYLPTIVNDVKLVFDPKELSKMFTEFILNVPMGLLTIQKLYCLIEIVHSDLFTQHDCREILLPMMTDQLKYHLERQEDLEACCQLLSHILEVLYRKDVGPTQRHVQIIMEKLLRTVNRTVISMGRDSELIGNFVACMTAILRQMEDYHYAHLIKTFGKMRTDVVDFLMETFIMFKNLIGKNVYPFDWVIMNMVQNNQLHDISSITTAGEWRKAAVHDYLLFCGQPFP

SEQ ID NO: 888944 - protein, 346 aa, Homo sapiens
GSLKNAGDTLTSLVLPTSEFYTSGMYCEDPNMSLCTNCFNFVFDLGWYRGYTLRKKSKKGIFPASYIHLKEAIVEGKGQHETVIPGDLPLIQEVTTTLREWSTIWRQLYVQDNREMFRSVRHMIYDLIEWRSQILSGTLPQDELKELKKKVTAKIDYGNRILDLDLVVRDEDGNILDPELTSTISLFRAHEIASKQVEERLQEEKSQKQNIDINRQAKFAATPSLALFVNLKNVVCKIGEDAEVLMSLYDPVESKFISENYLVRWSSSGLPKDIDRLHNLRAVFTDLGSKDLKREKISFVCQIVRVGRMELRDNNTRKLTSGLRRPFGVAVMDVTDIINLGLMVLE

SEQ ID NO: 888945 - protein, 137 aa, Homo sapiens
MFRSVRHMIYDLIEWRSQILSGTLPQDELKELKKKVTAKIDYGNRILDLDLVVRDEDGNILDPELTSTISLFRAHEIASKQVEERLQEEKSQKQNIDINRQAKFAATPSLALFVNLKNVVCKIGEETQLPEKKRNYL

SEQ ID NO: 888946 - protein, 1872 aa, Homo sapiens
TSGSGGAMTRWVPTKREEKYGVAFYNYDARGADELSLQIGDTVHILETYEGWYRGYTLRKKSKKGIFPASYIHLKEAIVEGKGQHETVIPGDLPLIQEVTTTLREWSTIWRQLYVQDNREMFRSVRHMIYDLIEWRSQILSGTLPQDELKELKKKVTAKIDYGNRILDLDLVVRDEDGNILDPELTSTISLFRAHEIASKQVEERLQEEKSQKQNIDINRQAKFAATPSLALFVNLKNVVCKIGEDAEVLMSLYDPVESKFISENYLVRWSSSGLPKDIDRLHNLRAVFTDLGSKDLKREKISFVCQIVRVGRMELRDNNTRKLTSGLRRPFGVAVMDVTDIINGKVDDEDKQHFIPFQPVAGENDFLQTVINKVIAAKEVNHKGQGLWVTLKLLPGDIHQIRKEFPHLVDRTTAVARKTGFPEIIMPGDVRNDIYVTLVQGDFDKGSKTTAKNVEVTVSVYDEDGKRLEHVIFPGAGDEAISEYKSVIYYQVKQPRWFETVKVAIPIEDVNRSHLRFTFRHRSSQDSKDKSEKIFALAFVKLMRYDGTTLRDGEHDLIVYKAEAKKLEDAATYLSLPSTKAELEEKGHSATGKSMQSLGSCTISKDSFQISTLVCSTKLTQNVDLLGLLKWRSNTSLLQQNLRQLMKVDGGEVVKFLQDTLDALFNIMMENSESETFDTLVFDALVFIIGLIADRKFQHFNPVLETYIKKHFSATLAYTKLTKVLKNYVDGAEKPGVNEQLYKAMKALESIFKFIVRSRILFNQLYENKGEADFVESLLQLFRSINDMMSSMSDQTVRVKGAALKYLPTIVNDVKLVFDPKELSKMFTEFILNVPMGLLTIQKLYCLIEIVHSDLFTQHDCREILLPMMTDQLKYHLERQEDLEACCQLLSHILEVLYRKDVGPTQRHVQIIMEKLLRTVNRTVISMGRDSELIGNFVACMTAILRQMEDYHYAHLIKTFGKMRTDVVDFLMETFIMFKNLIGKNVYPFDWVIMNMVQNKVFLRAINQYADMLNKKFLDQANFELQLWNNYFHLAVAFLTQESLQLENFSSAKRAKILNKYGDMRRQIGFEIRDMWYNLGQHKIKFIPEMVGPILEMTLIPETELRKATIPIFFDMMQCEFHSTRSFQMFENEIITKLDHEVEGGRGDEQYKVLFDKILLEHCRKHKYLAKTGETFVKLVVRLMERLLDYRTIMHDENKENRMSCTVNVLNFYKEIEREEMYIRYLYKLCDLHKECDNYTEAAYTLLLHAKLLKWSEDVCVAHLTQRDGYQATTQGQLKEQLYQEIIHYFDKGKMWEEAIALGKELAEQYENEMFDYEQLSELLKKQAQFYENIVKVIRPKPDYFAVGYYGQGFPTFLRGKVFIYRGKEYERREDFEARLLTQFPNAEKMKTTSPPGDDIKNSPGQYIQCFTVKPKLDLPPKFHRPVSEQIVSFYRVNEVQRFEYSRPIRKGEKNPDNEFANMWIERTIYTTAYKLPGILRWFEVKSVFMVEISPLENAIETMQLTNDKINSMVQQHLDDPSLPINPLSMLLNGIVDPAVMGGFANYEKAFFTDRYLQEHPEAHEKIEKLKDLIAWQIPFLAEGIRIHGDKVTEALRPFHERMEACFKQLKEKVEKEYGVRIMPSSLDDRRGSRPRSMVRSFTMPSSSRPLSVASVSSLSSDSTPSRPGSDGFALEPLLPKKMHSRSQDKLDKDDLEKEKKDKKKEKRNSKHQEIFEKEFKPTDISLQQSEAVILSETISPLRPQRPKSQVMNVIGSERRFSVSPSSPSSQQTPPPVTPRAKLSFSMQSSLELNGMTGADVADVPPPLPLKGSVADYGNLMENQDLLGSPTPPPPPPHQRHLPPPLPSKTPPPPPPKTTRKQTSVDSGIVQ

SEQ ID NO: 888947 - protein, 1861 aa, Homo sapiens
GSLKNAGDTLTSLVLPTSEFYTSGMYCEDPNMSLCTNCFNFVFDLGWYRGYTLRKKSKKGIFPASYIHLKEAIVEGKGQHETVIPGDLPLIQEVTTTLREWSTIWRQLYVQDNREMFRSVRHMIYDLIEWRSQILSGTLPQDELKELKKKVTAKIDYGNRILDLDLVVRDEDGNILDPELTSTISLFRAHEIASKQVEERLQEEKSQKQNIDINRQAKFAATPSLALFVNLKNVVCKIGEDAEVLMSLYDPVESKFISENYLVRWSSSGLPKDIDRLHNLRAVFTDLGSKDLKREKISFVCQIVRVGRMELRDNNTRKLTSGLRRPFGVAVMDVTDIINGKVDDEDKQHFIPFQPVAGENDFLQTVINKVIAAKEVNHKGQGLWVTLKLLPGDIHQIRKEFPHLVDRTTAVARKTGFPEIIMPGDVRNDIYVTLVQGDFDKGSKTTAKNVEVTVSVYDEDGKRLEHVIFPGAGDEAISEYKSVIYYQVKQPRWFETVKVAIPIEDVNRSHLRFTFRHRSSQDSKDKSEKIFALAFVKLMRYDGTTLRDGEHDLIVYKAEAKKLEDAATYLSLPSTKAELEEKGHSATGKSMQSLGSCTISKDSFQISTLVCSTKLTQNVDLLGLLKWRSNTSLLQQNLRQLMKVDGGEVVKFLQDTLDALFNIMMENSESETFDTLVFDALVFIIGLIADRKFQHFNPVLETYIKKHFSATLAYTKLTKVLKNYVDGAEKPGVNEQLYKAMKALESIFKFIVRSRILFNQLYENKGEADFVESLLQLFRSINDMMSSMSDQTVRVKGAALKYLPTIVNDVKLVFDPKELSKMFTEFILNVPMGLLTIQKLYCLIEIVHSDLFTQHDCREILLPMMTDQLKYHLERQEDLEACCQLLSHILEVLYRKDVGPTQRHVQIIMEKLLRTVNRTVISMGRDSELIGNFVACMTAILRQMEDYHYAHLIKTFGKMRTDVVDFLMETFIMFKNLIGKNVYPFDWVIMNMVQNKVFLRAINQYADMLNKKFLDQANFELQLWNNYFHLAVAFLTQESLQLENFSSAKRAKILNKYGDMRRQIGFEIRDMWYNLGQHKIKFIPEMVGPILEMTLIPETELRKATIPIFFDMMQCEFHSTRSFQMFENEIITKLDHEVEGGRGDEQYKVLFDKILLEHCRKHKYLAKTGETFVKLVVRLMERLLDYRTIMHDENKENRMSCTVNVLNFYKEIEREEMYIRYLYKLCDLHKECDNYTEAAYTLLLHAKLLKWSEDVCVAHLTQRDGYQATTQGQLKEQLYQEIIHYFDKGKMWEEAIALGKELAEQYENEMFDYEQLSELLKKQAQFYENIVKVIRPKPDYFAVGYYGQGFPTFLRGKVFIYRGKEYERREDFEARLLTQFPNAEKMKTTSPPGDDIKNSPGQYIQCFTVKPKLDLPPKFHRPVFYRVNEVQRFEYSRPIRKGEKNPDNEFANMWIERTIYTTAYKLPGILRWFEVKSVFMVEISPLENAIETMQLTNDKINSMVQQHLDDPSLPINPLSMLLNGIVDPAVMGGFANYEKAFFTDRYLQEHPEAHEKIEKLKDLIAWQIPFLAEGIRIHGDKVTEALRPFHERMEACFKQLKEKVEKEYGVRIMPSSLDDRRGSRPRSMVRSFTMPSSSRPLSVASVSSLSSDSTPSRPGSDGFALEPLLPKKMHSRSQDKLDKDDLEKEKKDKKKEKRNSKHQEIFEKEFKPTDISLQQSEAVILSETISPLRPQRPKSQVMNVIGSERRFSVSPSSPSSQQTPPPVTPRAKLSFSMQSSLELNGMTGADVADVPPPLPLKGSVADYGNLMENQDLLGSPTPPPPPPHQRHLPPPLPSKTPPPPPPKTTRKQTSVDSGIVQ

SEQ ID NO: 888948 - protein, 819 aa, Homo sapiens
MFRSVRHMIYDLIEWRSQILSGTLPQDELKELKKKVTAKIDYGNRILDLDLVVRDEDGNILDPELTSTISLFRAHEIASKQVEERLQEEKSQKQNIDINRQAKFAATPSLALFVNLKNVVCKIGEDAEVLMSLYDPVESKFISENYLVRWSSSGLPKDIDRLHNLRAVFTDLGSKDLKREKISFVCQIVRVGRMELRDNNTRKLTSGLRRPFGVAVMDVTDIINGKVDDEDKQHFIPFQPVAGENDFLQTVINKVIAAKEVNHKGQGLWVTLKLLPGDIHQIRKEFPHLVDRTTAVARKTGFPEIIMPGDVRNDIYVTLVQGDFDKGSKTTAKNVEVTVSVYDEDGKRLEHVIFPGAGDEAISEYKSVIYYQVKQPRWFETVKVAIPIEDVNRSHLRFTFRHRSSQDSKDKSEKIFALAFVKLMRYDGTTLRDGEHDLIVYKAEAKKLEDAATYLSLPSTKAELEEKGHSATGKSMQSLGSCTISKDSFQISTLVCSTKLTQNVDLLGLLKWRSNTSLLQQNLRQLMKVDGGEVVKFLQDTLDALFNIMMENSESETFDTLVFDALVFIIGLIADRKFQHFNPVLETYIKKHFSATLAYTKLTKVLKNYVDGAEKPGVNEQLYKAMKALESIFKFIVRSRILFNQLYENKGEADFVESLLQLFRSINDMMSSMSDQTVRVKGAALKYLPTIVNDVKLVFDPKELSKMFTEFILNVPMGLLTIQKLYCLIEIVHSDLFTQHDCREILLPMMTDQLKYHLERQEDLEACCQLLSHILEVLYRKDVGPTQRHVQIIMEKLLRTVNRTVISMGRDSELIVSAW

SEQ ID NO: 888949 - protein, 881 aa, Homo sapiens
MFRSVRHMIYDLIEWRSQILSGTLPQDELKELKKKVTAKIDYGNRILDLDLVVRDEDGNILDPELTSTISLFRAHEIASKQVEERLQEEKSQKQNIDINRQAKFAATPSLALFVNLKNVVCKIGEDAEVLMSLYDPVESKFISENYLVRWSSSGLPKDIDRLHNLRAVFTDLGSKDLKREKISFVCQIVRVGRMELRDNNTRKLTSGLRRPFGVAVMDVTDIINGKVDDEDKQHFIPFQPVAGENDFLQTVINKVIAAKEVNHKGQGLWVTLKLLPGDIHQIRKEFPHLVDRTTAVARKTGFPEIIMPGDVRNDIYVTLVQGDFDKGSKTTAKNVEVTVSVYDEDGKRLEHVIFPGAGDEAISEYKSVIYYQVKQPRWFETVKVAIPIEDVNRSHLRFTFRHRSSQDSKDKSEKIFALAFVKLMRYDGTTLRDGEHDLIVYKAEAKKLEDAATYLSLPSTKAELEEKGHSATGKSMQSLGSCTISKDSFQISTLVCSTKLTQNVDLLGLLKWRSNTSLLQQNLRQLMKVDGGEVVKFLQDTLDALFNIMMENSESETFDTLVFDALVFIIGLIADRKFQHFNPVLETYIKKHFSATLAYTKLTKVLKNYVDGAEKPGVNEQLYKAMKALESIFKFIVRSRILFNQLYENKGEADFVESLLQLFRSINDMMSSMSDQTVRVKGAALKYLPTIVNDVKLVFDPKELSKMFTEFILNVPMGLLTIQKLYCLIEIVHSDLFTQHDCREILLPMMTDQLKYHLERQEDLEACCQLLSHILEVLYRKDVGPTQRHVQIIMEKLLRTVNRTVISMGRDSELIGNFVACMTAILRQMEDYHYAHLIKTFGKMRTDVVDFLMETFIMFKNLIGKNVYPFDWVIMNMVQNK

SEQ ID NO: 888950 - protein, 836 aa, Homo sapiens
MFRSVRHMIYDLIEWRSQILSGTLPQDELKELKKKVTAKIDYGNRILDLDLVVRDEDGNILDPELTSTISLFRAHEIASKQVEERLQEEKSQKQNIDINRQAKFAATPSLALFVNLKNVVCKIGEDAEVLMSLYDPVESKFISENYLVRWSSSGLPKDIDRLHNLRAVFTDLGSKDLKREKISFVCQIVRVGRMELRDNNTRKLTSGLRRPFGVAVMDVTDIINGKVDDEDKQHFIPFQPVAGENDFLQTVINKVIAAKEVNHKGQGLWVTLKLLPGDIHQIRKEFPHLVDRTTAVARKTGFPEIIMPGDVRNDIYVTLVQGDFDKGSKTTAKNVEVTVSVYDEDGKRLEHVIFPGAGDEAISEYKSVIYYQVKQPRWFETVKVAIPIEDVNRSHLRFTFRHRSSQDSKDKSEKIFALAFVKLMRYDGTTLRDGEHDLIVYKAEAKKLEDAATYLSLPSTKAELEEKGHSATGKSMQSLGSCTISKDSFQISTLVCSTKLTQNVDLLGLLKWRSNTSLLQQNLRQLMKVDGGEVVKFLQDTLDALFNIMMENSESETFDTLVFDALVFIIGLIADRKFQHFNPVLETYIKKHFSATLAYTKLTKVLKNYVDGAEKPGVNEQLYKAMKALESIFKFIVRSRILFNQLYENKGEADFVESLLQLFRSINDMMSSMSDQTVRVKGAALKYLPTIVNDVKLVFDPKELSKMFTEFILNVPMGLLTIQKLYCLIEIVHSDLFTQHDCREILLPMMTDQLKYHLERQEDLEACCQLLSHILEVLYRKDVGPTQRHVQIIMEKLLRTVNRTVISMGRDSELIGYFVACMTAILRHCDLRLGRF

SEQ ID NO: 888951 - protein, 395 aa, Homo sapiens
GSLKNAGDTLTSLVLPTSEFYTSGMYCEDPNMSLCTNCFNFVFDLGWYRGYTLRKKSKKGIFPASYIHLKEAIVEGKGQHETVIPGDLPLIQEVTTTLREWSTIWRQLYVQDNREMFRSVRHMIYDLIEWRSQILSGTLPQDELKELKKKVTAKIDYGNRILDLDLVVRDEDGNILDPELTSTISLFRAHEIASKQVEERLQEEKSQKQNIDINRQAKFAATPSLALFVNLKNVVCKIGEDAEVLMSLYDPVESKFISENYLVRWSSSGLPKDIDRLHNLRAVFTDLGSKDLKREKISFVCQIVRVGRMELRDNNTRKLTSGLRRPFGVAVMDVTDIINGKVDDEDKQHFIPFQPVAGENDFLQTVINKVIAAKEVNHKGQGCVDAAANLVVVVD

SEQ ID NO: 888952 - protein, 107 aa, Homo sapiens
VGQDGAQLMWGGWFRLSGCARSDPTWRRCLFCQDISYVTSSPSSCFLASATSTAQQNSASSPSKDNSQADIGGLRDRAVTSQGSLERVCCPSPSPCPLLLCPLSLLF

SEQ ID NO: 888953 - protein, 730 aa, Homo sapiens
MKIFSESHKTVFVVDHCPYMAESCRQHVEFDMLVKNRTQGIIPLAPISKSLWTCSVESSMEYCRIMYDIFPFKKLVNFIVSDSGAHVLNSWTQEDQNLQELMAALAAVGPPNPRADPECCSILHGLVAAVETLCKITEYQHEARTLLMENAERVGNRGRIICITNAKSDSHVRMLEDCVQETIHEHNKLAANSDHLMQIQKCELVLIHTYPVGEDSLVSDRSKKELSPVLTSEVHSVRAGRHLATKLNILVQQHFDLASTTITNIPMKEEQHANTSANYDVELLHHKDAHVDFLKSGDSHLGGGSREGSFKETITLKWCTPRTNNIELHYCTGAYRISPVDVNSRPSSCLTNFLLNGRSVLLEQPRKSGSKVISHMLSSHGGEIFLHVLSSSRSILEDPPSISEGCGGRVTDYRITDFGEFMRENRLTPFLDPRYKIDGSLEVPLERAKDQLEKHTRYWPMIISQTTIFNMQAVVPLASVIVKESLTEEDVLNCQKTIYNLVDMERKNDPLPISTVGTRGKGPKRDEQYRIMWNELETLVRAHINNSEKHQRVLECLSLLSLTCPLCLPSFFLVSFVLPLLMACRSKPPEEEERKKRGRKREDKEDKSEKAVKDYEQEKSWQDSERLKGILERGKEELAEAEIIKDSPDSPEPPNKKPLVEMDETPQVEKSKGPVSLLSLWSNRINTANSRKHQEFAGRLNSVNNRAELYQHLKEENGMETTENGKASRQ

SEQ ID NO: 888954 - protein, 601 aa, Homo sapiens
MKIFSESHKTVFVVDHCPYMAESCRQHVEFDMLVKNRTQGIIPLAPISKSLWTCSVESSMEYCRIMYDIFPFKKLVNFIVSDSGAHVLNSWTQEDQNLQELMAALAAVGPPNPRADPECCSILHGLVAAVETLCKITEYQHEARTLLMENAERVGNRGRIICITNAKSDSHVRMLEDCVQETIHEHNKLAANSDHLMQIQKCELVLIHTYPVGEDSLVSDRSKKELSPVLTSEVHSVRAGRHLATKLNILVQQHFDLASTTITNIPMKEEQHANTSANYDVELLHHKDAHVDFLKSELHYCTGAYRISPVDVNSRPSSCLTNFLLNDPRYKIDGSLEVPLERAKDQLEKHTRYWPMIISQTTIFNMQAVVPLASVIVKESLTEEDVLNCQKTIYNLVDMERKNDPLPISTVGTRGKGPKRDEQYRIMWNELETLVRAHINNSEKHQRVLECLMACRSKPPEEEERKKRGRKREDKEDKSEKAVKDYEQEKSWQDSERLKGILERGKEELAEAEIIKDSPDSPEPPNKKPLVEMDETPQVEKSKGPVSLLSLWSNRINTANSRKHQEFAGRLNSVNNRAELYQHLKEENGMETTENGKASRQ

SEQ ID NO: 888955 - protein, 290 aa, Homo sapiens
MTSLRSAPSLSYSPRVWPSVRDIHRLGVTGSITMHLSTLSMMSRTVPHCRRDDSASGLLPQFATRIIFSLHIQLVAYPFSHLHNLVDMERKNDPLPISTVGTRGKGPKRDEQYRIMWNELETLVRAHINNSEKHQRVLECLMACRSKPPEEEERKKRGRKREDKEDKSEKAVKDYEQEKSWQDSERLKGILERGKEELAEAEIIKDSPDSPEPPNKKPLVEMDETPQVEKSKGPVSLLSLWSNRINTANSRKHQEFAGRLNSVNNRAELYQHLKEENGMETTENGKASRQ

SEQ ID NO: 888956 - protein, 706 aa, Homo sapiens
MKIFSESHKTVFVVDHCPYMAESCRQHVEFDMLVKNRTQGIIPLAPISKSLWTCSVESSMEYCRIMYDIFPFKKLVNFIVSDSGAHVLNSWTQEDQNLQELMAALAAVGPPNPRADPECCSILHGLVAAVETLCKITEYQHEARTLLMENAERVGNRGRIICITNAKSDSHVRMLEDCVQETIHEHNKLAANSDHLMQIQKCELVLIHTYPVGEDSLVSDRSKKELSPVLTSEVHSVRAGRHLATKLNILVQQHFDLASTTITNIPMKEEQHANTSANYDVELLHHKDAHVDFLKSGDSHLGGGSREGSFKETITLKWCTPRTNNIELHYCTGAYRISPVDVNSRPSSCLTNFLLNGRSVLLEQPRKSGSKVISHMLSSHGGEIFLHVLSSSRSILEDPPSISEGCGGRVTDYRITDFGEFMRENRLTPFLDPRYKIDGSLEVPLERAKDQLEKHTRYWPMIISQTTIFNMQAVVPLASVIVKESLTEEDVLNCQKTIYNLVDMERKNDPLPISTVGTRGKGPKRDEQYRIMWNELETLVRAHINNSEKHQRVLECLMACRSKPPEEEERKKRGRKREDKEDKSEKAVKDYEQEKSWQDSERLKGILERGKEELAEAEIIKDSPDSPEPPNKKPLVEMDETPQVEKSKGPVSLLSLWSNRINTANSRKHQEFAGRLNSVNNRAELYQHLKEENGMETTENGKASRQ

SEQ ID NO: 888957 - protein, 272 aa, Homo sapiens
MKIFSESHKTVFVVDHCPYMAESCRQHVEFDMLVKNRTQGIIPLAPISKSLWTCSVESSMEYCRIMYDIFPFKKLVNFIVSDSGAHVLNSWTQEDQNLQELMAALAAVGPPNPRADPECCSILHGLVAAVETLCKITEYQHEARTLLMENAERVGNRGRIICITNAKSDSHVRMLEDCVQETIHEHNKLAANSDHLMQIQKCELVLIHTYPVGEDSLVSDRSKKELSPVLTSEVHSVRAGRHLATKLNILVQQHFDLASTTITNIPMKVIRI

SEQ ID NO: 888958 - protein, 314 aa, Homo sapiens
MTSLRSAPSLSYSPRVWPSVRDIHRLGVTGSITMHLSTLSMMSRTVPHCRRDDSASGLLPQFATRIIFSLHIQLVAYPFSHLHNLVDMERKNDPLPISTVGTRGKGPKRDEQYRIMWNELETLVRAHINNSEKHQRVLECLSLLSLTCPLCLPSFFLVSFVLPLLMACRSKPPEEEERKKRGRKREDKEDKSEKAVKDYEQEKSWQDSERLKGILERGKEELAEAEIIKDSPDSPEPPNKKPLVEMDETPQVEKSKGPVSLLSLWSNRINTANSRKHQEFAGRLNSVNNRAELYQHLKEENGMETTENGKASRQ

SEQ ID NO: 888959 - protein, 287 aa, Homo sapiens
LPLLCPAPGTRLFPLQCLRGGDGSTMDPRLSTVRQTCCCFNVRIATTALAIYHVIMSVLLFIEHSVEVAHGKASCKLSQMGYLRIADLISSFLLITMLFIISLSLLIGVVKNREKYLLPFLSLQIMDYLLCLLTLLGSYIELPAYLKLASRSRASSSKFPLMTLQLLDFCLSILTLCSSYMEVPTYLNFKSMNHMNYLPSQEDMPHNQFIKMMIIFSIAFITVLIFKVYMFKCVWRCYRLIKCMNSVEEKRNSKMLQKVVLPSYEEALSLPSKTPEGGPAPPPYSEV

SEQ ID NO: 888960 - protein, 191 aa, Homo sapiens [sequence omitted]

SEQ ID NO: 888961 - protein, 287 aa, Homo sapiens; identical to SEQ ID NO: 888959

SEQ ID NO: 888962 - protein, 287 aa, Homo sapiens; identical to SEQ ID NO: 888959

SEQ ID NO: 888963 - protein, 509 aa, Homo sapiens
MAERAALEELVKLQGERVRGLKQQKASAELIEEEVAKLLKLKAQLGPDESKQKFVLKTPKGTRDYSPRQMAVREKVFDVIIRCFKRHGAEVIDTPVFELKETLMGKYGEDSKLIYDLKDQGGELLSLRYDLTVPFARYLAMNKLTNIKRYHIAKVYRRDNPAMTRGRYREFYQCDFDIAGNFDPMIPDAECLKIMCEILSSLQIGDFLVKVNDRRILDGMFAICGVSDSKFRTICSSVDKLDKVSWEEVKNEMVGEKGLAPEVADRIGDYVQQHGGVSLVEQLLQDPKLSQNKQALEGLGDLKLLFEYLTLFGIDDKISFDLSLARGLDYYTGVIYEAVLLQTPAQAGEEPLGVGSVAAGGRYDGLVGMFDPKGRKVPCVGLSIGVERIFSIVEQRLEALEEKIRTTETQVLVASAQKKLLEERLKLVSELWDAGIKAELLYKKNPKLLNQLQYCEEAGIPLVAIIGEQELKDGVIKLRSVTSREEVDVRREDLVEEIKRRTGQPLCIC

SEQ ID NO: 888964 - protein, 509 aa, Homo sapiens; identical to SEQ ID NO: 888963

SEQ ID NO: 888965 - protein, 403 aa, Homo sapiens
MAERAALEELVKLQGERVRGLKQQKASAELIEEEVAKLLKLKAQLGPDESKQKFVLKTPKGTRDYSPRQMAVREKVFDVIIRCFKRHGAEVIDTPVFELKETLMGKYGEDSKLIYDLKDQGGELLSLRYDLTVPFARYLAMNKLTNIKRYHIAKVYRRDNPAMTRGRYREFYQCDFDIAGNFDPMIPDAECLKIMCEILSSLQIGDFLVKVNDRRILDGMFAICGVSDSKFRTICSSVDKLDKVSWEEVKNEMVGEKGLAPEVADRIGDYVQQHGGVSLVEQLLQDPKLSQNKQALEGLGDLKLLFEYLTLFGIDDKISFDLSLARGLDYYTGVIYEAVLLQTPAQAGEEPLGVGSVAAGGRYDGLVGMFDPKGRKVPCVGLSIGVERIFSIVEQRLEVGPRR

SEQ ID NO: 888966 - protein, 489 aa, Homo sapiens
MAERAALEELVKLQGERVRGLKQQKASAELIEEEVAKLLKLKAQLGPDESKQKFVLKTPKGTRDYSPRQMAVREKVFDVIIRCFKRHGAEVIDTPVFELKETLMGKYGEDSKLIYDLKDQGGELLSLRYDLTVPFARYLAMNKLTNIKRYHIAKDFDIAGNFDPMIPDAECLKIMCEILSSLQIGDFLVKVNDRRILDGMFAICGVSDSKFRTICSSVDKLDKVSWEEVKNEMVGEKGLAPEVADRIGDYVQQHGGVSLVEQLLQDPKLSQNKQALEGLGDLKLLFEYLTLFGIDDKISFDLSLARGLDYYTGVIYEAVLLQTPAQAGEEPLGVGSVAAGGRYDGLVGMFDPKGRKVPCVGLSIGVERIFSIVEQRLEALEEKIRTTETQVLVASAQKKLLEERLKLVSELWDAGIKAELLYKKNPKLLNQLQYCEEAGIPLVAIIGEQELKDGVIKLRSVTSREEVDVRREDLVEEIKRRTGQPLCIC

SEQ ID NO: 888967 - protein, 473 aa, Homo sapiens
MAERAALEELVKLQGERVRGLKQQKASAELIEEEVAKLLKLKAQLGPDESKQKFVLKTPKGTRDYSPRQMAVREKVFDVIIRCFKRHGAEVIDTPVFELKETLMGKYGEDSKLIYDLKDQGGELLSLRYDLTVPFARYLAMNKLTNIKRYHIAKVYRRDNPAMTRGRYREFYQCVNDRRILDGMFAICGVSDSKFRTICSSVDKLDKVSWEEVKNEMVGEKGLAPEVADRIGDYVQQHGGVSLVEQLLQDPKLSQNKQALEGLGDLKLLFEYLTLFGIDDKISFDLSLARGLDYYTGVIYEAVLLQTPAQAGEEPLGVGSVAAGGRYDGLVGMFDPKGRKVPCVGLSIGVERIFSIVEQRLEALEEKIRTTETQVLVASAQKKLLEERLKLVSELWDAGIKAELLYKKNPKLLNQLQYCEEAGIPLVAIIGEQELKDGVIKLRSVTSREEVDVRREDLVEEIKRRTGQPLCIC

SEQ ID NO: 888968 - protein, 138 aa, Homo sapiens
VTSREEVDVRREDLVERIFSIVDLRLEALEEKIRTTETQVLVASAQKKLLEERLKLVSELWDAGIKAELLYKKNPKLLNQLQYCEEAGIPLVAIIGEQELKDGVIKLRSVTSREEVDVRREDLVEEIKRRTGQPLCIC

SEQ ID NO: 888969 - protein, 135 aa, Homo sapiens
MAERAALEELVKLQGERVRGLKQQKASAELIEEEVAKLLKLKAQLGPDESKQKFVLKTPKGTRDYSPRQMAVREKVFDVIIRCFKRHGAEVIDTPVFELKETLMGKYGEDSKLIYDLKDQGGELLSLRYDLTVSF

SEQ ID NO: 888970 - protein, 106 aa, Homo sapiens [sequence omitted]

SEQ ID NO: 888971 - protein, 509 aa, Homo sapiens; identical to SEQ ID NO: 888963

SEQ ID NO: 888972 - protein, 509 aa, Homo sapiens; identical to SEQ ID NO: 888963

SEQ ID NO: 888973 - protein, 560 aa, Homo sapiens
MAERAALEELVKLQGERVRGLKQQKASAELIEEEVAKLLKLKAQLGPDESKQKFVLKTPKGTRDYSPRQMAVREKVFDVIIRCFKRHGAEVIDTPVFELKETLMGKYGEDSKLIYDLKDQGGELLSLRYDLTVPFARYLAMNKLTNIKRYHIAKVYRRDNPAMTRGRYREFYQCDFDIAGNFDPMIPDAECLKIMCEILSSLQIGDFLVKVRADKAGRAKLGLASHKRRSLCRGTSSLSDHDYCRYVRKEIPPSLCIGSLQVNDRRILDGMFAICGVSDSKFRTICSSVDKLDKVSWEEVKNEMVGEKGLAPEVADRIGDYVQQHGGVSLVEQLLQDPKLSQNKQALEGLGDLKLLFEYLTLFGIDDKISFDLSLARGLDYYTGVIYEAVLLQTPAQAGEEPLGVGSVAAGGRYDGLVGMFDPKGRKVPCVGLSIGVERIFSIVEQRLEALEEKIRTTETQVLVASAQKKLLEERLKLVSELWDAGIKAELLYKKNPKLLNQLQYCEEAGIPLVAIIGEQELKDGVIKLRSVTSREEVDVRREDLVEEIKRRTGQPLCIC

SEQ ID NO: 888974 - protein, 435 aa, Homo sapiens
MAERAALEELVKLQGERVRGLKQQKASAELIEEEVAKLLKLKAQLGPDESKQKFVLKTPKGTRDYSPRQMAVREKVFDVIIRCFKRHGAEVIDTPVFELKDFDIAGNFDPMIPDAECLKIMCEILSSLQIGDFLVKVNDRRILDGMFAICGVSDSKFRTICSSVDKLDKVSWEEVKNEMVGEKGLAPEVADRIGDYVQQHGGVSLVEQLLQDPKLSQNKQALEGLGDLKLLFEYLTLFGIDDKISFDLSLARGLDYYTGVIYEAVLLQTPAQAGEEPLGVGSVAAGGRYDGLVGMFDPKGRKVPCVGLSIGVERIFSIVEQRLEALEEKIRTTETQVLVASAQKKLLEERLKLVSELWDAGIKAELLYKKNPKLLNQLQYCEEAGIPLVAIIGEQELKDGVIKLRSVTSREEVDVRREDLVEEIKRRTGQPLCIC

SEQ ID NO: 888975 - protein, 195 aa, Homo sapiens
MAERAALEELVKLQGERVRGLKQQKASAELIEEEVAKLLKLKAQLGPDESKQKFVLKTPKGTRDYSPRQMAVREKVFDVIIRCFKRHGAEVIDTPVFELKETLMGKYGEDSKLIYDLKDQGGELLSLRYDLTVPFARYLAMNKLTNIKRYHIAKVYRRDNPAMTRGRYREFYQCVSVGKPWGRMSYLGLSQASRI

SEQ ID NO: 888976 - protein, 110 aa, Homo sapiens
MAERAALEELVKLQGERVRGLKQQKASAELIEEEVAKLLKLKAQLGPDESKQKFVLKTPKGTRDYSPRQMAVREKVFDVIIRCFKRHGAEVIDTPVFELKVRNGQEETTW

SEQ ID NO: 888977 - protein, 136 aa, Homo sapiens [sequence omitted]

SEQ ID NO: 888978 - protein, 136 aa, Homo sapiens [sequence omitted]

SEQ ID NO: 888979 - protein, 168 aa, Homo sapiens
MMYDVDTGCISVTRGRRFSCISRCVFCGLYQVMLYDFLVKPYRVRRCPKAPDHFRSHLEHQKGSSSQGYGSVCLDIVWNCALSPQASPELKGSKNILKLLFQNMRFRRNQVSPGERGSLLNQHRELLAGRLPSAVESPPASGLGAPSHFLLLMEYMGLLCFKPRSELL

SEQ ID NO: 888980 - protein, 261 aa, Homo sapiens
MDWGTLHTFIGGVNKHSTSIGKVWITVIFIFRVMILVVAAQEVWGDEQEDFVCNTLQPGCKNVCYDHFFPVSHIRLWALQLIFVSTPALLVAMHVAYYRHETTRKFRRGEKRNDFKDIEDIKKQKVRIEGSLWWTYTSSIFFRIIFEAAFMYVFYFLYNGYHLPWVLKCGIDPCPNLVDCFISRPTEKTVFTIFMISASVICMLLNVAELCYLLLKVCFRRSKRAQTQKNHPNHALKESKQNEMNELISDSGQNAITGFPS

SEQ ID NO: 888981 - protein, 261 aa, Homo sapiens; identical to SEQ ID NO: 888980

SEQ ID NO: 888982 - protein, 466 aa, Homo sapiens
QHREWKTAEVTEQPCSKRSWSPSSPPQVKTGPAGDTMGHLSAPLHRVRVPWQGLLLTASLLTFWNPPTTAQLTTESMPFNVAEGKEVLLLVHNLPQQLFGYSWYKGERVDGNRQIVGYAIGTQQATPGPANSGRETIYPNASLLIQNVTQNDTGFYTLQVIKSDLVNEEATGQFHVYPELPKPSISSNNSNPVEDKDAVAFTCEPETQDTTYLWWINNQSLPVSPRLQLSNGNRTLTLLSVTRNDTGPYECEIQNPVSANRSDPVTLNVTYGPDTPTISPSDTYYRPGANLSLSCYAASNPPAQYSWLINGTFQQSTQELFIPNITVNNSGSYTCHANNSVTGCNRTTVKTIIVTDNALPQENGLSPGAIAGIVIGVVALVALIAVALACFLHFGKTGRASDQRDLTEHKPSVSNHTQDHSNDPPNKMNEVTYSTLNFEAQQPTQPTSASPSLTATEIIYSEVKKQ

SEQ ID NO: 888983 - protein, 453 aa, Homo sapiens
QHREWKTAEVTEQPCSKRSWSPSSPPQVKTGPAGDTMGHLSAPLHRVRVPWQGLLLTASLLTFWNPPTTAQLTTESMPFNVAEGKEVLLLVHNLPQQLFGYSWYKGERVDGNRQIVGYAIGTQQATPGPANSGRETIYPNASLLIQNVTQNDTGFYTLQVIKSDLVNEEATGQFHVYPELPKPSISSNNSNPVEDKDAVAFTCEPETQDTTYLWWINNQSLPVSPRLQLSNGNRTLTLLSVTRNDTGPYECEIQNPVSANRSDPVTLNVTYGPDTPTISPSDTYYRPGANLSLSCYAASNPPAQYSWLINGTFQQSTQELFIPNITVNNSGSYTCHANNSVTGCNRTTVKTIIVTELSPVVAKPQIKASKTTVTGDKDSVNLTCSTNDTGISIRWFFKNQSLPSSERMKLSQGNTTLSINPVKREDAGTYWCEVFNPISKNQSDPIMLNVNCK

SEQ ID NO: 888984 - protein, 321 aa, Homo sapiens
MGHLSAPLHRVRVPWQGLLLTASLLTFWNPPTTAQLTTESMPFNVAEGKEVLLLVHNLPQQLFGYSWYKGERVDGNRQIVGYAIGTQQATPGPANSGRETIYPNASLLIQNVTQNDTGFYTLQVIKSDLVNEEATGQFHVYPELPKPSISSNNSNPVEDKDAVAFTCEPETQDTTYLWWINNQSLPVSPRLQLSNGNRTLTLLSVTRNDTGPYECEIQNPVSANRSDPVTLNVTYGPDTPTISPSDTYYRPGANLSLSCYAASNPPAQYSWLINGTFQQSTQELFIPNITVNNSGSYTCHANNSVTGCNRTTVKTIIVTGK

SEQ ID NO: 888985 - protein, 387 aa, Homo sapiens
QHREWKTAEVTEQPCSKRSWSPSSPPQVKTGPAGDTMGHLSAPLHRVRVPWQGLLLTASLLTFWNPPTTAQLTTESMPFNVAEGKEVLLLVHNLPQQLFGYSWYKGERVDGNRQIVGYAIGTQQATPGPANSGRETIYPNASLLIQNVTQNDTGFYTLQVIKSDLVNEEATGQFHVYPELPKPSISSNNSNPVEDKDAVAFTCEPETQDTTYLWWINNQSLPVSPRLQLSNGNRTLTLLSVTRNDTGPYECEIQNPVSANRSDPVTLNVTYGPDTPTISPSDTYYRPGANLSLSCYAASNPPAQYSWLINGTFQQSTQELFIPNITVNNSGSYTCHANNSVTGCNRTTVKTIIVTESPVLGEDEAVPGQHHPQHKPCQEGGCWDVLV

SEQ ID NO: 888986 - protein, 73 aa, Homo sapiens
AQRVENSRGDRAAVLEAFLEPKLSSTGEDRASRRHHGAPLSPTSQSACTLAGASAHSLTSNLLEPAHHCPAHY

SEQ ID NO: 888987 - protein, 568 aa, Homo sapiens
QHREWKTAEVTEQPCSKRSWSPSSPPQVKTGPAGDTMGHLSAPLHRVRVPWQGLLLTASLLTFWNPPTTAQLTTESMPFNVAEGKEVLLLVHNLPQQLFGYSWYKGERVDGNRQIVGYAIGTQQATPGPANSGRETIYPNASLLIQNVTQNDTGFYTLQVIKSDLVNEEATGQFHVYPELPKPSISSNNSNPVEDKDAVAFTCEPETQDTTYLWWINNQSLPVSPRLQLSNGNRTLTLLSVTRNDTGPYECEIQNPVSANRSDPVTLNVTYGPDTPTISPSDTYYRPGANLSLSCYAASNPPAQYSWLINGTFQQSTQELFIPNITVNNSGSYTCHANNSVTGCNRTTVKTIIVTELSPVVAKPQIKASKTTVTGDKDSVNLTCSTNDTGISIRWFFKNQSLPSSERMKLSQGNTTLSINPVKREDAGTYWCEVFNPISKNQSDPIMLNVNYNALPQENGLSPGAIAGIVIGVVALVALIAVALACFLHFGKTGRYDGLSSCSVSSKADCHAWERERILCLSLGLDLILLPLNSCFSALIPTGFLFPGLRAPCLPLSLGHGYSNPHLI

SEQ ID NO: 888988 - protein, 461 aa, Homo sapiens
MGHLSAPLHRVRVPWQGLLLTASLLTFWNPPTTAQLTTESMPFNVAEGKEVLLLVHNLPQQLFGYSWYKGERVDGNRQIVGYAIGTQQATPGPANSGRETIYPNASLLIQNVTQNDTGFYTLQVIKSDLVNEEATGQFHVYPELPKPSISSNNSNPVEDKDAVAFTCEPETQDTTYLWWINNQSLPVSPRLQLSNGNRTLTLLSVTRNDTGPYECEIQNPVSANRSDPVTLNVTYGPDTPTISPSDTYYRPGANLSLSCYAASNPPAQYSWLINGTFQQSTQELFIPNITVNNSGSYTCHANNSVTGCNRTTVKTIIVTERQNLTMLPRLDSNSWAQAILPSVSQSAEITDNALPQENGLSPGAIAGIVIGVVALVALIAVALACFLHFGKTGRASDQRDLTEHKPSVSNHTQDHSNDPPNKMNEVTYSTLNFEAQQPTQPTSASPSLTATEIIYSEVKKQ

SEQ ID NO: 888989 - protein, 324 aa, Homo sapiens
CEVIQRSRNNSNPVEDKDAVAFTCEPETQDTTYLWWINNQSLPVSPRLQLSNGNRTLTLLSVTRNDTGPYECEIQNPVSANRSDPVTLNVTYGPDTPTISPSDTYYRPGANLSLSCYAASNPPAQYSWLINGTFQQSTQELFIPNITVNNSGSYTCHANNSVTGCNRTTVKTIIVTEMAFHHVAKAGLKLLSSSNPPASTSQSAKITDNALPQENGLSPGAIAGIVIGVVALVALIAVALACFLHFGKTGRYDGLSSCSVSSKADCHAWERERILCLSLGLDLILLPLNSCFSALIPTGFLFPGLRAPCLPLSLGHGYSNPHLI

SEQ ID NO: 888990 - protein, 161 aa, Homo sapiens
MKLSQGNTTLSINPVKREDAGTYWCEVFNPISKNQSDPIMLNVNYNALPQENGLSPGAIAGIVIGVVALVALIAVALACFLHFGKTGRYDGLSSCSVSSKADCHAWERERILCLSLGLDLILLPLNSCFSALIPTGFLFPGLRAPCLPLSLGHGYSNPHLI

SEQ ID NO: 888991 - protein, 73 aa, Homo sapiens; identical to SEQ ID NO: 888986

SEQ ID NO: 888992 - protein, 292 aa, Homo sapiens
QHREWKTAEVTEQPCSKRSWSPSSPPQVKTGPAGDTMGHLSAPLHRVRVPWQGLLLTASLLTFWNPPTTAQLTTESMPFNVAEGKEVLLLVHNLPQQLFGYSWYKGERVDGNRQIVGYAIGTQQATPGPANSGRETIYPNASLLIQNVTQNDTGFYTLQVIKSDLVNEEATGQFHVYPELPKPSISSNNSNPVEDKDAVAFTCEPETQDTTYLWWINNQSLPVSPRLQLSNGNRTLTLLSVTRNDTGPYECEIQNPVSANRSDPVTLNVTYGPDTPPFPLQTLASRGYRADL

SEQ ID NO: 888993 - protein, 95 aa, Homo sapiens
IQNVTQNDTGFYTLQVIKSDLVNEEATGQFHVYREYFPMTSGCWGVSSTSHTWDCQAWAVPVSSSALYPMLRFEHLVQDTLWDRHQNTECLTLES

SEQ ID NO: 888994 - protein, 562 aa, Homo sapiens
QHREWKTAEVTEQPCSKRSWSPSSPPQVKTGPAGDTMGHLSAPLHRVRVPWQGLLLTASLLTFWNPPTTAQLTTESMPFNVAEGKEVLLLVHNLPQQLFGYSWYKGERVDGNRQIVGYAIGTQQATPGPANSGRETIYPNASLLIQNVTQNDTGFYTLQVIKSDLVNEEATGQFHVYPELPKPSISSNNSNPVEDKDAVAFTCEPETQDTTYLWWINNQSLPVSPRLQLSNGNRTLTLLSVTRNDTGPYECEIQNPVSANRSDPVTLNVTYGPDTPTISPSDTYYRPGANLSLSCYAASNPPAQYSWLINGTFQQSTQELFIPNITVNNSGSYTCHANNSVTGCNRTTVKTIIVTELSPVVAKPQIKASKTTVTGDKDSVNLTCSTNDTGISIRWFFKNQSLPSSERMKLSQGNTTLSINPVKREDAGTYWCEVFNPISKNQSDPIMLNVNYNALPQENGLSPGAIAGIVIGVVALVALIAVALACFLHFGKTGRASDQRDLTEHKPSVSNHTQDHSNDPPNKMNEVTYSTLNFEAQQPTQPTSASPSLTATEIIYSEVKKQ

SEQ ID NO: 888995 - protein, 464 aa, Homo sapiens
MGHLSAPLHRVRVPWQGLLLTASLLTFWNPPTTAQLTTESMPFNVAEGKEVLLLVHNLPQQLFGYSWYKGERVDGNRQIVGYAIGTQQATPGPANSGRETIYPNASLLIQNVTQNDTGFYTLQVIKSDLVNEEATGQFHVYPELPKPSISSNNSNPVEDKDAVAFTCEPETQDTTYLWWINNQSLPVSPRLQLSNGNRTLTLLSVTRNDTGPYECEIQNPVSANRSDPVTLNVTYGPDTPTISPSDTYYRPGANLSLSCYAASNPPAQYSWLINGTFQQSTQELFIPNITVNNSGSYTCHANNSVTGCNRTTVKTIIVTELSPVVAKPQIKASKTTVTGDKDSVNLTCSTNDTGISIRWFFKNQSLPSSERMKLSQGNTTLSINPVKREDAGTYWCEVFNPISKNQSDPIMLNVNYNALPQENGLSPGAIAGIVIGVVALVALIAVALACFLHFGKTGSSGPLQ

SEQ ID NO: 888996 - protein, 372 aa, Homo sapiens
QHREWKTAEVTEQPCSKRSWSPSSPPQVKTGPAGDTMGHLSAPLHRVRVPWQGLLLTASLLTFWNPPTTAQLTTESMPFNVAEGKEVLLLVHNLPQQLFGYSWYKGERVDGNRQIVGYAIGTQQATPGPANSGRETIYPNASLLIQNVTQNDTGFYTLQVIKSDLVNEEATGQFHVYPELPKPSISSNNSNPVEDKDAVAFTCEPETQDTTYLWWINNQSLPVSPRLQLSNGNRTLTLLSVTRNDTGPYECEIQNPVSANRSDPVTLNVTYGPDTPTISPSDTYYRPGANLSLSCYAASNPPAQYSWLINGTFQQSTQELFIPNITVNNSGSYTCHANNSVTGCNRTTVKTIIVTERQNLTMLPRLDSNSWA

SEQ ID NO: 888997 - protein, 73 aa, Homo sapiens; identical to SEQ ID NO: 888986

SEQ ID NO: 888998 - protein, 464 aa, Homo sapiens; identical to SEQ ID NO: 888995

SEQ ID NO: 888999 - protein, 435 aa, Homo sapiens
QHREWKTAEVTEQPCSKRSWSPSSPPQVKTGPAGDTMGHLSAPLHRVRVPWQGLLLTASLLTFWNPPTTAQLTTESMPFNVAEGKEVLLLVHNLPQQLFGYSWYKGERVDGNRQIVGYAIGTQQATPGPANSGRETIYPNASLLIQNVTQNDTGFYTLQVIKSDLVNEEATGQFHVYPELPKPSISSNNSNPVEDKDAVAFTCEPETQDTTYLWWINNQSLPVSPRLQLSNGNRTLTLLSVTRNDTGPYECEIQNPVSANRSDPVTLNVTYGPDTPTISPSDTYYRPGANLSLSCYAASNPPAQYSWLINGTFQQSTQELFIPNITVNNSGSYTCHANNSVTGCNRTTVKTIIVTEMAFHHVAKAGLKLLSSSNPPASTSQSAKITDNALPQENGLSPGAIAGIVIGVVALVALIAVALACFLHFGKTGSSGPLQ

SEQ ID NO: 889000 - protein, 161 aa, Homo sapiens; identical to SEQ ID NO: 888990

SEQ ID NO: 889001 - protein, 128 aa, Homo sapiens
QEREIKSIQIGREESKLSLFVEDMILCLENPIVSAQKLLKLINNFSKVLGYKINVQKSPATHTTNFSLPIPNSHRNNLFRSKKAVMKPVLLTAVLMYFKSLTLITRRFLSPVGVEGWGQKQLSPTLPS

SEQ ID NO: 889002 - protein, 481 aa, Homo sapiens
MGHLSAPLHRVRVPWQGLLLTASLLTFWNPPTTAQLTTESMPFNVAEGKEVLLLVHNLPQQLFGYSWYKGERVDGNRQIVGYAIGTQQATPGPANSGRETIYPNASLLIQNVTQNDTGFYTLQVIKSDLVNEEATGQFHVYPELPKPSISSNNSNPVEDKDAVAFTCEPETQDTTYLWWINNQSLPVSPRLQLSNGNRTLTLLSVTRNDTGPYECEIQNPVSANRSDPVTLNVTYGPDTPTISPSDTYYRPGANLSLSCYAASNPPAQYSWLINGTFQQSTQELFIPNITVNNSGSYTCHANNSVTGCNRTTVKTIIVTELSPVVAKPQIKASKTTVTGDKDSVNLTCSTNDTGISIRWFFKNQSLPSSERMKLSQGNTTLSINPVKREDAGTYWCEVFNPISKNQSDPIMLNVNYNALPQENGLSPGAIAGIVIGVVALVALIAVALACFLHFGKTGRASDQRDLTEHKPSVSNHTTGVP

SEQ ID NO: 889003 - protein, 269 aa, Homo sapiens
MPIVMARDLEETASSSEDEEVISQEDHPCIMWTGGCRRIPVLVFHADAILTKDNNIRVIGERYHLSYKIVRTDSRLVRSILTAHGFHEVHPSSTDYNLMWTGSHLKPFLLRTLSEAQKVNHFPRSYELTRKDRLYKNIIRMQHTHGFKAFHILPQTFLLPAEYAEFCNSYSKDRGPWIVKPVASSRGRGVYLINNPNQISLEENILVSRYINNPLLIDDFKFDVRLYVLVTSYDPLVIYLYEEGLARKCNWKMGNTMDKRRLPIYVQVL

SEQ ID NO: 889004 - protein, 105 aa, Homo sapiens
MTGYLPLGFEFAVELTYPESEGISSGLLNISAQVFGIIFTISQGQIIDNYGTKPGNIFLCVFLTLGAALTAFIKADLRRQKANKETLENVSIWELCGAEIGVQGF

SEQ ID NO: 889005 - protein, 269 aa, Homo sapiens; identical to SEQ ID NO: 889003

SEQ ID NO: 889006 - protein, 268 aa, Homo sapiens
MPIVMARDLEETASSSEDEEVISQEDHPCIMWTGGCRRIPVLVFHADAILTKDNNIRVIGERYHLSYKIVRTDSRLVRSILTAHGFHEVHPSSTDYNLMWTGSHLKPFLLRTLSEAQKVNHFPRSYELTRKDRLYKNIIRMQHTHGFKAFHILPQTFLLPAEYAEFCNSYSKDRGPWIVKPVASSRGRGVYLINNPNQISLEENILVSRYINNPLLIDDFKFDVRLYVLVTSYDPLVIYLYEEGLARFATVRYDQGAKNIRNQFMHLT

SEQ ID NO: 889007 - protein, 526 aa, Homo sapiens
MVNEGPNQEESDDTPVPESALQADPSVSVHPSVSVHPSVSINPSVSVHPSSSAHPSALAQPSGLAHPSSSGPEDLSVIKVSRRRWAVVLVFSCYSMCNSFQWIQYGSINNIFMHFYGVSAFAIDWLSMCYMLTYIPLLLPVAWLLEKFGLRTIALTGSALNCLGAWVKLGSLKPHLFPVTVVGQLICSVAQVFILGMPSRIASVWFGANEVSTACSVAVFGNQLGIAIGFLVPPVLVPNIEDRDELAYHISIMFYIIGGVATLLLILVIIVFKEKPKYPPSRAQSLSYALTSPDASYLGSIARLFKNLNFVLLVITYGLNAGAFYALSTLLNRMVIWHYPGEEVNAGRIGLTIVIAGMLGAVISGIWLDRSKTYKETTLVVYIMTLVGMVVYTFTLNLGHLWVVFITAGTMGFFMTGYLPLGFEFAVELTYPESEGISSGLLNISAQVFGIIFTISQGQIIDNYGTKPGNIFLCVFLTLGAALTAFIKADLRRQKANKETLENKLQEEEEESNTSKVPTAVSEDHL

SEQ ID NO: 889008 - protein, 124 aa, Homo sapiens
MPIVMARDLEETASSSEDEEVISQEDHPCIMWTGGCRRIPVLVFHADAILTKDNNIRVIGERYHLSYKIVRTDSRLVRSILTAHGFHEVHPSSTDYNLMWTGSHLKPFLLRTLSEAQKVNHFPR

SEQ ID NO: 889009 - protein, 246 aa, Homo sapiens
MVNEGPNQEESDDTPVPESALQADPSVSVHPSVSVHPSVSINPSVSVHPSSSAHPSALAQPSGLAHPSSSGPEDLSVIKVSRRRWAVVLVFSCYSMCNSFQWIQYGSINNIFMHFYGVSAFAIDWLSMCYMLTYIPLLLPVAWLLEKFGLRTIALTGSALNCLGAWVKLGSLKPHLFPVTVVGQLICSVAQVFILGMPSRIASVWFGANEVSTACSVAVFGNQESVPSKLLDPVNLLGKVSEAPVC

SEQ ID NO: 889010 - protein, 108 aa, Homo sapiens
VRNVLDDDNDNVGQPNEYDLNDSFLDDEEEDYEPTDEDSDWEPGKEDEEKEDGEELLKEEKETHIDNLRLVKKHHNITETDMRYDAVVKNLHIPSIQIGRRQRTQDRN

SEQ ID NO: 889011 - protein, 499 aa, Homo sapiens
DLPSGASPAYISVKSTPSDMAPEETIASPEDGQSKEDATGIWRRRRRVRTRPEAREPPDQHRLVGVQDSPPQGSLCCHFSAMATSEQSICQARASVMVYDDTSKKWVPIKPGQQGFSRINIYHNTASNTFRVVGVKLQDQQVVINYSIVKGLKYNQATPTFHQWRDARQVYGLNFASKEEATTFSNAMLFALNIMNSQEGGPSSQRQVQNGPSPDEMDIQRRQVMEQHQQQRQESLERRTSATGPILPPGHPSSAASAPVSCSGPPPPPPPPVPPPPTGATPPPPPPLPAGGAQGSSHDESSMSGLAAAIAGAKLRRVQRPEDASGGSSPSGTSKSDANRASSGGGGGGLMEEMNKLLAKRRKAASQSDKPAEKKEDESQMEDPSTSPSPGTRAASQPPNSSEAGRKPWERSNSVEKPVSSILSRTPSVAKSPEAKSPLQSQPHSRMKPAGSVNDMALDAFDLDRMKQEILEEVVRELHKVKEEIIDAIRQELSGISTT

SEQ ID NO: 889012 - protein, 467 aa, Homo sapiens
DLPSGASPAYISVKSTPSDMAPEETIASPEDGQSKEDATGIWRRRRRVRTRPEAREPPDQHRLVGVQDSPPQGSLCCHFSAMATSEQSICQARASVMVYDDTSKKWVPIKPGQQGFSRINIYHNTASNTFRVVGVKLQDQQVVINYSIVKGLKYNQATPTFHQWRDARQVYGLNFASKEEATTFSNAMLFALNIMNSQEGGPSSQRQVQNGPSPDEMDIQRRQVMEQHQQQRQESLERRTSATGPILPPGHPSSAASAPVSCSGPPPPPPPPVPPPPTGATPPPPPPLPAGGAQGSSHDESSMSGLAAAIAGAKLRRVQRPEDASGGSSPSGTSKSDANRASSGGGGGGLMEEMNKLLAKRRKAASQSDKPAEKKEDESQMEDPSTSPSPGTRAASQPPNSSEAGRKPWERSNSVEKPVSSILSRTPSVAKSPEAKSPLQSQPHSRYRTTLLLTCPPGFGAPLSPVP

SEQ ID NO: 889013 - protein, 414 aa, Homo sapiens
AKMAGAGAQLSVRRRRRVAPGPARPSPAATMSEQSICQARASVMVYDDTSKKWVPIKPGQQGFSRINIYHNTASNTFRVVGVKLQDQQVVINYSIVKGLKYNQATPTFHQWRDARQVYGLNFASKEEATTFSNAMLFALNIMNSQEGGPSSQRQVQNGPSPDEMDIQRRQVMEQHQQQRQESLERRTSATGPILPPGHPSSAASAPVSCSGPPPPPPPPVPPPPTGATPPPPPPLPAGGAQGSSHDESSMSGLAAAIAGAKLRRVQRPEDASGGSSPSGTSKSDANRASSGGGGGGLMEEMNKLLAKRRKAASQSDKPAEKKEDESQMEDPSTSPSPGTRAASQPPNSSEAGRKPWERSNSVEKPVSSILSRTPSVAKSPEAKSPLQSQPHSRYRTTLLLTCPPGFGAPLSPVP

SEQ ID NO: 889014 - protein, 384 aa, Homo sapiens [sequence omitted]

SEQ ID NO: 889015 - protein, 493 aa, Homo sapiens
DLPSGASPAYISVKSTPSDMAPEETIASPEDGQSKEDATGIWRRRRRVRTRPEAREPPDQHRLVGVQDSPPQGSLCCHFSAMATSEQSICQARASVMVYDDTSKKWVPIKPGQQGFSRINIYHNTASNTFRVVGVKLQDQQVVINYSIVKGLKYNQATPTFHQWRDARQVYGLNFASKEEATTFSNAMLFALNIMNSQEGGACILLNDKATLYFLPQMNGGSLTSCGPSSQRQVQNGPSPDEMDIQRRQVMEQHQQQRQESLERRTSATGPILPPGHPSSAASAPVSCSGPPPPPPPPVPPPPTGATPPPPPPLPAGGAQGSSHDESSMSGLAAAIAGAKLRRVQRPEDASGGSSPSGTSKSDANRASSGGGGGGLMEEMNKLLAKRRKAASQSDKPAEKKEDESQMEDPSTSPSPGTRAASQPPNSSEAGRKPWERSNSVEKPVSSILSRTPSVAKSPEAKSPLQSQPHSRYRTTLLLTCPPGFGAPLSPVP

SEQ ID NO: 889016 - protein, 443 aa, Homo sapiens
DLPSGASPAYISVKSTPSDMAPEETIASPEDGQSKEDATGIWRRRRRVRTRPEAREPPDQHRLVGVQDSPPQGSLCCHFSAMATSEQSICQARASVMVYDDTSKKWVPIKPGQQGFSRINIYHNTASNTFRVVGVKLQDQQVVINYSIVKGLKYNQATPTFHQWRDARQVYGLNFASKEEATTFSNAMLFALNIMNSQEGGPSSQRQVQNGPSPDEMDIQRRQVMEQHQQQRQESLERRTSATGPILPPGHPSSAASAPVSCSGPPPPPPPPVPPPPTGATPPPPPPLPAGGAQGSSHDESSMSGLAAAIAGAKLRRVQRPEDASGGSSPSGTSKSDANRASSGGGGGGLMEEMNKLLAKREKQPPSQTSQPALTPQRLAGSPGSGATRWRSLCPRFCPEPRLWQRAPKLRAPFSRSLTLGTEQPSCSHVPQGLGLLCPPSRD

SEQ ID NO: 889017 - protein, 235 aa, Homo sapiens
AAHILKLGTIQRRLAWPLRKDDTQIREAFHILPPPPPPPPVPPPPTGATPPPPPPLPAGGAQGSSHDESSMSGLAAAIAGAKLRRVQRPEDASGGSSPSGTSKSDANRASSGGGGGGLMEEMNKLLAKRRKAASQSDKPAEKKEDESQMEDPSTSPSPGTRAASQPPNSSEAGRKPWERSNSVEKPVSSILSRTPSVAKSPEAKSPLQSQPHSRYRTTLLLTCPPGFGAPLSPVP

SEQ ID NO: 889018 - protein, 467 aa, Homo sapiens; identical to SEQ ID NO: 889012

SEQ ID NO: 889019 - protein, 467 aa, Homo sapiens; identical to SEQ ID NO: 889012

SEQ ID NO: 889020 - protein, 103 aa, Homo sapiens
VAEVTLEDPFLLCGVGWGKPLSGAGIFVDPDEEESALRRSWGQPPKLKEGMKPAGSVNDMALDAFDLDRMKQEILEEVVRELHKVKEEIIDAIRQELSGISTT

SEQ ID NO: 889021 - protein, 467 aa, Homo sapiens; identical to SEQ ID NO: 889012

SEQ ID NO: 889022 - protein, 467 aa, Homo sapiens; identical to SEQ ID NO: 889012

SEQ ID NO: 889023 - protein, 499 aa, Homo sapiens; identical to SEQ ID NO: 889011

SEQ ID NO: 889024 - protein, 467 aa, Homo sapiens; identical to SEQ ID NO: 889012

SEQ ID NO: 889025 - protein, 395 aa, Homo sapiens
DLPSGASPAYISVKSTPSDMAPEETIASPEDGQSKEDATGIWRRRRRVRTRPEAREPPDQHRLVGVQDSPPQGSLCCHFSAMATSEQSICQARASVMVYDDTSKKWVPIKPGQQGFSRINIYHNTASNTFRVVGVKLQDQQVVINYSIVKGLKYNQATPTFHQWRDARQVYGLNFASKEEATTFSNAMLFALNIMNSQEGGPSSQRQVQNGPSPDEMDIQRRQVMEQHQQQRQESLERRTSATGPILPPGHPSSAASAPVSCSGPPPPPPPPVPPPPTGATPPPPPPLPAGGAQGSSHDESSMSGLAAAIAGAKLRRVQRPEDASGGSSPSGTSKSDANRASSGGGGGGLMEEMNKLLAKREKQPPSQTSQPALTPQRLAGSPGRKQLRPQRSWC

SEQ ID NO: 889026 - protein, 786 aa, Homo sapiens
RSSFRSLASIYINQVTPSDMAPEETIASPEDGQSKEDATGIWRRRRRVRTRPEAREPPDQHRLVGVQDSPPQGSLCCHFSAMATSEQSICQARASVMVYDDTSKKWVPIKPGQQGFSRINIYHNTASNTFRVVGVKLQDQQVVINYSIVKGLKYNQATPTFHQWRDARQVYGLNFASKEEATTFSNAMLFALNIMNSQEGGPSSQRQVQNGPSPDEMDIQRRQVMEQHQQQRQESLERRTSATGPILPPGHPSSAASAPVSCSGHTKDRKTEKKEKREETKKGKGKKKGRKRKREKKKRQKNREEKGEREERSETRQRKTKKQQKTQRSKEKTKAREKTDQKEEEHKTERQQNTHQTPTNEKTKTTNEKEDSERGSKGEESKKKTKKERRREREKEENEDPNESEETKRQRRKGKRGTGKQNRKKRRKRQQKRKQKTKQKERQGAREEREERKKNGETAERRTRHKNRKEKKKRGEGEGQRREDESGKHRGRGPENEARRQEEQGEKRKTRARHEEEREAGQHEGGGERQKKTRRRARTTDAPSERRRGDDSSKDSAQKAATRETAEQHEREEKKQQEDGTRRGESRERPQRQEEDEKLREERNREGHKTSEKRERQMSATNERTRARGASRKEREEKRSGRAKQTDRESRTREDDERRRERSEEHGNDQQRKERQGEEHRDKRRKTDRSRTREADEARTGERRTRSRASTEQTQEPRERSRHSGKNTREKRKKKTKDERETKRENHGRGRTTQQRRDTTAMKQQRRQRAKVHASAQDRARRGRTT

SEQ ID NO: 889027 - protein, 299 aa, Homo sapiens
DLPSGASPAYISVKSTPSDMAPEETIASPEDGQSKEDATGIWRRRRRVRTRPEAREPPDQHRLVGVQDSPPQGSLCCHFSAMATSEQSICQARASVMVYDDTSKKWVPIKPGQQGFSRINIYHNTASNTFRVVGVKLQDQQVVINYSIVKGLKYNQATPTFHQWRDARQVYGLNFASKEEATTFSNAMLFALNIMNSQEGGPSSQRQVQNGPSPDEMDIQRRQVMEQHQQQRQESLERRTSATGPILPPGHPSSAASAPVSCSGYGIPKHTRFAAQPEFHAGPVADMPVSCHIRPLGRF

SEQ ID NO: 889028 - protein, 733 aa, Homo sapiens
AKMAGAGAQLSVRRRRRVAPGPARPSPAATMSEQSICQARASVMVYDDTSKKWVPIKPGQQGFSRINIYHNTASNTFRVVGVKLQDQQVVINYSIVKGLKYNQATPTFHQWRDARQVYGLNFASKEEATTFSNAMLFALNIMNSQEGGPSSQRQVQNGPSPDEMDIQRRQVMEQHQQQRQESLERRTSATGPILPPGHPSSAASAPVSCSGHTKDRKTEKKEKREETKKGKGKKKGRKRKREKKKRQKNREEKGEREERSETRQRKTKKQQKTQRSKEKTKAREKTDQKEEEHKTERQQNTHQTPTNEKTKTTNEKEDSERGSKGEESKKKTKKERRREREKEENEDPNESEETKRQRRKGKRGTGKQNRKKRRKRQQKRKQKTKQKERQGAREEREERKKNGETAERRTRHKNRKEKKKRGEGEGQRREDESGKHRGRGPENEARRQEEQGEKRKTRARHEEEREAGQHEGGGERQKKTRRRARTTDAPSERRRGDDSSKDSAQKAATRETAEQHEREEKKQQEDGTRRGESRERPQRQEEDEKLREERNREGHKTSEKRERQMSATNERTRARGASRKEREEKRSGRAKQTDRESRTREDDERRRERSEEHGNDQQRKERQGEEHRDKRRKTDRSRTREADEARTGERRTRSRASTEQTQEPRERSRHSGKNTREKRKKKTKDERETKRENHGRGRTTQQRRDTTAMKQQRRQRAKVHASAQDRARRGRTT

SEQ ID NO: 889029 - protein, 467 aa, Homo sapiens; identical to SEQ ID NO: 889012

SEQ ID NO: 889030 - protein, 390 aa, Homo sapiens
HRRRSSLHEQSICQARASVMVYDDTSKKWVPIKPGQQGFSRINIYHNTASNTFRVVGVKLQDQQVVINYSIVKGLKYNQATPTFHQWRDARQVYGLNFASKEEATTFSNAMLFALNIMNSQEGGPSSQRQVQNGPSPDEMDIQRRQVMEQHQQQRQESLERRTSATGPILPPGHPSSAASAPVSCSGPPPPPPPPVPPPPTGATPPPPPPLPAGGAQGSSHDESSMSGLAAAIAGAKLRRVQRPEDASGGSSPSGTSKSDANRASSGGGGGGLMEEMNKLLAKRRKAASQSDKPAEKKEDESQMEDPSTSPSPGTRAASQPPNSSEAGRKPWERSNSVEKPVSSILSRTPSVAKSPEAKSPLQSQPHSRYRTTLLLTCPPGFGAPLSPVP

SEQ ID NO: 889031 - protein, 251 aa, Homo sapiens
MDIQRRQVMEQHQQQRQESLERRTSATGPILPPGHPSSAASAPVSCSGPPPPPPPPVPPPPTGATPPPPPPLPAGGAQGSSHDESSMSGLAAAIAGAKLRRVQRPEDASGGSSPSGTSKSDANRASSGGGGGGLMEEMNKLLAKRRKAASQSDKPAEKKEDESQMEDPSTSPSPGTRAASQPPNSSEAGRKPWERSNSVEKPVSSILSRTPSVAKSPEAKSPLQSQPHSRYRTTLLLTCPPGFGAPLSPVP

SEQ ID NO: 889032 - protein, 538 aa, Homo sapiens
DLPSGASPAYISVKSTPSDMAPEETIASPEDGQSKEDATGIWRRRRRVRTRPEAREPPDQHRLVGVQDSPPQGSLCCHFSAMATSEQSICQARASVMVYDDTSKKWVPIKPGQQGFSRINIYHNTASNTFRVVGVKLQDQQVVINYSIVKGLKYNQATPTFHQWRDARQVYGLNFASKEEATTFSNAMLFALNIMNSQEGGPSSQRQVQNGPSPDEMDIQRRQVMEQHQQQRQESLERRTSATGPILPPGHPSSAASAPVSCSGPPPPPPPPVPPPPTGATPPPPPPLPAGGAQGSSHDESSMSGLAAAIAGAKLRRVQRPEDASGGSSPSGTSKSDANRASSGGGGGGLMEEMNKLLAKRRKAASQSDKPAEKKEDESQMEHALSLSLTEKKEGLFERRKEPQMWSPVTWAGPLPWQSWPGPMELLLRGPVPPPENLHPGMAASQTVRLPEEDPSTSPSPGTRAASQPPNSSEAGRKPWERSNSVEKPVSSILSRTPSVAKSPEAKSPLQSQPHSRYRTTLLLTCPPGFGAPLSPVP

SEQ ID NO: 889033 - protein, 570 aa, Homo sapiens
DLPSGASPAYISVKSTPSDMAPEETIASPEDGQSKEDATGIWRRRRRVRTRPEAREPPDQHRLVGVQDSPPQGSLCCHFSAMATSEQSICQARASVMVYDDTSKKWVPIKPGQQGFSRINIYHNTASNTFRVVGVKLQDQQVVINYSIVKGLKYNQATPTFHQWRDARQVYGLNFASKEEATTFSNAMLFALNIMNSQEGGPSSQRQVQNGPSPDEMDIQRRQVMEQHQQQRQESLERRTSATGPILPPGHPSSAASAPVSCSGPPPPPPPPVPPPPTGATPPPPPPLPAGGAQGSSHDESSMSGLAAAIAGAKLRRVQRPEDASGGSSPSGTSKSDANRASSGGGGGGLMEEMNKLLAKRRKAASQSDKPAEKKEDESQMEHALSLSLTEKKEGLFERRKEPQMWSPVTWAGPLPWQSWPGPMELLLRGPVPPPENLHPGMAASQTVRLPEEDPSTSPSPGTRAASQPPNSSEAGRKPWERSNSVEKPVSSILSRTPSVAKSPEAKSPLQSQPHSRMKPAGSVNDMALDAFDLDRMKQEILEEVVRELHKVKEEIIDAIRQELSGISTT

SEQ ID NO: 889034 - protein, 467 aa, Homo sapiens; identical to SEQ ID NO: 889012

SEQ ID NO: 889035 - protein, 467 aa, Homo sapiens; identical to SEQ ID NO: 889012

SEQ ID NO: 889036 - protein, 467 aa, Homo sapiens; identical to SEQ ID NO: 889012

SEQ ID NO: 889037 - protein, 467 aa, Homo sapiens; identical to SEQ ID NO: 889012

SEQ ID NO: 889038 - protein, 276 aa, Homo sapiens
DLPSGASPAYISVKSTPSDMAPEETIASPEDGQSKEDATGIWRRRRRVRTRPEAREPPDQHRLVGVQDSPPQGSLCCHFSAMATSEQSICQARASVMVYDDTSKKWVPIKPGQQGFSRINIYHNTASNTFRVVGVKLQDQQVVINYSIVKGLKYNQATPTFHQWRDARQVYGLNFASKEEATTFSNAMLFALNIMNSQEGGPSSQRQVQNGPSPDEMDIQRRQVMEQHQQQRQESLERRTSATGPILPPGHPSSAASAPVSCSGTEQQKTKDKPPT

SEQ ID NO: 889039 - protein, 266 aa, Homo sapiens
DLPSGASPAYISVKSTPSDMAPEETIASPEDGQSKEDATGIWRRRRRVRTRPEAREPPDQHRLVGVQDSPPQGSLCCHFSAMATSEQSICQARASVMVYDDTSKKWVPIKPGQQGFSRINIYHNTASNTFRVVGVKLQDQQVVINYSIVKGLKYNQATPTFHQWRDARQVYGLNFASKEEATTFSNAMLFALNIMNSQEGGPSSQRQVQNGPSPDEMDIQRRQVMEQHQQQRQESLERRTSATGPILPPGHPSSAASAPVSCSGRT

SEQ ID NO: 889040 - protein, 294 aa, Homo sapiens
ARGSGRPHLPVVLHGNNLLVFGGTGIPFGESNGNDVHVCNVKYKRWALLSCRGKKPSRIYGQAMAIINGSLYVFGGTTGYIYSTDLHKLDLNTREWTQLKPNNLSCDLPEERYRHEIAHDGQRIYILGGGTSWTAYSLNKIHAYNLETNAWEEIATKPHEKIGFPAARRCHSCVQIKNDVFICGGYNGEVILGDIWKLNLQTFQWVKLPATMPEPVYFHCAAVTPAGCMYIHGGVVNIHENKRTGSLFKIWLVVPSLLELAWEKLLAAFPNLANLSRTQLLHLGLTQGLIERLK

SEQ ID NO: 889041 - protein, 442 aa, Homo sapiens
MSAAQGWDRNRRRGGGAAGAGGGGSGAGGGSGGSGGRGTGQLNRFVQLSGRPHLPGKKKIRWDPVRRRFIQSCPIIRIPNRFLRGHRPPPARSGHRCVADNTNLYVFGGYNPDYDESGGPDNEDYPLFRELWRYHFATGVWHQMGTDGYMPRELASMSLVLHGNNLLVFGGTGIPFGESNGNDVHVCNVKYKRWALLSCRGKKPSRIYGQAMAIINGSLYVFGGTTGYIYSTDLHKLDLNTREWTQLKPNNLSCDLPEERYRHEIAHDGQRIYILGGGTSWTAYSLNKIHAYNLETNAWEEIATKPHEKIGFPAARRCHSCVQIKNDVFICGGYNGEVILGDIWKLNLQTFQWVKLPATMPEPVYFHCAAVTPAGCMYIHGGVVNIHENKRTGSLFKIWLVVPSLLELAWEKLLAAFPNLANLSRTQLLHLGLTQGLIERLK

SEQ ID NO: 889042 - protein, 496 aa, Homo sapiens
LKPTNLSCDLPEERYRHEIALDGQRIYLLGGGTSWTAYSLNKIHAYSLETNAWEEIATKPHEKIGFPAARRCHSCVQIKNDVGGSGGSGGRGTGQLNRFVQLSGRPHLPGKKKIRWDPVRRRFIQSCPIIRIPNRFLRGHRPPPARSGHRCVADNTNLYVFGGYNPDYDESGGPDNEDYPLFRELWRYHFATGVWHQMGTDGYMPRELASMSLVLHGNNLLVFGGTGIPFGESNGNDVHVCNVKYKRWALLSCRGKKPSRIYGQAMAIINGSLYVFGGTTGYIYSTDLHKLDLNTREWTQLKPNNLSCDLPEERYRHEIAHDGQRIYILGGGTSWTAYSLNKIHAYNLETNAWEEIATKPHEKIGFPAARRCHSCVQIKNDVFICGGYNGEVILGDIWKLNLQTFQWVKLPATMPEPVYFHCAAVTPAGCMYIHGGVVNIHENKRTGSLFKIWLVVPSLLELAWEKLLAAFPNLANLSRTQLLHLGLTQGLIERLK

SEQ ID NO: 889043 - protein, 423 aa, Homo sapiens
VIGLWWDRALPPSPVSWVSGGAQEGGSAGSAGSGADGTGLRQSLAGHVGRPGRGQWGQRGSGDWPGHRPPPARSGHRCVADNTNLYVFGGYNPDYDESGGPDNEDYPLFRELWRYHFATGVWHQMGTDGYMPRELASMSLVLHGNNLLVFGGTGIPFGESNGNDVHVCNVKYKRWALLSCRGKKPSRIYGQAMAIINGSLYVFGGTTGYIYSTDLHKLDLNTREWTQLKPNNLSCDLPEERYRHEIAHDGQRIYILGGGTSWTAYSLNKIHAYNLETNAWEEIATKPHEKIGFPAARRCHSCVQIKNDVFICGGYNGEVILGDIWKLNLQTFQWVKLPATMPEPVYFHCAAVTPAGCMYIHGGVVNIHENKRTGSLFKIWLVVPSLLELAWEKLLAAFPNLANLSRTQLLHLGLTQGLIERLK

SEQ ID NO: 889044 - protein, 298 aa, Homo sapiens
MSAAQGWDRNRRRGGGAAGAGGGGSGAGGGSGGSGGRGTGQLNRFVQLSGRPHLPGHRPPPARSGHRCVADNTNLYVFGGYNPDYDESGGPDNEDYPLFRELWRYHFATGVWHQMGTDGYMPRELASMSLVLHGNNLLVFGGTGIPFGESNGNDVHVCNVKYKRWALLSCRGKKPSRIYGQAMAIINGSLYVFGGTTGYIYSTDLHKLDLNTREWTQLKPNNLSCDLPEERYRHEIAHDGQRIYILGGGTSWTAYSLNKIHAYNLETNAWEEIATKPHEKIGFPAGRRCPVLPLKLMY

SEQ ID NO: 889045 - protein, 108 aa, Homo sapiens
SSSLLGHRPPPARSGHRCVADNTNLYVFGGYNPDYDESGGPDNEDYPLFRELWRYHFATGVWHQMGTDGYMPRELASMSRECKQFVTPDFMKCLRSQVQCPIFLINNL

SEQ ID NO: 889046 - protein, 423 aa, Homo sapiens; identical to SEQ ID NO: 889043

SEQ ID NO: 889047 - protein, 413 aa, Homo sapiens
MSAAQGWDRNRRRGGGAAGAGGGGSGAGGGSGGSGGRGTGQLNRFVQLSGRPHLPGHRPPPARSGHRCVADNTNLYVFGGYNPDYDESGGPDNEDYPLFRELWRYHFATGVWHQMGTDGYMPRELASMSLVLHGNNLLVFGGTGIPFGESNGNDVHVCNVKYKRWALLSCRGKKPSRIYGQAMAIINGSLYVFGGTTGYIYSTDLHKLDLNTREWTQLKPNNLSCDLPEERYRHEIAHDGQRIYILGGGTSWTAYSLNKIHAYNLETNAWEEIATKPHEKIGFPAARRCHSCVQIKNDVFICGGYNGEVILGDIWKLNLQTFQWVKLPATMPEPVYFHCAAVTPAGCMYIHGGVVNIHENKRTGSLFKIWLVVPSLLELAWEKLLAAFPNLANLSRTQLLHLGLTQGLIERLK

SEQ ID NO: 889048 - protein, 294 aa, Homo sapiens; identical to SEQ ID NO: 889040

SEQ ID NO: 889049 - protein, 442 aa, Homo sapiens; identical to SEQ ID NO: 889041

SEQ ID NO: 889050 - protein, 147 aa, Homo sapiens
MSAAQGWDRNRRRGGGAAGAGGGGSGAGGGSGGSGGRGTGQLNRFVQLSGRPHLPGHRPPPARSGHRCVADNTNLYVFGGYNPDYDESGGPDNEDYPLFRELWRYHFATGVWHQMGTDGYMPRELASMSLFTASSLGVDSISRNHFH

SEQ ID NO: 889051 - protein, 241 aa, Homo sapiens
MLRDTMKSWNDSQSDLCSTDQEEEEEMIFGENEDDLDEMMDLSDLPTSLFACSVHEAVFEAREQKERFEALFTIYDDQVTFQLFKSFRRVRINFSKPEAAARARIELHETDFNGQKLKLYFAQVQMSGEVRDKSYLLPPQPVKQFLISPPASPPVGWKQSEDAMPVINYDLLCAVSKLGPGEKYELHAGTESTPSVVVHVCESETEEEEETKNPKQKIAQTRRPDPPTAALNEPQTFDCAL

SEQ ID NO: 889052 - protein, 241 aa, Homo sapiens; identical to SEQ ID NO: 889051

SEQ ID NO: 889053 - protein, 231 aa, Homo sapiens
MLRDTMKSWNDSQSDLCSTDQEEEEEMIFGENEDDLDEMMDLSDLPTSLFACSVHEAVFEAREQKERFEALFTIYDDQVTFQLFKSFRRVRINFSKPEAAARARIELHETDFNGQKLKLYFAQSYLLPPQPVKQFLISPPASPPVGWKQSEDAMPVINYDLLCAVSKLGPGEKYELHAGTESTPSVVVHVCESETEEEEETKNPKQKIAQTRRPDPPTAALNEPQTFDCAL

SEQ ID NO: 889054 - protein, 178 aa, Homo sapiens
RNCPCTTGGGAAKGGGRWRRGRGGIFKRNNSRLMDEILKQQQELLGLDCSKYSPEFANSNDKDDQVLNCHLAVKVLSPEDGKADIVRAAQDFCQLVAQKQKRPTDLDVDTLASLLSSNGCPDPDLVLKFGPVDSTLGFLPWHIRLTEIVSLPSHLNISYEDFFSALRQYAACEQRLGK

SEQ ID NO: 889055 - protein, 293 aa, Homo sapiens
MTGLYELVWRVLHALLCLHRTLTSWLRVRFGTWNWIWRRCCRAASAAVLAPLGFTLRKPPAVGRNRRHHRHPRGGSCLAAAHHRMRWRADGRSLEKLPVHMGLVITEVEQEPSFSDIASLVVWCMAVGISYISVYDHQGIFKRNNSRLMDEILKQQQELLGLDCSKYSPEFANSNDKDDQVLNCHLAVKVLSPEDGKADIVRAAQDFCQLVAQKQKRPTDLDVDTLASLLSSNGCPDPDLVLKFGPVDSTLGFLPWHIRLTEIVSLPSHLNISYEDFFSALRQYAACEQRLGK

SEQ ID NO: 889056 - protein, 293 aa, Homo sapiens; identical to SEQ ID NO: 889055

SEQ ID NO: 889057 - protein, 169 aa, Homo sapiens
RNCPCTTGGGAAKGGGRWRRGRGGWRADGRSLEKLPVHMGLVITEVEQEPSFSDIASLVVWCMAVGISYISVYDHQGIFKRNNSRLMDEILKQQQELLGLDCSKYSPEFANSNDKDDQVLNCHLAVKVLSPEDGKADIVRAAQDFCQLVAQKQKRPTDLDVDTLASLLK

SEQ ID NO: 889058 - protein, 293 aa, Homo sapiens; identical to SEQ ID NO: 889055

SEQ ID NO: 889059 - protein, 275 aa, Homo sapiens
MTGLYELVWRVLHALLCLHRTLTSWLRVRFGTWNWIWRRCCRAASAAVLAPLGFTLRKPPAVGRNRRHHRHPRGGSCLAAAHHRMRWRADGRSLEKLPVHMGLVITEVEQEPSFSDIASLVVWCMAVGISYISVYDHQGIFKRNNSRLMDEILKQQQELLGLDCSKYSPEFANSNDKDDQVLNCHLAVKVLSPEDGQKRPTDLDVDTLASLLSSNGCPDPDLVLKFGPVDSTLGFLPWHIRLTEIVSLPSHLNISYEDFFSALRQYAACEQRLGK

SEQ ID NO: 889060 - protein, 293 aa, Homo sapiens; identical to SEQ ID NO: 889055

SEQ ID NO: 889061 - protein, 124 aa, Homo sapiens
STSASGAAAVQIRSKMAVVGVSSVSRLLGRSRPQLGRPMSSGAHGEEGSARMWKTLTFFVALPGVAVSMLNVYLKSHHGEHERPEFIAYPHLRIRTKPFPWGDGNHTLFHNPHVNPLPTGYEDE

SEQ ID NO: 889062 - protein, 84 aa, Homo sapiens
GGPVLRRRGDVGCGGPAASGGAVSGWADERGGEGDGRIYVGNLPTDVREKDLEDLFYKYGRIREIELKNRHGLVPFAFVRFEDP

SEQ ID NO: 889063 - protein, 124 aa, Homo sapiens
SAFPGLQEFGTRRSKMAVVGVSSVSRLLGRSRPQLGRPMSSGAHGEEGSARMWKTLTFFVALPGVAVSMLNVYLKSHHGEHERPEFIAYPHLRIRTKPFPWGDGNHTLFHNPHVNPLPTGYEDE

SEQ ID NO: 889064 - protein, 124 aa, Homo sapiens; identical to SEQ ID NO: 889063

SEQ ID NO: 889065 - protein, 124 aa, Homo sapiens; identical to SEQ ID NO: 889063

SEQ ID NO: 889066 - protein, 124 aa, Homo sapiens; identical to SEQ ID NO: 889063

SEQ ID NO: 889067 - protein, 146 aa, Homo sapiens
GALRGPRKEEMWSRLVWLGLRAPLGGRQGFTSKADPQGSGRITAAVIEHLERLALVDFGSREAVARLEKAIAFADRLRAVDTDGVEPMESVLEDRCLYLRSDNVVEGNCADELLQNSHRVVEEYFVAPPGNISLPKLDEQEPFPHS

SEQ ID NO: 889068 - protein, 146 aa, Homo sapiens; identical to SEQ ID NO: 889067

SEQ ID NO: 889069 - protein, 206 aa, Homo sapiens
SAFPGLQEFGTRRSKMAVVGVSSVSRLLGRSRPQLGRPMSSGAHGEEGSARMWKTLTFFVALPGVAVSMLNVYLKSHHGEHERPEFIAYPHLRIRTKGSGRITAAVIEHLERLALVDFGSREAVARLEKAIAFADRLRAVDTDGVEPMESVLEDRCLYLRSDNVVEGNCADELLQNSHRVVEEYFVAPPGNISLPKLDEQEPFPHS

SEQ ID NO: 889070 - protein, 131 aa, Homo sapiens
GALRGPRKEEMWSRLVWLGLRAPLGGRQGFTSKADPQGSGRITAAVIEHLERLALVDFGSREAVARLEKAIAFADRLRAVDTDGVEPMESVLEDRLECSGVISAHYKLCFLHSSDSCASASQVAGITDVYT

SEQ ID NO: 889071 - protein, 124 aa, Homo sapiens; identical to SEQ ID NO: 889063

SEQ ID NO: 889072 - protein, 81 aa, Homo sapiens
VCGFSAARMWKTLTFFVALPGVAVSMLNVYLKSHHGEHERPEFIAYPHLRIRTKPFPWGDGNHTLFHNPHVNPLPTGYEDE

SEQ ID NO: 889073 - protein, 146 aa, Homo sapiens; identical to SEQ ID NO: 889067

SEQ ID NO: 889074 - protein, 146 aa, Homo sapiens; identical to SEQ ID NO: 889067

SEQ ID NO: 889075 - protein, 121 aa, Homo sapiens
SAFPGLQEFGTRRSKMAVVGVSSVSRLLGRSRPQLGRPMSSGAHGEEGSARMWKTLTFFVALPGVAVSMLNVYLKSHHGEHERPEFIAYPHLRIRTKPFPWGDGNHTLFHNPHVNPLPTGY

SEQ ID NO: 889076 - protein, 124 aa, Homo sapiens; identical to SEQ ID NO: 889063

SEQ ID NO: 889077 - protein, 124 aa, Homo sapiens; identical to SEQ ID NO: 889063

SEQ ID NO: 889078 - protein, 124 aa, Homo sapiens; identical to SEQ ID NO: 889063

SEQ ID NO: 889079 - protein, 124 aa, Homo sapiens; identical to SEQ ID NO: 889063

SEQ ID NO: 889080 - protein, 124 aa, Homo sapiens; identical to SEQ ID NO: 889063

SEQ ID NO: 889081 - protein, 146 aa, Homo sapiens; identical to SEQ ID NO: 889067

SEQ ID NO: 889082 - protein, 124 aa, Homo sapiens
RQGKSTGLCIGPLSKPTCVRLWTCKNTFLWTEFTDRTLARCPHCRKVSSIGRRYPRKRCICCFLLGLLLAVTATGLAFGTWKHARRYGGIYAAWAFVILLAVLCLGRALYWACMKVSHPVQNFS

SEQ ID NO: 889083 - protein, 277 aa, Homo sapiens
MAADGERSPLLSEPIDGGAGGNGLVGPGGSGAGPGGGLTPSAPPYGAAFPPFPEGHPAVLPGEDPPPYSPLTSPDSGSAPMITCRVCQSLINVEGKMHQHVVKCGVCNEATPIKNAPPGKKYVRCPCNCLLICKVTSQRIACPRPYCKRIINLGPVHPGPLSPEPQPMGVRVICGHCKNTFLWTEFTDRTLARCPHCRKVSSIGRRYPRKRCICCFLLGLLLAVTATGLAFGTWKHARRYGGIYAAWAFVILLAVLCLGRALYWACMKVSHPVQNFS

SEQ ID NO: 889084 - protein, 149 aa, Homo sapiens
MAADGERSPLLSEPIDGGAGGNGLVGPGGSGAGPGGGLTPSAPPYGAGKHAPPQGKPGRVRGAPRGTLKAGEGAGPRAEAGPSRQVRDCCTCDWARLPSLRNRDHSLGTEGGSEQPDRSANYEKPSELGQRVEDQKDFPTTVEHQWGCK

SEQ ID NO: 889085 - protein, 284 aa, Homo sapiens
MAADGERSPLLSEPIDGGAGGNGLVGPGGSGAGPGGGLTPSAPPYGAGKHAPPQAFPPFPEGHPAVLPGEDPPPYSPLTSPDSGSAPMITCRVCQSLINVEGKMHQHVVKCGVCNEATPIKNAPPGKKYVRCPCNCLLICKVTSQRIACPRPYCKRIINLGPVHPGPLSPEPQPMGVRVICGHCKNTFLWTEFTDRTLARCPHCRKVSSIGRRYPRKRCICCFLLGLLLAVTATGLAFGTWKHARRYGGIYAAWAFVILLAVLCLGRALYWACMKVSHPVQNFS

SEQ ID NO: 889086 - protein, 197 aa, Homo sapiens
MITCRVCQSLINVEGKMHQHVVKCGVCNEATPIKNAPPGKKYVRCPCNCLLICKVTSQRIACPRPYCKRIINLGPVHPGPLSPEPQPMGVRVICGHCKNTFLWTEFTDRTLARCPHCRKVSSIGRRYPRKRCICCFLLGLLLAVTATGLAFGTWKHARRYGGIYAAWAFVILLAVLCLGRALYWACMKVSHPVQNFS

SEQ ID NO: 889087 - protein, 149 aa, Homo sapiens; identical to SEQ ID NO: 889084

SEQ ID NO: 889088 - protein, 390 aa, Homo sapiens
MAADGERSPLLSEPIDGGAGGNGLVGPGGSGAGPGGGLTPSAPPYGAGKHAPPQGKPGRVRGAPRGTLKAGEGAGPRAEAGPSRQVRDCCTCDWARLPSLRNRDHSLGTEGGSEQPDRSANYEKPSELGQRVEDQKDFPTTVEHQWGCEVIPALLFASSPAFPPFPEGHPAVLPGEDPPPYSPLTSPDSGSAPMITCRVCQSLINVEGKMHQHVVKCGVCNEATPIKNAPPGKKYVRCPCNCLLICKVTSQRIACPRPYCKRIINLGPVHPGPLSPEPQPMGVRVICGHCKNTFLWTEFTDRTLARCPHCRKVSSIGRRYPRKRCICCFLLGLLLAVTATGLAFGTWKHARRYGGIYAAWAFVILLAVLCLGRALYWACMKVSHPVQNFS

SEQ ID NO: 889089 - protein, 149 aa, Homo sapiens; identical to SEQ ID NO: 889084

SEQ ID NO: 889090 - protein, 74 aa, Homo sapiens
PLTSDTPISLRTGLDYTVKLRMSHVLQFEDKSRKVKDASMQDSDTFEIYDPRNPVNKRRREESKKLMREKKERR

SEQ ID NO: 889091 - protein, 252 aa, Homo sapiens
MSNIYIQEPPTNGKVLLKTTAGDIDIELWSKEAPKACRNFIQLCLEAYYDNTIFHRVVPGFIVQGGDPTGTGSGGESIYGAPFKDEFHSRLRFNRRGLVAMANAGSHDNGSQFFFTLGRADELNNKHTIFGKVTGDTVYNMLRLSEVDIDDDERPHNPHKIKSCEVLFNPFDDIIPREIKRLKKEKPEEEVKKLKPKGTKNFSLLSFGEEAEEEEEEVNRVSQSMKGKSKSSHDLLKDDPHLSSVPVVERPC

SEQ ID NO: 889092 - protein, 200 aa, Homo sapiens
GASHEWEGFIENYSWMYDVAHLGQYKGLCSLRGMSNIYIQEPPTNGKVLLKTTAGDIDIELWSKEAPKACRNFIQLCLEAYYDNTIFHRVVPGFIVQGGDPTGTGSGGESIYGAPFKDEFHSRLRFNRRGLVAMANAGSHDNGSQFFFTLGRADELNNKHTIFGKVTGDTVYNMLRLSEVDIDDDERPHNPHKIKSCEVR

SEQ ID NO: 889093 - protein, 472 aa, Homo sapiens
MSNIYIQEPPTNGKVLLKTTAGDIDIELWSKEAPKACRNFIQLCLEAYYDNTIFHRVVPGFIVQGGDPTGTGSGGESIYGAPFKDEFHSRLRFNRRGLVAMANAGSHDNGSQFFFTLGRADELNNKHTIFGKVTGDTVYNMLRLSEVDIDDDERPHNPHKIKSCEVLFNPFDDIIPREIKRLKKEKPEEEVKKLKPKGTKNFSLLSFGEEAEEEEEEVNRVSQSMKGKSKSSHDLLKDDPHLSSVPVVESEKGDAPDLVDDGEDESAEHDEYIDGDEKNLMRERIAKKLKKDTSANVKSAGEGEVEKKSVSRSEELRKEARQLKRELLAAKQKKVENAAKQAEKRSEEEEAPPDGAVAEYRREKQKYEALRKQQSKKGTSREDQTLALLNQFKSKLTQAIAETPENDIPETEVEDDEGWMSHVLQFEDKSRKVKDASMQDSDTFEIYDPRNPVNKRRREESKKLMREKKERR

SEQ ID NO: 889094 - protein, 372 aa, Homo sapiens
MANAGSHDNGSQFFFTLGRADELNNKHTIFGKVTGDTVYNMLRLSEVDIDDDERPHNPHKIKSCEVLFNPFDDIIPREIKRLKKEKPEEEVKKLKPKGTKNFSLLSFGEEAEEEEEEVNRVSQSMKGKSKSSHDLLKDDPHLSSVPVVESEKGDAPDLVDDGEDESAEHDEYIDGDEKNLMRERIAKKLKKDTSANVKSAGEGEVEKKSVSRSEELRKEARQLKRELLAAKQKKVENAAKQAEKRSEEEEAPPDGAVAEYRREKQKYEALRKQQSKKGTSREDQTLALLNQFKSKLTQAIAETPENDIPETEVEDDEGWMSHVLQFEDKSRKVKDASMQDSDTFEIYDPRNPVNKRRREESKKLMREKKERR

SEQ ID NO: 889095 - protein, 70 aa, Homo sapiens
GGGRRRTVSLGFEYDQLMSHVLQFEDKSRKVKDASMQDSDTFEIYDPRNPVNKRRREESKKLMREKKERR

SEQ ID NO: 889096 - protein, 472 aa, Homo sapiens; identical to SEQ ID NO: 889093

SEQ ID NO: 889097 - protein, 334 aa, Homo sapiens
MPNRTPENNKHTARSLTTNRPTRTTPDTNITNTHRTSQNKRKHSSATNQHTQHNRRQHTHRTIENGRAHQPRNDTTRGEEHATPAGNNNHTPSNTHRDAQAHSTAPNSNEQHQRTAPSRRRPNDTGTRHAPSSTPEGTKERKSRRRRNRERKDEEKNTQERGTRKDEEDSDKGDKTTKRKEEGKRQGEEQRRTRGQNSRDQRGTPDAPPDSRRREGGTAEEQDERPATARPEGDEGAENEEARDPASQRTAGRSAGSAAQHTHERRRARRSQAHRARAKGRGATTGSAGNTQTQQQRKGGTGERSSDRRRGRSTKNKNKRRKTEGEKSKNPRTE

SEQ ID NO: 889098 - protein, 472 aa, Homo sapiens; identical to SEQ ID NO: 889093

SEQ ID NO: 889099 - protein, 389 aa, Homo sapiens
MSNIYIQEPPTNGKVLLKTTAGDIDIELWSKEAPKACRNFIQLCLEAYYDNTIFHRVVPGFIVQGGDPTGTGSGGESIYGAPFKDEFHSRLRFNRRGLVAMANAGSHDNGSQFFFTLGRADELNNKHTIFGKVTGDTVYNMLRLSEVDIDDDERPHNPHKIKSCEVLFNPFDDIIPREIKRLKKEKPEEEVKKLKPKGTKNFSLLSFGEEAEEEEEEVNRVSQSMKGKSKSSHDLLKDDPHLSSVPVVERNTHFPFLQDGEDESAEHDEYIDGDEKNLMRERIAKKLKKDTSANVKSAGEGEVEKKSVSRSEELRKEARQLKRELLAAKQKKVENAAKQAEKRSEEEEAPPDGAVAEYRREKQKYEALRKQQSKKGTSREDQDVTCTSV

SEQ ID NO: 889100 - protein, 174 aa, Homo sapiens
MCKLSRNERLKKLKSEELRKEARQLKRELLAAKQKKVENAAKQAEKRSEEEEAPPDGAVAEYRREKQKYEALRKQQSKKGTSREDQTLALLNQFKSKLTQAIAETPENDIPETEVEDDEGWMSHVLQFEDKSRKVKDASMQDSDTFEIYDPRNPVNKRRREESKKLMREKKERR

SEQ ID NO: 889101 - protein, 131 aa, Homo sapiens [sequence omitted]

SEQ ID NO: 889102 - protein, 393 aa, Homo sapiens
MDENESNQSLMTSSQYPKEAVRKRQNSARNSGASDSSRFSRKSFKLDYRLEEDVTKSKKGKDGRFVNPWPTWKNPSIPNVLRWLIMEKDHSSVPSSKEELDKELPVLKPYFITNPEEAGVREAGLRVTWLGHATVMVEMDELIFLTDPIFSSRASPSQYMGPKRFRRSPCTISELPPIDAVLISHNHYDHLDYNSVIALNERFGNELRWFVPLGLLDWMQKCGCENVIELDWWEENCVPGHDKVTFVFTPSQHWCKRTLMDDNKVLWGSWSVLGPWNRFFFAGDTGYCPAFEEIGKRFGPFDLAAIPIGAYEPRWFMKYQHVDPEEAVRIHTDVQTKKSMAIHWGTFALANEHYLEPPVKLNEALERYGLNAEDFFVLKHGESRYLNNNDENF

SEQ ID NO: 889103 - protein, 411 aa, Homo sapiens
MFNSVFFPLVFFSSSPKDMDENESNQSLMTSSQYPKEAVRKRQNSARNSGASDSSRFSRKSFKLDYRLEEDVTKSKKGKDGRFVNPWPTWKNPSIPNVLRWLIMEKDHSSVPSSKEELDKELPVLKPYFITNPEEAGVREAGLRVTWLGHATVMVEMDELIFLTDPIFSSRASPSQYMGPKRFRRSPCTISELPPIDAVLISHNHYDHLDYNSVIALNERFGNELRWFVPLGLLDWMQKCGCENVIELDWWEENCVPGHDKVTFVFTPSQHWCKRTLMDDNKVLWGSWSVLGPWNRFFFAGDTGYCPAFEEIGKRFGPFDLAAIPIGAYEPRWFMKYQHVDPEEAVRIHTDVQTKKSMAIHWGTFALANEHYLEPPVKLNEALERYGLNAEDFFVLKHGESRYLNNNDENF

SEQ ID NO: 889104 - protein, 393 aa, Homo sapiens; identical to SEQ ID NO: 889102

SEQ ID NO: 889105 - protein, 393 aa, Homo sapiens; identical to SEQ ID NO: 889102

SEQ ID NO: 889106 - protein, 113 aa, Homo sapiens [sequence omitted]

SEQ ID NO: 889107 - protein, 169 aa, Homo sapiens
DNWDVLFQVPPHIQRQVAKRVWKSSPEALDFIRRRNLRKIQSARIKMEEDALLSDPVETSAEARAAVLAQSKPSDEGSSEEPAVPSGTARSHDDEEGAGNPPIPEQDRPLLRVPREKEAKTGVTTSFLRCFSFYKVPDRGKGWGYIWDVTGNIKERVEGKDLKVRRSST

SEQ ID NO: 889108 - protein, 356 aa, Homo sapiens
SVLGGAPGHNPDRRTKMVSIHSLSELERLKLQETAYHELVARHFLSEFKPDRALPIDRPNTLDKWFLILRGQQRAVSHKTFGISLEEVLVNEFTRRKHLELTATMQVEEATGQAAGRRRGNVVRRVFGRIRRFFSRRRNEPTLPREFTRRGRRGAVSVDSLAELEDGALLLQTLQLSKISFPIGQRLLGSKRKMSLNPIAKQIPQVVEACCQFIEKHGLSAVGIFTLEYSVQRVRQLREEFDQGLDVVLDDNQNVHDVAALLKEFFRDMKDSLLPDDLYMSFLLTATLKPQDQLSALQLLVYLMPPCHSDTLERLLKALHKITENCEDSIGIDGQLVPGNRMTSTNLALVFGSTFL

SEQ ID NO: 889109 - protein, 361 aa, Homo sapiens
SVLGGAPGHNPDRRTKMVSIHSLSELERLKLQETAYHELVARHFLSEFKPDRALPIDRPNTLDKWFLILRGQQRAVSHKTFGISLEEVLVNEFTRRKHLELTATMQVEEATGQAAGRRRGNVVRRVFGRIRRFFSRRRNEPTLPREFTRRGRRGAVSVDSLAELEDGALLLQTLQLSKISFPIGQRLLGSKRKMSLNPIAKQIPQVVEACCQFIEKHGLSAVGIFTLEYSVQRVRQLREEFDQGLDVVLDDNQNVHDVAALLKEFFRDMKDSLLPDDLYMSFLLTATLKPQDQLSALQLLVYLMPPCHSDTLERLLKALHKITENCEDSIGIDGQLVQATDDFTTWLGVGLSLKFARESAL

SEQ ID NO: 889110 - protein, 1015 aa, Homo sapiens
MGAERRLLSIKEAFRLAQQPHQNQAKLVVALSRTYRTMDDKTVFHEEFIHYLKYVMVVYKREPAVERVIEFAAKFVTSFHQSDMEDDEEEEDGGLLNYLFTFLLKSHEANSNAVRFRVCLLINKLLGSMPENAQIDDDVFDKINKAMLIRLKDKIPNVRIQAVLALSRLQDPKDDECPVVNAYATLIENDSNPEVRRAVLSCIAPSAKTLPKIVGRTKDVKEAVRKLAYQVLAEKVHMRAMSIAQRVMLLQQGLNDRSDAVKQAMQKHLLQGWLRFSEGNILELLHRLDVENSSEVAVSVLNALFSITPLSELVGLCKNNDGRKLIPVETLTPEIALYWCALCEYLKSKGDEGEEFLEQILPEPVVYADYLLSYIQSIPVVNEEHRGDFSYIGNLMTKEFIGQQLILIIKSLDTSEEGGRKKLLAVLQEILILPTIPISLVSFLVERLLHIIIDDNKRTQIVTEIISEIRAPIVTVGVNNDPADVRKKELKMAEIKVKLIEAKEALENCITLQDFNRASELKEEIKALEDARINLLKETEQLEIKEVHIEKNDAETLQKCLILCYELLKQMSISTGLSATMNGIIESLILPGIISIHPVVRNLAVLCLGCCGLQNQDFARKHFVLLLQVLQIDDVTIKISALKAIFDQLMTFGIEPFKTKKIKTLHCEGTEINSDDEQESKEVEETATAKNVLKLLSDFLDSEVSELRTGAAEGLAKLMFSGLLVSSRILSRLILLWYNPVTEEDVQLRHCLGVFFPVFAYASRTNQECFEEAFLPTLQTLANAPASSPLAEIDITNVAELLVDLTRPSGLNPQAKTSQDYQALTVHDNLAMKICNEILTSPCSPEIRVYTKALSSLELSSHLAKDLLVLLNEILEQVKDRTCLRALEKIKIQLEKGNKEFGDQAEAAQDATLTTTTFQNEDEKNKEVYMTPLRGVKATQASKSTQLKTNRGQRKVTVSARTNRRCQTAEADSESDHEVPEPESEMKMRLPRRAKTAALEKSKLNLAQFLNEDLS

SEQ ID NO: 889111 - protein, 158 aa, Homo sapiens
MQKHLLQGWLRFSEGNILELLHRLDVENSSEVAVSVLNALFSITPLSELVGLCKNNDGRKLIPVETLTPEIALYWCALCEYLKSKGDEGEEFLEQILPEPVVYADYLLSYIQSIPVVNEEHRGDFSYIGNLMTKEFIGQQLILIIKSLDTSEEGGRYV

SEQ ID NO: 889112 - protein, 1015 aa, Homo sapiens; identical to SEQ ID NO: 889110

SEQ ID NO: 889113 - protein, 975 aa, Homo sapiens
MGAERRLLSIKEAFRLAQQPHQNQAKLVVALSRTYRTMDDKTVFHEEFIHYLKYVMVVYKREPAVERVIEFAAKFVTSFHQSDMEDDEEEEDGGLLNYLFTFLLKSHEANSNAVRFRVCLLINKLLGSMPENAQIDDDVFDKINKAMLIRLKDKIPNVRIQAVLALSRLQDPKDDECPVVNAYATLIENDSNPEVRRAVLSCIAPSAKTLPKIVGRTKDVKEAVRKLAYQVLAEKVHMRAMSIAQRVMLLQQGLNDRSDAVKQAMQKHLLQGWLRFSEGNILELLHRLDVENSSEVAVSVLNALFSITPLSELVGLCKNNDGRKLIPVETLTPEIALYWCALCEYLKSKGDEGEEFLEQILPEPVVYADYLLSYIQSIPVVNEEHRGDFSYIGNLMTKEFIGQQLILIIKSLDTSEEGGRKKLLAVLQEILILPTIPISLVSFLVERLLHIIIDDNKRTQIVTEIISEIRAPIVTVGVNNDPADVRKKELKMAEIKVKLIEAKEALENCITLQDFNRASELKEEIKALEDARINLLKETEQLEIKEVHIEKNDAETLQKCLILCYELLKQMSISTGLSATMNGIIESLILPGIISIHPVVRNLAVLCLGCCGLQNQDFARKHFVLLLQVLQIDDVTIKISALKAIFDQLMTFGIEPFKTKKIKTLHCEGTEINSDDEQESKEVEETATAKNVLKLLSDFLDSEVSELRTGAAEGLAKLMFSGLLVSSRILSRLILLWYNPVTEEDVQLRHCLGVFFPVFAYASRTNQECFEEAFLPTLQTLANAPASSPLAEIDITNVAELLVDLTRPSGLNPQAKTSQDYQALTVHDNLAMKICNEILTSPCSPEIRVYTKALSSLELSSHLAKDLLVLLNEILEQVKDRTCLRALEKIKIQLEKGNKEFGDQAEAAQDATLTTTTFQNEDEKNKEVYMTPLRGVKATQASKSTQLKTNRGQRKVTVSARTNRRCQTAEADSER

SEQ ID NO: 889114 - protein, 935 aa, Homo sapiens
MGAERRLLSIKEAFRLAQQPHQNQAKLVVALSRTYRTMDDKTVFHEEFIHYLKYVMVVYKREPAVERVIEFAAKFVTSFHQSDMEDDEEEEDGGLLNYLFTFLLKSHEANSNAVRFRVCLLINKLLGSMPENAQIDDDVFDKINKAMLIRLKDKIPNVRIQAVLALSRLQDPKDDECPVVNAYATLIENDSNPEVRRAVLSCIAPSAKTLPKIVGRTKDVKEAVRKLAYQVLAEKVHMRAMSIAQRVMLLQQGLNDRSDAVKQAMQKHLLQGWLRFSEGNILELLHRLDVENSSEVAVSVLNALFSITPLSELVGLCKNNDGRKLIPVETLTPEIALYWCALCEYLKSKGDEGEEFLEQILPEPVVYADYLLSYIQSIPVVNEEHRGDFSYIGNLMTKEFIGQQLILIIKSLDTSEEGGRKKLLAVLQEILILPTIPISLVSFLVERLLHIIIDDNKRTQIVTEIISEIRAPIVTVGVNNDPADVRKKELKMAEIKVKLIEAKEALENCITLQDFNRASELKEEIKALEDARINLLKETEQLEIKEVHIEKNDAETLQKCLILCYELLKQMSISTGLSATMNGIIESLILPGIISIHPVVRNLAVLCLGCCGLQNQDFARKHFVLLLQVLQIDDVTIKISALKAIFDQLMTFGIEPFKTKKIKTLHCEGTEINSDDEQESKEVEETATAKNVLKLLSDFLDSEVSELRTGAAEGLAKLMFSGLLVSSRILSRLILLWYNPVTEEDVQLRHCLGVFFPVFAYASRTNQECFEEAFLPTLQTLANAPASSPLAEIDITNVAELLVDLTRPSGLNPQAKTSQDYQALTVHDNLAMKICNEILTSPCSPEIRVYTKALSSLELSSHLAKDLLVLLNEILEQVKDRTCLRALEKIKIQLEKGNKEFGDQAEAAQDATLTTTTFQNEDGNHILNRIFIRKE

SEQ ID NO: 889115 - protein, 388 aa, Homo sapiens
MGAERRLLSIKEAFRLAQQPHQNQAKLVVALSRTYRTMDDKTVFHEEFIHYLKYVMVVYKREPAVERVIEFAAKFVTSFHQSDMEDDEEEEDGGLLNYLFTFLLKSHEANSNAVRFRVCLLINKLLGSMPENAQIDDDVFDKINKAMLIRLKDKIPNVRIQAVLALSRLQDPKDDECPVVNAYATLIENDSNPEVRRAVLSCIAPSAKTLPKIVGRTKDVKEAVRKLAYQVLAEKVHMRAMSIAQRVMLLQQGLNDRSDAVKQAMQKHLLQGWLRFSEGNILELLHRLDVENSSEVAVSVLNALFSITPLSELVGLLQKLSQRFGRPLLLLVLITIQLYEGIQLQSTAEPEFSTDDGDVLFARCHSKHFTTELHNSTSIRWVFLSPLS

SEQ ID NO: 889116 - protein, 117 aa, Homo sapiens
KRSRPRPPPLARPGPPSLRGPPWPSGSAHRDSSLVHLRDSLHRDLRFGEVRDLPEVAWAQARKPPKPGRRSHGPRLGFSEPTPPASGRRGPLFLSPIVNVERNIYDHRGDQTSNIEP

SEQ ID NO: 889117 - protein, 276 aa, Homo sapiens
GLSCLKKMLICTGVGGLSRGGYARRTNQECFEEAFLPTLQTLANAPASSPLAEIDITNVAELLVDLTRPSGLNPQAKTSQDYQALTVHDNLAMKICNEILTSPCSPEIRVYTKALSSLELSSHLAKDLLVLLNEILEQVKDRTCLRALEKIKIQLEKGNKEFGDQAEAAQDATLTTTTFQNEDEKNKEVYMTPLRGVKATQASKSTQLKTNRGQRKVTVSARTNRRCQTAEADSESDHEVPEPESEMKMRLPRRAKTAALEKSKLNLAQFLNEDLS

SEQ ID NO: 889118 - protein, 751 aa, Homo sapiens [sequence omitted]

SEQ ID NO: 889119 - protein, 980 aa, Homo sapiens
MGAERRLLSIKEAFRLAQQPHQNQAKLVVALSRTYRTMDDKTVFHEEFIHYLKYVMVVYKREPAVERVIEFAAKFVTSFHQSDMEDDEEEEDGGLLNYLFTFLLKSHEANSNAVRFRVCLLINKLLGSMPENAQIDDDVFDKINKAMLIRLKDKIPNVRIQAVLALSRLQDPKDDECPVVNAYATLIENDSNPEVRRAVLSCIAPSAKTLPKIVGRTKDVKEAVRKLAYQVLAEKVHMRAMSIAQRVMLLQQGLNDRSDAVKQAMQKHLLQGWLRFSEGNILELLHRLDVENSSEVAVSVLNALFSITPLSELVGLCKNNDGRKLIPVETLTPEIALYWCALCEYLKSKGDEGEEFLEQILPEPVVYADYLLSYIQSIPVVNEEHRGDFSYIGNLMTKEFIGQQLILIIKSLDTSEEGGRKKLLAVLQEILILPTIPISLVSFLVERLLHIIIDDNKRTQIVTEIISEIRAPIVTVGVNNDPADVRKKELKMAEIKVKLIEAKEALENCITLQDFNRASELKEEIKALEDARINLLKETEQLEIKEVHIEKNDAETLQKCLILCYELLKQMSISTGLSATMNGIIESLILPGIISIHPVVRNLAVLCLGCCGLQNQDFARKHFVLLLQVLQIDDVTIKISALKAIFDQLMTFGIEPFKTKKIKTLHCEGTEINSDDEQESKEVEETATAKNVLKLLSDFLDSEVSELRTGAAEGLAKLMFSGLLVSSRILSRLILLWYNPVTEEDVQLRHCLGVFFPVFAYASRTNQECFEEAFLPTLQTLANAPASSPLAEIDITNVAELLVDLTRPSGLNPQAKTSQDYQALTVHDNLAMKICNEILTSPCSPEIRVYTKALSSLELSSHLAKDLLVLLNEILEQVKDRTCLRALEKIKIQLEKGNKEFGDQAEAAQDATLTTTTFQNEDEKNKEVYMTPLRGVKATQASKSTQLKTNRGQRKVTVSARTNRRCQTAEADSERYVMHV

SEQ ID NO: 889120 - protein, 1015 aa, Homo sapiens; identical to SEQ ID NO: 889110

SEQ ID NO: 889121 - protein, 400 aa, Homo sapiens
DAALTLLTYHALQVLQIDDVTIKISALKAIFDQLMTFGIEPFKTKKIKTLHCEGTEINSDDEQESKEVEETATAKNVLKLLSDFLDSEVSELRTGAAEGLAKLMFSGLLVSSRILSRLILLWYNPVTEEDVQLRHCLGVFFPVFAYASRTNQECFEEAFLPTLQTLANAPASSPLAEIDITNVAELLVDLTRPSGLNPQAKTSQDYQALTVHDNLAMKICNEILTSPCSPEIRVYTKALSSLELSSHLAKDLLVLLNEILEQVKDRTCLRALEKIKIQLEKGNKEFGDQAEAAQDATLTTTTFQNEDEKNKEVYMTPLRGVKATQASKSTQLKTNRGQRKVTVSARTNRRCQTAEADSESDHEVPEPESEMKMRLPRRAKTAALEKSKLNLAQFLNEDLS

SEQ ID NO: 889122 - protein, 691 aa, Homo sapiens
MGAERRLLSIKEAFRLAQQPHQNQAKLVVALSRTYRTMDDKTVFHEEFIHYLKYVMVVYKREPAVERVIEFAAKFVTSFHQSDMEDDEEEEDGGLLNYLFTFLLKSHEANSNAVRFRVCLLINKLLGSMPENAQIDDDVFDKINKAMLIRLKDKIPNVRIQAVLALSRLQDPKDDECPVVNAYATLIENDSNPEVRRAVLSCIAPSAKTLPKIVGRTKDVKEAVRKLAYQVLAEKVHMRAMSIAQRVMLLQQGLNDRSDAVKQAMQKHLLQGWLRFSEGNILELLHRLDVENSSEVAVSVLNALFSITPLSELVGLCKNNDGRKLIPVETLTPEIALYWCALCEYLKSKGDEGEEFLEQILPEPVVYADYLLSYIQSIPVVNEEHRGDFSYIGNLMTKEFIGQQLILIIKSLDTSEEGGRKKLLAVLQEILILPTIPISLVSFLVERLLHIIIDDNKRTQIVTEIISEIRAPIVTVGVNNDPADVRKKELKMAEIKVKLIEAKEALENCITLQDFNRASELKEEIKALEDARINLLKETEQLEIKEVHIEKNDAETLQKCLILCYELLKQMSISTGLSATMNGIIESLILPGIISIHPVVRNLAVLCLGCCGLQNQDFARKHFVLLLQVLQIDDVTIKISALKAIFDQLMTFGIEPFKTKKKKKKKKKKNLWGAGALKKFFQTPFGVGGGG

SEQ ID NO: 889123 - protein, 351 aa, Homo sapiens
MALPFQKELEKYKNIDEDELLGKLSEEELKQLENVLDDLDPESAMLPAGFRQKDQTQKAATGPFDREHLLMYLEKEALEQKDREDFVPFTGEKKGRVFIPKEKPIETRKEEKVTLDPELEEALASASDTELYDLAAVLGVHNLLNNPKFDEETANNKGGKGPVRNVVKGEKVKPVFEEPPNPTNVEISLQQMKANDPSLQEVNLNNIKNIPIPTLREFAKALETNTHVKKFSLAATRSNDPVAIAFADMLKVNKTLTSLNIESNFITGTGILALVEALKENDTLTEIKIDNQRQQLGTAVEMEIAQMLEENSRILKFGYQFTKQGPRTRVAAAITKNNDLVRKKRVEADRR

SEQ ID NO: 889124 - protein, 378 aa, Homo sapiens
MALPFQKELEKYKNIDEDELLGKLSEEELKQLENVLDDLDPEAGVPGKISAHCNLCLPDSSDSPTSASQSAMLPAGFRQKDQTQKAATGPFDREHLLMYLEKEALEQKDREDFVPFTGEKKGRVFIPKEKPIETRKEEKVTLDPELEEALASASDTELYDLAAVLGVHNLLNNPKFDEETANNKGGKGPVRNVVKGEKVKPVFEEPPNPTNVEISLQQMKANDPSLQEVNLNNIKNIPIPTLREFAKALETNTHVKKFSLAATRSNDPVAIAFADMLKVNKTLTSLNIESNFITGTGILALVEALKENDTLTEIKIDNQRQQLGTAVEMEIAQMLEENSRILKFGYQFTKQGPRTRVAAAITKNNDLVRKKRVEADRR

SEQ ID NO: 889125 - protein, 307 aa, Homo sapiens
MLPAGFRQKDQTQKAATGPFDREHLLMYLEKEALEQKDREDFVPFTGEKKGRVFIPKEKPIETRKEEKVTLDPELEEALASASDTELYDLAAVLGVHNLLNNPKFDEETANNKGGKGPVRNVVKGEKVKPVFEEPPNPTNVEISLQQMKANDPSLQEVNLNNIKNIPIPTLREFAKALETNTHVKKFSLAATRSNDPVAIAFADMLKVNKTLTSLNIESNFITGTGILALVEALKENDTLTEIKIDNQRQQLGTAVEMEIAQMLEENSRILKFGYQFTKQGPRTRVAAAITKNNDLVRKKRVEADRR

SEQ ID NO: 889126 - protein, 378 aa, Homo sapiens; identical to SEQ ID NO: 889124

SEQ ID NO: 889127 - protein, 280 aa, Homo sapiens
MALPFQKELEKYKNIDEDELLGKLSEEELKQLENVLDDLDPEAGVPGKISAHCNLCLPDSSDSPTSASQSAMLPAGFRQKDQTQKAATGPFDREHLLMYLEKEALEQKDREDFVPFTGEKKGRVFIPKEKPIETRKEEKVTLDPELEEALASASDTELYDLAAVLGVHNLLNNPKFDEETANNKGGKGPVRNVVKGEKVKPVFEEPPNPTNVEISLQQMKANDPSLQEVNLNNIKNIPIPTLREFAKALETNTHVKKFSLAATRSNDPVAIVSKILRNIT

SEQ ID NO: 889128 - protein, 255 aa, Homo sapiens
MALPFQKELEKYKNIDEDELLGKLSEEELKQLENVLDDLDPEAGVPGKISAHCNLCLPDSSDSPTSASQSAMLPAGFRQKDQTQKAATGPFDREHLLMYLEKEALEQKDREDFVPFTGEKKGRVFIPKEKPIETRKEEKVTLDPELEEALASASDTELYDLAAVLGVHNLLNNPKFDEETANNKGGKGPVRNVVKGEKVKPVFEEPPNPTNVEISLQQMKANDPSLQEVNLNNIKNITNSKLVKKKPRQRTSGIL

SEQ ID NO: 889129 - protein, 1723 aa, Homo sapiens
GGQVEDLSKQLKRVDGQVQGIATHVQHFSQASGLDLAALEWPEEQEVGVRAFDRVRTGSIMKDAAEELSFARVLLQRVDELEKLFKDREQFLELVSRKLSLVPGAEEVTMVTWEELEQAITDGWRASQAGSETLMGFSKHGGFTSLTSPEGTLSGDSTKQPSIEQALDSASGLGPDRTASGSGGTAHPSDGVSSREQSKVPSGTGRQQQPRARDEAGVPRLHQSSTFQFKSDSDRHRSREKLTSTQPRRNARPGPVQQDLPLARDQPSSVPASQSQVHLRPDRRGLEPTGMNQPGLVPASTYPHGVVPLSMGQLGVPPPEMDDRELIPFVVDEQRMLPPSVPGRDQQGLELPSTDQHGLVSVSAYQHGMTFPGTDQRSMEPLGMDQRGCVISGMGQQGLVPPGIDQQGLTLPVVDQHGLVLPFTDQHGLVSPGLMPISADQQGFVQPSLEATGFIQPGTEQHDLIQSGRFQRALVQRGAYQPGLVQPGADQRGLVRPGMDQSGLAQPGADQRGLVWPGMDQSGLAQPGRDQHGLIQPGTGQHDLVQSGTGQGVLVQPGVDQPGMVQPGRFQRALVQPGAYQPGLVQPGADQIDVVQPGADQHGLVQSGADQSDLAQPGAVQHGLVQPGVDQRGLAQPRADHQRGLVPPGADQRGLVQPGADQHGLVQPGVDQHGLAQPGEVQRSLVQPGIVQRGLVQPGAVQRGLVQPGAVQRGLVQPGVDQRGLVQPGAVQRGLVQPGAVQHGLVQPGADQRGLVQPGVDQRGLVQPGVDQRGLVQPGMDQRGLIQPGADQPGLVQPGAGQLGMVQPGIGQQGMVQPQADPHGLVQPGAYPLGLVQPGAYLHDLSQSGTYPRGLVQPGMDQYGLRQPGAYQPGLIAPGTKLRGSSTFQADSTGFISVRPYQHGMVPPGREQYGQVSPLLASQGLASPGIDRRSLVPPETYQQGLMHPGTDQHSPIPLSTGLGSTHPDQQHVASPGPGEHDQVYPDAAQHGHAFSLFDSHDSMYPGYRGPGYLSADQHGQEGLDPNRTRASDRHGIPAQKAPGQDVTLFRSPDSVDRVLSEGSEVSSEVLSERRNSLRRMSSSFPTAVETFHLMGELSSLYVGLKESMKDLDEEQAGQTDLEKIQFLLAQMVKRTIPPELQEQLKTVKTLAKEVWQEKAKVERLQRILEGEGNQEAGKELKAGELRLQLGVLRVTVADIEKELAELRESQDRGKAAMENSVSEASLYLQDQLDKLRMIIESMLTSSSTLLSMSMAPHKAHTLAPGQIDPEATCPACSLDVSHQVSTLVRRYEQLQDMVNSLAVSRPSKKAKLQRQDEELLGRVQSAILQVQGDCEKLNITTSNLIEDHRQKQKDIAMLYQGLEKLEKEKANREHLEMEIDVKADKSALATKVSRVQFDATTEQLNHMMQELVAKMSGQEQDWQKMLDRLLTEMDNKLDRLELDPVKQLLEDRWKSLRQQLRERPPLYQADEAAAMRRQLLAHFHCLSCDRPLETPVTGHAIPVTPAGPGLPGHHSIRPYTVFELEQVRQHSRNLKLGSAFPRGDLAQMEQSVGRLRSMHSKMLMNIEKVQIHFGGSTKASSQIIRELLHAQCLGSPCYKRVTDMADYTYSTVPRRCGGSHTLTYPYHRSRPQHLPRGLYPTEEIQIAMKHDEVDILGLDGHIYKGRMDTRLPGILRKDSSGTSKRKSQQPRPHVHRPPSLSSNGQLPSRPQSAQISAGNTSER

SEQ ID NO: 889130 - protein, 142 aa, Homo sapiens
SQSNSGPGLGNAKISFLDCVPSRRLKETTSDGPSELSLCSAQSYRPEASQDRGIARDSLDKIHWRGVEGERPPAVSASPCVPDGPGSAWVWPECGVWQSLIVHHRVTVADIEKELAELRESQDRGKAAMENSVSEASLYLQD

SEQ ID NO: 889131 - protein, 1723 aa, Homo sapiens; identical to SEQ ID NO: 889129

SEQ ID NO: 889132 - protein, 1184 aa, Homo sapiens
GGQVEDLSKQLKRVDGQVQGIATHVQHFSQASGLDLAALEWPEEQEVGVRAFDRVRTGSIMKDAAEELSFARVLLQRVDELEKLFKDREQFLELVSRKLSLVPGAEEVTMVTWEELEQAITDGWRASQAGSETLMGFSKHGGFTSLTSPEGTLSGDSTKQPSIEQALDSASGLGPDRTASGSGGTAHPSDGVSSREQSKVPSGTGRQQQPRARDEAGVPRLHQSSTFQFKSDSDRHRSREKLTSTQPRRNARPGPVQQDLPLARDQPSSVPASQSQVHLRPDRRGLEPTGMNQPGLVPASTYPHGVVPLSMGQLGVPPPEMDDRELIPFVVDEQRMLPPSVPGRDQQGLELPSTDQHGLVSVSAYQHGMTFPGTDQRSMEPLGMDQRGCVISGMGQQGLVPPGIDQQGLTLPVVDQHGLVLPFTDQHGLVSPGLMPISADQQGFVQPSLEATGFIQPGTEQHDLIQSGRFQRALVQRGAYQPGLVQPGADQRGLVRPGMDQSGLAQPGADQRGLVWPGMDQSGLAQPGRDQHGLIQPGTGQHDLVQSGTGQGVLVQPGVDQPGMVQPGRFQRALVQPGAYQPGLVQPGADQIDVVQPGADQHGLVQSGADQSDLAQPGAVQHGLVQPGVDQRGLAQPRADHQRGLVPPGADQRGLVQPGADQHGLVQPGVDQHGLAQPGEVQRSLVQPGIVQRGLVQPGAVQRGLVQPGAVQRGLVQPGVDQRGLVQPGAVQRGLVQPGAVQHGLVQPGADQRGLVQPGVDQRGLVQPGVDQRGLVQPGMDQRGLIQPGADQPGLVQPGAGQLGMVQPGIGQQGMVQPQADPHGLVQPGAYPLGLVQPGAYLHDLSQSGTYPRGLVQPGMDQYGLRQPGAYQPGLIAPGTKLRGSSTFQADSTGFISVRPYQHGMVPPGREQYGQVSPLLASQGLASPGIDRRSLVPPETYQQGLMHPGTDQHSPIPLSTGLGSTHPDQQHVASPGPGEHDQVYPDAAQHGHAFSLFDSHDSMYPGYRGPGYLSADQHGQEGLDPNRTRASDRHGIPAQKAPGQDVTLFRSPDSVDRVLSEGSEVSSEVLSERRNSLRRMSSSFPTAVETFHLMGELSSLYVGLKESMKDLDEEQAGQTDLEKIQFLLAQMGGCRLPIEEKPLSLFSVGFILFFPWPQLLAATHLPESLKTACHSEHVPQPSES

SEQ ID NO: 889133 - protein, 292 aa, Homo sapiens
MKSEAKDGEEESLQTAFKKLRVDASGSVASLSVGEGTGVRAPVRTATDDTKPKTTCASKDSWHGSTRKSSRGAVRTQRRRRSKSPVLHPPKFIHCSTIASSSSSQLKHKSQTDSPDGSSGLGISSPKEFSAGESSTSLDANHTGAVVEPLRTSVPRLPSESKKEDSSDATQVPQASLKASDLSDFQSVSKLNQGKPCTCIGKECQCKRWHDMEVYSFSGLQSVPPLAPERRSTLEDYSQSLHARTLSGSPRSCSEQARVFVDDVTIEDLSGYMEYYLYIPKKMSHMAEMMYT

SEQ ID NO: 889134 - protein, 292 aa, Homo sapiens; identical to SEQ ID NO: 889133

SEQ ID NO: 889135 - protein, 292 aa, Homo sapiens; identical to SEQ ID NO: 889133

SEQ ID NO: 889136 - protein, 292 aa, Homo sapiens; identical to SEQ ID NO: 889133

SEQ ID NO: 889137 - protein, 292 aa, Homo sapiens; identical to SEQ ID NO: 889133

SEQ ID NO: 889138 - protein, 292 aa, Homo sapiens; identical to SEQ ID NO: 889133

SEQ ID NO: 889139 - protein, 292 aa, Homo sapiens; identical to SEQ ID NO: 889133

SEQ ID NO: 889140 - protein, 254 aa, Homo sapiens
MKSEAKDGEEESLQTAFKKLRVDASGSTRKSSRGAVRTQRRRRSKSPVLHPPKFIHCSTIASSSSSQLKHKSQTDSPDGSSGLGISSPKEFSAGESSTSLDANHTGAVVEPLRTSVPRLPSESKKEDSSDATQVPQASLKASDLSDFQSVSKLNQGKPCTCIGKECQCKRWHDMEVYSFSGLQSVPPLAPERRSTLEDYSQSLHARTLSGSPRSCSEQARVFVDDVTIEDLSGYMEYYLYIPKKMSHMAEMMYT

SEQ ID NO: 889141 - protein, 68 aa, Homo sapiens
ALERRGRRPASAQSSAAALPSHWGGRSISRGRGACRSAQAQRDSRGAGRPLGWFGSGSVGCRDLGETL

SEQ ID NO: 889142 - protein, 229 aa, Homo sapiens
MKSEAKDGEEESLQTAFKKLRVDASGSVASLSVGEGTGVRAPVRTATDDTKPKTTCASKDSWHGSTRKSSRGAVRTQRRRRSKSPVLHPPKFIHCSTIASSSSSQLKHKSQTDSPDGSSGLGISSPKEFSAGESSTSLDANHTGAVVEPLRTSVPRLPSESKKEDSSDATQVPQASLKASDLSDFQSVSKLNQTLWPLCVRRHLFLLTVLAIKTFLGISVNLHSFNLLS

SEQ ID NO: 889143 - protein, 274 aa, Homo sapiens
MKSEAKDGEEESLQTAFKKLRVDASGSVASLSVGEGTGVRAPVRTATDDTKPKTTCASKDSWHGSTRKSSRGAVRTQRRRRSKSPVLHPPKFIHCSTIASSSSSQLKHKKFSAGESSTSLDANHTGAVVEPLRTSVPRLPSESKKEDSSDATQVPQASLKASDLSDFQSVSKLNQGKPCTCIGKECQCKRWHDMEVYSFSGLQSVPPLAPERRSTLEDYSQSLHARTLSGSPRSCSEQARVFVDDVTIEDLSGYMEYYLYIPKKMSHMAEMMYT

SEQ ID NO: 889144 - protein, 70 aa, Homo sapiens
ARRPHTIGWSSPLLLGWVAVETAAVLGGVGEGREAARASERARCFWERGTGDLRRQELGRGAAARLPAAL

SEQ ID NO: 889145 - protein, 70 aa, Homo sapiens; identical to SEQ ID NO: 889144

SEQ ID NO: 889146 - protein, 70 aa, Homo sapiens; identical to SEQ ID NO: 889144

SEQ ID NO: 889147 - protein, 70 aa, Homo sapiens; identical to SEQ ID NO: 889144

SEQ ID NO: 889148 - protein, 142 aa, Homo sapiens [sequence omitted]

SEQ ID NO: 889149 - protein, 101 aa, Homo sapiens
PCVRPTSPRPLLLLCAQTIQDEEGPLCCPHPGCLLRAHVICLAEEFLQEEPGQLLPLEGQCPCCEKSLLWGDLIWLCQMDTEKEVEDSELEEAHWTDLLET

SEQ ID NO: 889150 - protein, 73 aa, Homo sapiens
MEWPSARHPPFNLSGRGGVPAILCVRGHKPLPPMPRHDIIYSTPAVWLGADTAHPTDETPYIVRRDNHIIKRP

SEQ ID NO: 889151 - protein, 97 aa, Homo sapiens
MCAQTIQDEEGPLCCPHPGCLLRAHVICLAEEFLQEEPGQLLPLEGQCPCCEKSLLWGDLIWLCQMDTEKEVEDSELEEGHTLWSGHTLWRVGTHYG

SEQ ID NO: 889152 - protein, 295 aa, Homo sapiens
MELIQDTSRPPLEYVKGVPLIKYFAEALGPLQSFQARPDDLLINTYPKSGTTWVSQILDMIYQGGDLEKCNRAPIYVRVPFLEVNDPGEPSGLETLKDTPPPRLIKSHLPLALLPQTLLDQKVKVVYVARNPKDVAVSYYHFHRMEKAHPEPGTWDSFLEKFMAGEVSYGSWYQHVQEWWELSRTHPVLYLFYEDMKENPKREIQKILEFVGRSLPEETMDFMVQHTSFKEMKKNPMTNYTTVPQELMDHSISPFMRKGMAGDWKTTFTVAQNERFDADYAEKMAGCSLSFRSEL

SEQ ID NO: 889153 - protein, 295 aa, Homo sapiens; identical to SEQ ID NO: 889152

SEQ ID NO: 889154 - protein, 295 aa, Homo sapiens; identical to SEQ ID NO: 889152

SEQ ID NO: 889155 - protein, 354 aa, Homo sapiens [sequence omitted]

SEQ ID NO: 889156 - protein, 384 aa, Homo sapiens
MVRARRLDSSLASAVGLLHPPPDRRGARTGATASCRLPPDSPRELVPKQAPCSPSDPALPWTLGHGNQPPAVVPEPQGPMGPAGVAARPGRFFGVYLLYCLNPRYRGRVYVGFTVNTARRVQQHNGGRKKGGAWRTSGRGPWEMVLVVHGFPSSVAALRFEWAWQHPHASRRLAHVGPRLRGETAFAFHLRVLAHMLRAPPWARLPLTLRWVRPDLRQDLCLPPPPHVPLAFGPPPPQAPAPRRRAGPFDDAEPEPDQGDPGACCSLCAQTIQDEEGPLCCPHPGCLLRAHVICLAEEFLQEEPGQLLPLEGQCPCCEKSLLWGDLIWLCQMDTEKEVEDSELEEEHGADPGHLPPATGVREGGPAHQVLCRGTGAPAELPSPT

SEQ ID NO: 889157 - protein, 295 aa, Homo sapiens; identical to SEQ ID NO: 889152

SEQ ID NO: 889158 - protein, 384 aa, Homo sapiens; identical to SEQ ID NO: 889156

SEQ ID NO: 889159 - protein, 384 aa, Homo sapiens; identical to SEQ ID NO: 889156

SEQ ID NO: 889160 - protein, 295 aa, Homo sapiens; identical to SEQ ID NO: 889152

SEQ ID NO: 889161 - protein, 295 aa, Homo sapiens; identical to SEQ ID NO: 889152

SEQ ID NO: 889162 - protein, 295 aa, Homo sapiens; identical to SEQ ID NO: 889152

SEQ ID NO: 889163 - protein, 295 aa, Homo sapiens; identical to SEQ ID NO: 889152

SEQ ID NO: 889164 - protein, 354 aa, Homo sapiens [sequence omitted]

SEQ ID NO: 889165 - protein, 384 aa, Homo sapiens; identical to SEQ ID NO: 889156

SEQ ID NO: 889166 - protein, 295 aa, Homo sapiens; identical to SEQ ID NO: 889152

SEQ ID NO: 889167 - protein, 295 aa, Homo sapiens; identical to SEQ ID NO: 889152

SEQ ID NO: 889168 - protein, 163 aa, Homo sapiens [sequence omitted]

SEQ ID NO: 889169 - protein, 384 aa, Homo sapiens; identical to SEQ ID NO: 889156

SEQ ID NO: 889170 - protein, 295 aa, Homo sapiens; identical to SEQ ID NO: 889152

SEQ ID NO: 889171 - protein, 316 aa, Homo sapiens
TPILSPCRQGENRSGSRELRNMELIQDTSRPPLEYVKGVPLIKYFAEALGPLQSFQARPDDLLINTYPKSGTTWVSQILDMIYQGGDLEKCNRAPIYVRVPFLEVNDPGEPSGLETLKDTPPPRLIKSHLPLALLPQTLLDQKVKVVYVARNPKDVAVSYYHFHRMEKAHPEPGTWDSFLEKFMAGEVSYGSWYQHVQEWWELSRTHPVLYLFYEDMKENPKREIQKILEFVGRSLPEETMDFMVQHTSFKEMKKNPMTNYTTVPQELMDHSISPFMRKGMAGDWKTTFTVAQNERFDADYAEKMAGCSLSFRSEL

SEQ ID NO: 889172 - protein, 295 aa, Homo sapiens; identical to SEQ ID NO: 889152

SEQ ID NO: 889173 - protein, 293 aa, Homo sapiens
EDSELEEEHGADPGHLPLIKYFAEALGPLQSFQARPDDLLINTYPKSGTTWVSQILDMIYQGGDLEKCNRAPIYVRVPFLEVNDPGEPSGLETLKDTPPPRLIKSHLPLALLPQTLLDQKVKVVYVARNPKDVAVSYYHFHRMEKAHPEPGTWDSFLEKFMAGEVSYGSWYQHVQEWWELSRTHPVLYLFYEDMKENPKREIQKILEFVGRSLPEETMDFMVQHTSFKEMKKNPMTNYTTVPQELMDHSISPFMRKGMAGDWKTTFTVAQNERFDADYAEKMAGCSLSFRSEL

SEQ ID NO: 889174 - protein, 103 aa, Homo sapiens
MNYMDDNPKREIQKILEFVGRSLPEETMDFMVQHTSFKEMKKNPMTNYTTVPQELMDHSISPFMRKGMAGDWKTTFTVAQNERFDADYAEKMAGCSLSFRSEL

SEQ ID NO: 889175 - protein, 142 aa, Homo sapiens [sequence omitted]

SEQ ID NO: 889176 - protein, 107 aa, Homo sapiens
PGRPNTPLPGRSHGPLAGSQGGGNTRAPLHPGWSGRTGSSRPLDPPGLAQEFLQEEPGQLLPLEGQCPCCEKSLLWGDLIWLCQMDTEKEVEDSELEEAHWTDLLET

SEQ ID NO: 889177 - protein, 155 aa, Homo sapiens
RKKNYARVRVLRVNRPRVGLLHPPPDRRGARTGATASCRLPPDSPRELVPKQAPCSPSDPALPWTLGHGNQPPAVVPEPQGPMGPAGVAARPGRFFGVYLLYCLNPRYRGRVYVGFTVNTARRVHIGLLVGTLGSGGMQEREEVGQVGTWAGGRA

SEQ ID NO: 889178 - protein, 336 aa, Homo sapiens
MVRARRLDSSLASAVGLLHPPPDRRGARTGATASCRLPPDSPRELVPKQAPCSPSDPALPWTLGHGNQPPAVVPEPQGPMGPAGVAARPGRFFGVYLLYCLNPRYRGRVYVGFTVNTARRVQQHNGGRKKGGAWRTSGRGPWEMVLVVHGFPSSVAALRFEWAWQHPHASRRLAHVGPRLRGETAFAFHLRVLAHMLRAPPWARLPLTLRWVRPDLRQDLCLPPPPHVPLAFGPPPPQAPAPRRRAGPFDDAEPEPDQGDPGACCSLCAQTIQDEEGPLCCPHPGCLLRAHVICLAEEFLQEEPGQLLPLEGQCPCCEKSLLWGDLIWLCQMAWEE

SEQ ID NO: 889179 - protein, 381 aa, Homo sapiens
MVRARRLDSSLASAVGLLHPPPDRRGARTGATASCRLPPDSPRELVPKQAPCSPSDPALPWTLGHGNQPPAVVPEPQGPMGPAGVAARPGRFFGVYLLYCLNPRYRGRVYVGFTVNTARRVQQHNGGRKKGGAWRTSGRGPWEMVLVVHGFPSSVAALRFEWAWQHPHASRRLAHVGPRLRGETAFAFHLRVLAHMLRAPPWARLPLTLRWVRPDLRQDLCLPPPPHVPLAFGPPPPQAPAPRRRAGPFDDAEPEPDQGDPGACCSLCAQTIQDEEGPLCCPHPGCLLRAHVICLAEEFLQEEPGQLLPLEGQCPCCEKSLLWGDLIWLCQMDTEKEVEDSELEEGEWALVAGSLPHSLPWAACDHTAVPLQAHWTDLLET

SEQ ID NO: 889180 - protein, 295 aa, Homo sapiens; identical to SEQ ID NO: 889152

SEQ ID NO: 889181 - protein, 117 aa, Homo sapiens
MELIQDTSRPPLEYVKGVPLIKYFAEALGPLQSFQARPDDLLINTYPKSGTTWVSQILDMIYQGGDLEKCNRAPIYVRVPFLEVNDPGEPSGGLCCPKPKGRGGLLLPFPPYGKGAP

SEQ ID NO: 889182 - protein, 243 aa, Homo sapiens
RKKNYARVRVLRVNRPRVGLLHPPPDRRGARTGATASCRLPPDSPRELVPKQAPCSPSDPALPWTLGHGNQPPAVVPEPQGPMGPAGVAARPGRFFGVYLLYCLNPRYRGRVYVGFTVNTARRVQQHNGGRKKGGAWRTSGRGPWEMVLVVHGFPSSVAALRDEEGPLCCPHPGCLLRAHVICLAEEFLQEEPGQLLPLEGQCPCCEKSLLWGDLIWLCQMDTEKEVEDSELEEAHWTDLLET

SEQ ID NO: 889183 - protein, 105 aa, Homo sapiens
AAAPTSEWSGCTGSSRPLDPQTIQDEEGPLCCPHPGCLLRAHVICLAEEFLQEEPGQLLPLEGQCPCCEKSLLWGDLIWLCQMDTEKEVEDSELEEAHWTDLLET

SEQ ID NO: 889184 - protein, 76 aa, Homo sapiens
MELIQDTSRPPLEYVKGVPLIKYFAEALGPLQSFQARPDDLLINTYPKSGKSGGPPTLSQAAVPTLVSKVVPSACS

SEQ ID NO: 889185 - protein, 105 aa, Homo sapiens
MKCNTFIRQVKEEHGRHTDATVKVPFLKKCKEAGLLNYLLEEILDKVHSIPEKLMDETTSESDYEEIGSALFDCRLFEDTFVNFQAAIEKKIHASQQIVSSKGIP

SEQ ID NO: 889186 - protein, 193 aa, Homo sapiens
AGALPGSRYPAATRSCSTVMAQASPPRPERVLGASSPEARPAQEALLLPTGVFQVAEKMEKRTCALCPKDVEYNVLYFAQSENIAAHENCLLYSSGLVECEDQDPLNPDRSFDVESVKKEIQRGRKLKCKFCHKRGATVGCDLKNCNKNYHFFCAKKDDAVPQSDGVRGIYKLLCQQHAQFPIIAQSELNFQE

SEQ ID NO: 889187 - protein, 178 aa, Homo sapiens
AGALPGSRYPAATRSCSTVMAQASPPRPERVLGASSPEARPAQEALLLPTGVFQVAEKMEKRTCALCPKDVEYNVLYFAQSENIAAHENCLLYSSGLVECEDQDPLNPDRSFDVESVKKEIQRGRKLKCKFCHKRGATVGCDLKNCNKNYHFFCAKKDDAVPQSDGVRGIYKYLIKHF

SEQ ID NO: 889188 - protein, 137 aa, Homo sapiens [sequence omitted]

SEQ ID NO: 889189 - protein, 135 aa, Homo sapiens
MEKRTCALCPKDVEYNVLYFAQSENIAAHENCLLYSSGLVECEDQDPLNPDRSFDVESVKKEIQRGRKLKCKFCHKRGATVGCDLKNCNKNYHFFCAKKDDAVPQSDGVRGIYKLLCQQHAQFPIIAQSELNFQE

SEQ ID NO: 889190 - protein, 152 aa, Homo sapiens
LGHFRDLAIRPPPAAAAQSWPRRRRPGPRGCSAPAARRPGPRRRRSSFPPLYSSGLVECEDQDPLNPDRSFDVESVKKEIQRGRKLKCKFCHKRGATVGCDLKNCNKNYHFFCAKKDDAVPQSDGVRGIYKLLCQQHAQFPIIAQSELNFQE

SEQ ID NO: 889191 - protein, 106 aa, Homo sapiens
MDCKLYSSGLVECEDQDPLNPDRSFDVESVKKEIQRGRKLKCKFCHKRGATVGCDLKNCNKNYHFFCAKKDDAVPQSDGVRGIYKLLCQQHAQFPIIAQSELNFQE

SEQ ID NO: 889192 - protein, 167 aa, Homo sapiens
LGHFRDLAIRPPPAAAAQSWPRRRRPGPRGCSAPAARRPGPRRRRSSFPPLYSSGLVECEDQDPLNPDRSFDVESVKKEIQRGRKLKCKFCHKRGATVGCDLKNCNKNYHFFCAKKDDAVPQSDGVRGIYKLLCQQHAQFPIIAQSDLFSLNHSLVSFILPTLTEPN

SEQ ID NO: 889193 - protein, 137 aa, Homo sapiens [sequence omitted]

SEQ ID NO: 889194 - protein, 104 aa, Homo sapiens
MKCNTFIRQVKEEHGRHTDATVKVPFLKKCKEAGLLNYLLEEILDKVHSIPEKLMDETTSESDYEEIGSALFDCRLFEDTFVNFQAALRCPQDRLHLHLFMSLV

SEQ ID NO: 889195 - protein, 137 aa, Homo sapiens [sequence omitted]

SEQ ID NO: 889196 - protein, 135 aa, Homo sapiens; identical to SEQ ID NO: 889189

SEQ ID NO: 889197 - protein, 137 aa, Homo sapiens [sequence omitted]

SEQ ID NO: 889198 - protein, 135 aa, Homo sapiens; identical to SEQ ID NO: 889189

SEQ ID NO: 889199 - protein, 104 aa, Homo sapiens; identical to SEQ ID NO: 889194

SEQ ID NO: 889200 - protein, 629 aa, Homo sapiens
ERAALPPFPASAGAASSLRPARPPLLPPLLAGFGGDGGGGGGGGGGRGGRAPAERCRRRGKGSFKWKVVRRPARPPALLRSIMAEPSGSPVHVQLPQQAAPVTAAAAAAPAAATAAPAPAAPAAPAPAPAPAPAAQAVGWPICRDAYELQEVIGSGATAVVQAALCKPRQERVAIKRINLEKCQTSMDELLKEIQAMSQCSHPNVVTYYTSFVVKDELWLVMKLLSGGSMLDIIKYIVNRGEHKNGVLEEAIIATILKEVLEGLDYLHRNGQIHRDLKAGNILLGEDGSVQIADFGVSAFLATGGDVTRNKVRKTFVGTPCWMAPEVMEQVRGYDFKADMWSFGITAIELATGAAPYHKYPPMKVLMLTLQNDPPTLETGVEDKEMMKKYGKSFRKLLSLCLQKDPSKRPTAAELLKCKFFQKAKNREYLIEKLLTRTPDIAQRAKKVRRVPGSSGHLHKTEDGDWEWSDDEMDEKSEEGKAAFSQEKSRRVKEENPEIAVSASTIPEQIQSLSVHDSQGPPNANEDYREASSCAVNLVLRLRNSRKELNDIRFEFTPGRDTADGVSQELFSAGLVDGHDVVIVAANLQKIVDDPKALKTLTFKLASGCDGSEIPDEVKLIGFAQLSVS

SEQ ID NO: 889201 - protein, 629 aa, Homo sapiens; identical to SEQ ID NO: 889200

SEQ ID NO: 889202 - protein, 608 aa, Homo sapiens
ERAALPPFPASAGAASSLRPARPPLLPPLLAGFGGDGGGGGGGGGGRGGRAPAERCRRRGKGSFKWKVVRRPARPPALLRSIMAEPSGSPVHVQLPQQAAPVTAAAAAAPAAATAAPAPAAPAAPAPAPAPAPAAQAVGWPICRDAYELQEVIGSGATAVVQAALCKPRQERVAIKRINLEKCQTSMDELLKEIQAMSQCSHPNVVTYYTSFVVKDELWLVMKLLSGGSMLDIIKYIVNRGEHKNGVLEEAIIATILKEVLEGLDYLHRNGQIHRDLKAGNILLGEDGSVQIADFGVSAFLATGGDVTRNKVRKTFVGTPCWMAPEVMEQVRGYDFKADMWSFGITAIELATGAAPYHKYPPMKVLMLTLQNDPPTLETGVEDKEMMKKYGKSFRKLLSLCLQKDPSKRPTAAELLKCKFFQKAKNREYLIEKLLTRTPDIAQRAKKVRRVPGSSGHLHKTEDGDWEWSDDEMDEKSEEGKAAFSQEKSRRVKEENPEGPPNANEDYREASSCAVNLVLRLRNSRKELNDIRFEFTPGRDTADGVSQELFSAGLVDGHDVVIVAANLQKIVDDPKALKTLTFKLASGCDGSEIPDEVKLIGFAQLSVS

SEQ ID NO: 889203 - protein, 623 aa, Homo sapiens
ERAALPPFPASAGAASSLRPARPPLLPPLLAGFGGDGGGGGGGGGGRGGRAPAERCRRRGKGSFKWKVVRRPARPPALLRSIMAEPSGSPVHVQLPQQAAPVTAAAAAAPAAATAAPAPAAPAAPAPAPAPAPAAQAVGWPICRDAYELQEVIGSGATAVVQAALCKPRQERVAIKRINLEKCQTSMDELLKEIQAMSQCSHPNVVTYYTSFVVKDELWLVMKLLSGGSMLDIIKYIVNRGEHKNGVLEEAIIATILKEVLEGLDYLHRNGQIHRDLKAGNILLGEDGSVQIADFGVSAFLATGGDVTRNKVRKTFVGTPCWMAPEVMEQVRGYDFKADMWSFGITAIELATGAAPYHKYPPMKVLMLTLQNDPPTLETGVEDKEMMKKYGKSFRKLLSLCLQKDPSKRPTAAELLKCKFFQKAKNREYLIEKLLTRTPDIAQRAKKVRRVPGSSGHLHKTEDGDWEWSDDEMDEKSEEGKAAFSQEKSRRVKEENPEIAVSASTIPEQIQSLSVHDSQGPPNANEDYREASSCAVNLVLRLRNSRKELNDIRFEFTPGRDTADGVSQELFSAGLVDGHDVVIVAANLQKIVDDPKALKTLTFKLNQFLHLEAFDSAALGNVF

SEQ ID NO: 889204 - protein, 629 aa, Homo sapiens; identical to SEQ ID NO: 889200

SEQ ID NO: 889205 - protein, 629 aa, Homo sapiens; identical to SEQ ID NO: 889200

SEQ ID NO: 889206 - protein, 239 aa, Homo sapiens
MGAAKVWGEVGRWLVIALIQLAKAVLRMLLLLWFKAGLQTSPPIVPLDRETQAQPPDGDHSPGNHEQSYVGKRSNRVVRTLQNTPSLHSRHWGAPQQREGRQQQHHEELSATPTPLGLQETIAEFLYIARPLLHLLSLGLWGQRSWKPWLLAGVVDVTSLSLLSDRKGLTRRERRELRRRTILLLYYLLRSPFYDRFSEARILFLLQLLADHVPGVGLVTRPLMDYLPTWQKIYFYSWG

SEQ ID NO: 889207 - protein, 351 aa, Homo sapiens
MEKLRLLGLRYQEYVTRHPAATAQLETAVRGFSYLLAGRFADSHELSELVYSASNLLVLLNDGILRKELRKKLPVSLSQQKLLTWLSVLECVEVFMEMGAAKVWGEVGRWLVIALIQLAKAVLRMLLLLWFKAGLQTSPPIVPLDRETQAQPPDGDHSPGNHEQSYVGKRSNRVVRTLQNTPSLHSRHWGAPQQREGRQQQHHEELSATPTPLGLQETIAEFLYIARPLLHLLSLGLWGQRSWKPWLLAGVVDVTSLSLLSDRKGLTRRERRELRRRTILLLYYLLRSPFYDRFSEARILFLLQLLADHVPGVGLVTSPSVRPLRAYRPGPTHSPGRHQRSSQDTLDCALL

SEQ ID NO: 889208 - protein, 363 aa, Homo sapiens
SFCWDSDTGNFFRSSFRRIPSLSSTGRMEKLRLLGLRYQEYVTRHPAATAQLETAVRGFSYLLAGRFADSHELSELVYSASNLLVLLNDGILRKELRKKLPVSLSQQKLLTWLSVLECVEVFMEMGAAKVWGEVGRWLVIALIQLAKAVLRMLLLLWFKAGLQTSPPIVPLDRETQAQPPDGDHSPGNHEQSYVGKRSNRVVRTLQNTPSLHSRHWGAPQQREGRQQQHHEELSATPTPLGLQETIAEFLYIARPLLHLLSLGLWGQRSWKPWLLAGVVDVTSLSLLSDRKGLTRRERRELRRRTILLLYYLLRSPFYDRFSEARILFLLQLLADHVPGVGLVTRPLMDYLPTWQKIYFYSWG

SEQ ID NO: 889209 - protein, 254 aa, Homo sapiens
MEKLRLLGLRYQEYVTRHPAATAQLETAVRGFSYLLAGRFADSHELSELVYSASNLLVLLNDGILRKELRKKLPVSLSQQKLLTWLSVLECVEVFMEMGAAKVWGEVGRWLVIALIQLAKAVLRMLLLLWFKAGLQTSPPIVPLDRETQAQPPDGDHSPGNHEQSYVGKRSNRVVRTLQNTPSLHSRHWGAPQQREGRQQQHHEELSATPTPLGLQETIAEFLYIARPLLHCILSAGQDRAGTVGWGLSGECAE

SEQ ID NO: 889210 - protein, 239 aa, Homo sapiens; identical to SEQ ID NO: 889206

SEQ ID NO: 889211 - protein, 212 aa, Homo sapiens
MEKLRLLGLRYQEYVTRHPAATAQLETAVRGFSYLLAAALLPAALSFLRPLLRGQDPLPAPVAGRPRPWRWPGHKAAHGLLAHLAENLLLQLGLTDLPEGGCGEGWGREPLFPNKTDSGSVPACGLSVPTGQAPHTALVATSVPPRTPLTALSCDDATAARTLSLLGQEAFTRSGIQAPLPQKAVTSPHGAREAACLGSHRSEHCCSLAGPW

SEQ ID NO: 889212 - protein, 336 aa, Homo sapiens
MEKLRLLGLRYQEYVTRHPAATAQLETAVRGFSYLLAGRFADSHELSELVYSASNLLVLLNDGILRKELRKKLPVSLSQQKLLTWLSVLECVEVFMEMGAAKVWGEVGRWLVIALIQLAKAVLRMLLLLWFKAGLQTSPPIVPLDRETQAQPPDGDHSPGNHEQSYVGKRSNRVVRTLQNTPSLHSRHWGAPQQREGRQQQHHEELSATPTPLGLQETIAEFLYIARPLLHLLSLGLWGQRSWKPWLLAGVVDVTSLSLLSDRKGLTRRERRELRRRTILLLYYLLRSPFYDRFSEARILFLLQLLADHVPGVGLVTRPLMDYLPTWQKIYFYSWG

SEQ ID NO: 889213 - protein, 336 aa, Homo sapiens; identical to SEQ ID NO: 889212

SEQ ID NO: 889214 - protein, 239 aa, Homo sapiens; identical to SEQ ID NO: 889206

SEQ ID NO: 889215 - protein, 105 aa, Homo sapiens
MLSLGLWGQRSWKPWLLAGVVDVTSLSLLSDRKGLTRRERRELRRRTILLLYYLLRSPFYDRFSEARILFLLQLLADHVPGVGLVTRPLMDYLPTWQKIYFYSWG

SEQ ID NO: 889216 - protein, 70 aa, Homo sapiens
FLRPLLRVSTQDTLSQGEGWQAGTGAPVPAGAFPSPRLIQGSPSTVCCPGGSHQMPAQSRPQSSLGHQAT

SEQ ID NO: 889217 - protein, 545 aa, Homo sapiens
SGGGTRRGVGREPPVLISARSCGGGAARPGARRRDGEAAEVPARRVWWAAARLGRGEPERGAAVAPTRAGRPQHPQPPASAPKTARRRERAGGGAQALPAPSVPTPLRPFLSPPSSRLPRPRTGRPPCPPPAGALSVLAAAAGRAGPAGRGMALLDLALEGMAVFGFVLFLVLWLMHFMAIIYTRLHLNKKATDKQPYSKLPGVSLLKPLKGVDPNLINNLETFFELDYPKYEVLLCVQDHDDPAIDVCKKLLGKYPNVDARLFIGGKKVGINPKINNLMPGYEVAKYDLIWICDSGIRVIPDTLTDMVNQMTEKVGLVHGLPYVADRQGFAATLEQVYFGTSHPRYYISANVTGFKCVTGMSCLMRKDVLDQAGGLIAFAQYIAEDYFMAKAIADRGWRFAMSTQVAMQNSGSYSISQFQSRMIRWTKLRINMLPATIICEPISECFVASLIIGWAAHHVFRWDIMVFFMCHCLAWFIFDYIQLRGVQGGTLCFSKLDYAVAWFIRESMTIYIFLSALWDPTISWRTGRYRLRCGGTAEEILDV

SEQ ID NO: 889218 - protein, 545 aa, Homo sapiens; identical to SEQ ID NO: 889217

SEQ ID NO: 889219 - protein, 545 aa, Homo sapiens; identical to SEQ ID NO: 889217

SEQ ID NO: 889220 - protein, 248 aa, Homo sapiens
SGGGTRRGVGREPPVLISARSCGGGAARPGARRRDGEAAEVPARRVWWAAARLGRGEPERGAAVAPTRAGRPQHPQPPASAPKTARRRERAGGGAQALPAPSVPTPLRPFLSPPSSRLPRPRTGRPPCPPPAGALSVLAAAAGRAGPAGRGMALLDLALEGMAVFGFVLFLVLWLMHFMAIIYTRLHLNKKATDKQPYSKLPGVSLLKPLKGVDPNLINNLETFFELDYPKPLFFSVAPMKRIEKTQM

SEQ ID NO: 889221 - protein, 457 aa, Homo sapiens
SGGGTRRGVGREPPVLISARSCGGGAARPGARRRDGEAAEVPARRVWWAAARLGRGEPERGAAVAPTRAGRPQHPQPPASAPKTARRRERAGGGAQALPAPSVPTPLRPFLSPPSSRLPRPRTGRPPCPPPAGALSVLAAAAGRAGPAGRGMALLDLALEGMAVFGFVLFLVLWLMHFMAIIYTRLHLNKKATDKQPYSKLPGVSLLKPLKGVDPNLINNLETFFELDYPKYEVLLCVQDHDDPAIDVCKKLLGKYPRYYISANVTGFKCVTGMSCLMRKDVLDQAGGLIAFAQYIAEDYFMAKAIADRGWRFAMSTQVAMQNSGSYSISQFQSRMIRWTKLRINMLPATIICEPISECFVASLIIGWAAHHVFRWDIMVFFMCHCLAWFIFDYIQLRGVQGGTLCFSKLDYAVAWFIRESMTIYIFLSALWDPTISWRTGRYRLRCGGTAEEILDV

SEQ ID NO: 889222 - protein, 376 aa, Homo sapiens
SGGGTRRGVGREPPVLISARSCGGGAARPGARRRDGEAAEVPARRVWWAAARLGRGEPERGAAVAPTRAGRPQHPQPPASAPKTARRRERAGGGAQALPAPSVPTPLRPFLSPPSSRLPRPRTGRPPCPPPAGALSVLAAAAGRAGPAGRGMALLDLALEGMAVFGFVLFLVLWLMHFMAIIYTRLHLNKKATDKQPYSKLPGVSLLKPLKGVDPNLINNLETFFELDYPKYEVLLCVQDHDDPAIDVCKKLLGKYPNVDARLFIGGKKVGINPKINNLMPGYEVAKYDLIWICDSGIRVIPDTLTDMVNQMTEKVGLVHGLPYVADRQGFAATLEQMESRSVAQARVQWRDLGSLQAPPPGFTPFSCLSRLSSWD

SEQ ID NO: 889223 - protein, 249 aa, Homo sapiens
SGGGTRRGVGREPPVLISARSCGGGAARPGARRRDGEAAEVPARRVWWAAARLGRGEPERGAAVAPTRAGRPQHPQPPASAPKTARRRERAGGGAQALPAPSVPTPLRPFLSPPSSRLPRPRTGRPPCPPPAGALSVLAAAAGRAGPAGRGMALLDLALEGMAVFGFVLFLVLWLMHFMAIIYTRLHLNKKATDKQPYSKLPGVSLLKPLKGVDPNLINNLETFFELDYPKVSSVLRFFVLFCFVLFPS

SEQ ID NO: 889224 - protein, 545 aa, Homo sapiens; identical to SEQ ID NO: 889217

SEQ ID NO: 889225 - protein, 545 aa, Homo sapiens; identical to SEQ ID NO: 889217

SEQ ID NO: 889226 - protein, 556 aa, Homo sapiens
SGGGTRRGVGREPPVLISARSCGGGAARPGARRRDGEAAEVPARRVWWAAARLGRGEPERGAAVAPTRAGRPQHPQPPASAPKTARRRERAGGGAQALPAPSVPTPLRPFLSPPSSRLPRPRTGRPPCPPPAGALSVLAAAAGRAGPAGRGMALLDLALEGMAVFGFVLFLVLWLMHFMAIIYTRLHLNKKATDKQPYSKLPGVSLLKPLKGVDPNLINNLETFFELDYPKNLIYIQCFLTEYEVLLCVQDHDDPAIDVCKKLLGKYPNVDARLFIGGKKVGINPKINNLMPGYEVAKYDLIWICDSGIRVIPDTLTDMVNQMTEKVGLVHGLPYVADRQGFAATLEQVYFGTSHPRYYISANVTGFKCVTGMSCLMRKDVLDQAGGLIAFAQYIAEDYFMAKAIADRGWRFAMSTQVAMQNSGSYSISQFQSRMIRWTKLRINMLPATIICEPISECFVASLIIGWAAHHVFRWDIMVFFMCHCLAWFIFDYIQLRGVQGGTLCFSKLDYAVAWFIRESMTIYIFLSALWDPTISWRTGRYRLRCGGTAEEILDV

SEQ ID NO: 889227 - protein, 426 aa, Homo sapiens
SGGGTRRGVGREPPVLISARSCGGGAARPGARRRDGEAAEVPARRVWWAAARLGRGEPERGAAVAPTRAGRPQHPQPPASAPKTARRRERAGGGAQALPAPSVPTPLRPFLSPPSSRLPRPRTGRPPCPPPAGALSVLAAAAGRAGPAGRGMALLDLALEGMAVFGFVLFLVLWLMHFMAIIYTRLHLNKKATDKQPYSKLPGVSLLKPLKGVDPNLINNLETFFELDYPKYEVLLCVQDHDDPAIDVCKKLLGKYPNVDARLFIGGKKVGINPKINNLMPGYEVAKYDLIWICDSGIRVIPDTLTDMVNQMTEKVGLVHGLPYVADRQGFAATLEQVYFGTSHPRYYISANVTGFKCVTGMSCLMRKDVLDQAGGLIAFAQYIAEDYFMAKAIADRGWRFAMSTQVAMQNSGSYSISQFQSRMIR

SEQ ID NO: 889228 - protein, 838 aa, Homo sapiens
TSSVKSEYTDPWGYYIDYTGMQEDPGNPAGGCSTSSGVPTGNGPVRHVQEGSRATMPQVPGGSVKPKIMSPEKSHRVISPSSGYSSQSNTPTALTPVPVFLKSVSPANGKGKPKPKVPERKSSLISSVSISSSSTSLSSSTSTEGSGTMKKLDPAVGSPPAPPPPPVPSPPFPCPADRSPFLPPPPPVTDCSQGSPLPHSPVFPPPPPEALIPFCSPPDWCLSPPRPALSPILPDSPVSLPLPPPLLPSSEPPPAPPLDPKFMKDTRPPFTNSGQPESSRGSLRPPSTKEETSRPPMPLITTEALQMVQLRPVRKNSGAEAAQLSERTAQEQRTPVAPQYHLKPSAFLKSRNSTNEMESESQPASVTSSLPTPAKSSSQGDHGSAAERGGPVSRSPGAPSAGEAEARPSPSTTPLPDSSPSRKPPPISKKPKLFLVVPPPQKDFAVEPAENVSEALRAVPSPTTGEEGSVHSREAKESSAAQAGSHATHPGTSVLEGGAAGSMSPSRVEANVPMVQPDVSPAPKQEEPAENSADTGGDGESCLSQQDGAAGVPETNAAGSSSEACDFLKEDGNDEVMTPSRPRTTEDLFAAIHRSKRKVLGRRDSDDDHSRNHSPSPPVTPTGAAPSLASPKQVGSIQRSIRKSSTSSDNFKALLLKKGSRSDTSARMSAAEMLKNTDPRFQRSRSEPSPDAPESPSSCSPSKNRRAQEEWAKNEGLMPRSLSFSGPRYGRSRTPPSAASSRYSMRNRIQSSPMTVISEGEGEAVEPVDSIARGALGAAEGCSLDGLAREEMDEGGLLCGEGPAASLQPQAPGPVDGTASAEGREPSPQCGGSLSEES

SEQ ID NO: 889229 - protein, 838 aa, Homo sapiens; identical to SEQ ID NO: 889228

SEQ ID NO: 889230 - protein, 772 aa, Homo sapiens
HKQRQVRVHGPLGLLHRLHGHAGRSGEPGRGLFNQQWGAHWERASPPCPRRVQSHNAPSARWFSQTKDHVTREVTQSHFSIQWVFQPVEYTHSTHPCACVFKISVTMDPAVGSPPAPPPPPVPSPPFPCPADRSPFLPPPPPVTDCSQGSPLPHSPVFPPPPPEALIPFCSPPDWCLSPPRPALSPILPDSPVSLPLPPPLLPSSEPPPAPPLDPKFMKDTRPPFTNSGQPESSRGSLRPPSTKEETSRPPMPLITTEALQMVQLRPVRKNSGAEAAQLSERTAQEQRTPVAPQYHLKPSAFLKSRNSTNEMESESQPASVTSSLPTPAKSSSQGDHGSAAERGGPVSRSPGAPSAGEAEARPSPSTTPLPDSSPSRKPPPISKKPKLFLVVPPPQKDFAVEPAENVSEALRAVPSPTTGEEGSVHSREAKESSAAQAGSHATHPGTSVLEGGAAGSMSPSRVEANVPMVQPDVSPAPKQEEPAGVPETNAAGSSSEACDFLKEDGNDEVMTPSRPRTTEDLFAAIHRSKRKVLGRRDSDDDHSRNHSPSPPVTPTGAAPSLASPKQVGSIQRSIRKSSTSSDNFKALLLKKGSRSDTSARMSAAEMLKNTDPRFQRSRSEPSPDAPESPSSCSPSKNRRAQEEWAKNEGLMPRSLSFSGPRYGRSRTPPSAASSRYSMRNRIQSSPMTVISEGEGEAVEPVDSIARGALGAAEGCSLDGLAREEMDEGGLLCGEGPAASLQPQAPGPVDGTASAEGREPSPQCGGSLSEES

SEQ ID NO: 889231 - protein, 236 aa, Homo sapiens
MLLNLRSKRKVLGRRDSDDDHSRNHSPSPKQVGSIQRSIRKSSTSSDNFKALLLKKGSRSDTSARMSAAEMLKNTDPRFQRSRSEPSPDAPESPSSCSPSKNRRAQEEWAKNEGLMPRSLSFSGPRYGRSRTPPSAASSRYSMRNRIQSSPMTVISEGEGEAVEPVDSIARGALGAAEGCSLDGLAREEMDEGGLLCGEGPAASLQPQAPGPVDGTASAEGREPSPQCGGSLSEES

SEQ ID NO: 889232 - protein, 236 aa, Homo sapiens; identical to SEQ ID NO: 889231

SEQ ID NO: 889233 - protein, 838 aa, Homo sapiens; identical to SEQ ID NO: 889228

SEQ ID NO: 889234 - protein, 236 aa, Homo sapiens; identical to SEQ ID NO: 889231

SEQ ID NO: 889235 - protein, 236 aa, Homo sapiens; identical to SEQ ID NO: 889231

SEQ ID NO: 889236 - protein, 335 aa, Homo sapiens
MGTVPTSICCQPATPPSTLRSCSGSGSCGCWKIWASRTSRCSRGALWSQAPQSPGSPRNPDGGSQMQCLSPHRWAGSAPGAPSSTSPRGLAVRCAAGRAPRPTRSPPHTSPTRRSERAWRARRRRCVSTSRECLQGTIRNSQEAEVSCPFIDNTYSCSGKLLEREIKALLTPEDYQRFLDLGISIAENRSAFSYHCKTPDCKGWCFFEDDVNEFTCPVCFHVNCLLCKAIHEQMNCKEYQEDLALRAQNDVAARQTTEMLKVMLQQGEAMRCPQCQIVVQKKDGCDWIRCTVCHTEICWVTKGPRWGPGGPGDTSGGCRCRVNGIPCHPSCQNCH

SEQ ID NO: 889237 - protein, 114 aa, Homo sapiens
PPTPPAAQLLPAALRCGPQGDPGGSPGTRDQPRRTGWGRPKQERRDRWDPALGVRRRRVAGQWRSRMRRQFFRPPLPVPPHFRGRHFHFLFRTLLKSIAQKLYTLLPLIPVDQN

SEQ ID NO: 889238 - protein, 519 aa, Homo sapiens
MDEKTKKAEEMALSLTRAVAGGDEQVAMKCAIWLAEQRVPLSVQLKPEVSPTQDIRLWVSVEDAQMHTVTIWLTVRPDMTVASLKDMVFLDYGFPPVLQQWVIGQRLARDQETLHSHGVRQNGDSAYLYLLSARNTSLNPQELQRERQLRMLEDLGFKDLTLQPRGPLEPGPPKPGVPQEPGRGQPDAVPEPPPVGWQCPGCTFINKPTRPGCEMCCRARPEAYQVPASYQPDEEERARLAGEEEALRQYQQRKQQQQEGNYLQHVQLDQRSLVLNTEPAECPVCYSVLAPGEAVVLRECLHTFCRECLQGTIRNSQEAEVSCPFIDNTYSCSGKLLEREIKALLTPEDYQRFLDLGISIAENRSAFSYHCKTPDCKGWCFFEDDVNEFTCPVCFHVNCLLCKAIHEQMNCKEYQEDLALRAQNDVAARQTTEMLKVMLQQGEAMRCPQCQIVVQKKDGCDWIRCTVCHTEICWVTKGPRWGPGGESLLVVVWRGCPCGLCLRGGLGKLQPMGHIQPST

SEQ ID NO: 889239 - protein, 551 aa, Homo sapiens
MDEKTKKAEEMALSLTRAVAGGDEQVAMKCAIWLAEQRVPLSVQLKPEVSPTQDIRSRGEKTEEVGEVREVPDHGGPRVLPRVDSKSSVEPLEGPNWLWVSVEDAQMHTVTIWLTVRPDMTVASLKDMVFLDYGFPPVLQQWVIGQRLARDQETLHSHGVRQNGDSAYLYLLSARNTSLNPQELQRERQLRMLEDLGFKDLTLQPRGPLEPGPPKPGVPQEPGRGQPDAVPEPPPVGWQCPGCTFINKPTRPGCEMCCRARPEAYQVPASYQPDEEERARLAGEEEALRQYQQRKQQQQEGNYLQHVQLDQRSLVLNTEPAECPVCYSVLAPGEAVVLRECLHTFCRECLQGTIRNSQEAEVSCPFIDNTYSCSGKLLEREIKALLTPEDYQRFLDLGISIAENRSAFSYHCKTPDCKGWCFFEDDVNEFTCPVCFHVNCLLCKAIHEQMNCKEYQEDLALRAQNDVAARQTTEMLKVMLQQGEAMRCPQCQIVVQKKDGCDWIRCTVCHTEICWVTKGPRWGPGGPGDTSGGCRCRVNGIPCHPSCQNCH

SEQ ID NO: 889240 - protein, 519 aa, Homo sapiens; identical to SEQ ID NO: 889238

SEQ ID NO: 889241 - protein, 409 aa, Homo sapiens
MDEKTKKAEEMALSLTRAVAGGDEQVAMKCAIWLAEQRVPLSVQLKPEVSPTQDIRLWVSVEDAQMHTVTIWLTVRPDMTVASLKDMVFLDYGFPPVLQQWVIGQRLARDQETLHSHGVRQNGDSAYLYLLSVGWQCPGCTFINKPTRPGCEMCCRARPEAYQVPASYQPDEEERARLAGEEEALRQYQQRKQQQQEGNYLQHVQLDQRSLVLNTEPAECPVCYSVLAPGEAVVLRECLHTFCRECLQGTIRNSQEAEVSCPFIDNTYSCSGKLLEREIKALLTPEDYQRFLDLGISIAENRSAFSYHCKTPDCKGWCFFEDDVNEFTCPVCFHVNCLLCKAIHEQMNCKEYQEDLALRAQNDVAARQTTEMLKVRLGQGRGLGILSSGIQVGAGGFPVRAVLTHPWRL

SEQ ID NO: 889242 - protein, 527 aa, Homo sapiens
MDEKTKKAPENKPCANWLLLYWLSAEEMALSLTRAVAGGDEQVAMKCAIWLAEQRVPLSVQLKPEVSPTQDIRLWVSVEDAQMHTVTIWLTVRPDMTVASLKDMVFLDYGFPPVLQQWVIGQRLARDQETLHSHGVRQNGDSAYLYLLSARNTSLNPQELQRERQLRMLEDLGFKDLTLQPRGPLEPGPPKPGVPQEPGRGQPDAVPEPPPVGWQCPGCTFINKPTRPGCEMCCRARPEAYQVPASYQPDEEERARLAGEEEALRQYQQRKQQQQEGNYLQHVQLDQRSLVLNTEPAECPVCYSVLAPGEAVVLRECLHTFCRECLQGTIRNSQEAEVSCPFIDNTYSCSGKLLEREIKALLTPEDYQRFLDLGISIAENRSAFSYHCKTPDCKGWCFFEDDVNEFTCPVCFHVNCLLCKAIHEQMNCKEYQEDLALRAQNDVAARQTTEMLKVMLQQGEAMRCPQCQIVVQKKDGCDWIRCTVCHTEICWVTKGPRWGPGGPGDTSGGCRCRVNGIPCHPSCQNCH

SEQ ID NO: 889243 - protein, 510 aa, Homo sapiens
MDEKTKKAEEMALSLTRAVAGGDEQVAMKCAIWLAEQRVPLSVQLKPEVSPTQDIRLWVSVEDAQMHTVTIWLTVRPDMTVASLKDMVFLDYGFPPVLQQWVIGQRLARDQETLHSHGVRQNGDSAYLYLLSARNTSLNPQELQRERQLRMLEDLGFKDLTLQPRGPLEPGPPKPGVPQEPGRGQPDAVPEPPPVGWQCPGCTFINKPTRPGCEMCCRARPEAYQVPASYQPDEEERARLAGEEEALRQYQQRKQQQQEGNYLQHVQLDQRSLVLNTEPAECPVCYSVLAPGEAVVLRECLHTFCRECLQGTIRNSQEAEVSCPFIDNTYSCSGKLLEREIKALLTPEDYQRFLDLGISIAENRSAFSYHCKTPDCKGWCFFEDDVNEFTCPVCFHVNCLLCKAIHEQMNCKEYQEDLALRAQNDVAARQTTEMLKVMLQQGEAMRCPQCQIVVQKKDGCDWIRCTVCHTEICWVTKGPRWGPGGPGDTSGGCRCRVNGIPCHPSCQNCH

SEQ ID NO: 889244 - protein, 269 aa, Homo sapiens [sequence omitted]

SEQ ID NO: 889245 - protein, 510 aa, Homo sapiens; identical to SEQ ID NO: 889243

SEQ ID NO: 889246 - protein, 304 aa, Homo sapiens
MDEKTKKAEEMALSLTRAVAGGDEQVAMKCAIWLAEQRVPLSVQLKPEVSPTQDIRLWVSVEDAQMHTVTIWLTVRPDMTVASLKDMVFLDYGFPPVLQQWVIGQRLARDQETLHSHGVRQNGDSAYLYLLSARNTSLNPQELQRERQLRMLEDLGFKDLTLQPRGPLEPGPPKPGVPQEPGRGQPDAVPEPPPVGWQCPGCTFINKPTRPGCEMCCRARPEAYQVPASYQPDEEERARLAGEEEALRQYQQVTLWLRPAPWLWRTSRFTCPTPTWAVAPSPALTHHTSMAGHDPSTLAMTPAP

SEQ ID NO: 889247 - protein, 445 aa, Homo sapiens
MHTVTIWLTVRPDMTVASLKDMVFLDYGFPPVLQQWVIGQRLARDQETLHSHGVRQNGDSAYLYLLSARNTSLNPQELQRERQLRMLEDLGFKDLTLQPRGPLEPGPPKPGVPQEPGRGQPDAVPEPPPVGWQCPGCTFINKPTRPGCEMCCRARPEAYQVPASYQPDEEERARLAGEEEALRQYQQRKQQQQEGNYLQHVQLDQRSLVLNTEPAECPVCYSVLAPGEAVVLRECLHTFCRECLQGTIRNSQEAEVSCPFIDNTYSCSGKLLEREIKALLTPEDYQRFLDLGISIAENRSAFSYHCKTPDCKGWCFFEDDVNEFTCPVCFHVNCLLCKAIHEQMNCKEYQEDLALRAQNDVAARQTTEMLKVMLQQGEAMRCPQCQIVVQKKDGCDWIRCTVCHTEICWVTKGPRWGPGGPGDTSGGCRCRVNGIPCHPSCQNCH

SEQ ID NO: 889248 - protein, 424 aa, Homo sapiens
MVFLDYGFPPVLQQWVIGQRLARDQETLHSHGVRQNGDSAYLYLLSARNTSLNPQELQRERQLRMLEDLGFKDLTLQPRGPLEPGPPKPGVPQEPGRGQPDAVPEPPPVGWQCPGCTFINKPTRPGCEMCCRARPEAYQVPASYQPDEEERARLAGEEEALRQYQQRKQQQQEGNYLQHVQLDQRSLVLNTEPAECPVCYSVLAPGEAVVLRECLHTFCRECLQGTIRNSQEAEVSCPFIDNTYSCSGKLLEREIKALLTPEDYQRFLDLGISIAENRSAFSYHCKTPDCKGWCFFEDDVNEFTCPVCFHVNCLLCKAIHEQMNCKEYQEDLALRAQNDVAARQTTEMLKVMLQQGEAMRCPQCQIVVQKKDGCDWIRCTVCHTEICWVTKGPRWGPGGPGDTSGGCRCRVNGIPCHPSCQNCH

SEQ ID NO: 889249 - protein, 105 aa, Homo sapiens
MDEKTKKAEEMALSLTRAVAGGDEQVAMKCAIWLAEQRVPLSVQLKPEVSPTQDIRFLMVQNGHSSSIQPSHHRRKGRKTPLHTLLKSIAQKLYTLLPLIPVDQN

SEQ ID NO: 889250 - protein, 122 aa, Homo sapiens
MDEKTKKAPENKPCANWLLLYWLSAEEMALSLTRAVAGGDEQVAMKCAIWLAEQRVPLSVQLKPEVSPTQDIRFLMVQNGHSSSIQPSHHRRKGRKTPLHTLLKSIAQKLYTLLPLIPVDQN

SEQ ID NO: 889251 - protein, 220 aa, Homo sapiens
PPTPPAAQLLPAALRCGPQGDPGGSPGTRDQPRRTGWGRPKQERRDRWDPALGVRRRRVAGQWRSRMRRQFFRPPLPVPPHFRGRHFHFLFRRSRSPCEELGPPGRREGFALKPGTPGALPQVGVLRDLERPGWVVSGRPFPASSHLGWSRFLLRPVRTCLGARCPLTAPRRIPAWSPGSVMLPDCRGDSEAHTGLGPRRRPHGLAELLLVSRLSQATRR

SEQ ID NO: 889252 - protein, 220 aa, Homo sapiens; identical to SEQ ID NO: 889251

SEQ ID NO: 889253 - protein, 468 aa, Homo sapiens
MGTATPDGREDQERLWVSVEDAQMHTVTIWLTVRPDMTVASLKDMVFLDYGFPPVLQQWVIGQRLARDQETLHSHGVRQNGDSAYLYLLSARNTSLNPQELQRERQLRMLEDLGFKDLTLQPRGPLEPGPPKPGVPQEPGRGQPDAVPEPPPVGWQCPGCTFINKPTRPGCEMCCRARPEAYQVPASYQPDEEERARLAGEEEALRQYQQRKQQQQEGNYLQHVQLDQRSLVLNTEPAECPVCYSVLAPGEAVVLRECLHTFCRECLQGTIRNSQEAEVSCPFIDNTYSCSGKLLEREIKALLTPEDYQRFLDLGISIAENRSAFSYHCKTPDCKGWCFFEDDVNEFTCPVCFHVNCLLCKAIHEQMNCKEYQEDLALRAQNDVAARQTTEMLKVMLQQGEAMRCPQCQIVVQKKDGCDWIRCTVCHTEICWVTKGPRWGPGGPGDTSGGCRCRVNGIPCHPSCQNCH

SEQ ID NO: 889254 - protein, 510 aa, Homo sapiens; identical to SEQ ID NO: 889243

SEQ ID NO: 889255 - protein, 471 aa, Homo sapiens
MDEKTKKAEEMALSLTRAVAGGDEQVAMKCAIWLAEQRVPLSVQLKPEVSPTQDIRLWVSVEDAQMHTVTIWLTVRPDMTVASLKDMVFLDYGFPPVLQQWVIGQRLARDQETLHSHGVRQNGDSAYLYLLSARNTSLNPQELQRERQLRMLEDLGFKDLTLQPRGPLEPGPPKPGVPQEPGRGQPDAVPEPPPVGWQCPGCTFINKPTRPGCEMCCRARPEAYQVPASYQPDEEERARLAGEEEALRQYQQRKQQQQEGNYLQHVQLDQRSLVLNTEPAECPVCYSVLAPGEAVVLRECLHTFCRECLQGTIRNSQEAEVSCPFIDNTYSCSGKLLEREIKALLTPEDYQRFLDLGISIAENRSAFSYHCKTPDCKGWCFFEDDVNEFTCPVCFHVNCLLCKAIHEQMNCKEYQEDLALRAQNDVAARQTTEMLKVRLGQGRGLGILSSGIQVGAGGFPVRAVLTHPWRL

SEQ ID NO: 889256 - protein, 335 aa, Homo sapiens; identical to SEQ ID NO: 889236

SEQ ID NO: 889257 - protein, 510 aa, Homo sapiens; identical to SEQ ID NO: 889243

SEQ ID NO: 889258 - protein, 105 aa, Homo sapiens; identical to SEQ ID NO: 889249

SEQ ID NO: 889259 - protein, 378 aa, Homo sapiens
MDEKTKKAEEMALSLTRAVAGGDEQVAMKCAIWLAEQRVPLSVQLKPEVSPTQDIRLWVSVEDAQMHTVTIWLTVRPDMTVASLKDMVFLDYGFPPVLQQWVIGQRLARDQETLHSHGVRQNGDSAYLYLLSARNTSLNPQELQRERQLRMLEDLGFKDLTLQPRGPLEPGPPKPGVPQEPGRGQPDAVPEPPPVGWQCPGCTFINKPTRPGCEMCCRARPEAYQVPASYQPDEEERARLAGEEEALRQYQQRKQQQQEGNYLQHVQLDQRSLVLNTEPAECPVCYSVLAPGEAVVLRECLHTFCRCGPQSHPRQCSLIKAANYAGLDVGGALCSDTSLDARENLRGRLRLPMLRTRNLREREAQRLTPGPRLMREAA

SEQ ID NO: 889260 - protein, 269 aa, Homo sapiens [sequence omitted]

SEQ ID NO: 889261 - protein, 269 aa, Homo sapiens [sequence omitted]

SEQ ID NO: 889262 - protein, 445 aa, Homo sapiens; identical to SEQ ID NO: 889247

SEQ ID NO: 889263 - protein, 260 aa, Homo sapiens
GVSLFNLVALRTDSDFEDTRTSLVLNTEPAECPVCYSVLAPGEAVVLRECLHTFCRECLQGTIRNSQEAEVSCPFIDNTYSCSGKLLEREIKALLTPEDYQRFLDLGISIAENRSAFSYHCKTPDCKGWCFFEDDVNEFTCPVCFHVNCLLCKAIHEQMNCKEYQEDLALRAQNDVAARQTTEMLKVMLQQGEAMRCPQCQIVVQKKDGCDWIRCTVCHTEICWVTKGPRWGPGGPGDTSGGCRCRVNGIPCHPSCQNCH

SEQ ID NO: 889264 - protein, 225 aa, Homo sapiens
MESPVKGVPMILTLFPSPPPRECLQGTIRNSQEAEVSCPFIDNTYSCSGKLLEREIKALLTPEDYQRFLDLGISIAENRSAFSYHCKTPDCKGWCFFEDDVNEFTCPVCFHVNCLLCKAIHEQMNCKEYQEDLALRAQNDVAARQTTEMLKVMLQQGEAMRCPQCQIVVQKKDGCDWIRCTVCHTEICWVTKGPRWGPGGPGDTSGGCRCRVNGIPCHPSCQNCH

SEQ ID NO: 889265 - protein, 220 aa, Homo sapiens; identical to SEQ ID NO: 889251

SEQ ID NO: 889266 - protein, 234 aa, Homo sapiens [sequence omitted]

SEQ ID NO: 889267 - protein, 137 aa, Homo sapiens
MAGPELLLDSNIYATGVGPSQTENTQTEDKETSRRSKDQSRGKSEQGEKMLQLQDTGEEDEDQVALHRPRPSAKLKRVSILPKSRRSMIKAKPEKNWHEKPRNLHQNGDPSQTKSEKERPNNPRENPDGLRGETERV

SEQ ID NO: 889268 - protein, 164 aa, Homo sapiens; identical to SEQ ID NO: 746823

SEQ ID NO: 889269 - protein, 258 aa, Homo sapiens
QCDQSQGMRNMESNAVQLTRMEYAMKSLSLLYPKSLSRHVSVRTSVVTQQLLSEPSPKAPRARPCRVSTADRSVRKGIMAYSLEDLLLKVRDTLMLADKPFFLVLEEDGTTVETEEYFQALAGDTVFMVLQKGQKWQPPSEQGTRHPLSLSHKPAKKIDVARVTFDLYKLNPQDFIGCLNVKATFYDTYSLSYDLHCCGAKRIMKEAFRWALFSMQATGHVLLGTSCYLQQLLDATEEGQPPKGKASSLIPTCLKILQ

SEQ ID NO: 889270 - protein, 92 aa, Homo sapiens
VVIQRILRGQGGGSDPNTQNPKYITAACEMVAEMVESLQSVLALGHKRNSGRNGLEGVVLAAEEGLKGIRLWLLRHPPQDRPLTVIPLIQSL

SEQ ID NO: 889271 - protein, 2709 aa, Homo sapiens
MLVHYLLGKVLLGEEEALEDDSESRSDVSSSALTASVKDEISGELAASSGVSTPGSAGHDIITEQPRSQHTLQADSVDLASCDLTSSATDGDEEDILSHSSSQVSAVPSDPAMDLNDGTQASSPISDSSQTTTEGPDSAVTPSDSSEIVLDGTDNQYLGLQIGQPQDEDEEATGILPDEASEAFRNSSMALQQAHLLKNMSHCRQPSDSSVDKFVLRDEATEPGDQENKPCRIKGDIGQSTDDDSAPLVHCVRLLSASFLLTGGKNVLVPDRDVRVSVKALALSCVGAAVALHPESFFSKLYKVPLDTTEYPEEQYVSDILNYIDHGDPQVRGATAILCGTLICSILSRSRFHVGDWMGTIRTLTGNTFSLADCIPLLRKTLKDESSVTCKLACTAVRNCVMSLCSSSYSELGLQLIIDVLTLRNSSYWLVRTELLETLAEIDFRLVSFLEAKAENLHRGAHHYTGLLKLQERVLNNVVIHLLGDEDPRVRHVAAASLIRLVPKLFYKCDQGQADPVVAVARDQSSVYLKLLMHETQPPSHFSVSTITRIYRGYNLLPSITDVTMENNLSRVIAAVSHELITSTTRALTFGCCEALCLLSTAFPVCIWSLGWHCGVPPLSASDESRKSCTVGMATMILTLLSSAWFPLDLSAHQDALILAGNLLAASAPKSLRSSWASEEEANPAATKQEEVWPALGDRALVPMVEQLFSHLLKVINICAHVLDDVAPGPAIKAALPSLTNPPSLSPIRRKGKEKEPGEQASVPLSPKKGSEASAASRQSDTSGPVTTSKSSSLGSFYHLPSYLKLHDVLKATHANYKVTLDLQNSTEKFGGFLRSALDVLSQILELATLQDIGKCVEEILGYLKSCFSREPMMATVCVQQLLKTLFGTNLASQFDGLSSNPSKSQGRAQRLGSSSVRPGLYHYCFMAPYTHFTQALADASLRNMVQAEQENDTSGWFDVLQKVSTQLKTNLTSVTKNRADKNAIHNHIRLFEPLVIKALKQYTTTTCVQLQKQVLDLLAQLVQLRVNYCLLDSDQVFIGFVLKQFEYIEVGQFRESEAIIPNIFFFLVLLSYERYHSKQIIGIPKIIQLCDGIMASGRKAVTHAIPALQPIVHDLFVLRGTNKADAGKELETQKEVVVSMLLRLIQYHQVLEMFILVLQQCHKENEDKWKRLSRQIADIILPMLAKQQMHIDSHEALGVLNTLFEILAPSSLRPVDMLLRSMFVTPNTMASVSTVQLWISGILAILRVLISQSTEDIVLSRIQELSFSPYLISCTVINRLRDGDSTSTLEEHSEGKQIKNLPEETFSRFLLQLVGILLEDIVTKQLKVEMSEQQHTFYCQELGTLLMCLIHIFKSGMFRRITAAATRLFRSDGCGGSFYTLDSLNLRARSMITTHPALVLLWCQILLLVNHTDYRWWAEVQQTPKRHSLSSTKLLSPQMSGEEEDSDLAAKLGMCNREIVRRGALILFCDYVCQNLHDSEHLTWLIVNHIQDLISLSHEPPVQDFISAVHRNSAASGLFIQAIQSRCENLSTPTMLKKTLQCLEGIHLSQSGAVLTLYVDRLLCTPFRVLARMVDILACRRVEMLLAANLQSSMAQLPMEELNRIQEYLQSSGLAQRHQRLYSLLDRFRLSTMQDSLSPSPPVSSHPLDGDGHVSLETVSPDKDWYVHLVKSQCWTRSDSALLEGAELVNRIPAEDMNAFMMNSEFNLSLLAPCLSLGMSEISGGQKSALFEAAREVTLARVSGTVQQLPAVHHVFQPELPAEPAAYWSKLNDLFGDAALYQSLPTLARALAQYLVVVSKLPSHLHLPPEKEKDIVKFVVATLEALSWHLIHEQIPLSLDLQAGLDCCCLALQLPGLWSVVSSTEFVTHACSLIYCVHFILEAVAVQPGEQLLSPERRTNTPKAISEEEEEVDPNTQNPKYITAACEMVAEMVESLQSVLALGHKRNSGVPAFLTPLLRNIIISLARLPLVNSYTRVPPLVWKLGWSPKPGGDFGTAFPEIPVEFLQEKEVFKEFIYRINTLGWTSRTQFEETWATLLGVLVTQPLVMEQEESPPEEDTERTQINVLAVQAITSLVLSAMTVPVAGNPAVSCLEQQPRNKPLKALDTRFGRKLSIIRGIVEQEIQAMVSKRENIATHHLYQAWDPVPSLSPATTGALISHEKLLLQINPERELGSMSYKLGQVSIHSVWLGNSITPLREEEWDEEEEEEADAPAPSSPPTSPVNSRKHRAGVDIHSCSQFLLELYSRWILPSSSARRTPAILISEVVRSLLVVSDLFTERNQFELMYVTLTELRRVHPSEDEILAQYLVPATCKAAAVLGMDKAVAEPVSRLLESTLRSSHLPSRVGALHGVLYVLECDLLDDTAKQLIPVISDYLLSNLKGIAHCVNIHSQQHVLVMCATAFYLIENYPLDVGPEFSASIIQMCGVMLSGSEESTPSIIYHCALRGLERLLLSEQLSRLDAESLVKLSVDRVNVHSPHRAMAALGLMLTCMYTGKEKVSPGRTSDPNPAAPDSESVIVAMERVSVLFDRIRKGFPCEARVVARILPQFLDDFFPPQDIMNKVIGEFLSNQQPYPQFMATVVYKVFQTLHSTGQSSMVRDWVMLSLSNFTQRAPVAMATWSLSCFFVSASTSPWVAAILPHVISRMGKLEQVDVNLFCLVATDFYRHQIEEELDRRAFQSVLEVVAAPGSPYHRLLTCLRNVHKVTTC

SEQ ID NO: 889272 - protein, 2308 aa, Homo sapiens [sequence omitted]

SEQ ID NO: 889273 - protein, 3144 aa, Homo sapiens
MATLEKLMKAFESLKSFQQQQQQQQQQQQQQQQQQQQQQQPPPPPPPPPPPQLPQPPPQAQPLLPQPQPPPPPPPPPPGPAVAEEPLHRPKKELSATKKDRVNHCLTICENIVAQSVRNSPEFQKLLGIAMELFLLCSDDAESDVRMVADECLNKVIKALMDSNLPRLQLELYKEIKKNGAPRSLRAALWRFAELAHLVRPQKCRPYLVNLLPCLTRTSKRPEESVQETLAAAVPKIMASFGNFANDNEIKVLLKAFIANLKSSSPTIRRTAAGSAVSICQHSRRTQYFYSWLLNVLLGLLVPVEDEHSTLLILGVLLTLRYLVPLLQQQVKDTSLKGSFGVTRKEMEVSPSAEQLVQVYELTLHHTQHQDHNVVTGALELLQQLFRTPPPELLQTLTAVGGIGQLTAAKEESGGRSRSGSIVELIAGGGSSCSPVLSRKQKGKVLLGEEEALEDDSESRSDVSSSALTASVKDEISGELAASSGVSTPGSAGHDIITEQPRSQHTLQADSVDLASCDLTSSATDGDEEDILSHSSSQVSAVPSDPAMDLNDGTQASSPISDSSQTTTEGPDSAVTPSDSSEIVLDGTDNQYLGLQIGQPQDEDEEATGILPDEASEAFRNSSMALQQAHLLKNMSHCRQPSDSSVDKFVLRDEATEPGDQENKPCRIKGDIGQSTDDDSAPLVHCVRLLSASFLLTGGKNVLVPDRDVRVSVKALALSCVGAAVALHPESFFSKLYKVPLDTTEYPEEQYVSDILNYIDHGDPQVRGATAILCGTLICSILSRSRFHVGDWMGTIRTLTGNTFSLADCIPLLRKTLKDESSVTCKLACTAVRNCVMSLCSSSYSELGLQLIIDVLTLRNSSYWLVRTELLETLAEIDFRLVSFLEAKAENLHRGAHHYTGLLKLQERVLNNVVIHLLGDEDPRVRHVAAASLIRLVPKLFYKCDQGQADPVVAVARDQSSVYLKLLMHETQPPSHFSVSTITRIYRGYNLLPSITDVTMENNLSRVIAAVSHELITSTTRALTFGCCEALCLLSTAFPVCIWSLGWHCGVPPLSASDESRKSCTVGMATMILTLLSSAWFPLDLSAHQDALILAGNLLAASAPKSLRSSWASEEEANPAATKQEEVWPALGDRALVPMVEQLFSHLLKVINICAHVLDDVAPGPAIKAALPSLTNPPSLSPIRRKGKEKEPGEQASVPLSPKKGSEASAASRQSDTSGPVTTSKSSSLGSFYHLPSYLKLHDVLKATHANYKVTLDLQNSTEKFGGFLRSALDVLSQILELATLQDIGKCVEEILGYLKSCFSREPMMATVCVQQLLKTLFGTNLASQFDGLSSNPSKSQGRAQRLGSSSVRPGLYHYCFMAPYTHFTQALADASLRNMVQAEQENDTSGWFDVLQKVSTQLKTNLTSVTKNRADKNAIHNHIRLFEPLVIKALKQYTTTTCVQLQKQVLDLLAQLVQLRVNYCLLDSDQVFIGFVLKQFEYIEVGQFRESEAIIPNIFFFLVLLSYERYHSKQIIGIPKIIQLCDGIMASGRKAVTHAIPALQPIVHDLFVLRGTNKADAGKELETQKEVVVSMLLRLIQYHQVLEMFILVLQQCHKENEDKWKRLSRQIADIILPMLAKQQMHIDSHEALGVLNTLFEILAPSSLRPVDMLLRSMFVTPNTMASVSTVQLWISGILAILRVLISQSTEDIVLSRIQELSFSPYLISCTVINRLRDGDSTSTLEEHSEGKQIKNLPEETFSRFLLQLVGILLEDIVTKQLKVEMSEQQHTFYCQELGTLLMCLIHIFKSGMFRRITAAATRLFRSDGCGGSFYTLDSLNLRARSMITTHPALVLLWCQILLLVNHTDYRWWAEVQQTPKRHSLSSTKLLSPQMSGEEEDSDLAAKLGMCNREIVRRGALILFCDYVCQNLHDSEHLTWLIVNHIQDLISLSHEPPVQDFISAVHRNSAASGLFIQAIQSRCENLSTPTMLKKTLQCLEGIHLSQSGAVLTLYVDRLLCTPFRVLARMVDILACRRVEMLLAANLQSSMAQLPMEELNRIQEYLQSSGLAQRHQRLYSLLDRFRLSTMQDSLSPSPPVSSHPLDGDGHVSLETVSPDKDWYVHLVKSQCWTRSDSALLEGAELVNRIPAEDMNAFMMNSEFNLSLLAPCLSLGMSEISGGQKSALFEAAREVTLARVSGTVQQLPAVHHVFQPELPAEPAAYWSKLNDLFGDAALYQSLPTLARALAQYLVVVSKLPSHLHLPPEKEKDIVKFVVATLEALSWHLIHEQIPLSLDLQAGLDCCCLALQLPGLWSVVSSTEFVTHACSLIYCVHFILEAVAVQPGEQLLSPERRTNTPKAISEEEEEVDPNTQNPKYITAACEMVAEMVESLQSVLALGHKRNSGVPAFLTPLLRNIIISLARLPLVNSYTRVPPLVWKLGWSPKPGGDFGTAFPEIPVEFLQEKEVFKEFIYRINTLGWTSRTQFEETWATLLGVLVTQPLVMEQEESPPEEDTERTQINVLAVQAITSLVLSAMTVPVAGNPAVSCLEQQPRNKPLKALDTRFGRKLSIIRGIVEQEIQAMVSKRENIATHHLYQAWDPVPSLSPATTGALISHEKLLLQINPERELGSMSYKLGQVSIHSVWLGNSITPLREEEWDEEEEEEADAPAPSSPPTSPVNSRKHRAGVDIHSCSQFLLELYSRWILPSSSARRTPAILISEVVRSLLVVSDLFTERNQFELMYVTLTELRRVHPSEDEILAQYLVPATCKAAAVLGMDKAVAEPVSRLLESTLRSSHLPSRVGALHGVLYVLECDLLDDTAKQLIPVISDYLLSNLKGIAHCVNIHSQQHVLVMCATAFYLIENYPLDVGPEFSASIIQMCGVMLSGSEESTPSIIYHCALRGLERLLLSEQLSRLDAESLVKLSVDRVNVHSPHRAMAALGLMLTCMYTGKEKVSPGRTSDPNPAAPDSESVIVAMERVSVLFDRIRKGFPCEARVVARILPQFLDDFFPPQDIMNKVIGEFLSNQQPYPQFMATVVYKVFQTLHSTGQSSMVRDWVMLSLSNFTQRAPVAMATWSLSCFFVSASTSPWVAAILPHVISRMGKLEQVDVNLFCLVATDFYRHQIEEELDRRAFQSVLEVVAAPGSPYHRLLTCLRNVHKVTTC

SEQ ID NO: 889274 - protein, 3144 aa, Homo sapiens; identical to SEQ ID NO: 889273

SEQ ID NO: 889275 - protein, 281 aa, Homo sapiens
MLSGSEESTPSIIYHCALRGLERLLLSEQLSRLDAESLVKLSVDRVNVHSPHRAMAALGLMLTCMYTGKEKVSPGRTSDPNPAAPDSESVIVAMERVSVLFDRIRKGFPCEARVVARILPQFLDDFFPPQDIMNKVIGEFLSNQQPYPQFMATVVYKVFQTLHSTGQSSMVRDWVMLSLSNFTQRAPVAMATWSLSCFFVSASTSPWVAAILPHVISRMGKLEQVDVNLFCLVATDFYRHQIEEELDRRAFQSVLEVVAAPGSPYHRLLTCLRNVHKVTTC

SEQ ID NO: 889276 - protein, 2775 aa, Homo sapiens
MATLEKLMKAFESLKSFQQQQQQQQQQQQQQQQQQQQQQQPPPPPPPPPPPQLPQPPPQAQPLLPQPQPPPPPPPPPPGPAVAEEPLHRPKKELSATKKDRVNHCLTICENIVAQSVRNSPEFQKLLGIAMELFLLCSDDAESDVRMVADECLNKVIKALMDSNLPRLQLELYKEIKKNGAPRSLRAALWRFAELAHLVRPQKCRPYLVNLLPCLTRTSKRPEESVQETLAAAVPKIMASFGNFANDNEIKVLLKAFIANLKSSSPTIRRTAAGSAVSICQHSRRTQYFYSWLLNVLLGLLVPVEDEHSTLLILGVLLTLRYLVPLLQQQVKDTSLKGSFGVTRKEMEVSPSAEQLVQVYELTLHHTQHQDHNVVTGALELLQQLFRTPPPELLQTLTAVGGIGQLTAAKEESGGRSRSGSIVELIAGGGSSCSPVLSRKQKGKVLLGEEEALEDDSESRSDVSSSALTASVKDEISGELAASSGVSTPGSAGHDIITEQPRSQHTLQADSVDLASCDLTSSATDGDEEDILSHSSSQVSAVPSDPAMDLNDGTQASSPISDSSQTTTEGPDSAVTPSDSSEIVLDGTDNQYLGLQIGQPQDEDEEATGILPDEASEAFRNSSMALQQAHLLKNMSHCRQPSDSSVDKFVLRDEATEPGDQENKPCRIKGDIGQSTDDDSAPLVHCVRLLSASFLLTGGKNVLVPDRDVRVSVKALALSCVGAAVALHPESFFSKLYKVPLDTTEYPEEQYVSDILNYIDHGDPQVRGATAILCGTLICSILSRSRFHVGDWMGTIRTLTGNTFSLADCIPLLRKTLKDESSVTCKLACTAVRNCVMSLCSSSYSELGLQLIIDVLTLRNSSYWLVRTELLETLAEIDFRLVSFLEAKAENLHRGAHHYTGLLKLQERVLNNVVIHLLGDEDPRVRHVAAASLIRLVPKLFYKCDQGQADPVVAVARDQSSVYLKLLMHETQPPSHFSVSTITRIYRGYNLLPSITDVTMENNLSRVIAAVSHELITSTTRALTFGCCEALCLLSTAFPVCIWSLGWHCGVPPLSASDESRKSCTVGMATMILTLLSSAWFPLDLSAHQDALILAGNLLAASAPKSLRSSWASEEEANPAATKQEEVWPALGDRALVPMVEQLFSHLLKVINICAHVLDDVAPGPAIKAALPSLTNPPSLSPIRRKGKEKEPGEQASVPLSPKKGSEASAASRQSDTSGPVTTSKSSSLGSFYHLPSYLKLHDVLKATHANYKVTLDLQNSTEKFGGFLRSALDVLSQILELATLQDIGKCVEEILGYLKSCFSREPMMATVCVQQLLKTLFGTNLASQFDGLSSNPSKSQGRAQRLGSSSVRPGLYHYCFMAPYTHFTQALADASLRNMVQAEQENDTSGWFDVLQKVSTQLKTNLTSVTKNRADKNAIHNHIRLFEPLVIKALKQYTTTTCVQLQKQVLDLLAQLVQLRVNYCLLDSDQVFIGFVLKQFEYIEVGQFRESEAIIPNIFFFLVLLSYERYHSKQIIGIPKIIQLCDGIMASGRKAVTHAIPALQPIVHDLFVLRGTNKADAGKELETQKEVVVSMLLRLIQYHQVLEMFILVLQQCHKENEDKWKRLSRQIADIILPMLAKQQMHIDSHEALGVLNTLFEILAPSSLRPVDMLLRSMFVTPNTMASVSTVQLWISGILAILRVLISQSTEDIVLSRIQELSFSPYLISCTVINRLRDGDSTSTLEEHSEGKQIKNLPEETFSRFLLQLVGILLEDIVTKQLKVEMSEQQHTFYCQELGTLLMCLIHIFKSGMFRRITAAATRLFRSDGCGGSFYTLDSLNLRARSMITTHPALVLLWCQILLLVNHTDYRWWAEVQQTPKRHSLSSTKLLSPQMSGEEEDSDLAAKLGMCNREIVRRGALILFCDYVCQNLHDSEHLTWLIVNHIQDLISLSHEPPVQDFISAVHRNSAASGLFIQAIQSRCENLSTPTMLKKTLQCLEGIHLSQSGAVLTLYVDRLLCTPFRVLARMVDILACRRVEMLLAANLQSSMAQLPMEELNRIQEYLQSSGLAQRHQRLYSLLDRFRLSTMQDSLSPSPPVSSHPLDGDGHVSLETVSPDKDWYVHLVKSQCWTRSDSALLEGAELVNRIPAEDMNAFMMNSEFNLSLLAPCLSLGMSEISGGQKSALFEAAREVTLARVSGTVQQLPAVHHVFQPELPAEPAAYWSKLNDLFGDAALYQSLPTLARALAQYLVVVSKLPSHLHLPPEKEKDIVKFVVATLEALSWHLIHEQIPLSLDLQAGLDCCCLALQLPGLWSVVSSTEFVTHACSLIYCVHFILEAVAVQPGEQLLSPERRTNTPKAISEEEEEVDPNTQNPKYITAACEMVAEMVESLQSVLALGHKRNSGVPAFLTPLLRNIIISLARLPLVNSYTRVPPLVWKLGWSPKPGGDFGTAFPEIPVEFLQEKEVFKEFIYRINTLGWTSRTQFEETWATLLGVLVTQPLVMEQEESPPEEDTERTQINVLAVQAITSLVLSAMTVPVAGNPAVSCLEQQPRNKPLKALDTRFGRKLSIIRGIVEQEIQAMVSKRENIATHHLYQAWDPVPSLSPATTGALISHEKLLLQINPERELGSMSYKLGQVSIHSVWLGNSITPLREEEWDEEEEEEADAPAPSSPPTSPVNSRKHRAGVDIHSCSQFLLELYSRWILPSSSARRTPAILISEVVRSLLVVSDLFTERNQFELMYVTLTELRRVHPSEDEILAQYLVPATCKAAAVLGMARPGGPGTAVETPTLPQV

SEQ ID NO: 889277 - protein, 1653 aa, Homo sapiens
MATLEKLMKAFESLKSFQQQQQQQQQQQQQQQQQQQQQQQPPPPPPPPPPPQLPQPPPQAQPLLPQPQPPPPPPPPPPGPAVAEEPLHRPKKELSATKKDRVNHCLTICENIVAQSVRNSPEFQKLLGIAMELFLLCSDDAESDVRMVADECLNKVIKALMDSNLPRLQLELYKEIKKNGAPRSLRAALWRFAELAHLVRPQKCRPYLVNLLPCLTRTSKRPEESVQETLAAAVPKIMASFGNFANDNEIKVLLKAFIANLKSSSPTIRRTAAGSAVSICQHSRRTQYFYSWLLNVLLGLLVPVEDEHSTLLILGVLLTLRYLVPLLQQQVKDTSLKGSFGVTRKEMEVSPSAEQLVQVYELTLHHTQHQDHNVVTGALELLQQLFRTPPPELLQTLTAVGGIGQLTAAKEESGGRSRSGSIVELIAGGGSSCSPVLSRKQKGKVLLGEEEALEDDSESRSDVSSSALTASVKDEISGELAASSGVSTPGSAGHDIITEQPRSQHTLQADSVDLASCDLTSSATDGDEEDILSHSSSQVSAVPSDPAMDLNDGTQASSPISDSSQTTTEGPDSAVTPSDSSEIVLDGTDNQYLGLQIGQPQDEDEEATGILPDEASEAFRNSSMALQQAHLLKNMSHCRQPSDSSVDKFVLRDEATEPGDQENKPCRIKGDIGQSTDDDSAPLVHCVRLLSASFLLTGGKNVLVPDRDVRVSVKALALSCVGAAVALHPESFFSKLYKVPLDTTEYPEEQYVSDILNYIDHGDPQVRGATAILCGTLICSILSRSRFHVGDWMGTIRTLTGNTFSLADCIPLLRKTLKDESSVTCKLACTAVRNCVMSLCSSSYSELGLQLIIDVLTLRNSSYWLVRTELLETLAEIDFRLVSFLEAKAENLHRGAHHYTGLLKLQERVLNNVVIHLLGDEDPRVRHVAAASLIRLVPKLFYKCDQGQADPVVAVARDQSSVYLKLLMHETQPPSHFSVSTITRIYRGYNLLPSITDVTMENNLSRVIAAVSHELITSTTRALTFGCCEALCLLSTAFPVCIWSLGWHCGVPPLSASDESRKSCTVGMATMILTLLSSAWFPLDLSAHQDALILAGNLLAASAPKSLRSSWASEEEANPAATKQEEVWPALGDRALVPMVEQLFSHLLKVINICAHVLDDVAPGPAIKAALPSLTNPPSLSPIRRKGKEKEPGEQASVPLSPKKGSEASAASRQSDTSGPVTTSKSSSLGSFYHLPSYLKLHDVLKATHANYKVTLDLQNSTEKFGGFLRSALDVLSQILELATLQDIGKCVEEILGYLKSCFSREPMMATVCVQQLLKTLFGTNLASQFDGLSSNPSKSQGRAQRLGSSSVRPGLYHYCFMAPYTHFTQALADASLRNMVQAEQENDTSGWFDVLQKVSTQLKTNLTSVTKNRADKNAIHNHIRLFEPLVIKALKQYTTTTCVQLQKQVLDLLAQLVQLRVNYCLLDSDQVFIGFVLKQFEYIEVGQFRESEAIIPNIFFFLVLLSYERYHSKQIIGIPKIIQLCDGIMASGRKAVTHAIPALQPIVHDLFVLRGTNKADAGKELETQKEVVVSMLLRLIQYHQVRGMYVGTVVDTLLTRADGRKCHVVTLTVNCVTLNQVWAFWGLGRYAVFAKHQQSGCSFIFFKAFPNH

SEQ ID NO: 889278 - protein, 462 aa, Homo sapiens
MATLEKLMKAFESLKSFQQQQQQQQQQQQQQQQQQQQQQQPPPPPPPPPPPQLPQPPPQAQPLLPQPQPPPPPPPPPPGPAVAEEPLHRPKKELSATKKDRVNHCLTICENIVAQSVRNSPEFQKLLGIAMELFLLCSDDAESDVRMVADECLNKVIKALMDSNLPRLQLELYKEIKKNGAPRSLRAALWRFAELAHLVRPQKCRPYLVNLLPCLTRTSKRPEESVQETLAAAVPKIMASFGNFANDNEIKVLLKAFIANLKSSSPTIRRTAAGSAVSICQHSRRTQYFYSWLLNVLLGLLVPVEDEHSTLLILGVLLTLRYLVPLLQQQVKDTSLKGSFGVTRKEMEVSPSAEQLVQVYELTLHHTQHQDHNVVTGALELLQQLFRTPPPELLQTLTAVGGIGQLTAAKEESGGRSRSGSIVELIAGGGSSCSPVLSRKQKGDYFRNQSLVLNLTDFLVFL

SEQ ID NO: 889279 - protein, 447 aa, Homo sapiens
MATLEKLMKAFESLKSFQQQQQQQQQQQQQQQQQQQQQQQPPPPPPPPPPPQLPQPPPQAQPLLPQPQPPPPPPPPPPGPAVAEEPLHRPKKELSATKKDRVNHCLTICENIVAQSVRNSPEFQKLLGIAMELFLLCSDDAESDVRMVADECLNKVIKALMDSNLPRLQLELYKEIKKNGAPRSLRAALWRFAELAHLVRPQKCRPYLVNLLPCLTRTSKRPEESVQETLAAAVPKIMASFGNFANDNEIKVLLKAFIANLKSSSPTIRRTAAGSAVSICQHSRRTQYFYSWLLNVLLGLLVPVEDEHSTLLILGVLLTLRYLVPLLQQQVKDTSLKGSFGVTRKEMEVSPSAEQLVQVYELTLHHTQHQDHNVVTGALELLQQLFRTPPPELLQTLTAVGGIGQLTAAKEESGGRSRSGSIVELIGKLLARSTLTINFAVILVTLY

SEQ ID NO: 889280 - protein, 3144 aa, Homo sapiens; identical to SEQ ID NO: 889273

SEQ ID NO: 889281 - protein, 3144 aa, Homo sapiens; identical to SEQ ID NO: 889273

SEQ ID NO: 889282 - protein, 1321 aa, Homo sapiens
MIVPLCSSLGDTARRCLWGKKKETEPRGVQPSESGPFRRHSLSSTKLLSPQMSGEEEDSDLAAKLGMCNREIVRRGALILFCDYVCQNLHDSEHLTWLIVNHIQDLISLSHEPPVQDFISAVHRNSAASGLFIQAIQSRCENLSTPTMLKKTLQCLEGIHLSQSGAVLTLYVDRLLCTPFRVLARMVDILACRRVEMLLAANLQSSMAQLPMEELNRIQEYLQSSGLAQRHQRLYSLLDRFRLSTMQDSLSPSPPVSSHPLDGDGHVSLETVSPDKDWYVHLVKSQCWTRSDSALLEGAELVNRIPAEDMNAFMMNSEFNLSLLAPCLSLGMSEISGGQKSALFEAAREVTLARVSGTVQQLPAVHHVFQPELPAEPAAYWSKLNDLFGDAALYQSLPTLARALAQYLVVVSKLPSHLHLPPEKEKDIVKFVVATLEALSWHLIHEQIPLSLDLQAGLDCCCLALQLPGLWSVVSSTEFVTHACSLIYCVHFILEAVAVQPGEQLLSPERRTNTPKAISEEEEEVDPNTQNPKYITAACEMVAEMVESLQSVLALGHKRNSGVPAFLTPLLRNIIISLARLPLVNSYTRVPPLVWKLGWSPKPGGDFGTAFPEIPVEFLQEKEVFKEFIYRINTLGWTSRTQFEETWATLLGVLVTQPLVMEQEESPPEEDTERTQINVLAVQAITSLVLSAMTVPVAGNPAVSCLEQQPRNKPLKALDTRFGRKLSIIRGIVEQEIQAMVSKRENIATHHLYQAWDPVPSLSPATTGALISHEKLLLQINPERELGSMSYKLGQVSIHSVWLGNSITPLREEEWDEEEEEEADAPAPSSPPTSPVNSRKHRAGVDIHSCSQFLLELYSRWILPSSSARRTPAILISEVVRSLLVVSDLFTERNQFELMYVTLTELRRVHPSEDEILAQYLVPATCKAAAVLGMDKAVAEPVSRLLESTLRSSHLPSRVGALHGVLYVLECDLLDDTAKQLIPVISDYLLSNLKGIAHCVNIHSQQHVLVMCATAFYLIENYPLDVGPEFSASIIQMCGVMLSGSEESTPSIIYHCALRGLERLLLSEQLSRLDAESLVKLSVDRVNVHSPHRAMAALGLMLTCMYTGKEKVSPGRTSDPNPAAPDSESVIVAMERVSVLFDRIRKGFPCEARVVARILPQFLDDFFPPQDIMNKVIGEFLSNQQPYPQFMATVVYKVFQTLHSTGQSSMVRDWVMLSLSNFTQRAPVAMATWSLSCFFVSASTSPWVAAILPHVISRMGKLEQVDVNLFCLVATDFYRHQIEEELDRRAFQSVLEVVAAPGSPYHRLLTCLRNVHKVTTC

SEQ ID NO: 889283 - protein, 606 aa, Homo sapiens
FFLKCRFGRKLSIIRGIVEQEIQAMVSKRENIATHHLYQAWDPVPSLSPATTGALISHEKLLLQINPERELGSMSYKLGQVSIHSVWLGNSITPLREEEWDEEEEEEADAPAPSSPPTSPVNSRKHRAGVDIHSCSQFLLELYSRWILPSSSARRTPAILISEVVRSLLVVSDLFTERNQFELMYVTLTELRRVHPSEDEILAQYLVPATCKAAAVLGMDKAVAEPVSRLLESTLRSSHLPSRVGALHGVLYVLECDLLDDTAKQLIPVISDYLLSNLKGIAHCVNIHSQQHVLVMCATAFYLIENYPLDVGPEFSASIIQMCGVMLSGSEESTPSIIYHCALRGLERLLLSEQLSRLDAESLVKLSVDRVNVHSPHRAMAALGLMLTCMYTGKEKVSPGRTSDPNPAAPDSESVIVAMERVSVLFDRIRKGFPCEARVVARILPQFLDDFFPPQDIMNKVIGEFLSNQQPYPQFMATVVYKVFQTLHSTGQSSMVRDWVMLSLSNFTQRAPVAMATWSLSCFFVSASTSPWVAAILPHVISRMGKLEQVDVNLFCLVATDFYRHQIEEELDRRAFQSVLEVVAAPGSPYHRLLTCLRNVHKVTTC

SEQ ID NO: 889284 - protein, 2940 aa, Homo sapiens
MATLEKLMKAFESLKSFQQQQQQQQQQQQQQQQQQQQQQQPPPPPPPPPPPQLPQPPPQAQPLLPQPQPPPPPPPPPPGPAVAEEPLHRPKKELSATKKDRVNHCLTICENIVAQSVRNSPEFQKLLGIAMELFLLCSDDAESDVRMVADECLNKVIKALMDSNLPRLQLELYKEIKKNGAPRSLRAALWRFAELAHLVRPQKCRPYLVNLLPCLTRTSKRPEESVQETLAAAVPKIMASFGNFANDNEIKVLLKAFIANLKSSSPTIRRTAAGSAVSICQHSRRTQYFYSWLLNVLLGLLVPVEDEHSTLLILGVLLTLRYLVPLLQQQVKDTSLKGSFGVTRKEMEVSPSAEQLVQVYELTLHHTQHQDHNVVTGALELLQQLFRTPPPELLQTLTAVGGIGQLTAAKEESGGRSRSGSIVELIAGGGSSCSPVLSRKQKGKVLLGEEEALEDDSESRSDVSSSALTASVKDEISGELAASSGVSTPGSAGHDIITEQPRSQHTLQADSVDLASCDLTSSATDGDEEDILSHSSSQVSAVPSDPAMDLNDGTQASSPISDSSQTTTEGPDSAVTPSDSSEIVLDGTDNQYLGLQIGQPQDEDEEATGILPDEASEAFRNSSMALQQAHLLKNMSHCRQPSDSSVDKFVLRDEATEPGDQENKPCRIKGDIGQSTDDDSAPLVHCVRLLSASFLLTGGKNVLVPDRDVRVSVKALALSCVGAAVALHPESFFSKLYKVPLDTTEYPEEQYVSDILNYIDHGDPQVRGATAILCGTLICSILSRSRFHVGDWMGTIRTLTGNTFSLADCIPLLRKTLKDESSVTCKLACTAVRNCVMSLCSSSYSELGLQLIIDVLTLRNSSYWLVRTELLETLAEIDFRLVSFLEAKAENLHRGAHHYTGLLKLQERVLNNVVIHLLGDEDPRVRHVAAASLIRLVPKLFYKCDQGQADPVVAVARDQSSVYLKLLMHETQPPSHFSVSTITRIYRGYNLLPSITDVTMENNLSRVIAAVSHELITSTTRALTFGCCEALCLLSTAFPVCIWSLGWHCGVPPLSASDESRKSCTVGMATMILTLLSSAWFPLDLSAHQDALILAGNLLAASAPKSLRSSWASEEEANPAATKQEEVWPALGDRALVPMVEQLFSHLLKVINICAHVLDDVAPGPAIKAALPSLTNPPSLSPIRRKGKEKEPGEQASVPLSPKKGSEASAASRQSDTSGPVTTSKSSSLGSFYHLPSYLKLHDVLKATHANYKVTLDLQNSTEKFGGFLRSALDVLSQILELATLQDIGKCVEEILGYLKSCFSREPMMATVCVQQLLKTLFGTNLASQFDGLSSNPSKSQGRAQRLGSSSVRPGLYHYCFMAPYTHFTQALADASLRNMVQAEQENDTSGWFDVLQKVSTQLKTNLTSVTKNRADKNAIHNHIRLFEPLVIKALKQYTTTTCVQLQKQVLDLLAQLVQLRVNYCLLDSDQVFIGFVLKQFEYIEVGQFRESEAIIPNIFFFLVLLSYERYHSKQIIGIPKIIQLCDGIMASGRKAVTHAIPALQPIVHDLFVLRGTNKADAGKELETQKEVVVSMLLRLIQYHQVLEMFILVLQQCHKENEDKWKRLSRQIADIILPMLAKQQMHIDSHEALGVLNTLFEILAPSSLRPVDMLLRSMFVTPNTMASVSTVQLWISGILAILRVLISQSTEDIVLSRIQELSFSPYLISCTVINRLRDGDSTSTLEEHSEGKQIKNLPEETFSRFLLQLVGILLEDIVTKQLKVEMSEQQHTFYCQELGTLLMCLIHIFKSGMFRRITAAATRLFRSDGCGGSFYTLDSLNLRARSMITTHPALVLLWCQILLLVNHTDYRWWAEVQQTPKRHSLSSTKLLSPQMSGEEEDSDLAAKLGMCNREIVRRGALILFCDYVCQNLHDSEHLTWLIVNHIQDLISLSHEPPVQDFISAVHRNSAASGLFIQAIQSRCENLSTPTMLKKTLQCLEGIHLSQSGAVLTLYVDRLLCTPFRVLARMVDILACRRVEMLLAANLQSSMAQLPMEELNRIQEYLQSSGLAQRHQRLYSLLDRFRLSTMQDSLSPSPPVSSHPLDGDGHVSLETVSPDKDWYVHLVKSQCWTRSDSALLEGAELVNRIPAEDMNAFMMNSEFNLSLLAPCLSLGMSEISGGQKSALFEAAREVTLARVSGTVQQLPAVHHVFQPELPAEPAAYWSKLNDLFGDAALYQSLPTLARALAQYLVVVSKLPSHLHLPPEKEKDIVKFVVATLEALSWHLIHEQIPLSLDLQAGLDCCCLALQLPGLWSVVSSTEFVTHACSLIYCVHFILEAVAVQPGEQLLSPERRTNTPKAISEEEEEVDPNTQNPKYITAACEMVAEMVESLQSVLALGHKRNSGVPAFLTPLLRNIIISLARLPLVNSYTRVPPLVWKLGWSPKPGGDFGTAFPEIPVEFLQEKEVFKEFIYRINTLGWTSRTQFEETWATLLGVLVTQPLVMEQEESPPEEDTERTQINVLAVQAITSLVLSAMTVPVAGNPAVSCLEQQPRNKPLKALDTRFGRKLSIIRGIVEQEIQAMVSKRENIATHHLYQAWDPVPSLSPATTGALISHEKLLLQINPERELGSMSYKLGQVSIHSVWLGNSITPLREEEWDEEEEEEADAPAPSSPPTSPVNSRKHRAGVDIHSCSQFLLELYSRWILPSSSARRTPAILISEVVRSLLVVSDLFTERNQFELMYVTLTELRRVHPSEDEILAQYLVPATCKAAAVLGMDKAVAEPVSRLLESTLRSSHLPSRVGALHGVLYVLECDLLDDTAKQLIPVISDYLLSNLKGIAHCVNIHSQQHVLVMCATAFYLIENYPLDVGPEFSASIIQMCGVMLSGSEELYATPAGTQLRCRTQHTTLTDPPHSTQLRCRTQHMTLTQTLHTAHNSDATHSTQHSYTAQQHMTHTDATP

SEQ ID NO: 889285 - protein, 1391 aa, Homo sapiens
MATLEKLMKAFESLKSFQQQQQQQQQQQQQQQQQQQQQQQPPPPPPPPPPPQLPQPPPQAQPLLPQPQPPPPPPPPPPGPAVAEEPLHRPKKELSATKKDRVNHCLTICENIVAQSVRNSPEFQKLLGIAMELFLLCSDDAESDVRMVADECLNKVIKALMDSNLPRLQLELYKEIKKNGAPRSLRAALWRFAELAHLVRPQKCRPYLVNLLPCLTRTSKRPEESVQETLAAAVPKIMASFGNFANDNEIKVLLKAFIANLKSSSPTIRRTAAGSAVSICQHSRRTQYFYSWLLNVLLGLLVPVEDEHSTLLILGVLLTLRYLVPLLQQQVKDTSLKGSFGVTRKEMEVSPSAEQLVQVYELTLHHTQHQDHNVVTGALELLQQLFRTPPPELLQTLTAVGGIGQLTAAKEESGGRSRSGSIVELIAGGGSSCSPVLSRKQKGKVLLGEEEALEDDSESRSDVSSSALTASVKDEISGELAASSGVSTPGSAGHDIITEQPRSQHTLQADSVDLASCDLTSSATDGDEEDILSHSSSQVSAVPSDPAMDLNDGTQASSPISDSSQTTTEGPDSAVTPSDSSEIVLDGTDNQYLGLQIGQPQDEDEEATGILPDEASEAFRNSSMALQQAHLLKNMSHCRQPSDSSVDKFVLRDEATEPGDQENKPCRIKGDIGQSTDDDSAPLVHCVRLLSASFLLTGGKNVLVPDRDVRVSVKALALSCVGAAVALHPESFFSKLYKVPLDTTEYPEEQYVSDILNYIDHGDPQVRGATAILCGTLICSILSRSRFHVGDWMGTIRTLTGNTFSLADCIPLLRKTLKDESSVTCKLACTAVRNCVMSLCSSSYSELGLQLIIDVLTLRNSSYWLVRTELLETLAEIDFRLVSFLEAKAENLHRGAHHYTGLLKLQERVLNNVVIHLLGDEDPRVRHVAAASLIRLVPKLFYKCDQGQADPVVAVARDQSSVYLKLLMHETQPPSHFSVSTITRIYRGYNLLPSITDVTMENNLSRVIAAVSHELITSTTRALTFGCCEALCLLSTAFPVCIWSLGWHCGVPPLSASDESRKSCTVGMATMILTLLSSAWFPLDLSAHQDALILAGNLLAASAPKSLRSSWASEEEANPAATKQEEVWPALGDRALVPMVEQLFSHLLKVINICAHVLDDVAPGPAIKAALPSLTNPPSLSPIRRKGKEKEPGEQASVPLSPKKGSEASAASRQSDTSGPVTTSKSSSLGSFYHLPSYLKLHDVLKATHANYKVTLDLQNSTEKFGGFLRSALDVLSQILELATLQDIGKCVEEILGYLKSCFSREPMMATVCVQQLLKTLFGTNLASQFDGLSSNPSKSQGRAQRLGSSSVRPGLYHYCFMAPYTHFTQALADASLRNMVQAEQENDTSG

SEQ ID NO: 889286 - protein, 858 aa, Homo sapiens
MATLEKLMKAFESLKSFQQQQQQQQQQQQQQQQQQQQQQQPPPPPPPPPPPQLPQPPPQAQPLLPQPQPPPPPPPPPPGPAVAEEPLHRPKKELSATKKDRVNHCLTICENIVAQSVRNSPEFQKLLGIAMELFLLCSDDAESDVRMVADECLNKVIKALMDSNLPRLQLELYKEIKKNGAPRSLRAALWRFAELAHLVRPQKCRPYLVNLLPCLTRTSKRPEESVQETLAAAVPKIMASFGNFANDNEIKVLLKAFIANLKSSSPTIRRTAAGSAVSICQHSRRTQYFYSWLLNVLLGLLVPVEDEHSTLLILGVLLTLRYLVPLLQQQVKDTSLKGSFGVTRKEMEVSPSAEQLVQVYELTLHHTQHQDHNVVTGALELLQQLFRTPPPELLQTLTAVGGIGQLTAAKEESGGRSRSGSIVELIAGGGSSCSPVLSRKQKGKVLLGEEEALEDDSESRSDVSSSALTASVKDEISGELAASSGVSTPGSAGHDIITEQPRSQHTLQADSVDLASCDLTSSATDGDEEDILSHSSSQVSAVPSDPAMDLNDGTQASSPISDSSQTTTEGPDSAVTPSDSSEIVLDGTDNQYLGLQIGQPQDEDEEATGILPDEASEAFRNSSMALQQAHLLKNMSHCRQPSDSSVDKFVLRDEATEPGDQENKPCRIKGDIGQSTDDDSAPLVHCVRLLSASFLLTGGKNVLVPDRDVRVSVKALALSCVGAAVALHPESFFSKLYKVPLDTTEYPEEQYVSDILNYIDHGDPQVRGATAILCGTLICSILSRSRFHVGDWMGTIRTLTGNTFSLADCIPLLRKTLKDESSVTCKLACTAVRVSIIFCGTISSLSGHFIIATIKIGA

SEQ ID NO: 889287 - protein, 98 aa, Homo sapiens [sequence omitted]

SEQ ID NO: 889288 - protein, 419 aa, Homo sapiens
EGGDVFGSGTHHFSCVLGSFRVSAMFPRVSTFLPLRPLSRHPLSSGSPETSAAAIMLLTVRHGTVRYRSSALLARTKNNIQRYFGTNSVICSKKDKQSVRTEETSKETSESQDSEKENTKKDLLGIIKGMKVELSTVNVRTTKPPKRRPLKSLEATLGRLRRATEYAPKKRIEPLSPELVAAASAVADSLPFDKQTTKSELLSQLQQHEEESRAQRDAKRPKISFSNIISDMKVARSATARVRSRPELRIQFDEGYDNYPGQEKTDDLKKRKNIFTGKRLNIFDMMAVTKEAPETDTSPSLWDVEFAKQLATVNEQPLQNGFEELIQWTKEGKLWEFPINNEAGFDDDGSEFHEHIFLEKHLESFPKQGPIRHFMELVTCGLSKNPYLSVKQKVEHIEWFRNYFNEKKDILKESNIQFN

SEQ ID NO: 889289 - protein, 419 aa, Homo sapiens; identical to SEQ ID NO: 889288

SEQ ID NO: 889290 - protein, 406 aa, Homo sapiens
EGGDVFGSGTHHFSCVLGSFRVSAMFPRVSTFLPLRPLSRHPLSSGSPETSAAAIMLLTVRHGTVRYRSSALLARTKNNIQRYFGTNSVICSKKDKQSVRTEETSKETSESQDSEKENTKKDLLGIIKGMKVELSTVNVRTTKPPKRRPLKSLEATLGRLRRATEYAPKKRIEPLSPELVAAASAVADSLPFDKQTTKSELLSQLQQHEEESRAQRDAKRPKISFSNIISDMKVARSATARVRSRPELRIQFDEGYDNYPGQEKTDDLKKRKNIFTGKRLNIFDMMAVTKEAPETDTSPSLWDVEFAKQLATVNEQPLQNGFEELIQWTKEGKLWEFPINNEAGFDDDGSEFHEHIFLTHPPNPILRQCLADNLGWPQKLFIPDSMCVSAYGGHGGPHLCFFLPLV

SEQ ID NO: 889291 - protein, 275 aa, Homo sapiens
EGGDVFGSGTHHFSCVLGSFRVSAMFPRVSTFLPLRPLSRHPLSSGSPETSAAAIMLLTVRHGTVRYRSSALLARTKNNIQRYFGTNSVICSKKDKQSVRTEETSKETSESQDSEKENTKKDLLGIIKGMKVELSTVNVRTTKPPKRRPLKSLEATLGRLRRATEYAPKKRIEPLSPELVAAASAVADSLPFDKQTTKSELLSQLQQHEEESRAQRDAKRPKISFSNIISDMKVARSATARVRSRPELRIQFDEGYDNYPGQEKTDDLKKRYQAL

SEQ ID NO: 889292 - protein, 275 aa, Homo sapiens; identical to SEQ ID NO: 889291

SEQ ID NO: 889293 - protein, 418 aa, Homo sapiens
KTLPRLELARALGGGCRSFRVSAMFPRVSTFLPLRPLSRHPLSSGSPETSAAAIMLLTVRHGTVRYRSSALLARTKNNIQRYFGTNSVICSKKDKQSVRTEETSKETSESQDSEKENTKKDLLGIIKGMKVELSTVNVRTTKPPKRRPLKSLEATLGRLRRATEYAPKKRIEPLSPELVAAASAVADSLPFDKQTTKSELLSQLQQHEEESRAQRDAKRPKISFSNIISDMKVARSATARVRSRPELRIQFDEGYDNYPGQEKTDDLKKRKNIFTGKRLNIFDMMAVTKEAPETDTSPSLWDVEFAKQLATVNEQPLQNGFEELIQWTKEGKLWEFPINNEAGFDDDGSEFHEHIFLEKHLESFPKQGPIRHFMELVTCGLSKNPYLSVKQKVEHIEWFRNYFNEKKDILKESNIQFN

SEQ ID NO: 889294 - protein, 430 aa, Homo sapiens
WQHESASQVVFWCAEHGHWLMSLLKILRIDCTKLPFGLLYPRTTLVLASWKAARDTVHTESRMDVKTVIREQCYTSGVEVKFQLDWTKNNIQRYFGTNSVICSKKDKQSVRTEETSKETSESQDSEKENTKKDLLGIIKGMKVELSTVNVRTTKPPKRRPLKSLEATLGRLRRATEYAPKKRIEPLSPELVAAASAVADSLPFDKQTTKSELLSQLQQHEEESRAQRDAKRPKISFSNIISDMKVARSATARVRSRPELRIQFDEGYDNYPGQEKTDDLKKRKNIFTGKRLNIFDMMAVTKEAPETDTSPSLWDVEFAKQLATVNEQPLQNGFEELIQWTKEGKLWEFPINNEAGFDDDGSEFHEHIFLEKHLESFPKQGPIRHFMELVTCGLSKNPYLSVKQKVEHIEWFRNYFNEKKDILKESNIQFN

SEQ ID NO: 889295 - protein, 410 aa, Homo sapiens
EGGDVFGSGTHHFSCVLGSFRVSAMFPRVSTFLPLRPLSRHPLSSGSPETSAAAIMLLTVRHGTVRTKNNIQRYFGTNSVICSKKDKQSVRTEETSKETSESQDSEKENTKKDLLGIIKGMKVELSTVNVRTTKPPKRRPLKSLEATLGRLRRATEYAPKKRIEPLSPELVAAASAVADSLPFDKQTTKSELLSQLQQHEEESRAQRDAKRPKISFSNIISDMKVARSATARVRSRPELRIQFDEGYDNYPGQEKTDDLKKRKNIFTGKRLNIFDMMAVTKEAPETDTSPSLWDVEFAKQLATVNEQPLQNGFEELIQWTKEGKLWEFPINNEAGFDDDGSEFHEHIFLEKHLESFPKQGPIRHFMELVTCGLSKNPYLSVKQKVEHIEWFRNYFNEKKDILKESNIQFN

SEQ ID NO: 889296 - protein, 366 aa, Homo sapiens
EGGDVFGSGTHHFSCVLGSFRVSAMFPRVSTFLPLRPLSRHPLSSGSPETSAAAIMLLTVRHGTVRYRSSALLARTKNNIQRYFGTNSVICSKKDKQSVRTEETSKETSESQDSEKENTKKDLLGIIKGMKVELSTVNVRTTKPPKRRPLKSLEATLGRLRRATEYAPKKSFSNIISDMKVARSATARVRSRPELRIQFDEGYDNYPGQEKTDDLKKRKNIFTGKRLNIFDMMAVTKEAPETDTSPSLWDVEFAKQLATVNEQPLQNGFEELIQWTKEGKLWEFPINNEAGFDDDGSEFHEHIFLEKHLESFPKQGPIRHFMELVTCGLSKNPYLSVKQKVEHIEWFRNYFNEKKDILKESNIQFN

SEQ ID NO: 889297 - protein, 323 aa, Homo sapiens
EGGDVFGSGTHHFSCVLGSFRVSAMFPRVSTFLPLRPLSRHPLSSGSPETSAAAIMLLTVRHGTVRYRSSALLARIEPLSPELVAAASAVADSLPFDKQTTKSELLSQLQQHEEESRAQRDAKRPKISFSNIISDMKVARSATARVRSRPELRIQFDEGYDNYPGQEKTDDLKKRKNIFTGKRLNIFDMMAVTKEAPETDTSPSLWDVEFAKQLATVNEQPLQNGFEELIQWTKEGKLWEFPINNEAGFDDDGSEFHEHIFLEKHLESFPKQGPIRHFMELVTCGLSKNPYLSVKQKVEHIEWFRNYFNEKKDILKESNIQFN

SEQ ID NO: 889298 - protein, 132 aa, Homo sapiens
VAFCETAGDTSPSLWDVEFAKQLATVNEQPLQNGFEELIQWTKEGKLWEFPINNEAGFDDDGSEFHEHIFLEKHLESFPKQGPIRHFMELVTCGLSKNPYLSVKQKVEHIEWFRNYFNEKKDILKESNIQFN

SEQ ID NO: 889299 - protein, 425 aa, Homo sapiens
MAPITTSREEFDEIPTVVGIFSAFGLVFTVSLFAWICCQRKSSKSNKTPPYKFVHVLKGVDIYPENLNSKKKFGADDKNEVKNKPAVPKNSLHLDLEKRDLNGNFPKTNLKPGSPSDLENATPKLFLEGEKESVSPESLKSSTSLTSEEKQEKLGTLFFSLEYNFERKAFVVNIKEARGLPAMDEQSMTSDPYIKMTILPEKKHKVKTRVLRKTLDPAFDETFTFYGIPYTQIQELALHFTILSFDRFSRDDIIGEVLIPLSGIELSEGKMLMNREIIKRNVRKSSGRGELLISLCYQSTTNTLTVVVLKARHLPKSDVSGLSDPYVKVNLYHAKKRISKKKTHVKKCTPNAVFNELFVFDIPCEGLEDISVEFLVLDSERGSRNEVIGQLVLGAAAEGTGGEHWKEICDYPRRQIAKWHVLCDG

SEQ ID NO: 889300 - protein, 425 aa, Homo sapiens; identical to SEQ ID NO: 889299

SEQ ID NO: 889301 - protein, 173 aa, Homo sapiens
ASINLQDQLEKTGENKGWSDPTPGFPEPTNNTPKGILHLSPDVYQEMEASRHKVISGTTLGYLSPKDMNQPSSSFFSISPTSNSSATIARELLMNGTSSTAEAIGLKGSSPTPPCSPVQPSKQLEYLARIQGFQVHYCDRQSGKECVTCLTLAPVQMTFHAIGSSIEASHDQV

SEQ ID NO: 889302 - protein, 173 aa, Homo sapiens; identical to SEQ ID NO: 889301

SEQ ID NO: 889303 - protein, 173 aa, Homo sapiens; identical to SEQ ID NO: 889301

SEQ ID NO: 889304 - protein, 307 aa, Homo sapiens
MAEISDLDRQIEQLRRCELIKESEVKALCAKAREILVEESNVQRVDSPVTVCGDIHGQFYDLKELFRVGGDVPETNYLFMGDFVDRGFYSVETFLLLLALKVRYPDRITLIRGNHESRQITQVYGFYDECLRKYGSVTVWRYCTEIFDYLSLSAIIDGKIFCVHGGLSPSIQTLDQIRTIDRKQEVPHDGPMCDLLWSDPEDTTGWGVSPRGAGYLFGSDVVAQFNAANDIDMICRAHQLVMEGYKWHFNETVLTVWSAPNYCYRCGNVAAILELDEHLQKDFIIFEAAPQETRGIPSKKPVADYFL

SEQ ID NO: 889305 - protein, 307 aa, Homo sapiens; identical to SEQ ID NO: 889304

SEQ ID NO: 889306 - protein, 319 aa, Homo sapiens
MAEISDLDRQIEQLRRCELIKESEVKALCAKAREILVEESNVQRVDSPVTVCGDIHGQFYDLKELFRVGGDVPETNYLFMGDFVDRGFYSVETFLLLLALKVRYPDRITLIRGNHESRQITQVYGFYDECLRKYGSVTVWRYCTEIFDYLSLSAIIDGKIFCVHGGLSPSIQTLDQIRTIDRKQEVPHDGPMCDLLWSDPEDTTGWGVSPRGAGYLFGSDVVAQFNAANDIDMICRAHQLVMEGYKWHFNETVLTVWSAPNYCYRCGNVAAILELDEHLQKDFIIFEAAPQETRGIPSKKPVADYFLWPPPTLLALAPL

SEQ ID NO: 889307 - protein, 363 aa, Homo sapiens
REHAGSTTRCGVVDLGLKYEGMGAGEPRTGDRQRRETPVRCGGGGGPDSDPRRGWAMAEISDLDRQIEQLRRCELIKESEVKALCAKAREILVEESNVQRVDSPVTVCGDIHGQFYDLKELFRVGGDVPETNYLFMGDFVDRGFYSVETFLLLLALKVRYPDRITLIRGNHESRQITQVYGFYDECLRKYGSVTVWRYCTEIFDYLSLSAIIDGKIFCVHGGLSPSIQTLDQIRTIDRKQEVPHDGPMCDLLWSDPEDTTGWGVSPRGAGYLFGSDVVAQFNAANDIDMICRAHQLVMEGYKWHFNETVLTVWSAPNYCYRCGNVAAILELDEHLQKDFIIFEAAPQETRGIPSKKPVADYFL

SEQ ID NO: 889308 - protein, 228 aa, Homo sapiens
MGDFVDRGFYSVETFLLLLALKVRYPDRITLIRGNHESRQITQVYGFYDECLRKYGSVTVWRYCTEIFDYLSLSAIIDGKIFCVHGGLSPSIQTLDQIRTIDRKQEVPHDGPMCDLLWSDPEDTTGWGVSPRGAGYLFGSDVVAQFNAANDIDMICRAHQLVMEGYKWHFNETVLTVWSAPNYCYRCGNVAAILELDEHLQKDFIIFEAAPQETRGIPSKKPVADYFL

SEQ ID NO: 889309 - protein, 342 aa, Homo sapiens
MAEISDLDRQIEQLRRCELIKESEVKALCAKAREILVEESNVQRVDSPVTVCGDIHGQFYDLKELFRVGGDVPETNYLFMGDFVDRGFYSVETFLLLLALKVRYPDRITLIRGNHESRQITQVYGFYDECLRKYGSVTVWRYCTEIFDYLSLSAIIDGKIFCVHGGLSPSIQTLDQIRTIDRKQEVPHDGPMCDLLWSDPEDTTGWGVSPRGAGYLFGSDVVAQFNAANDIDMICRAHQLVMEGYKWHFNETVLTVWSAPNYCYRCGNVAAILELDEHLQKDFIIFEAAPQETRGIPPRPAPAPSNPSGPRTTVTLPSSSDGGWAWGGAVLALLSPKRVLRG

SEQ ID NO: 889310 - protein, 228 aa, Homo sapiens; identical to SEQ ID NO: 889308

SEQ ID NO: 889311 - protein, 286 aa, Homo sapiens
MAEISDLDRQIEQLRRCELIKESEVKALCAKAREILVEESNVQRVDSPVTVCGDIHGQFYDLKELFRVGGDVPETNYLFMGDFVDRGFYSVETFLLLLALKVRYPDRITLIRGNHESRQITQVYGFYDECLRKYGSVTVWRYCTEIFDYLSLSAIIDGKIFCVHGGLSPSIQTLDQIRTIDRKQEVPHDGPMCDLLWSDPEDTTGWGVSPRGAGYLFGSDVVAQFNAANDIDMICRAHQLVMEGYKWHFNETVLTVWSAPNYCYRVRTSLERPGDLAPCSSSSLPT

SEQ ID NO: 889312 - protein, 341 aa, Homo sapiens
MAEISDLDRQIEQLRRCELIKESEVKALCAKAREILVEESNVQRVDSPVTVCGDIHGQFYDLKELFRVGGDVPETNYLFMGDFVDRGFYSVETFLLLLALKVRYPDRITLIRGNHESRQITQVYGFYDECLRKYGSVTVWRYCTEIFDYLSLSAIIDGKIFCVHGGLSPSIQTLDQIRTIDRKQEVPHDGPMCDLLWSDPEDTTGWGVSPRGAGYLFGSDVVAQFNAANDIDMICRAHQLVMEGYKWHFNETVLTVWSAPNYCYRCGNVAAILELDEHLQKDFIIFEAVCCPPRGCFEGEDFSGEAWRPSSMFLLLSPHLNHEVSNNFFFFFSFFFLFVFR

SEQ ID NO: 889313 - protein, 257 aa, Homo sapiens
TSSQIASDLELVKELFRVGGDVPETNYLFMGDFVDRGFYSVETFLLLLALKVRYPDRITLIRGNHESRQITQVYGFYDECLRKYGSVTVWRYCTEIFDYLSLSAIIDGKIFCVHGGLSPSIQTLDQIRTIDRKQEVPHDGPMCDLLWSDPEDTTGWGVSPRGAGYLFGSDVVAQFNAANDIDMICRAHQLVMEGYKWHFNETVLTVWSAPNYCYRCGNVAAILELDEHLQKDFIIFEAAPQETRGIPSKKPVADYFL

SEQ ID NO: 889314 - protein, 254 aa, Homo sapiens
MPHDSGKRCQECAGQWLLGWQAGGHEEVREGCVERPSRRQPWLGGHPQVRYPDRITLIRGNHESRQITQVYGFYDECLRKYGSVTVWRYCTEIFDYLSLSAIIDGKIFCVHGGLSPSIQTLDQIRTIDRKQEVPHDGPMCDLLWSDPEDTTGWGVSPRGAGYLFGSDVVAQFNAANDIDMICRAHQLVMEGYKWHFNETVLTVWSAPNYCYRCGNVAAILELDEHLQKDFIIFEAAPQETRGIPSKKPVADYFL

SEQ ID NO: 889315 - protein, 254 aa, Homo sapiens; identical to SEQ ID NO: 889314

SEQ ID NO: 889316 - protein, 273 aa, Homo sapiens
MAEISDLDRQIEQLRRCELIKESEVKALCAKAREILVEESNVQRVDSPVTVCGDIHGQFYDLKELFRVRYPDRITLIRGNHESRQITQVYGFYDECLRKYGSVTVWRYCTEIFDYLSLSAIIDGKIFCVHGGLSPSIQTLDQIRTIDRKQEVPHDGPMCDLLWSDPEDTTGWGVSPRGAGYLFGSDVVAQFNAANDIDMICRAHQLVMEGYKWHFNETVLTVWSAPNYCYRCGNVAAILELDEHLQKDFIIFEAAPQETRGIPSKKPVADYFL

SEQ ID NO: 889317 - protein, 254 aa, Homo sapiens; identical to SEQ ID NO: 889314

SEQ ID NO: 889318 - protein, 225 aa, Homo sapiens
MAEISDLDRQIEQLRRCELIKESEVKALCAKAREILVEESNVQRVDSPVTVCGDIHGQFYDLKELFRVGGDVPETNYLFMGDFVDRGFYSVETFLLLLALKVRYPDRITLIRGNHESRQITQVYGFYDECLRKYGSVTVVAQFNAANDIDMICRAHQLVMEGYKWHFNETVLTVWSAPNYCYRCGNVAAILELDEHLQKDFIIFEAAPQETRGIPSKKPVADYFL

SEQ ID NO: 889319 - protein, 115 aa, Homo sapiens
REREREREREREREREREREAGYLFGSDVVAQFNAANDIDMICRAHQLVMEGYKWHFNETVLTVWSAPNYCYRCGNVAAILELDEHLQKDFIIFEAAPQETRGIPSKKPVADYFL

SEQ ID NO: 889320 - protein, 225 aa, Homo sapiens
MAEISDLDRQIEQLRRCELIKESEVKALCAKAREILVEESNVQRVDSPVTVCGDIHGQFYDLKELFRVGGDVPETNYLFMGDFVDRGFYSVETFLLLLALKVRYPDRITLIRGNHESRQITQVYGFYDECLRKYGSVTVWRYCTEIFDYLSLSAIIDGKTPPGPCPLQPFWPSHHCDSAIFLRRRLGVGGGCPGSAVPQEGASRVRTSLERPGDLAPCSSSSLPT

SEQ ID NO: 889321 - protein, 120 aa, Homo sapiens
MAEISDLDRQIEQLRRCELIKESEVKALCAKAREILVEESNVQRVDSPVTVCGDIHGQFYDLKELFRVGGDVPETNYLFMGDFVDRGFYSVETFLLLLALKVAVPGFCTPNLGDLGPGLS

SEQ ID NO: 889322 - protein, 112 aa, Homo sapiens
CVHGGLSPSIQTLDQIRTIDRKQEVPHDGPMCDLLWSDPEGEGMWAGAGRDSQEGLGKRGSRAGLHCHSSSTCQMAGTLEEEQGGLHGRCFEHTVAWGMAQRAVEDNQVMAP

SEQ ID NO: 889323 - protein, 136 aa, Homo sapiens
SFQDCLISSPPPKKGQELGWAGLAVVTLVFSCLQRDLGRGEQRAEGGLASHSEYLLSLQSQAWSFRHMKFPLHLGGSISPTLSSFICPFPHLQRSTAKRSGGCCARWLTPVIPAFWEGKVGTSLEVRSSRPAWPTW

SEQ ID NO: 889324 - protein, 1132 aa, Homo sapiens
MELFQAKDHYILQQGERALWCSRRDGGLQLRPATDLLLAWNPICLGLVEGVIGKIQLHSDLPWWLILIRQKALVGKLPGDHEVCKVTKIAVLSLSEMEPQDLELELCKKHHFGINKPEKIIPSPDDSKFLLKTFTHIKSNVSAPNKKKVKESKEKEKLERRLLEELLKMFMDSESFYYSLTYDLTNSVQRQSTGERDGRPLWQKVDDRFFWNKYMIQDLTEIGTPDVDFWIIPMIQGFVQIEELVVNYTESSDDEKSSPETPPQESTCVDDIHPRFLVALISRRSRHRAGMRYKRRGVDKNGNVANYVETEQLIHVHNHTLSFVQTRGSVPVFWSQVGYRYNPRPRLDRSEKETVAYFCAHFEEQLNIYKKQVIINLVDQAGREKIIGDAYLKQVLLFNNSHLTYVSFDFHEHCRGMKFENVQTLTDAIYDIILDMKWCWVDEAGVICKQEGIFRVNCMDCLDRTNVVQAAIARVVMEQQLKKLGVMPPEQPLPVKCNRIYQIMWANNGDSISRQYAGTAALKGDFTRTGERKLAGVMKDGVNSANRYYLNRFKDAYRQAVIDLMQGIPVTEDLYSIFTKEKEHEALHKENQRSHQELISQLLQSYMKLLLPDDEKFHGGWALIDCDPSLIDATHRDVDVLLLLSNSAYYVAYYDDEVDKVNQYQRLSLENLEKIEIGPEPTLFGKPKFSCMRLHYRYKEASGYFHTLRAVMRNPEEDGKDTLQCIAEMLQITKQAMGSDLPIIEKKLERKSSKPHEDIIGIRSQNQGSLAQGKNFLMSKFSSLNQKVKQTKSNVNIGNLRKLGNFTKPEMKVNFLKPNLKVNLWKSDSSLETMENTGVMDKVQAESDGDMSSDNDSYHSDEFLTNSKSDEDRQLANSLESVGPIDYVLPSCGIIASAPRLGSRSQSLSSTDSSVHAPSEITVAHGSGLGKGQESPLKKSPSAGDVHILTGFAKPMDIYCHRFVQDAQNKVTHLSETRSVSQQASQERNQMTNQVSNETQSESTEQTPSRPSQLDVSLSATGPQFLSVEPAHSVASQKTPTSASSMLELETGLHVTPSPSESSSSRAVSPFAKIRSSMVQVASITQAGLTHGINFAVSKVQKSPPEPEIINQVQQNELKKMFIQCQTRIIQI

SEQ ID NO: 889325 - protein, 89 aa, Homo sapiens
SPPTGRVPRGVPSAAASRRGSYPAAPRGAGSGGLDRLGRPVRRPRAAASLGARGQHGALPSQGPLHPAAGRARAVVQPPRRRPPAPTRY

SEQ ID NO: 889326 - protein, 918 aa, Homo sapiens [sequence omitted]

SEQ ID NO: 889327 - protein, 918 aa, Homo sapiens [sequence omitted]

SEQ ID NO: 889328 - protein, 522 aa, Homo sapiens
MCHDVIFMAWLKQQFSECTLIDATHRDVDVLLLLSNSAYYVAYYDDEVDKVNQYQRLSLENLEKIEIGPEPTLFGKPKFSCMRLHYRYKEASGYFHTLRAVMRNPEEDGKDTLQCIAEMLQITKQAMGSDLPIIEKKLERKSSKPHEDIIGIRSQNQGSLAQGKNFLMSKFSSLNQKVKQTKSNVNIGNLRKLGNFTKPEMKVNFLKPNLKVNLWKSDSSLETMENTGVMDKVQAESDGDMSSDNDSYHSDEFLTNSKSDEDRQLANSLESVGPIDYVLPSCGIIASAPRLGSRSQSLSSTDSSVHAPSEITVAHGSGLGKGQESPLKKSPSAGDVHILTGFAKPMDIYCHRFVQDAQNKVTHLSETRSVSQQASQERNQMTNQVSNETQSESTEQTPSRPSQLDVSLSATGPQFLSVEPAHSVASQKTPTSASSMLELETGLHVTPSPSESSSSRAVSPFAKIRSSMVQVASITQAGLTHGINFAVSKVQKSPPEPEIINQVQQNELKKMFIQCQTRIIQI

SEQ ID NO: 889329 - protein, 918 aa, Homo sapiens [sequence omitted]

SEQ ID NO: 889330 - protein, 219 aa, Homo sapiens
MELFQAKDHYILQQGERALWCSRRDGGLQLRPATDLLLAWNPICLGLVEGVIGKIQLHSDLPWWLILIRQKALVGKLPGDHEVCKVTKIAVLSLSEMEPQDLELELCKKHHFGINKPEKIIPSPDDSKFLLKTFTHIKSNVSAPNKKKVKESKEKEKLERRLLEELLKMFMDSESFYYSLTYDLTNSVQRQSTGERDGRPLWQKVPLTARRAGFALGKK

SEQ ID NO: 889331 - protein, 57 aa, Homo sapiens
QSLMLMSPEDSGFYATIVAVVGLHVVLAIFVFIVWKEGCPSGGKTKTNRAASSELQT

SEQ ID NO: 889332 - protein, 548 aa, Homo sapiens
MSFAVFFDILLYVQIEVNLLFEIKTVGLKLQRGVSDVKNCSLRLCLIDATHRDVDVLLLLSNSAYYVAYYDDEVDKVNQYQRLSLENLEKIEIGPEPTLFGKPKFSCMRLHYRYKEASGYFHTLRAVMRNPEEDGKDTLQCIAEMLQITKQAMGSDLPIIEKKLERKSSKPHEDIIGIRSQNQGSLAQGKNFLMSKFSSLNQKVKQTKSNVNIGNLRKLGNFTKPEMKVNFLKPNLKVNLWKSDSSLETMENTGVMDKVQAESDGDMSSDNDSYHSDEFLTNSKSDEDRQLANSLESVGPIDYVLPSCGIIASAPRLGSRSQSLSSTDSSVHAPSEITVAHGSGLGKGQESPLKKSPSAGDVHILTGFAKPMDIYCHRFVQDAQNKVTHLSETRSVSQQASQERNQMTNQVSNETQSESTEQTPSRPSQLDVSLSATGPQFLSVEPAHSVASQKTPTSASSMLELETGLHVTPSPSESSSSRAVSPFAKIRSSMVQVASITQAGLTHGINFAVSKVQKSPPEPEIINQVQQNELKKMFIQCQTRIIQI

SEQ ID NO: 889333 - protein, 900 aa, Homo sapiens
MIQDLTEIGTPDVDFWIIPMIQGFVQIEELVVNYTESSDDEKSSPETPPQESTCVDDIHPRFLVALISRRSRHRAGMRYKRRGVDKNGNVANYVETEQLIHVHNHTLSFVQTRGSVPVFWSQVGYRYNPRPRLDRSEKETVAYFCAHFEEQLNIYKKQVIINLVDQAGREKIIGDAYLKQVLLFNNSHLTYVSFDFHEHCRGMKFENVQTLTDAIYDIILDMKWCWVDEAGVICKQEGIFRVNCMDCLDRTNVVQAAIARVVMEQQLKKLGVMPPEQPLPVKCNRIYQIMWANNGDSISRQYAGTAALKGDFTRTGERKLAGVMKDGVNSANRYYLNRFKDAYRQAVIDLMQGIPVTEDLYSIFTKEKEHEALHKENQRSHQELISQLLQSYMKLLLPDDEKFHGGWALIDCDPSLIDATHRDVDVLLLLSNSAYYVAYYDDEVDKVNQYQRLSLENLEKIEIGPEPTLFGKPKFSCMRLHYRYKEASGYFHTLRAVMRNPEEDGKDTLQCIAEMLQITKQAMGSDLPIIEKKLERKSSKPHEDIIGIRSQNQGSLAQGKNFLMSKFSSLNQKVKQTKSNVNIGNLRKLGNFTKPEMKVNFLKPNLKVNLWKSDSSLETMENTGVMDKVQAESDGDMSSDNDSYHSDEFLTNSKSDEDRQLANSLESVGPIDYVLPSCGIIASAPRLGSRSQSLSSTDSSVHAPSEITVAHGSGLGKGQESPLKDIYCHRFVQDAQNKVTHLSETRSVSQQASQERNQMTNQVSNETQSESTEQTPSRPSQLDVSLSATGPQFLSVEPAHSVASQKTPTSASSMLELETGLHVTPSPSESSSSRAVSPFAKIRSSMVQVASITQAGLTHGINFAVSKVQKSPPEPEIINQVQQNELKKMFIQCQTRIIQI

SEQ ID NO: 889334 - protein, 910 aa, Homo sapiens
MIQDLTEIGTPDVDFWIIPMIQGFVQIEELVVNYTESSDDEKSSPETPPQESTCVDDIHPRFLVALISRRSRHRAGMRYKRRGVDKNGNVANYVETEQLIHVHNHTLSFVQTRGSVPVFWSQVGYRYNPRPRLDRSEKETVAYFCAHFEEQLNIYKKQVIINLVDQAGREKIIGDAYLKQVLLFNNSHLTYVSFDFHEHCRGMKFENVQTLTDAIYDIILDMKWCWVDEAGVICKQEGIFRVNCMDCLDRTNVVQAAIARVVMEQQLKKLGVMPPEQPLPVKCNRIYQIMWANNGDSISRQYAGTAALKGDFTRTGERKLAGVMKDGVNSANRYYLNRFKDAYRQAVIDLMQGIPVTEDLYSIFTKEKEHEALHKENQRSHQELISQLLQSYMKLLLPDDEKFHGGWALIDCDPSLIDATHRDVDVLLLLSNSAYYVAYYDDEVDKVNQYQRLSLENLEKIEIGPEPTLFGKPKFSCMRLHYRYKEASGYFHTLRAVMRNPEEDGKDTLQCIAEMLQITKQAMGSDLPIIEKKLERKSSKPHEDIIGIRSQNQGSLAQGKNFLMSKFSSLNQKVKQTKSNVNIGNLRKLGNFTKPEMKVNFLKPNLKVNLWKSDSSLETMENTGVMDKVQAESDGDMSSDNDSYHSDEFLTNSKSDEDRQLANSLESVGPIDYVLPSCGIIASAPRLGSRSQSLSSTDSSVHAPSEITVAHGSGLGKGQESPLKKSPSAGDVHILTGFAKPMDIYCHRFVQDAQNKVTHLSETRSVSQQASQERNQMTNQVSNETQSESTEQTPSRPSQLDVSLSATGPQFLSVEPAHSVASQKTPTSASSMLELETGLHVTPSPSESSSSRAVSPFAKIRSSMVQVASITQAGLTHGINFAVSKVQKSPPEPEIINQVQQNLRGVRAPL

SEQ ID NO: 889335 - protein, 74 aa, Homo sapiens
DINNSTLDLMQGIPVTEDLYSIFTKEKEHEALHKENQRSHQELISQLLQSYMKLLLPDDEKFHGGWALIDCDPR

SEQ ID NO: 889336 - protein, 654 aa, Homo sapiens
RRSGPAAAAAASSPRIGCTVLTRKSSSAARQRRAGAMTQEYDNKRPVLALQNEALYPQRRSYTSEDEAWKSFLENPLTAATKAMMSINGDEDSAAALGLLYDYYKVPRERRSSTAKPEVEHPEPDHSKRNSIPIVTEQPLISAGENRVQVLKNVPFNIVLPHGNQLGIDKRGHLTAPDTTVTVSIATMPTHSIKTETQPHGFAVGIPPAVYHPEPTERVVVFDRNLNTDQFSSGAQAPNAQRRTPDSTFSETFKEGVQEVFFPSDLSLRMPGMNSEDYVFDSVSGNNFEYTLEASKSLRQKPGDSTMTYLNKGQFYPITLKEVSSSEGIHHPISKVRSVIMVVFAEDKSREDQLRHWKYWHSRQHTAKQRCIDIADYKESFNTISNIEEIAYNAISFTWDINDEAKVFISVNCLSTDFSSQKGVKGLPLNIQVDTYSYNNRSNKPVHRAYCQIKVFCDKGAERKIRDEERKQSKRKVSDVKVPLLPSHKRMDITVFKPFIDLDTQPVLFIPDVHFANLQRGTHVLPIASEELEGEGSVLKRGPYGTEDDFAVPPSTKLARIEEPKRVLLYVRKESEEVFDALMLKTPSLKGLMEAISDKYDVPHDKIGKIFKKCKKGILVNMDDNIVKHYSNEDTFQLQIEEAGGSYKLTLTEI

SEQ ID NO: 889337 - protein, 530 aa, Homo sapiens
RRSGPAAAAAASSPRIGCTVLTRKSSSAARQRRAGAMTQEYDNKRPVLALQNEALYPQRRSYTSEDEAWKSFLENPLTAATKAMMSINGDEDSAAALGLLYDYYKVPRERRSSTAKPEVEHPEPDHSKRNSIPIVTEQPLISAGENRVQVLKNVPFNIVLPHGNQLGIDKRGHLTAPDTTVTVSIATMPTHSIKTETQPMASLWESPQQCIILSPLSGWWFSIGISILTSSALVLKPQMLKGELQTRPSQRPSRKAFRRNNFEYTLEASKSLRQKPGDSTMTYLNKGQFYPITLKEVSSSEGIHHPISKVRSVIMVVFAEDKSREDQLRHWKYWHSRQHTAKQRCIDIADYKESFNTISNIEEIAYNAISFTWDINDEAKVFISVNCLSTDFSSQKGVKGLPLNIQVDTYSYNNRSNKPVHRAYCQIKVFCDKGAERKIRDEERKQSKRKVSDVKVPLLPSHKRMDITVFKPFIDLDTQPVLFIPDVHFANLQRGTHVGNQDPRGGYQEGRHGKRKFFGIIHGETEAKIE

SEQ ID NO: 889338 - protein, 556 aa, Homo sapiens
RRSGPAAAAAASSPRIGCTVLTRKSSSAARQRRAGAMTQEYDNKRPVLALQNEALYPQRRSYTSEDEAWKSFLENPLTAATKAMMSINGDEDSAAALGLLYDYYKVPRERRSSTAKPEVEHPEPDHSKRNSIPIVTEQPLISAGENRVQVLKNVPFNIVLPHGNQLGIDKRGHLTAPDTTVTVSIATMPTHSIKTETQPHGFAVGIPPAVYHPEPTERVVVFDRNLNTDQFSSGAQAPNAQRRTPDSTFSETFKEGVQEVFFPSDLSLRMPGMNSEDYVFDSVSGNNFEYTLEASKSLRQKPGDSTMTYLNKGQFYPITLKEVSSSEGIHHPISKVRSVIMVVFAEDKSREDQLRHWKYWHSRQHTAKQRCIDIADYKESFNTISNIEEIAYNAISFTWDINDEAKVFISVNCLSTDFSSQKGVKGLPLNIQVDTYSYNNRSNKPVHRAYCQIKVFCDKGAERKIRDEERKQSKRKVSDVKVPLLPSHKRMDITVFKPFIDLDTQPVLFIPDVHFANLQRGTHVGNQDPRGGYQEGRHGKRKFFGIIHGETEAKIE

SEQ ID NO: 889339 - protein, 107 aa, Homo sapiens
LLEDSRQSASISCGIMATERLANYTGGIYAEYQDTTYINHVVSVAGWGISDGSKTVFVPQESHRLPVEVAYKRGLFDEEMNEILTDPSDDTKGFFDPNTEENLTYLQ

SEQ ID NO: 889340 - protein, 303 aa, Homo sapiens
MARRGPGWRPLLLLVLLAGAAQGGLYFRRGQTCYRPLRGDGLAPLGRSTYPRPHEYLSPADLPKSWDWRNVDGVNYASITRNQHIPQYCGSCWAHASTSAMADRINIKRKGAWPSTLLSVQNVIDCGNAGSCEGGNDLSVWDYAHQHGIPDETCNNYQAKDQECDKFNQCGTCNEFKECHAIRNYTLWRVGDYGSLSGREKMMAEIYANGPISCGIMATERLANYTGGIYAEYQDTTYINHVVSVAGWGISDGTEYWIVRNSWGEPWGERGWLRIVTSTYKDGKGARYNLAIEEHCTFGDPIV

SEQ ID NO: 889341 - protein, 303 aa, Homo sapiens; identical to SEQ ID NO: 889340

SEQ ID NO: 889342 - protein, 303 aa, Homo sapiens; identical to SEQ ID NO: 889340

SEQ ID NO: 889343 - protein, 288 aa, Homo sapiens
MARRGPGWRPLLLLVLLAGAAQGGLYFRRGQTCYRPLRGDGLAPLGRSTYPRPHEYLSPADLPKSWDWRNVDGVNYASITRNQHIPQYCGSCWAHASTSAMADRINIKRKGAWPSTLLSVQNVIDCGNAGSCEGGNDLSVWDYAHQHGIPDETCNNYQAKDQECDKFNQCGTCNEFKECHAIRNYTLWRVGDYGSLSGREKMMAEIYANGPISCGIMATERLANYTGGIYAEYQDTTYINHVVSVAGWGISDGTEYWIVRNSWGEPWVRCFHFLKVIPRKKRPGTPLA

SEQ ID NO: 889344 - protein, 308 aa, Homo sapiens
MARRGPGWRPLLLLVLLAGAAQGGLYFRRGQTCYRPLRGDGLAPLGRSTYPRPHEYLSPADLPKSWDWRNVDGVNYASITRNQHIPQYCGSCWAHASTSAMADRINIKRKGAWPSTLLSVQNVIDCGNAGSCEGGNDLSVWDYAHQHGIPDETCNNYQAKDQECDKFNQCGTCNEFKECHAIRNYTLWRVGDYGSLSGREKMMAEIYANGPISCGIMATERLANYTGGIYAEYQDTTYINHVVSVAGWGISDGSKTVFSHQESHRLPVEVAYKRGLFDEEMNEILTDPSDDTKGFFDPNTEENLTYLQ

SEQ ID NO: 889345 - protein, 114 aa, Homo sapiens
MKISEPTFFFFFFFSDGTKMVLISCGIMATERLANYTGGIYAEYQDTTYINHVVSVAGWGISDGTEYWIVRNSWGEPWGERGWLRIVTSTYKDGKGARYNLAIEEHCTFGDPIV

SEQ ID NO: 889346 - protein, 145 aa, Homo sapiens
SSSSHQLWNMATERLANYTGGIYPNTRTPHINHVCFRGWVGITDGSKTGPVFILSCGIMATERLANYTGGIYAEYQDTTYINHVVSVAGWGISDGTEYWIVRNSWGEPWGERGWLRIVTSTYKDGKGARYNLAIEEHCTFGDPIV

SEQ ID NO: 889347 - protein, 115 aa, Homo sapiens
EIPPIPENRFLMRKSPPKADGSKISCGIMATERLANYTGGIYAEYQDTTYINHVVSVAGWGISDGTEYWIVRNSWGEPWGERGWLRIVTSTYKDGKGARYNLAIEEHCTFGDPIV

SEQ ID NO: 889348 - protein, 178 aa, Homo sapiens
MARRGPGWRPLLLLVLLAGAAQGGLYFRRGQTCYRPLRGDGLAPLGRSTYPRPHEYLSPADLPKSWDWRNVDGVNYASITRNQHIPQYCGSCWAHASTSAMAGEWPPLTVGQESPSRLPVYRPRQLSPRFQGPVIQGQVSLGWGAKAEERGPLPSAEVTQAGSFWGFWVTGRTRTESQ

SEQ ID NO: 889349 - protein, 142 aa, Homo sapiens
NGERGGGEKRKKKKERGKGGKIRKSETEALPRPLAGKAGVGRVLGRGRGRGRGGIQSGSRRGIWDSERDPERDPGAGAGPWRGAGQGGGRFCCSCCWRARRRAASTSAGDRPATGLCGGTGWLRWGAAHTPGLYVFCKINRF

SEQ ID NO: 889350 - protein, 85 aa, Homo sapiens
IFSVDLTQVVGVRASSDTTYINHVVSVAGWGISDGTEYWIVRNSWGEPWGERGWLRIVTSTYKDGKGARYNLAIEEHCTFGDPIV

SEQ ID NO: 889351 - protein, 303 aa, Homo sapiens; identical to SEQ ID NO: 889340

SEQ ID NO: 889352 - protein, 470 aa, Homo sapiens
MARRGPGWRPLLLLVLLAGAAQGGLYFRRGQTCYRPLRGDGLAPLGRRWAPAGRQPWGDGRPIARARRALCLLGALRRQQALEGQIQPLRFGGRSFSSTSRVSPDVCGVGQAPPGQKARPAPPPRPLGVALTARHGWGSNPVPSFRGCPASFTILRALEPPSVRWAHTWLTSGDCGPTPMPSGVGKGGRALPRASWAHGPREPQHRSGGGGSLLSTYPRPHEYLSPADLPKSWDWRNVDGVNYASITRNQHIPQYCGSCWAHASTSAMADRINIKRKGAWPSTLLSVQNVIDCGNAGSCEGGNDLSVWDYAHQHGIPDETCNNYQAKDQECDKFNQCGTCNEFKECHAIRNYTLWRVGDYGSLSGREKMMAEIYANGPISCGIMATERLANYTGGIYAEYQDTTYINHVVSVAGWGISDGTEYWIVRNSWGEPWGERGWLRIVTSTYKDGKGARYNLAIEEHCTFGDPIV

SEQ ID NO: 889353 - protein, 233 aa, Homo sapiens
QRTPKILSITRNQHIPQYCGSCWAHASTSAMADRINIKRKGAWPSTLLSVQNVIDCGNAGSCEGGNDLSVWDYAHQHGIPDETCNNYQAKDQECDKFNQCGTCNEFKECHAIRNYTLWRVGDYGSLSGREKMMAEIYANGPISCGIMATERLANYTGGIYAEYQDTTYINHVVSVAGWGISDGTEYWIVRNSWGEPWGERGWLRIVTSTYKDGKGARYNLAIEEHCTFGDPIV

SEQ ID NO: 889354 - protein, 102 aa, Homo sapiens
LLEDSRQSASISCGIMATERLANYTGGIYAEYQDTTYINHVVSVAGWGISDGTEYWIVRNSWGEPWGERGWLRIVTSTYKDGKGARYNLAIEEHCTFGDPIV

SEQ ID NO: 889355 - protein, 104 aa, Homo sapiens
MADGSKTGPVFILSCGIMATERLANYTGGIYAEYQDTTYINHVVSVAGWGISDGTEYWIVRNSWGEPWGERGWLRIVTSTYKDGKGARYNLAIEEHCTFGDPIV

SEQ ID NO: 889356 - protein, 142 aa, Homo sapiens
LEDPSSSISQIHTSLPPYGEVAFELALTDSRFGVGQLGNGNTDPDGSKMPISCGIMATERLANYTGGIYAEYQDTTYINHVVSVAGWGISDGTEYWIVRNSWGEPWGERGWLRIVTSTYKDGKGARYNLAIEEHCTFGDPIV

SEQ ID NO: 889357 - protein, 85 aa, Homo sapiens; identical to SEQ ID NO: 889350

SEQ ID NO: 889358 - protein, 516 aa, Homo sapiens
MTLLITGDSIVSAEAVWDHVTMANRELAFKAGDVIKVLDASNKDWWWGQIDDEEGWFPASFVRLWVNQEDEVEEGPSDVQNGHLDPNSDCLCLGRPLQNRDQMRANVINEIMSTERHYIKHLKDICEGYLKQCRKRRDMFSDEQLKVIFGNIEDIYRFQMGFVRDLEKQYNNDDPHLSEIGPCFLEHQDGFWIYSEYCNNHLDACMELSKLMKDSRYQHFFEACRLLQQMIDIAIDGFLLTPVQKICKYPLQLAELLKYTAQDHSDYRYVAAALAVMRNVTQQINERKRRLENIDKIAQWQASVLDWEGEDILDRSSELIYTGEMAWIYQPYGRNQQRVFFLFDHQMVLCKKDLIRRDILYYKGRIDMDKYEVVDIEDGRDDDFNVSMKNAFKLHNKETEEIHLFFAKKLEEKIRWLRAFREERKMVQEDEKIGFEISENQKRQAAMTVRKVPKQKGVNSARSVPPSYPPPQDPLNHGQYLVPDGIAQSQVFEFTEPKRSQSPFWQNFSRLTPFKK

SEQ ID NO: 889359 - protein, 463 aa, Homo sapiens
MQWIRGGSGMLWVNQEDEVEEGPSDVQNGHLDPNSDCLCLGRPLQNRDQMRANVINEIMSTERHYIKHLKDICEGYLKQCRKRRDMFSDEQLKVIFGNIEDIYRFQMGFVRDLEKQYNNDDPHLSEIGPCFLEHQDGFWIYSEYCNNHLDACMELSKLMKDSRYQHFFEACRLLQQMIDIAIDGFLLTPVQKICKYPLQLAELLKYTAQDHSDYRYVAAALAVMRNVTQQINERKRRLENIDKIAQWQASVLDWEGEDILDRSSELIYTGEMAWIYQPYGRNQQRVFFLFDHQMVLCKKDLIRRDILYYKGRIDMDKYEVVDIEDGRDDDFNVSMKNAFKLHNKETEEIHLFFAKKLEEKIRWLRAFREERKMVQEDEKIGFEISENQKRQAAMTVRKVPKQKGVNSARSVPPSYPPPQDPLNHGQYLVPDGIAQSQVFEFTEPKRSQSPFWQNFSRLTPFKK

SEQ ID NO: 889360 - protein, 523 aa, Homo sapiens
MQWIRGGSGMLITGDSIVSAEAVWDHVTMANRELAFKAGDVIKVLDASNKDWWWGQIDDEEGWFPASFVRLWVNQEDEVEEGPSDVQNGHLDPNSDCLCLGRPLQNRDQMRANVINEIMSTERHYIKHLKDICEGYLKQCRKRRDMFSDEQLKVIFGNIEDIYRFQMGFVRDLEKQYNNDDPHLSEIGPCFLEHQDGFWIYSEYCNNHLDACMELSKLMKDSRYQHFFEACRLLQQMIDIAIDGFLLTPVQKICKYPLQLAELLKYTAQDHSDYRYVAAALAVMRNVTQQINERKRRLENIDKIAQWQASVLDWEGEDILDRSSELIYTGEMAWIYQPYGRNQQRVFFLFDHQMVLCKKDLIRRDILYYKGRIDMDKYEVVDIEDGRDDDFNVSMKNAFKLHNKETEEIHLFFAKKLEEKIRWLRAFREERKMVQEDEKIGFEISENQKRQAAMTVRKVPKQKGVNSARSVPPSYPPPQDPLNHGQYLVPDGIAQSQVFEFTEPKRSQSPFWQNFSRLTPFKK

SEQ ID NO: 889361 - protein, 365 aa, Homo sapiens
MTLLITGDSIVSAEAVWDHVTMANRELAFKAGDVIKVLDASNKDWWWGQIDDEEGWFPASFVRLWVNQEDEVEEGPSDVQNGHLDPNSDCLCLGRPLQNRDQMRANVINEIMSTERHYIKHLKDICEGYLKQCRKRRDMFSDEQLKVIFGNIEDIYRFQMGFVRDLEKQYNNDDPHLSEIGPCFLEHQDGFWIYSEYCNNHLDACMELSKLMKDSRYQHFFEACRLLQQMIDIAIDGFLLTPVQKICKYPLQLAELLKYTAQDHSDYRYVAAALAVMRNVTQQINERKRRLENIDKIAQWQASVLDWEGEDILDRSSELIYTGEMAWIYQPYGRNQQRVFFLFDHQMVLCKKALKFLKTRRGRLQ

SEQ ID NO: 889362 - protein, 516 aa, Homo sapiens; identical to SEQ ID NO: 889358

SEQ ID NO: 889363 - protein, 83 aa, Homo sapiens
DSSDRIFAKSHPYAVEAKVPKQKGVNSARSVPPSYPPPQDPLNHGQYLVPDGIAQSQVFEFTEPKRSQSPFWQNFSRLTPFKK

SEQ ID NO: 889364 - protein, 516 aa, Homo sapiens; identical to SEQ ID NO: 889358

SEQ ID NO: 889365 - protein, 282 aa, Homo sapiens
MTLLITGDSIVSAEAVWDHVTMANRELAFKAGDVIKVLDASNKDWWWGQIDDEEGWFPASFVRLWVNQEDEVEEGPSDVQNGHLDPNSDCLCLGRPLQNRDQMRANVINEIMSTERHYIKHLKDICEGYLKQCRKRRDMFSDEQLKVIFGNIEDIYRFQMGFVRDLEKQYNNDDPHLSEIGPCFLEHQDGFWIYSEYCNNHLDACMELSKLMKDSRYQHFFEACRLLQQMIDIAIDGFLLTPVQKICKYPLQLAELLKYTAQDHSDYRVVACCFGLQEKMGS

SEQ ID NO: 889366 - protein, 516 aa, Homo sapiens; identical to SEQ ID NO: 889358

SEQ ID NO: 889367 - protein, 516 aa, Homo sapiens; identical to SEQ ID NO: 889358

SEQ ID NO: 889368 - protein, 516 aa, Homo sapiens; identical to SEQ ID NO: 889358

SEQ ID NO: 889369 - protein, 178 aa, Homo sapiens
ALGSRSYLAEVGVIIVILFLQVSHKGRIDMDKYEVVDIEDGRDDDFNVSMKNAFKLHNKETEEIHLFFAKKLEEKIRWLRAFREERKMVQEDEKIGFEISENQKRQAAMTVRKVPKQKGVNSARSVPPSYPPPQDPLNHGQYLVPDGIAQSQVFEFTEPKRSQSPFWQNFSRLTPFKK

SEQ ID NO: 889370 - protein, 221 aa, Homo sapiens
MTLLITGDSIVSAEAVWDHVTMANRELAFKAGDVIKVLDASNKDWWWGQIDDEEGWFPASFVRLWVNQEDEVEEGPSDVQNGHLDPNSDCLCLGRPLQNRDQMRANVINEIMSTERHYIKHLKDICEGYLKQCRKRRDMFSDEQLKVIFGNIEDIYRFQMGFVRDLEKQYNNDDPHLSEIGPCFLEHQDGFWIYSEYCNNHLDACMELSKLMNSAVKSKPL

SEQ ID NO: 889371 - protein, 110 aa, Homo sapiens
MGEHITKSQSQRRCHCYGPVRVPASWCLGGRHQEDFGGVVSGQLSGPLCPFLASLAACTSRLVGRTVGRACGSPPRPPRGLGPAAASSTAAGWESPRDAASGPAPGLCPH

SEQ ID NO: 889372 - protein, 218 aa, Homo sapiens
MQPPGPPPAYAPTNGDFTFVSSADAEDLSGSIASPDVKLNLGGDFIKESTATTFLRQRGYGWLLEVEDDDPEDNKPLLEELDIDLKDIYYKIRCVLMPMPSLGFNRQVVRDNPDFWGPLAVVLFFSMISLYGQFRVAYGQVLGVIGYSLLPLIVIAPVLLVVGSFEVVSTLIKLFGVFWAAYSAASLLVGEEFKTKKPLLIYPIFLLYIYFLSLYTGV

SEQ ID NO: 889373 - protein, 226 aa, Homo sapiens
MQPPGPPPAYAPTNGDFTFVSSADAEDLSGSIASPDVKLNLGGDFIKESTATTFLRQRGYGWLLEVEDDDPEDNKPLLEELDIDLKDIYYVRDNPDFWGPLAVVLFFSMISLYGQFRVVSWIITIWIFGSLTIFLLARVLGGEVAYGQVLGVIGYSLLPLIVIAPVLLVVGSFEVVSTLIKLFGVFWAAYSAASLLVGEEFKTKKPLLIYPIFLLYIYFLSLYTGV

SEQ ID NO: 889374 - protein, 110 aa, Homo sapiens; identical to SEQ ID NO: 889371

SEQ ID NO: 889375 - protein, 110 aa, Homo sapiens; identical to SEQ ID NO: 889371

SEQ ID NO: 889376 - protein, 110 aa, Homo sapiens; identical to SEQ ID NO: 889371

SEQ ID NO: 889377 - protein, 244 aa, Homo sapiens
MQPPGPPPAYAPTNGDFTFVSSADAEDLSGSIASPDVKLNLGGDFIKESTATTFLRQRGYGWLLEVEDDDPEDNKPLLEELDIDLKDIYYKIRCVLMPMPSLGFNRQVVRDNPDFWGPLAVVLFFSMISLYGQFRVVSWIITIWIFGSLTIFLLARVLGGEVAYGQVLGVIGYSLLPLIVIAPVLLVVGSFEVVSTLIKLFGVFWAAYSAASLLVGEEFKTKKPLLIYPIFLLYIYFLSLYTGV

SEQ ID NO: 889378 - protein, 244 aa, Homo sapiens; identical to SEQ ID NO: 889377

SEQ ID NO: 889379 - protein, 244 aa, Homo sapiens; identical to SEQ ID NO: 889377

SEQ ID NO: 889380 - protein, 214 aa, Homo sapiens
MQPPGPPPAYAPTNGDFTFVSSADAEDLSGSIASPDVKLNLGGDFIKESTATTFLRQRGYGWLLEVEDDDPEDNKPLLEELDIDLKDIYYKIRCVLMPMPSLGFNRQVVRDNPDFWGPLAVVLFFSMISLYGQFRVVSWIITIWIFGSLTIFLLARVLGGEVAYGQVLGVIGYSLLPLIVIAPVLLVVGSFEVVSTLIKVRSTRGTGLLEVRII

SEQ ID NO: 889381 - protein, 422 aa, Homo sapiens
MDHPSREKDERQRTTKPMAQRSAHCSRPSGSSSSSGVLMVGPNFRVGKKIGCGNFGELRLGKNLYTNEYVAIKLEPIKSRAPQLHLEYRFYKQLGSAGEGLPQVYYFGPCGKYNAMVLELLGPSLEDLFDLCDRTFTLKTVLMIAIQLLSRMEYVHSKNLIYRDVKPENFLIGRQGNKKEHVIHIIDFGLAKEYIDPETKKHIPYREHKSLTGTARYMSINTHLGKEQSRRDDLEALGHMFMYFLRGSLPWQGLKADTLKERYQKIGDTKRNTPIEALCENFPEEMATYLRYVRRLDFFEKPDYEYLRTLFTDLFEKKGYTFDYAYDWVGRPIPTPVGSVHVDSGASAITRESHTHRDRPSQQQPLRNQVVSSTNGELNVDDPTGAHSNAPITAHAEVEVVEEAKCCCFFKRKRKKTAQRHK

SEQ ID NO: 889382 - protein, 393 aa, Homo sapiens
MDHPSREKDERQRTTKPMAQRSAHCSRPSGSSSSSGVLMVGPNFRVGKKIGCGNFGELRLGKNLYTNEYVAIKLEPIKSRAPQLHLEYRFYKQLGSAGEGLPQVYYFGPCGKYNAMVLELLGPSLEDLFDLCDRTFTLKTVLMIAIQLLSRMEYVHSKNLIYRDVKPENFLIGRQGNKKEHVIHIIDFGLAKEYIDPETKKHIPYREHKSLTGTARYMSINTHLGKEQSRRDDLEALGHMFMYFLRGSLPWQGLKADTLKERYQKIGDTKRNTPIEALCENFPEEMATYLRYVRRLDFFEKPDYEYLRTLFTDLFEKKGYTFDYAYDWVGRPIPTPVGSVHVDSGASAITRESHTHRDRPSQQQPLRNQSLRTVTAEHYDVNNSAIWHRGRGT

SEQ ID NO: 889383 - protein, 372 aa, Homo sapiens
MDHPSREKDERQRTTKPMAQRSAHCSRPSGSSSSSGVLMVGPNFRVGKKIGCGNFGELRLGKNLYTNEYVAIKLEPIKSRAPQLHLEYRFYKQLGSAGEGLPQVYYFGPCGKYNAMVLELLGPSLEDLFDLCDRTFTLKTVLMIAIQLLSRMEYVHSKNLIYRDVKPENFLIGRQGNKKEHVIHIIDFGLAKEYIDPETKKHIPYREHKSLTGTARYMSINTHLGKEQSRRDDLEALGHMFMYFLRGSLPWQGLKADTLKERYQKIGDTKRNTPIEALCENFPEEMATYLRYVRRLDFFEKPDYEYLRTLFTDLFEKKGYTFDYAYDWVGRPIPTPVGSVHVDSGASAITRESHTHRDRPSQQQPLRNQSTV

SEQ ID NO: 889384 - protein, 422 aa, Homo sapiens
MDHPSREKDERQRTTKPMAQRSAHCSRPSGSSSSSGVLMVGPNFRVGKKIGCGNFGELRLGKNLYTNEYVAIKLEPIKSRAPQLHLEYRFYKQLGSAGEGLPQVYYFGPCGKYNAMVLELLGPSLEDLFDLCDRTFTLKTVLMIAIQLLSRMEYVHSKNLIYRDVKPENFLIGRQGNKKEHVIHIIDFGLAKEYIDPETKKHIPYREHKSLTGTARYMSINTHLGKEQSRRDDLEALGHMFMYFLRGSLPWQGLKADTLKERYQKIGDTKRNTPIEALCENFPEEMATYLRYVRRLDFFEKPDYEYLRTLFTDLFEKKGYTFDYAYDWVGRPIPTPVGSVHVDSGASAITRESHTHRDRPSQQQPLRNQPRSLTSRVFCPAVRPLFPLPSTHINRNNVLEMKPGGRSSYTCKRSLIGSTLTR

SEQ ID NO: 889385 - protein, 107 aa, Homo sapiens
MDHPSREKDERQRTTKPMAQRSAHCSRPSGSSSSSGVLMVGPNFRVGKKIGCGNFGELRLGKNLYTNEYVAIKLEPIKSRAPQLHLEYRFYKQLGSAGKSSLFSPLT

SEQ ID NO: 889386 - protein, 210 aa, Homo sapiens
MDHPSREKDERQRTTKPMAQRSAHCSRPSGSSSSSGVLMVGPNFRVGKKIGCGNFGELRLGKNLYTNEYVAIKLEPIKSRAPQLHLEYRFYKQLGSAGEGLPQVYYFGPCGKYNAIKPSELKALSAEGDQEAGGKAKKVGGKWQTWAGEEPSPYPRCAWQYGFLFLCACAAFIPAGLGVQVPSSLPPVKLHCRTQAVSNLQSTVPVCWRS

SEQ ID NO: 889387 - protein, 473 aa, Homo sapiens
MDHPSREKDERQRTTKPMAQRSAHCSRPSGSSSSSGVLMVGPNFRVGKKIGCGNFGELRLGKCSVSYVAELLSNSWPEMILLPWPPAKVLAVIGISHCDWPNILPMDICHYGKNLYTNEYVAIKLEPIKSRAPQLHLEYRFYKQLGSAGEGLPQVYYFGPCGKYNAMVLELLGPSLEDLFDLCDRTFTLKTVLMIAIQLLSRMEYVHSKNLIYRDVKPENFLIGRQGNKKEHVIHIIDFGLAKEYIDPETKKHIPYREHKSLTGTARYMSINTHLGKEQSRRDDLEALGHMFMYFLRGSLPWQGLKADTLKERYQKIGDTKRNTPIEALCENFPEEMATYLRYVRRLDFFEKPDYEYLRTLFTDLFEKKGYTFDYAYDWVGRPIPTPVGSVHVDSGASAITRESHTHRDRPSQQQPLRNQVVSSTNGELNVDDPTGAHSNAPITAHAEVEVVEEAKCCCFFKRKRKKTAQRHK

SEQ ID NO: 889388 - protein, 381 aa, Homo sapiens
MDHPSREKDERQRTTKPMAQRSAHCSRPSGSSSSSGVLMVGPNFRVGKKIGCGNFGELRLGKNLYTNEYVAIKLEPIKSRAPQLHLEYRFYKQLGSAGEGLPQVYYFGPCGKYNAMVLELLGPSLEDLFDLCDRTFTLKTVLMIAIQLLSRMEYVHSKNLIYRDVKPENFLIGRQGNKKEHVIHIIDFGLAKEYIDPETKKHIPYREHKSLTGTARYMSINTHLGKEQSRRDDLEALGHMFMYFLRGSLPWQGLKADTLKERYQKIGDTKRNTPIEALCENFPEEMATYLRYVRRLDFFEKPDYEYLRTLFTDLFEKKGYTFDYAYDWVGRPIPTPVGSVHVDSGASAITRESHTHRDRPSQQQPLRNQRWTVPLQILQFD

SEQ ID NO: 889389 - protein, 299 aa, Homo sapiens
MDHPSREKDERQRTTKPMAQRSAHCSRPSGSSSSSGVLMVGPNFRVGKKIGCGNFGELRLGKNLYTNEYVAIKLEPIKSRAPQLHLEYRFYKQLGSAGEGLPQVYYFGPCGKYNAMVLELLGPSLEDLFDLCDRTFTLKTVLMIAIQLLSRMEYVHSKNLIYRDVKPENFLIGRQGNKKEHVIHIIDFGLAKEYIDPETKKHIPYREHKSLTGTARYMSINTHLGKEQSRRDDLEALGHMFMYFLRGSLPWQGLKADTLKERYQKIGDTKRNTPIEALCENFPVGDGNLPSIFRIPWIQ

SEQ ID NO: 889390 - protein, 546 aa, Homo sapiens [sequence omitted]

SEQ ID NO: 889391 - protein, 416 aa, Homo sapiens
ERTSIMCARSGQMQGGAIHERRQCLPHLGGSHTCDLSFRKEITLLMQTLNTLSTPEEKLAALCKKYAELLEEHRNSQKQMKLLQKKQSQLVQEKDHLRGEHSKAVLARSKLESLCRELQRHNRSLKEEGVQRAREEEEKRKEVTSHFQVTLNDIQLQMEQHNERNSKLRQENMELAERLKKLIEQYELREEHIDKVFKHKDLQQQLVDAKLQQAQEMLKEAEERHQREKDFLLKEAVESQRMCELMKQQETHLKQQLALYTEKFEEFQNTLSKSSEVFTTFKQEMEKMTKKIKKLEKETTMYRSRWESSNKALLEMAEEKTVRDKELEGLQVKIQRLEKLCRALQTERNDLNKRVQDLSAGGQGSLTDSGPERRPEGPGAQAPSSPRVTEAPCYPGAPSTEASGQTGPQEPTSARA

SEQ ID NO: 889392 - protein, 129 aa, Homo sapiens [sequence omitted]

SEQ ID NO: 889393 - protein, 546 aa, Homo sapiens [sequence omitted]

SEQ ID NO: 889394 - protein, 546 aa, Homo sapiens [sequence omitted]

SEQ ID NO: 889395 - protein, 520 aa, Homo sapiens
MKNQDKKNGAAKQSNPKSSPGQPEAGPEGAQERPSQAAPAVEAEGPGSSQAPRKPEGAQARTAQSGALRDVSEELSRQLEDILSTYCVDNNQGGPGEDGAQGEPAEPEDAEKSRTYVARNGEPEPTPVVNGEKEPSKGDPNTEEIRQSDEVGDGDHRRPQEKKKAKGLGKEITLLMQTLNTLSTPEEKLAALCKKYAELLEEHRNSQKQMKLLQKKQSQLVQEKDHLRGEHSKAVLARSKLESLCRELQRHNRSLKEEGVQRAREEEEKRKEVTSHFQVTLNDIQLQMEQHNERNSKLRQENMELAERLKKLIEQYELREEHIDKVFKHKDLQQQLVDAKLQQAQEMLKEAEERHQREKDFLLKEAVESQRMCELMKQQETHLKQQLALYTEKFEEFQNTLSKSSEVFTTFKQEMEKVTVVQARHGCWGISCFIQNCWACLQEAPIWGVSRAGLLGRFTAFPLLRQYQWYVYTPGCPREWGSLFCLFGFFGGFLLLLLLLLLFEMETHYALGGYAEASIS

SEQ ID NO: 889396 - protein, 71 aa, Homo sapiens
HRNSQKQMKLLQKKQSQLVQEKDHLRGEHSKAVLARSKLESLCRELQRHNRSLKVGLGPLEQVTLVSLTST

SEQ ID NO: 889397 - protein, 121 aa, Homo sapiens
MKNQDKKNGAAKQSNPKSSPGQPEAGPEGAQERPSQAAPAVEAEGPGSSQAPRKPEGAQARTAQSGALRDVSEELSRQLEDILSCCPSLSALHSTEVVTPGTARHLLLLPFLGEGSCLLSL

SEQ ID NO: 889398 - protein, 390 aa, Homo sapiens
PRSSFHQDSKENGKEITLLMQTLNTLSTPEEKLAALCKKYAELLEEHRNSQKQMKLLQKKQSQLVQEKDHLRGEHSKAVLARSKLESLCRELQRHNRSLKEEGVQRAREEEEKRKEVTSHFQVTLNDIQLQMEQHNERNSKLRQENMELAERLKKLIEQYELREEHIDKVFKHKDLQQQLVDAKLQQAQEMLKEAEERHQREKDFLLKEAVESQRMCELMKQQETHLKQQLALYTEKFEEFQNTLSKSSEVFTTFKQEMEKMTKKIKKLEKETTMYRSRWESSNKALLEMAEEKTVRDKELEGLQVKIQRLEKLCRALQTERNDLNKRVQDLSAGGQGSLTDSGPERRPEGPGAQAPSSPRVTEAPCYPGAPSTEASGQTGPQEPTSARA

SEQ ID NO: 889399 - protein, 367 aa, Homo sapiens
MKNQDKKNGAAKQSNPKSSPGQPEAGPEGAQERPSQAAPAVEAEGPGSSQAPRKPEGAQARTAQSGALRDVSEELSRQLEDILSTYCVDNNQGGPGEDGAQGEPAEPEDAEKSRTYVARNGEPEPTPVVNGEKEPSKGDPNTEEIRQSDEVGDGDHRRPQEKKKAKGLGKEITLLMQTLNTLSTPEEKLAALCKKYAELLEEHRNSQKQMKLLQKKQSQLVQEKDHLRGEHSKAVLARSKLESLCRELQRHNRSLKEEGVQRAREEEEKRKEVTSHFQVTLNDIQLQMEQHNERNSKLRQENMELAERLKKLIEQYELREEHIDKVFKHKDLQQQLVDAKLQQAQEMLKEAEERHQREKDFANDASQ

SEQ ID NO: 889400 - protein, 168 aa, Homo sapiens
HTKKPQRRRDSGRSSWLNKRNWSDKVKELQAANESKQQELEAVRKKLEKETTMYRSRWESSNKALLEMAEEKTVRDKELEGLQVKIQRLEKLCRALQTERNDLNKRVQDLSAGGQGSLTDSGPERRPEGPGAQAPSSPRVTEAPCYPGAPSTEASGQTGPQEPTSARA

SEQ ID NO: 889401 - protein, 546 aa, Homo sapiens [sequence omitted]

SEQ ID NO: 889402 - protein, 361 aa, Homo sapiens
MKNQDKKNGAAKQSNPKSSPGQPEAGPEGAQERPSQAAPAVEAEGPGSSQAPRKPEGAQARTAQSGALRDVSEELSRQLEDILSTYCVDNNQGGPGEDGAQGEPAEPEDAEKSRTYVARNGEPEPTPVVNGEKEPSKGDPNTEEIRQSDEVGDGDHRRPQEKKKAKGLGKEITLLMQTLNTLSTPEEKLAALCKKYAELLEEHRNSQKQMKLLQKKQSQLVQEKDHLRGEHSKAVLARSKLESLCRELQRHNRSLKEEGVQRAREEEEKRKEVTSHFQVTLNDIQLLPQPFRLAQHRGGHPRDSQAPAPLALPGGRELPSVPVTAFLMAQPGHSDLFEAALAAFLSPLGIHNSQGLDFDVF

SEQ ID NO: 889403 - protein, 152 aa, Homo sapiens [sequence omitted]

SEQ ID NO: 889404 - protein, 183 aa, Homo sapiens
MSPEAMGYPEVERRELLPAAAPRERGSQGCGCGGAPARAGEGNSCLLFLGFFGLSLALHLLTLCCYLELRSELRRERGAESRLGGSGTPGTSGTLSSLGGLDPDSPITSHLGQPSPKQQPLEPGEAALHSDSQDGHQMALLNFFFPDEKPYSEEESRRVRRNKRSKSNEGADGKSTQLILYHF

SEQ ID NO: 889405 - protein, 326 aa, Homo sapiens
MSPEAMGYPEVERRELLPAAAPRERGSQGCGCGGAPARAGEGNSCLLFLGFFGLSLALHSDSQDGHQMALLNFFFPDEKPYSEEESRRVRRNKRSKSNEGADGPVKNKKKGKKAGPPGPNGPPGPPGPPGPQGPPGIPGIPGIPGTTVMGPPGPPGPPGPQGPPGLQGPSGAADKAGTRENQPAVVHLQGQGSAIQVKNDLSGGVLNDWSRITMNPKVFKLHPRSGELEVLVDGTYFIYSQVEVYYINFTDFASYEVVVDEKPFLQCTRSIETGKTNYNTCYTAGVCLLKARQKIAVKMVHADISINMSKHTTFFGAIRLGEAPAS

SEQ ID NO: 889406 - protein, 396 aa, Homo sapiens
MSPEAMGYPEVERRELLPAAAPRERGSQGCGCGGAPARAGEGNSCLLFLGFFGLSLALHLLTLCCYLELRSELRRERGAESRLGGSGTPGTSGTLSSLGGLDPDSPITSHLGQPSPKQQPLEPGEAALHSDSQDGHQMALLNFFFPDEKPYSEEESRRVRRNKRSKSNEGADGPVKNKKKGKKAGPPGPNGPPGPPGPPGPQGPPGIPGIPGIPGTTVMGPPGPPGPPGPQGPPGLQGPSGAADKAGTRENQPAVVHLQGQGSAIQVKNDLSGGVLNDWSRITMNPKVFKLHPRSGELEVLVDGTYFIYSQVEVYYINFTDFASYEVVVDEKPFLQCTRSIETGKTNYNTCYTAGVCLLKARQKIAVKMVHADISINMSKHTTFFGAIRLGEAPAS

SEQ ID NO: 889407 - protein, 147 aa, Homo sapiens
MSPEAMGYPEVERRELLPAAAPRERGSQGCGCGGAPARAGEGNSCLLFLGFFGLSLALHLLTLCCYLELRSELRRERGAESRLGGSGTPGTSGTLSSLGGLDPDSPITSHLGQPSPKQQPLEPGEAALHSDSQDGHQACFPQVLLSL

SEQ ID NO: 889408 - protein, 233 aa, Homo sapiens
PRRTLPWAGLSRGTRWNRGERGAPGAANMDDYSLDEFRRRWQEELAQAQAPKKRRRPEAAERRARRPEVGSGRGEQASGDPALAQGLLEGAGRPPAARATRAEGQDVASRSRSPLAREGAGGGEQLVDQLIRDLNEMNDVPFFDIQLPYELAINIFQYLDRKELGRCAQVSKTWKVIAEDEVLWYRLCQQEGHLPDSSISDYSCWKLIFQECRAKEHMLQTNWKVGSGQYHYL

SEQ ID NO: 889409 - protein, 560 aa, Homo sapiens
PRRTLPWAGLSRGTRWNRGERGAPGAANMDDYSLDEFRRRWQEELAQAQAPKKRRRPEAAERRARRPENEMNDVPFFDIQLPYELAINIFQYLDRKELGRCAQVSKTWKVIAEDEVLWYRLCQQEGHLPDSSISDYSCWKLIFQECRAKEHMLQTNWKNRKGAVSELEHVPDTVLCDVHSHDGVVIAGYTSGDVRVWDTRTWDYVAPFLESEDEEDEPGMQPNVSFVRINSSLAVAAYEDGFLNIWDLRTGKYPVHRFEHDARIQALALSQDDATVATASAFDVVMLSPNEEGYWQIAAEFEVPKLVQYLEIVPETRRYPVAVAAAGDLMYLLKAEDSARTLLYAHGPPVTCLDVSANQVAFGVQGLGWVYEGSKILVYSLEAGRRLLKLGNVLRDFTCVNLSDSPPNLMVSGNMDGRVRIHDLRSGNIALSLSAHQLRVSAVQMDDWKIVSGGEEGLVSVWDYRMNQKLWEVYSGHPVQHISFSSHSLITANVPYQTVMRNADLDSFTTHRRHRGLIRAYEFAVDQLAFQSPLPVCRSSCDAMATHYYDLALAFPYNHV

SEQ ID NO: 889410 - protein, 560 aa, Homo sapiens; identical to SEQ ID NO: 889409

SEQ ID NO: 889411 - protein, 560 aa, Homo sapiens; identical to SEQ ID NO: 889409

SEQ ID NO: 889412 - protein, 560 aa, Homo sapiens; identical to SEQ ID NO: 889409

SEQ ID NO: 889413 - protein, 226 aa, Homo sapiens [sequence omitted]

SEQ ID NO: 889414 - protein, 224 aa, Homo sapiens
TDTNRAGTESRHIVHLYGYGRQFLFYNNFLFIPSFIFQLSYSSLRWWATRAYPNSSVCKAGTTLDRMPSHHRAHSPPTHTQTATRHQQTSPAHLWGVGGNQSAQKALRPGGRLDGAQTVAPAGNQFFSQCYNKMTLNKTMLFKDPLCVKWCMRAFSGKKRGYLASDSPRDYSPPENFISATRVCFVTQAMCHPGAAVAQAIIYVSEILQGRHHLLLPSTTPCAG

SEQ ID NO: 889415 - protein, 560 aa, Homo sapiens; identical to SEQ ID NO: 889409

SEQ ID NO: 889416 - protein, 626 aa, Homo sapiens
PRRTLPWAGLSRGTRWNRGERGAPGAANMDDYSLDEFRRRWQEELAQAQAPKKRRRPEAAERRARRPEVGSGRGEQASGDPALAQGLLEGAGRPPAARATRAEGQDVASRSRSPLAREGAGGGEQLVDQLIRDLNEMNDVPFFDIQLPYELAINIFQYLDRKELGRCAQVSKTWKVIAEDEVLWYRLCQQEGHLPDSSISDYSCWKLIFQECRAKEHMLQTNWKNRKGAVSELEHVPDTVLCDVHSHDGVVIAGYTSGDVRVWDTRTWDYVAPFLESEDEEDEPGMQPNVSFVRINSSLAVAAYEDGFLNIWDLRTGKYPVHRFEHDARIQALALSQDDATVATASAFDVVMLSPNEEGYWQIAAEFEVPKLVQYLEIVPETRRYPVAVAAAGDLMYLLKAEDSARTLLYAHGPPVTCLDVSANQVAFGVQGLGWVYEGSKILVYSLEAGRRLLKLGNVLRDFTCVNLSDSPPNLMVSGNMDGRVRIHDLRSGNIALSLSAHQLRVSAVQMDDWKIVSGGEEGLVSVWDYRMNQKLWEVYSGHPVQHISFSSHSLITANVPYQTVMRNADLDSFTTHRRHRGLIRAYEFAVDQLAFQSPLPVCRSSCDAMATHYYDLALAFPYNHV

SEQ ID NO: 889417 - protein, 434 aa, Homo sapiens
MRNKKILKEDELLSETQQAAFHQIAMEPFEINVPKPKRRNGVNFSLAVVVIYLILLTAGAGLLVVQVLNLQARLRVLEMYFLNDTLAAEDSPSFSLLQSAHPGEHLAQGASRLQVLQAQLTWVRVSHEHLLQRVDNFTQNPGMFRIKGEQGAPGLQGHKGAMGMPGAPGPPGPPAEKGAKGAMGRDGATGPSGPQGPPGVKGEAGLQGPQGAPGKQGATGTPGPQGEKGSKGDGGLIGPKGETGTKGEKGDLGLPGSKGDRGMKGDAGVMGPPGAQGSKGDFGRPGPPGLAGFPGAKGDQGQPGLQGVPGPPGAVGHPGAKGEPGSAGSPGRAGLPGSPGSPGATGLKGSKGDTGLQGQQGRKGESGVPGPAGVKGEQGSPGLAGPKGAPGQAGQKGDQGVKGSSGEQGVKGEKGERGENSVSVRIVHWADLAG

SEQ ID NO: 889418 - protein, 520 aa, Homo sapiens
MRNKKILKEDELLSETQQAAFHQIAMEPFEINVPKPKRRNGVNFSLAVVVIYLILLTAGAGLLVVQVLNLQARLRVLEMYFLNDTLAAEDSPSFSLLQSAHPGEHLAQGASRLQVLQAQLTWVRVSHEHLLQRVDNFTQNPGMFRIKGEQGAPGLQGHKGAMGMPGAPGPPGPPAEKGAKGAMGRDGATGPSGPQGPPGVKGEAGLQGPQGAPGKQGATGTPGPQGEKGSKGDGGLIGPKGETGTKGEKGDLGLPGSKGDRGMKGDAGVMGPPGAQGSKGDFGRPGPPGLAGFPGAKGDQGQPGLQGVPGPPGAVGHPGAKGEPGSAGSPGRAGLPGSPGSPGATGLKGSKGDTGLQGQQGRKGESGVPGPAGVKGEQGSPGLAGPKGAPGQAGQKGDQGVKGSSGEQGVKGEKGERGENSVSVRIVGSSNRGRAEVYYSGTWGTICDDEWQNSDAIVFCRMLGYSKGRALYKVGAGTGQIWLDNVQCRGTESTLWSCTKNSWGHHDCSHEEDAGVECSV

SEQ ID NO: 889419 - protein, 382 aa, Homo sapiens
MRNKKILKEDELLSETQQAAFHQIAMEPFEINVPKPKRRNGVNFSLAVVVIYLILLTAGAGLLVVQVLNLQARLRVLEMYFLNDTLAAEDSPSFSLLQSAHPGEHLAQGASRLQVLQAQLTWVRVSHEHLLQRVDNFTQNPGMFRIKGEQGAPGLQGHKGAMGMPGAPGPPGPPAEKGAKGAMGRDGATGPSGPQGPPGVKGEAGLQGPQGAPGKQGATGTPGPQGEKGSKGDGGLIGPKGETGTKGEKGDLGLPGSKGDRGMKGDAGVMGPPGAQGSKGDFGRPGPPGLAGFPGAKGDQGQPGLQGVPGPPGAVGHPGAKGEPGSAGSPGRAGLPGSPGSPGATGLKGSKGDTGLQGQQGRKGESGVPGPNAVVPGQDSSL

SEQ ID NO: 889420 - protein, 1164 aa, Homo sapiens
MAQQANVGELLAMLDSPMLGVRDDVTAVFKENLNSDRGPMLVNTLVDYYLETSSQPALHILTTLQEPHDKHLLDRINEYVGKAATRLSILSLLGHVIRLQPSWKHKLSQAPLLPSLLKCLKMDTDVVVLTTGVLVLITMLPMIPQSGKQHLLDFFDIFGRLSSWCLKKPGHVAEVYLVHLHASVYALFHRLYGMYPCNFVSFLRSHYSMKENLETFEEVVKPMMEHVRIHPELVTGSKDHELDPRRWKRLETHDVVIECAKISLDPTEASYEDGYSVSHQISARFPHRSADVTTSPYADTQNSYGCATSTPYSTSRLMLLNMPGQLPQTLSSPSTRLITEPPQATLWSPSMVCGMTTPPTSPGNVPPDLSHPYSKVFGTTAGGKGTPLGTPATSPPPAPLCHSDDYVHISLPQATVTPPRKEERMDSARPCLHRQHHLLNDRGSEEPPGSKGSVTLSDLPGFLGDLASEEDSIEKDKEEAAISRELSEITTAEAEPVVPRGGFDSPFYRDSLPGSQRKTHSAASSSQGASVNPEPLHSSLDKLGPDTPKQAFTPIDLPCGSADESPAGDRECQTSLETSIFTPSPCKIPPPTRVGFGSGQPPPYDHLFEVALPKTAHHFVIRKTEELLKKAKGNTEEDGVPSTSPMEVLDRLIQQGADAHSKELNKLPLPSKSVDWTHFGGSPPSDEIRTLRDQLLLLHNQLLYERFKRQQHALRNRRLLRKVIKAAALEEHNAAMKDQLKLQEKDIQMWKVSLQKEQARYNQLQEQRDTMVTKLHSQIRQLQHDREEFYNQSQELQTKLEDCRNMIAELRIELKKANNKVCHTELLLSQVSQKLSNSESVQQQMEFLNRQLLVLGEVNELYLEQLQNKHSDTTKEVEMMKAAYRKELEKNRSHVLQQTQRLDTSQKRILELESHLAKKDHLLLEQKKYLEDVKLQARGQLQAAESRYEAQKRITQVFELEILDLYGRLEKDGLLKKLEEEKAEAAEAAEERLDCCNDGCSDSMVGHNEEASGHNGETKTPRPSSARGSSGSRGGGGSSSSSSELSTPEKPPHQRAGPFSSRWETTMGEASASIPTTVGSLPSSKSFLGMKARELFRNKSESQCDEDGMTSSLSESLKTELGKDLGVEAKIPLNLDGPHPSPPTPDSVGQLHIMDYNETHHEHS

SEQ ID NO: 889421 - protein, 1164 aa, Homo sapiens; identical to SEQ ID NO: 889420

SEQ ID NO: 889422 - protein, 740 aa, Homo sapiens [sequence omitted]

SEQ ID NO: 889423 - protein, 1064 aa, Homo sapiens
GWKHYVYSSGTSLPSGLKGLKMDTDVVVLTTGVLVLITMLPMIPQSGKQHLLDFFDIFGRLSSWCLKKPGHVAEVYLVHLHASVYALFHRLYGMYPCNFVSFLRSHYSMKENLETFEEVVKPMMEHVRIHPELVTGSKDHELDPRRWKRLETHDVVIECAKISLDPTEASYEDGYSVSHQISARFPHRSADVTTSPYADTQNSYGCATSTPYSTSRLMLLNMPGQLPQTLSSPSTRLITEPPQATLWSPSMVCGMTTPPTSPGNVPPDLSHPYSKVFGTTAGGKGTPLGTPATSPPPAPLCHSDDYVHISLPQATVTPPRKEERMDSARPCLHRQHHLLNDRGSEEPPGSKGSVTLSDLPGFLGDLASEEDSIEKDKEEAAISRELSEITTAEAEPVVPRGGFDSPFYRDSLPGSQRKTHSAASSSQGASVNPEPLHSSLDKLGPDTPKQAFTPIDLPCGSADESPAGDRECQTSLETSIFTPSPCKIPPPTRVGFGSGQPPPYDHLFEVALPKTAHHFVIRKTEELLKKAKGNTEEDGVPSTSPMEVLDRLIQQGADAHSKELNKLPLPSKSVDWTHFGGSPPSDEIRTLRDQLLLLHNQLLYERFKRQQHALRNRRLLRKVIKAAALEEHNAAMKDQLKLQEKDIQMWKVSLQKEQARYNQLQEQRDTMVTKLHSQIRQLQHDREEFYNQSQELQTKLEDCRNMIAELRIELKKANNKVCHTELLLSQVSQKLSNSESVQQQMEFLNRQLLVLGEVNELYLEQLQNKHSDTTKEVEMMKAAYRKELEKNRSHVLQQTQRLDTSQKRILELESHLAKKDHLLLEQKKYLEDVKLQARGQLQAAESRYEAQKRITQVFELEILDLYGRLEKDGLLKKLEEEKAEAAEAAEERLDCCNDGCSDSMVGHNEEASGHNGETKTPRPSSARGSSGSRGGGGSSSSSSELSTPEKPPHQRAGPFSSRWETTMGEASASIPTTVGSLPSSKSFLGMKARELFRNKSESQCDEDGMTSSLSESLKTELGKDLGVEAKIPLNLDGPHPSPPTPDSVGQLHIMDYNETHHEHS

SEQ ID NO: 889424 - protein, 1164 aa, Homo sapiens; identical to SEQ ID NO: 889420

SEQ ID NO: 889425 - protein, 438 aa, Homo sapiens
MAQQANVGELLAMLDSPMLGVRDDVTAVFKENLNSDRGPMLVNTLVDYYLETSSQPALHILTTLQEPHDKHLLDRINEYVGKAATRLSILSLLGHVIRLQPSWKHKLSQAPLLPSLLKCLKMDTDVVVLTTGVLVLITMLPMIPQSGKQHLLDFFDIFGRLSSWCLKKPGHVAEVYLVHLHASVYALFHRLYGMYPCNFVSFLRSHYSMKENLETFEEVVKPMMEHVRIHPELVTGSKDHELDPRRWKRLETHDVVIECAKISLDPTEASYEDGYSVSHQISARFPHRSADVTTSPYADTQNSYGCATSTPYSTSRLMLLNMPGQLPQTLSSPSTRLITEPPQATLWSPSMVCGMTTPPTSPGNVPPDLSHPYSKVFGTTAGGKGTPLGTPATSPPPAPLCHSDDYVHISLPQATVTPPRKVRSSSSAIPLPRHSDSL

SEQ ID NO: 889426 - protein, 1164 aa, Homo sapiens; identical to SEQ ID NO: 889420

SEQ ID NO: 889427 - protein, 740 aa, Homo sapiens [sequence omitted]

SEQ ID NO: 889428 - protein, 754 aa, Homo sapiens
MKSYYRHILYSVSSFTLTGITLYFFDFSCLCFSSEEPPGSKGSVTLSDLPGFLGDLASEEDSIEKDKEEAAISRELSEITTAEAEPVVPRGGFDSPFYRDSLPGSQRKTHSAASSSQGASVNPEPLHSSLDKLGPDTPKQAFTPIDLPCGSADESPAGDRECQTSLETSIFTPSPCKIPPPTRVGFGSGQPPPYDHLFEVALPKTAHHFVIRKTEELLKKAKGNTEEDGVPSTSPMEVLDRLIQQGADAHSKELNKLPLPSKSVDWTHFGGSPPSDEIRTLRDQLLLLHNQLLYERFKRQQHALRNRRLLRKVIKAAALEEHNAAMKDQLKLQEKDIQMWKVSLQKEQARYNQLQEQRDTMVTKLHSQIRQLQHDREEFYNQSQELQTKLEDCRNMIAELRIELKKANNKVCHTELLLSQVSQKLSNSESVQQQMEFLNRQLLVLGEVNELYLEQLQNKHSDTTKEVEMMKAAYRKELEKNRSHVLQQTQRLDTSQKRILELESHLAKKDHLLLEQKKYLEDVKLQARGQLQAAESRYEAQKRITQVFELEILDLYGRLEKDGLLKKLEEEKAEAAEAAEERLDCCNDGCSDSMVGHNEEASGHNGETKTPRPSSARGSSGSRGGGGSSSSSSELSTPEKPPHQRAGPFSSRWETTMGEASASIPTTVGSLPSSKSFLGMKARELFRNKSESQCDEDGMTSSLSESLKTELGKDLGVEAKIPLNLDGPHPSPPTPDSVGQLHIMDYNETHHEHS

SEQ ID NO: 889429 - protein, 420 aa, Homo sapiens
MAQQANVGELLAMLDSPMLGVRDDVTAVFKENLNSDRGPMLVNTLVDYYLETSSQPALHILTTLQEPHDKHLLDRINEYVGKAATRLSILSLLGHVIRLQPSWKHKLSQAPLLPSLLKCLKMDTDVVVLTTGVLVLITMLPMIPQSGKQHLLDFFDIFGRLSSWCLKKPGHVAEVYLVHLHASVYALFHRLYGMYPCNFVSFLRSHYSMKENLETFEEVVKPMMEHVRIHPELVTGSKDHELDPRRWKRLETHDVVIECAKISLDPTEASYEDGYSVSHQISARFPHRSADVTTSPYADTQNSYGCATSTPYSTSRLMLLNMPGQLPQTLSSPSTRLITEPPQATLGAIYGRGMTILSSSECPTIAPYSKAGKRGRILGPELSLKPLDETGQYSSGSPRRQRPNRTEPIETDKPALARRT

SEQ ID NO: 889430 - protein, 672 aa, Homo sapiens
MTPSQVAFEIRGTLLPGEVFAICGSCDALGNWNPQNAVALLPENDTGESMLWKATIVLSRGVSVQYRYFKGYFLEPKTIGGPCQVIVHKWETHLQPRSITPLESEIIIDDGQFGIHNGVETLDSGWLTCQTEIRLRLHYSEKPPVSITKKKLKKSRFRVKLTLEGLEEDDDDRVSPTVLHKMSNSLEISLISDNEFKCRHSQPECGYGLQPDRWTEYSIQTMEPDNLELIFDFFEEDLSEHVVQGDALPGHVGTACLLSSTIAESGKSAGILTLPIMSRNSRKTIGKVRVDYIIIKPLPGYSCDMKSSFSKYWKPRIPLDVGHRGAGNSTTTAQLAKVQENTIASLRNAASHGAAFVEFDVHLSKDFVPVVYHDLTCCLTMKKKFDADPVELFEIPVKELTFDQLQLLKLTHVTALKSKDRKESVVQEENSFSENQPFPSLKMVLESLPEDVGFNIEIKWICQQRDGMWDGNLSTYFDMNLFLDIILKTVLENSGKRRIVFSSFDADICTMVRQKQNKYPILFLTQGKSEIYPELMDLRSRTTPIAMSFAQFENLLGINVHTEDLLRNPSYIQEAKAKGLVIFCWGDDTNDPENRRKLKELGVNGLIYDRIYDWMPEQPNIFQVEQLERLKQELPELKSCLCPTVSRFVPSSLCGESDIHVDANGIDNVENA

SEQ ID NO: 889431 - protein, 385 aa, Homo sapiens
MKVDYIIIKPLPGYSCDMKSSFSKYWKPRIPLDVGHRGAGNSTTTAQLAKVQENTIASLRNAASHGAAFVEFDVHLSKDFVPVVYHDLTCCLTMKKKFDADPVELFEIPVKELTFDQLQLLKLTHVTALKSKDRKESVVQEENSFSENQPFPSLKMVLESLPEDVGFNIEIKWICQQRDGMWDGNLSTYFDMNLFLDIILKTVLENSGKRRIVFSSFDADICTMVRQKQNKYPILFLTQGKSEIYPELMDLRSRTTPIAMSFAQFENLLGINVHTEDLLRNPSYIQEAKAKGLVIFCWGDDTNDPENRRKLKELGVNGLIYDRIYDWMPEQPNIFQVEQLERLKQELPELKSCLCPTVSRFVPSSLCGESDIHVDANGIDNVENA

SEQ ID NO: 889432 - protein, 385 aa, Homo sapiens; identical to SEQ ID NO: 889431

SEQ ID NO: 889433 - protein, 385 aa, Homo sapiens; identical to SEQ ID NO: 889431

SEQ ID NO: 889434 - protein, 205 aa, Homo sapiens [sequence omitted]

SEQ ID NO: 889435 - protein, 385 aa, Homo sapiens; identical to SEQ ID NO: 889431

SEQ ID NO: 889436 - protein, 385 aa, Homo sapiens; identical to SEQ ID NO: 889431

SEQ ID NO: 889437 - protein, 385 aa, Homo sapiens; identical to SEQ ID NO: 889431

SEQ ID NO: 889438 - protein, 385 aa, Homo sapiens; identical to SEQ ID NO: 889431

SEQ ID NO: 889439 - protein, 385 aa, Homo sapiens; identical to SEQ ID NO: 889431

SEQ ID NO: 889440 - protein, 385 aa, Homo sapiens; identical to SEQ ID NO: 889431

SEQ ID NO: 889441 - protein, 347 aa, Homo sapiens [sequence omitted]

SEQ ID NO: 889442 - protein, 227 aa, Homo sapiens
LETQSLEPSIEIKVEYCQQRDGMWDGNLSTYFDMNLFLDIILKTVLENSGKRRIVFSSFDADICTMVRQKQNKYPILFLTQGKSEIYPELMDLRSRTTPIAMSFAQFENLLGINVHTEDLLRNPSYIQEAKAKGLVIFCWGDDTNDPENRRKLKELGVNGLIYDRIYDWMPEQPNIFQVEQLERLKQELPELKSCLCPTVSRFVPSSLCGESDIHVDANGIDNVENA

SEQ ID NO: 889443 - protein, 385 aa, Homo sapiens; identical to SEQ ID NO: 889431

SEQ ID NO: 889444 - protein, 611 aa, Homo sapiens
MHLTLSLLLFSLHFPTYIIRVNFCLVSNLFQRMRSTKLLRLIDLDFSFTFSLLDLPPVNEYDMYIRNFGKKNTKQAYVQCNEDNVERDIQTEEIETREVWTQHPGESTVVSGGSEQRDTSDAVVMPKIDTPRLCSFLRAACQVMAVLLEEDRLAAEPSWNLRAQDRALYFSDSSSQLNTSLPFLQNRKVSSLHTSRVQRQMVVSVHDLPEKSFVPLLDSKYVLCVWDIWQPSGPQKVLICESQVTCCCLSPLKAFLLFAGTAHGSVVVWDLREDSRLHYSVTLSDGFWTFRTATFSTDGILTSVNHRSPLQAVEPISTSVHKKQSFVLSPFSTQEEMSGLSFHIASLDESGVLNVWVVVELPKADIAGSISDLGLMPGGRVKLVHSALIQLGDSLSHKGNEFWGTTQTLNVKFLPSDPNHFIIGTDMGLISHGTRQDLRVAPKLFKPQQHGIRPVKVNVIDFSPFGEPIFLAGCSDGSIRLHQLSSAFPLLQWDSSTDSHAVTGLQWSPTRPAVFLVQDDTSNIYIWDLLQSDLGPVAKQQVSPNRLVAMAAVGEPEKAGGSFLALVLARASGSIDIQHLKRRWAAPEVDECNRLRLLLQEALWPEGKLHK

SEQ ID NO: 889445 - protein, 275 aa, Homo sapiens
MSGLSFHIASLDESGVLNVWVVVELPKADIAGSISDLGLMPGGRVKLVHSALIQLGDSLSHKGNEFWGTTQTLNVKFLPSDPNHFIIGTDMGLISHGTRQDLRVAPKLFKPQQHGIRPVKVNVIDFSPFGEPIFLAGCSDGSIRLHQLSSAFPLLQWDSSTDSHAVTGLQWSPTRPAVFLVQDDTSNIYIWDLLQSDLGPVAKQQVSPNRLVAMAAVGEPEKAGGSFLALVLARASGSIDIQHLKRRWAAPEVDECNRLRLLLQEALWPEGKLHK

SEQ ID NO: 889446 - protein, 185 aa, Homo sapiens [sequence omitted]

SEQ ID NO: 889447 - protein, 185 aa, Homo sapiens [sequence omitted]

SEQ ID NO: 889448 - protein, 227 aa, Homo sapiens
MLFPHISPCEVRVLMLLYSSKKKIFMGLIPYDQSGFVSAIRQVITTRKQAVGPGGVNSGPVQIVNNKFLAWSGVMEWQEPRPEPNSRSKRWLPSHVYVNQGEILRTEQWPRKLYMQLIPQQLLTTLVPLFRNSRLVQFHFTKDLETLKSLCRIMDNGFAGCVHFSYKASCEIRVLMLLYSSEKKIFIGLIPHDQGNFVNGIRRVIANQQQVLQRNLEQEQQQRGMGG

SEQ ID NO: 889449 - protein, 479 aa, Homo sapiens
RLGERPAVKSARRPRLRGSGPLGPPMEGARVFGALGPIGPSSPGLTLGGLAVSEHRLSNKLLAWSGVLEWQEVSLCGAAAGLQGLVLSLRGQARASRLCTVTPLLPPQKRRPYSDSTAKLKRTLPCQAYVNQGENLECRGVAARAVAGAVAVAVGIRAALSDQLLPKGDRPVAAEADHAADPSAAAGETRPSHPIHSEHPHAWLTQLLSCRPQTTLGPLFRNSQLAQFHFTNRDCDSLKGLCRIMGNGFAGCMLFPHISPCEVRVLMLLYSSKKKIFMGLIPYDQSGFVSAIRQVITTRKQAVGPGGVNSGPVQIVNNKFLAWSGVMEWQEPRPEPNSRSKRWLPSHVYVNQGEILRTEQWPRKLYMQLIPQQLLTTLVPLFRNSRLVQFHFTKDLETLKSLCRIMDNGFAGCVHFSYKASCEIRVLMLLYSSEKKIFIGLIPHDQGNFVNGIRRVIANQQQVLQRNLEQEQQQRGMGG

SEQ ID NO: 889450 - protein, 332 aa, Homo sapiens
MAGARSCRGARRMPGGFPPGLHGKAATGRLCRAGGWVLARRQGSQRSGELGRGWDRPAAGRPCLVTTCPGHALPVEADSAGPVHQVRAGTCLRPLGSHGGLWQMRGRACSPGTREWTQLGLTAKARREGWQAPGQTDRFPRSLGPSSHPVPFQQAVGPGGVNSGPVQIVNNKFLAWSGVMEWQEPRPEPNSRSKRWLPSHVYVNQGEILRTEQWPRKLYMQLIPQQLLTTLVPLFRNSRLVQFHFTKDLETLKSLCRIMDNGFAGCVHFSYKASCEIRVLMLLYSSEKKIFIGLIPHDQGNFVNGIRRVIANQQQVLQRNLEQEQQQRGMGG

SEQ ID NO: 889451 - protein, 227 aa, Homo sapiens; identical to SEQ ID NO: 889448

SEQ ID NO: 889452 - protein, 254 aa, Homo sapiens
LRIELRYPHVSRSLGLCRIMGNGFAGCMLFPHISPCEVRVLMLLYSSKKKIFMGLIPYDQSGFVSAIRQVITTRKQAVGPGGVNSGPVQIVNNKFLAWSGVMEWQEPRPEPNSRSKRWLPSHVYVNQGEILRTEQWPRKLYMQLIPQQLLTTLVPLFRNSRLVQFHFTKDLETLKSLCRIMDNGFAGCVHFSYKASCEIRVLMLLYSSEKKIFIGLIPHDQGNFVNGIRRVIANQQQVLQRNLEQEQQQRGMGG

SEQ ID NO: 889453 - protein, 220 aa, Homo sapiens
MLFPHISPCEVRVLMLLYSSKKKIFMGLIPYDQSGFVSAIRQAVGPGGVNSGPVQIVNNKFLAWSGVMEWQEPRPEPNSRSKRWLPSHVYVNQGEILRTEQWPRKLYMQLIPQQLLTTLVPLFRNSRLVQFHFTKDLETLKSLCRIMDNGFAGCVHFSYKASCEIRVLMLLYSSEKKIFIGLIPHDQGNFVNGIRRVIANQQQVLQRNLEQEQQQRGMGG

SEQ ID NO: 889454 - protein, 136 aa, Homo sapiens
RLGERPAVKSARRPRLRGSGPLGPPMEGARVFGALGPIGPSSPGLTLGGLAVSEHRLSNKLLAWSGVLEWQEVSLCGAAAGLQGLVLSLRGQARASRLCTVTPLLPPQKRRPYSDSTAKLKRTLPCQAYVNQGENL

SEQ ID NO: 889455 - protein, 276 aa, Homo sapiens
MGGCEQMRGRACSPGTREWTQLGLTGQGSEGGMAGPRTDRQVSQEPGPLFPPRSLPTGSGTWWCQLRPSPDRQQQVSGMEWCHGVAGGEHSAAQGLVDPQILTDCGWEGTLALGVSSPEGSSLPLPQKPRPEPNSRSKRWLPSHVYVNQGEILRTEQWPRKLYMQLIPQQLLTTLVPLFRNSRLVQFHFTKDLETLKSLCRIMDNGFAGCVHFSYKASCEIRVLMLLYSSEKKIFIGLIPHDQGNFVNGIRRVIANQQQVLQRNLEQEQQQRGMGG

SEQ ID NO: 889456 - protein, 136 aa, Homo sapiens; identical to SEQ ID NO: 889454

SEQ ID NO: 889457 - protein, 227 aa, Homo sapiens; identical to SEQ ID NO: 889448

SEQ ID NO: 889458 - protein, 227 aa, Homo sapiens; identical to SEQ ID NO: 889448

SEQ ID NO: 889459 - protein, 136 aa, Homo sapiens; identical to SEQ ID NO: 889454

SEQ ID NO: 889460 - protein, 136 aa, Homo sapiens; identical to SEQ ID NO: 889454

SEQ ID NO: 889461 - protein, 136 aa, Homo sapiens; identical to SEQ ID NO: 889454

SEQ ID NO: 889462 - protein, 227 aa, Homo sapiens; identical to SEQ ID NO: 889448

SEQ ID NO: 889463 - protein, 227 aa, Homo sapiens; identical to SEQ ID NO: 889448

SEQ ID NO: 889464 - protein, 136 aa, Homo sapiens; identical to SEQ ID NO: 889454

SEQ ID NO: 889465 - protein, 136 aa, Homo sapiens; identical to SEQ ID NO: 889454

SEQ ID NO: 889466 - protein, 121 aa, Homo sapiens
RLRDHGQWLLSPSVRWRRLDFGVSEPSPRCPPSSWAILGPAACTFPTKHRVRSACLCSCTLQRRKSSLASSPMTRATLSTASGVSLPTSSRSCSGTWSRSNSNEGWGGSGYPGLGPSRSHR

SEQ ID NO: 889467 - protein, 136 aa, Homo sapiens; identical to SEQ ID NO: 889454

SEQ ID NO: 889468 - protein, 136 aa, Homo sapiens; identical to SEQ ID NO: 889454

SEQ ID NO: 889469 - protein, 136 aa, Homo sapiens; identical to SEQ ID NO: 889454

SEQ ID NO: 889470 - protein, 136 aa, Homo sapiens; identical to SEQ ID NO: 889454

SEQ ID NO: 889471 - protein, 1662 aa, Homo sapiens
MTDRFWDQWYLWYLRLLRLLDRGSFRNDGLKASDVLPILKEKVAFVSGGGRDKRGGPILTFPARSNHDRIRQEDLRKLVTYLASVPSEDVCKRGFTVIIDMRGSKWDLIKPLLKTLQEAFPAEIHVALIIKPDNFWQKQKTNFGSSKFIFETSMVSVEGLTKLVDPSQLTEEFDGSLDYNHEEWIELRLSLEEFFNSAVHLLSRLEDLQEMLARKEFPVDVEGSRRLIDEHTQLKKKVLKAPVEELDREGQRLLQCIRCSDGFSGRNCIPGSADFQSLVPKITSLLDKLHSTRQHLHQMWHVRKLKLDQCFQLRLFEQDAEKMFDWISHNKELFLQSHTEIGVSYQYALDLQTQHNHFAMNSMNAYVNINRIMSVASRLSEAGHYASQQIKQISTQLDQEWKSFAAALDERSTILAMSAVFHQKAEQFLSGVDAWCKMCSEGGLPSEMQDLELAIHHHQTLYEQVTQAYTEVSQDGKALLDVLQRPLSPGNSESLTATANYSKAVHQVLDVVHEVLHHQRRLESIWQHRKVRLHQRLQLCVFQQDVQQVLDWIENHGEAFLSKHTGVGKSLHRARALQKRHDDFEEVAQNTYTNADKLLEAAEQLAQTGECDPEEIYKAARHLEVRIQDFVRRVEQRKLLLDMSVSFHTHTKELWTWMEDLQKEMLEDVCADSVDAVQELIKQFQQQQTATLDATLNVIKEGEDLIQQLRSAPPSLGEPSGDSAVSNNKTPHSSSISHIESVLQQLDDAQVQMEELFHERKIKLDIFLQLRIFEQYTIEVTAELDAWNEDLLRQMNDFNTEDLTLAEQRLQRHTERKLAMNNMTFEVIQQGQDLHQYITEVQASGIELICEKDIDLAAQVQELLEFLHEKQHELELNAEQTHKRLEQCLQLRHLQAEVKQVLGWIRNGESMLNASLVNASSLSEAEQLQREHEQFQLAIESLFHATSLQKTHQSALQVQQKAEVLLQAGHYDADAIRECAEKVALHWQQLMLKMEDRLKLVNASVAFYKTSEQVCSVLESLEQEYRRDEDWCGGRDKLGPAAEIDHVIPLISKHLEQKEAFLKACTLARRNAEVFLKYIHRNNVSMPSVASHTRGPEQQVKAILSELLQRENRVLHFWTLKKRRLDQCQQYVVFERSAKQALDWIQETGEFYLSTHTSTGETTEETQELLKEYGEFRVPAKQTKEKVKLLIQLADSFVEKGHIHATEIRKWVTTVDKHYRDFSLRMGKYRYSLEKALGVNTEDNKDLELDIIPASLSDREVKLRDANHEVNEEKRKSARKKEFIMAELLQTEKAYVRDLHECLETYLWEMTSGVEEIPPGILNKEHIIFGNIQEIYDFHNNIFLKELEKYEQLPEDVGHCFVTWADKFQMYVTYCKNKPDSNQLILEHAGTFFDEIQQRHGLANSISSYLIKPVQRITKYQLLLKELLTCCEEGKGELKDGLEVMLSVPKKANDAMHVSMLEGFDENLDVQGELILQDAFQVWDPKSLIRKGRERHLFLFEISLVFSKEIKDSSGHTKYVYKNKLLTSELGVTEHVEGDPCKFALWSGRTPSSDNKTVLKASNIETKQEWIKNIREVIQERIIHLKGALKEPLQLPKTPAKQRNNSKRDGVEDIDSQGDGSSQPDTISIASRTSQNTVDSDKDGNLVPRWHLGPGDPFSTYV

SEQ ID NO: 889472 - protein, 124 aa, Homo sapiens
AAAAAPRALRPPGAEQPSAPGFFGSRLPADSPPTVMNPPEGAAEEGGAADSDVDAFFLDGSFRNDGLKASDVLPILKEKVAFVSGGGRDKRGGPILTFPARSNHDRIRQEDLRKLVTYLASVPR

SEQ ID NO: 889473 - protein, 1562 aa, Homo sapiens
MRGSKWDLIKPLLKTLQEAFPAEIHVALIIKPDNFWQKQKTNFGSSKFIFETSMVSVEGLTKLVDPSQLTEEFDGSLDYNHEEWIELRLSLEEFFNSAVHLLSRLEDLQEMLARKEFPVDVEGSRRLIDEHTQLKKKVLKAPVEELDREGQRLLQCIRCSDGFSGRNCIPGSADFQSLVPKITSLLDKLHSTRQHLHQMWHVRKLKLDQCFQLRLFEQDAEKMFDWISHNKELFLQSHTEIGVSYQYALDLQTQHNHFAMNSMNAYVNINRIMSVASRLSEAGHYASQQIKQISTQLDQEWKSFAAALDERSTILAMSAVFHQKAEQFLSGVDAWCKMCSEGGLPSEMQDLELAIHHHQTLYEQVTQAYTEVSQDGKALLDVLQRPLSPGNSESLTATANYSKAVHQVLDVVHEVLHHQRRLESIWQHRKVRLHQRLQLCVFQQDVQQVLDWIENHGEAFLSKHTGVGKSLHRARALQKRHDDFEEVAQNTYTNADKLLEAAEQLAQTGECDPEEIYKAARHLEVRIQDFVRRVEQRKLLLDMSVSFHTHTKELWTWMEDLQKEMLEDVCADSVDAVQELIKQFQQQQTATLDATLNVIKEGEDLIQQLRSAPPSLGEPSGDSAVSNNKTPHSSSISHIESVLQQLDDAQVQMEELFHERKIKLDIFLQLRIFEQYTIEVTAELDAWNEDLLRQMNDFNTEDLTLAEQRLQRHTERKLAMNNMTFEVIQQGQDLHQYITEVQASGIELICEKDIDLAAQVQELLEFLHEKQHELELNAEQTHKRLEQCLQLRHLQAEVKQVLGWIRNGESMLNASLVNASSLSEAEQLQREHEQFQLAIESLFHATSLQKTHQSALQVQQKAEVLLQAGHYDADAIRECAEKVALHWQQLMLKMEDRLKLVNASVAFYKTSEQVCSVLESLEQEYRRDEDWCGGRDKLGPAAEIDHVIPLISKHLEQKEAFLKACTLARRNAEVFLKYIHRNNVSMPSVASHTRGPEQQVKAILSELLQRENRVLHFWTLKKRRLDQCQQYVVFERSAKQALDWIQETGEFYLSTHTSTGETTEETQELLKEYGEFRVPAKQTKEKVKLLIQLADSFVEKGHIHATEIRKWVTTVDKHYRDFSLRMGKYRYSLEKALGVNTEDNKDLELDIIPASLSDREVKLRDANHEVNEEKRKSARKKEFIMAELLQTEKAYVRDLHECLETYLWEMTSGVEEIPPGILNKEHIIFGNIQEIYDFHNNIFLKELEKYEQLPEDVGHCFVTWADKFQMYVTYCKNKPDSNQLILEHAGTFFDEIQQRHGLANSISSYLIKPVQRITKYQLLLKELLTCCEEGKGELKDGLEVMLSVPKKANDAMHVSMLEGFDENLDVQGELILQDAFQVWDPKSLIRKGRERHLFLFEISLVFSKEIKDSSGHTKYVYKNKLLTSELGVTEHVEGDPCKFALWSGRTPSSDNKTVLKASNIETKQEWIKNIREVIQERIIHLKGALKEPLQLPKTPAKQRNNSKRDGVEDIDSQGDGSSQPDTISIASRTSQNTVDSDKDGNLVPRWHLGPGDPFSTYV

SEQ ID NO: 889474 - protein, 1551 aa, Homo sapiens
MRGSKWDLIKPLLKTLQEAFPAEIHVALIIKPDNFWQKQKTNFGSSKFIFETSMVSVEGLTKLVDPSQLTEEFDGSLDYNHEEWIELRLSLEEFFNSAVHLLSRLEDLQEMLARKEFPVDVEGSRRLIDEHTQLKKKVLKAPVEELDREGQRLLQCIRCSDGFSGRNCIPGSADFQSLVPKITSLLDKLHSTRQHLHQMWHVRKLKLDQCFQLRLFEQDAEKMFDWISHNKELFLQSHTEIGVSYQYALDLQTQHNHFAMNSMNAYVNINRIMSVASRLSEAGHYASQQIKQISTQLDQEWKSFAAALDERSTILAMSAVFHQKAEQFLSGVDAWCKMCSEGGLPSEMQDLELAIHHHQTLYEQVTQAYTEVSQDGKALLDVLQRPLSPGNSESLTATANYSKAVHQVLDVVHEVLHHQRRLESIWQHRKVRLHQRLQLCVFQQDVQQVLDWIENHGEAFLSKHTGVGKSLHRARALQKRHDDFEEVAQNTYTNADKLLEAAEQLAQTGECDPEEIYKAARHLEVRIQDFVRRVEQRKLLLDMSVSFHTHTKELWTWMEDLQKEMLEDVCADSVDAVQELIKQFQQQQTATLDATLNVIKEGEDLIQQLRDSAVSNNKTPHSSSISHIESVLQQLDDAQVQMEELFHERKIKLDIFLQLRIFEQYTIEVTAELDAWNEDLLRQMNDFNTEDLTLAEQRLQRHTERKLAMNNMTFEVIQQGQDLHQYITEVQASGIELICEKDIDLAAQVQELLEFLHEKQHELELNAEQTHKRLEQCLQLRHLQAEVKQVLGWIRNGESMLNASLVNASSLSEAEQLQREHEQFQLAIESLFHATSLQKTHQSALQVQQKAEVLLQAGHYDADAIRECAEKVALHWQQLMLKMEDRLKLVNASVAFYKTSEQVCSVLESLEQEYRRDEDWCGGRDKLGPAAEIDHVIPLISKHLEQKEAFLKACTLARRNAEVFLKYIHRNNVSMPSVASHTRGPEQQVKAILSELLQRENRVLHFWTLKKRRLDQCQQYVVFERSAKQALDWIQETGEFYLSTHTSTGETTEETQELLKEYGEFRVPAKQTKEKVKLLIQLADSFVEKGHIHATEIRKWVTTVDKHYRDFSLRMGKYRYSLEKALGVNTEDNKDLELDIIPASLSDREVKLRDANHEVNEEKRKSARKKEFIMAELLQTEKAYVRDLHECLETYLWEMTSGVEEIPPGILNKEHIIFGNIQEIYDFHNNIFLKELEKYEQLPEDVGHCFVTWADKFQMYVTYCKNKPDSNQLILEHAGTFFDEIQQRHGLANSISSYLIKPVQRITKYQLLLKELLTCCEEGKGELKDGLEVMLSVPKKANDAMHVSMLEGFDENLDVQGELILQDAFQVWDPKSLIRKGRERHLFLFEISLVFSKEIKDSSGHTKYVYKNKLLTSELGVTEHVEGDPCKFALWSGRTPSSDNKTVLKASNIETKQEWIKNIREVIQERIIHLKGALKEPLQLPKTPAKQRNNSKRDGVEDIDSQGDGSSQPDTISIASRTSQNTVDSDKDGNLVPRWHLGPGDPFSTYV

SEQ ID NO: 889475 - protein, 1686 aa, Homo sapiens
MRGSKWDLIKPLLKTLQEAFPAEIHVALIIKPDNFWQKQKTNFGSSKFIFETSMVSVEGLTKLVDPSQLTEEFDGSLDYNHEEWIELRLSLEEFFNSAVHLLSRLEDLQEMLARKEFPVDVEGSRRLIDEHTQLKKKVLKAPVEELDREGQRLLQCIRCSDGFSGRNCIPGSADFQSLVPKITSLLDKLHSTRQHLHQMWHVRKLKLDQCFQLRLFEQDAEKMFDWISHNKELFLQSHTEIGVSYQYALDLQTQHNHFAMNSMNAYVNINRIMSVASRLSEAGHYASQQIKQISTQLDQEWKSFAAALDERSTILAMSAVFHQKAEQFLSGVDAWCKMCSEGGLPSEMQDLELAIHHHQTLYEQVTQAYTEVSQDGKALLDVLQRPLSPGNSESLTATANYSKAVHQVLDVVHEVLHHQRRLESIWQHRKVRLHQRLQLCVFQQDVQQVLDWIENHGEAFLSKHTGVGKSLHRARALQKRHDDFEEVAQNTYTNADKLLEAAEQLAQTGECDPEEIYKAARHLEVRIQDFVRRVEQRKLLLDMSVSFHTHTKELWTWMEDLQKEMLEDVCADSVDAVQELIKQFQQQQTATLDATLNVIKEGEDLIQQLRSAPPSLGEPSGDSAVSNNKTPHSSSISHIESVLQQLDDAQVQMEELFHERKIKLDIFLQLRIFEQYTIEVTAELDAWNEDLLRQMNDFNTEDLTLAEQRLQRHTERKLAMNNMTFEVIQQGQDLHQYITEVQASGIELICEKDIDLAAQVQELLEFLHEKQHELELNAEQTHKRLEQCLQLRHLQAEVKQVLGWIRNGESMLNASLVNASSLSEAEQLQREHEQFQLAIESLFHATSLQKTHQSALQVQQKAEVLLQAGHYDADAIRECAEKVALHWQQLMLKMEDRLKLVNASVAFYKTSEQVCSVLESLEQEYRRDEDWCGGRDKLGPAAEIDHVIPLISKHLEQKEAFLKACTLARRNAEVFLKYIHRNNVSMPSVASHTRGPEQQVKAILSELLQRENRVLHFWTLKKRRLDQCQQYVVFERSAKQALDWIQETGEFYLSTHTSTGETTEETQELLKEYGEFRVPAKQTKEKVKLLIQLADSFVEKGHIHATEIRKWVTTVDKHYRDFSLRMGKYRYSLEKALGVNTEDNKDLELDIIPASLSDREVKLRDANHEVNEEKRKSARKKEFIMAELLQTEKAYVRDLHECLETYLWEMTSGVEEIPPGILNKEHIIFGNIQEIYDFHNNIFLKELEKYEQLPEDVGHCFVTWADKFQMYVTYCKNKPDSNQLILEHAGTFFDEIQQRHGLANSISSYLIKPVQRITKYQLLLKELLTCCEEGKGELKDGLEVMLSVPKKANDAMHVSMLEGFDENLDVQGELILQDAFQVWDPKSLIRKGRERHLFLFEISLVFSKEIKDSSGHTKYVYKNKLLTSELGVTEHVEGDPCKFALWSGRTPSSDNKTVLKASNIETKQEWIKNIREVIQERIIHLKGALKEPLQLPKTPAKQRNNSKRDGVEDIDSQGDGSSQPDTISIASRTSQNTVDSDKLSGGCELTVVLQDFSAGHSSELTIQVGQTVELLERPSERPGWCLVRTTERSPPLEGLVPSSALCISHSRSSVEMDCFFPLVKDAYSHSSSENGGKSESVANLQAQPSLNSIHSSPGPKRSTNTLKKWLTSPVRRLNSGKADGNI

SEQ ID NO: 889476 - protein, 577 aa, Homo sapiens
MPSVASHTRGPEQQVKAILSELLQRENRVLHFWTLKKRRLDQCQQYVVFERSAKQALDWIQETGEFYLSTHTSTGETTEETQELLKEYGEFRVPAKQTKEKVKLLIQLADSFVEKGHIHATEIRKWVTTVDKHYRDFSLRMGKYRYSLEKALGVNTEDNKDLELDIIPASLSDREVKLRDANHEVNEEKRKSARKKEFIMAELLQTEKAYVRDLHECLETYLWEMTSGVEEIPPGILNKEHIIFGNIQEIYDFHNNIFLKELEKYEQLPEDVGHCFVTWADKFQMYVTYCKNKPDSNQLILEHAGTFFDEIQQRHGLANSISSYLIKPVQRITKYQLLLKELLTCCEEGKGELKDGLEVMLSVPKKANDAMHVSMLEGFDENLDVQGELILQDAFQVWDPKSLIRKGRERHLFLFEISLVFSKEIKDSSGHTKYVYKNKLLTSELGVTEHVEGDPCKFALWSGRTPSSDNKTVLKASNIETKQEWIKNIREVIQERIIHLKGALKEPLQLPKTPAKQRNNSKRDGVEDIDSQGDGSSQPDTISIASRTSQNTVDSDKDGNLVPRWHLGPGDPFSTYV

SEQ ID NO: 889477 - protein, 1538 aa, Homo sapiens
MRGSKWDLIKPLLKTLQEAFPAEIHVALIIKPDNFWQKQKTNFGSSKFIFETSMVSVEGLTKLVDPSQLTEEFDGSLDYNHEEWIELRLSLEEFFNSAVHLLSRLEDLQEMLARKEFPVDVEGSRRLIDEHTQLKKKVLKAPVEELDREGQRLLQCIRCSDGFSGRNCIPGSADFQSLVPKITSLLDKLHSTRQHLHQMWHVRKLKLDQCFQLRLFEQDAEKMFDWISHNKELFLQSHTEIGVSYQYALDLQTQHNHFAMNSMNAYVNINRIMSVASRLSEAGHYASQQIKQISTQLDQEWKSFAAALDERSTILAMSAVFHQKAEQFLSGVDAWCKMCSEGGLPSEMQDLELAIHHHQTLYEQVTQAYTEVSQDGKALLDVLQRPLSPGNSESLTATANYSKAVHQVLDVVHEVLHHQRRLESIWQHRKVRLHQRLQLCVFQQDVQQVLDWIENHGEAFLSKHTGVGKSLHRARALQKRHDDFEEVAQNTYTNADKLLEAAEQLAQTGECDPEEIYKAARHLEVRIQDFVRRVEQRKLLLDMSVSFHTHTKELWTWMEDLQKEMLEDVCADSVDAVQELIKQFQQQQTATLDATLNVIKEGEDLIQQLRSAPPSLGEPSGDSAVSNNKTPHSSSISHIESVLQQLDDAQVQMEELFHERKIKLDIFLQLRIFEQYTIEVTAELDAWNEDLLRQMNDFNTEDLTLAEQRLQRHTERKLAMNNMTFEVIQQGQDLHQYITEVQASGIELICEKDIDLAAQVQELLEFLHEKQHELELNAEQTHKRLEQCLQLRHLQAEVKQVLGWIRNGESMLNASLVNASSLSEAEQLQREHEQFQLAIESLFHATSLQKTHQSALQVQQKAEVLLQAGHYDADAIRECAEKVALHWQQLMLKMEDRLKLVNASVAFYKTSEQVCSVLESLEQEYRRDEDWCGGRDKLGPAAEIDHVIPLISKHLEQKEAFLKACTLARRNAEVFLKYIHRNNVSMPSVASHTRGPEQQVKAILSELLQRENRVLHFWTLKKRRLDQCQQYVVFERSAKQALDWIQETGEFYLSTHTSTGETTEETQELLKEYGEFRVPAKQTKEKVKLLIQLADSFVEKGHIHATEIRKWVTTVDKHYRDFSLRMGKYRYSLEKALGVNTEDNKDLELDIIPASLSDREVKLRDANHEVNEEKRKSARKKEFIMAELLQTEKAYVRDLHECLETYLWEMTSGVEEIPPGILNKEHIIFGNIQEIYDFHNNIFLKELEKYEQLPEDVGHCFVTWADKFQMYVTYCKNKPDSNQLILEHAGTFFDEIQQRHGLANSISSYLIKPVQRITKYQLLLKELLTCCEEGKGELKDGLEVMLSVPKKANDAMHVSMLEGFDENLDVQGELILQDAFQVWDPKSLIRKGRERHLFLFEISLVFSKEIKDSSGHTKYVYKNKLLTSELGVTEHVEGDPCKFALWSGRTPSSDNKTVLKASNIETKQEWIKNIREVIQERIIHLKGALKEPLQLPKTPAKQRNNSKRMEWRILTERGQNWRETEPVYVAALSPLVAI

SEQ ID NO: 889478 - protein, 331 aa, Homo sapiens
SEDARLIGNNIFLKELEKYEQLPEDVGHCFVTWADKFQMYVTYCKNKPDSNQLILEHAGTFFDEIQQRHGLANSISSYLIKPVQRITKYQLLLKELLTCCEEGKGELKDGLEVMLSVPKKANDAMHVSMLEGFDENLDVQGELILQDAFQVWDPKSLIRKGRERHLFLFEISLVFSKEIKDSSGHTKYVYKNKLLTSELGVTEHVEGDPCKFALWSGRTPSSDNKTVLKASNIETKQEWIKNIREVIQERIIHLKGALKEPLQLPKTPAKQRNNSKRDGVEDIDSQGDGSSQPDTISIASRTSQNTVDSDKDGNLVPRWHLGPGDPFSTYV

SEQ ID NO: 889479 - protein, 1427 aa, Homo sapiens
MRGSKWDLIKPLLKTLQEAFPAEIHVALIIKPDNFWQKQKTNFGSSKFIFETSMVSVEGLTKLVDPSQLTEEFDGSLDYNHEEWIELRLSLEEFFNSAVHLLSRLEDLQEMLARKEFPVDVEGSRRLIDEHTQLKKKVLKAPVEELDREGQRLLQCIRCSDGFSGRNCIPGSADFQSLVPKITSLLDKLHSTRQHLHQMWHVRKLKLDQCFQLRLFEQDAEKMFDWISHNKELFLQSHTEIGVSYQYALDLQTQHNHFAMNSMNAYVNINRIMSVASRLSEAGHYASQQIKQISTQLDQEWKSFAAALDERSTILAMSAVFHQKAEQFLSGVDAWCKMCSEGGLPSEMQDLELAIHHHQTLYEQVTQAYTEVSQDGKALLDVLQRPLSPGNSESLTATANYSKAVHQVLDVVHEVLHHQRRLESIWQHRKVRLHQRLQLCVFQQDVQQVLDWIENHGEAFLSKHTGVGKSLHRARALQKRHDDFEEVAQNTYTNADKLLEAAEQLAQTGECDPEEIYKAARHLEVRIQDFVRRVEQRKLLLDMSVSFHTHTKELWTWMEDLQKEMLEDVCADSVDAVQELIKQFQQQQTATLDATLNVIKEGEDLIQQLRSAPPSLGEPSGDSAVSNNKTPHSSSISHIESVLQQLDDAQVQMEELFHERKIKLDIFLQLRIFEQYTIEVTAELDAWNEDLLRQMNDFNTEDLTLAEQRLQRHTERKLAMNNMTFEVIQQGQDLHQYITEVQASGIELICEKDIDLAAQVQELLEFLHEKQHELELNAEQTHKRLEQCLQLRHLQAEVKQVLGWIRNGESMLNASLVNASSLSEAEQLQREHEQFQLAIESLFHATSLQKTHQSALQVQQKAEVLLQAGHYDADAIRECAEKVALHWQQLMLKMEDRLKLVNASVAFYKTSEQVCSVLESLEQEYRRDEDWCGGRDKLGPAAEIDHVIPLISKHLEQKEAFLKACTLARRNAEVFLKYIHRNNVSMPSVASHTRGPEQQVKAILSELLQRENRVLHFWTLKKRRLDQCQQYVVFERSAKQALDWIQETGEFYLSTHTSTGETTEETQELLKEYGEFRVPAKQTKEKVKLLIQLADSFVEKGHIHATEIRKWVTTVDKHYRDFSLRMGKYRYSLEKALGVNTEDNKDLELDIIPASLSDREVKLRDANHEVNEEKRKSARKKEFIMAELLQTEKAYVRDLHECLETYLWEMTSGVEEIPPGILNKEHIIFGNIQEIYDFHNNIFLKELEKYEQLPEDVGHCFVTWADKFQMYVTYCKNKPDSNQLILEHAGTFFDEIQQRHGLANSISSYLIKPVQRITKYQLLLKELLTCCEEGKGELKDGLEVMLSVPKKANDAMHVSMLEGFDENLDVQGELILQDAFQVWDPKSLIRKGRERHLFLFEISLVFSKEIKDSSGHTKYVYKNKLLP

SEQ ID NO: 889480 - protein, 641 aa, Homo sapiens
MRGSKWDLIKPLLKTLQEAFPAEIHVALIIKPDNFWQKQKTNFGSSKFIFETSMVSVEGLTKLVDPSQLTEEFDGSLDYNHEEWIELRLSLEEFFNSAVHLLSRLEDLQEMLARKEFPVDVEGSRRLIDEHTQLKKKVLKAPVEELDREGQRLLQCIRCSDGFSGRNCIPGSADFQSLVPKITSLLDKLHSTRQHLHQMWHVRKLKLDQCFQLRLFEQDAEKMFDWISHNKELFLQSHTEIGVSYQYALDLQTQHNHFAMNSMNAYVNINRIMSVASRLSEAGHYASQQIKQISTQLDQEWKSFAAALDERSTILAMSAVFHQKAEQFLSGVDAWCKMCSEGGLPSEMQDLELAIHHHQTLYEQVTQAYTEVSQDGKALLDVLQRPLSPGNSESLTATANYSKAVHQVLDVVHEVLHHQRRLESIWQHRKVRLHQRLQLCVFQQDVQQVLDWIENHGEAFLSKHTGVGKSLHRARALQKRHDDFEEVAQNTYTNADKLLEAAEQLAQTGECDPEEIYKAARHLEVRIQDFVRRVEQRKLLLDMSVSFHTHTKELWTWMEDLQKEMLEDVCADSVDAVQELIKQFQQQQTATLDATLNVIKEGEDLIQQLRSAPPSLGEPSEEARSAWAELSSGKCLGLDVR

SEQ ID NO: 889481 - protein, 641 aa, Homo sapiens; identical to SEQ ID NO: 889480

SEQ ID NO: 889482 - protein, 66 aa, Homo sapiens
AAAAAPRALRPPGAEQPSAPGFFGSRLPADSPPTVMNPPEGAAEEGGAADSDVDAFFRTGLFGMMV

SEQ ID NO: 889483 - protein, 44 aa, Homo sapiens
MVSVEGLTKLVDPSQLTEEFDGSLDYNHEEWIELRLSLEEFFNS

SEQ ID NO: 889484 - protein, 1100 aa, Homo sapiens
MPGKLKVKIVAGRHLPVMDRASDLTDAFVEVKFGNTTFKTDVYLKSLNPQWNSEWFKFEVDDEDLQDEPLQITVLDHDTYSANDAIGKVYIDIDPLLYSEAATVISGWFPIYDTIHGIRGEINVVVKVDLFNDLNRFRQSSCGVKFFCTTSIPKCYRAVIIHGFVEELVVNEDPEYQWIDRIRTPRASNEARQRLISLMSGELQRKIGLKVLEMRGNAVVGYLQCFDLEGESGLVVRAIGTACTLDKLSSPAAFLPACNSPSKEMKESPLVHPPSHGCRSTHNSPIHTATGSRLTQNFSVSVPTLIYTGTRLLRLQSWGDAGHGQSGCRGRQAGMGSGSAGKEGGPFKALLRQQTQSALEQRGGSPHRFCRRREFPFFTLTAFPPGFLVHVGGVVSARSVKLLDRIHNPAFVGIMGNTRSYKLLDWNSFNSDEPETRDAWWAEIRQEIKSHAKALGCHAVVGYSESTSICEEVCILSASGTAAVLNPRFLQDGTVEGCLEQRLEENLPTRCGFCHIPYDELNMPFPAHLTYCYNCRKQKVPDVLFTTIDLPTDATVIGKGCLIQARLCRLKKKAQAEANATAISNLLPFMEYEVHTQLMNKLKLKGMNALFGLRIQITVGENMLMGLASATGVYLAALPTPGGIQIAGKTPNDGSYEQHISHMQKKINDTIAKNKELYEINPPEISEEIIGSPIPEPRQRSRLLRSQSESSDEVTELDLSHGKKDAFVLEIDDTDAMEDVHSLLTDVPPPSGFYSCNTEIMPGINNWTSEIQMFTSVRVIRLSSLNLTNQALNKNFNDLCENLLKSLYFKLRSMIPCCLCHVNFTVSLPEDELIQVTVTAVAITFDKNQALQTTKTPVEKSLQRASTDNEELLQFPLELCSDSLPSHPFPPAKEHLESASSNSGIPAAQRATSVDYSSFADRCSSWIELIKLKAQTIRRGSIKTTMTVEKASPVGDGNFRNRSAPPCANSTVGVVKMTPLSFIPGAKITKYLGIINMFFIRETTSLREEGGVSGFLHAFIAEVFAMVRAHVAALGGNAVVSYIMKQCVFMENPNKNQAQCLINVSGDAVVFVRESDLEVVSSQQPTTNCQSSCTEGEVTT

SEQ ID NO: 889485 - protein, 1000 aa, Homo sapiens
MPGKLKVKIVAGRHLPVMDRASDLTDAFVEVKFGNTTFKTDVYLKSLNPQWNSEWFKFEVDDEDLQDEPLQITVLDHDTYSANDAIGKVYIDIDPLLYSEAATVISGWFPIYDTIHGIRGEINVVVKVDLFNDLNRFRQSSCGVKFFCTTSIPKCYRAVIIHGFVEELVVNEDPEYQWIDRIRTPRASNEARQRLISLMSGELQRKIGLKVLEMRGNAVVGYLQCFDLEGESGLVVRAIGTACTLDKLSSPAAFLPACNSPSKEMKEIPFNEDPNPNTHSSGPSTPLKNQTYSFSPSKSYSRQSSSSDTDLSLTPKTGMGSGSAGKEGGPFKALLRQQTQSALEQREFPFFTLTAFPPGFLVHVGGVVSARSVKLLDRIHNPDEPETRDAWWAEIRQEIKSHAKALGCHAVVGYSESTSICEEVCILSASGTAAVLNPRFLQDGTVEGCLEQRLEENLPTRCGFCHIPYDELNMPFPAHLTYCYNCRKQKVPDVLFTTIDLPTDATVIGKGCLIQARLCRLKKKAQAEANATAISNLLPFMEYEVHTQLMNKLKLKGMNALFGLRIQITVGENMLMGLASATGVYLAALPTPGGIQIAGKTPNDGSYEQHISHMQKKINDTIAKNKELYEINPPEISEEIIGSPIPEPRQRSRLLRSQSESSDEVTELDLSHGKKDAFVLEIDDTDAMEDVHSLLTDVPPPSGFYSCNTEIMPGINNWTSEIQMFTSVRVIRLSSLNLTNQALNKNFNDLCENLLKSLYFKLRSMIPCCLCHVNFTVSLPEDELIQVTVTAVAITFDKNQALQTTKTPVEKSLQRASTDNEELLQFPLELCSDSLPSHPFPPAKAMTVEKASPVGDGNFRNRSAPPCANSTVGVVKMTPLSFIPGAKITKYLGIINMFFIRETTSLREEGGVSGFLHAFIAEVFAMVRAHVAALGGNAVVSYIMKQCVFMENPNKNQAQCLINVSGDAVVFVRESDLEVVSSQQPTTNCQSSCTEGEVTT

SEQ ID NO: 889486 - protein, 978 aa, Homo sapiens
MPGKLKVKIVAGRHLPVMDRASDLTDAFVEVKFGNTTFKTDVYLKSLNPQWNSEWFKFEVDDEDLQDEPLQITVLDHDTYSANDAIGKVYIDIDPLLYSEAATVISGWFPIYDTIHGIRGEINVVVKVDLFNDLNRFRQSSCGVKFFCTTSIPKCYRAVIIHGFVEELVVNEDPEYQWIDRIRTPRASNEARQRLISLMSGELQRKIGLKVLEMRGNAVVGYLQCFDLEGESGLVVRAIGTACTLDKLSSPAAFLPACNSPSKEMKEIPFNEDPNPNTHSSGPSTPLKNQTYSFSPSKSYSRQSSSSDTDLSLTPKTGMGSGSAGKEGGPFKALLRQQTQSALEQREFPFFTLTAFPPGFLVHVGGVVSARSVKLLDRIHNPDEPETRDAWWAEIRQEIKSHAKALGCHAVVGYSESTSICEEVCILSASGTAAVLNPRFLQDGTVEGCLEQRLEENLPTRCGFCHIPYDELNMPFPAHLTYCYNCRKQKVPDVLFTTIDLPTDATVIGKGCLIQARLCRLKKKAQAEANATAISNLLPFMEYEVHTQLMNKLKLKGMNALFGLRIQITVGENMLMGLASATGVYLAALPTPGGIQIAGKTPNDGSYEQHISHMQKKINDTIAKNKELYEINPPEISEEIIGSPIPEPRQRSRLLRSQSESSDEVTELDLSHGKKDAFVLEIDDTDAMEDVHSLLTDVPPPSGFYSCNTEIMPGINNWTSEIQMFTSVRVIRLSSLNLTNQALNKNFNDLCENLLKSLYFKLRSMIPCCLCHVNFTVSLPEDELIQVTVTAVAITFDKNQALQTTKTPVEKSLQRASTDNEELLQFPLELCSDSLPSHPFPPAKAMTVEKASPVGDGNFRNRSAPPCANSTVGVVKMTPLSFIPGAEGGVSGFLHAFIAEVFAMVRAHVAALGGNAVVSYIMKQCVFMENPNKNQAQCLINVSGDAVVFVRESDLEVVSSQQPTTNCQSSCTEGEVTT

SEQ ID NO: 889487 - protein, 979 aa, Homo sapiens
MPGKLKVKIVAGRHLPVMDRASDLTDAFVEVKFGNTTFKTDVYLKSLNPQWNSEWFKFEVDDEDLQDEPLQITVLDHDTYSANDAIGKVYIDIDPLLYSEAATVISGWFPIYDTIHGIRGEINVVVKVDLFNDLNRFRQSSCGVKFFCTTSIPKCYRAVIIHGFVEELVVNEDPEYQWIDRIRTPRASNEARQRLISLMSGELQRKIGLKVLEMRGNAVVGYLQCFDLEGESGLVVRAIGTACTLDKLSSPAAFLPACNSPSKEMKEIPFNEDPNPNTHSSGPSTPLKNQTYSFSPSKSYSRQSSSSDTDLSLTPKTGMGSGSAGKEGGPFKALLRQQTQSALEQREFPFFTLTAFPPGFLVHVGGVVSARSVKLLDRIHNPDEPETRDAWWAEIRQEIKSHAKALGCHAVVGYSESTSICEEVCILSASGTAAVLNPRFLQDGTVEGCLEQRLEENLPTRCGFCHIPYDELNMPFPAHLTYCYNCRKQKVPDVLFTTIDLPTDATVIGKGCLIQARLCRLKKKAQAEANATAISNLLPFMEYEVHTQLMNKLKLKGMNALFGLRIQITVGENMLMGLASATGVYLAALPTPGGIQIAGKTPNDGSYEQHISHMQKKINDTIAKNKELYEINPPEISEEIIGSPIPEPRQRSRLLRSQSESSDEVTELDLSHGKKDAFVLEIDDTDAMEDVHSLLTDVPPPSGFYSCNTEIMPGINNWTSEIQMFTSVRVIRLSSLNLTNQALNKNFNDLCENLLKSLYFKLRSMIPCCLCHVNFTVSLPEDELIQVTVTAVAITFDKNQALQTTKTPVEKSLQRASTDNEELLQFPLELCSDSLPSHPFPPAKAMTVEKASPVGDGNFRNRSAPPCANSTVGVVKMTPLSFIPGAKITKYLGIINMFFIRETTSLREEGGVSGFLHAFIAEVFAMVRAHVAALGGNAVVSYVSGDAVVFVRESDLEVVSSQQPTTNCQSSCTEGEVTT

SEQ ID NO: 889488 - protein, 289 aa, Homo sapiens [sequence omitted]

SEQ ID NO: 889489 - protein, 271 aa, Homo sapiens
MPGINNWTSEIQMFTSVRVIRLSSLNLTNQALNKNFNDLCENLLKSLYFKLRSMIPCCLCHVNFTVSLPEDELIQVTVTAVAITFDKNQALQTTKTPVVELCSDSLPSHPFPPAKAMTVEKASPVGDGNFRNRSAPPCANSTVGVVKMTPLSFIPGAKITKYLGIINMFFIRETTSLREEGGVSGFLHAFIAEVFAMVRAHVAALGGNAVVSYIMKQCVFMENPNKNQAQCLINVSGDAVVFVRESDLEVVSSQQPTTNCQSSCTEGEVTT

SEQ ID NO: 889490 - protein, 1000 aa, Homo sapiens; identical to SEQ ID NO: 889485

SEQ ID NO: 889491 - protein, 556 aa, Homo sapiens
RPPPATAHRLPAPARPPPPRALRPPRSLALRHDEQMSASEGMKFKFHSGEKVLCFEPDPTKARVLYDAKIVDVIVGKDEKGRKIPEYLIHFNGWNRSWDRWAAEDHVLRDTDENRRLQRKLARKAVARLRSTGRKKKRCRLPGVDSVLKGLPTEEKDENDENSLSSSSDCSENKDEEISEESDIEEKTEVKEEPELQTRREMEERTITIEIPEVLKKQLEDDCYYINRRKRLVKLPCQTNIITILESYVKHFAINAAFSANERPRHHHVMPHANMNVHYIPAEKNVDLCKEMVDGLRITFDYTLPLVLLYPYEQAQYKKVTSSKFFLPIKESATSTNRSQEELSPSPPLLNPSTPQSTESQPTTGEPATPKRRKAEPEALQSLRRSTRHSANCDRLSESSASPQPKRRQQDTSASMPKLFLHLEKKTPVHSRSSSPIPLTPSKEGSAVFAGFEGRRTNEINEVLSWKLVPDNYPPGDQPPPPSYIYGAQHLLRLFVKLPEILGKMSFSEKNLKALLKHFDLFLRFLAEYHDDFFPESAYVAACEAHYSTKNPRAIY

SEQ ID NO: 889492 - protein, 451 aa, Homo sapiens
RPPPATAHRLPAPARPPPPRALRPPRSLALRHDEQMSASEGMKFKFHSGEKVLCFEPDPTKARVLYDAKIVDVIVGKDEKGRKIPEYLIHFNGWNRSWDRWAAEDHVLRDTDENRRLQRKLARKAVARLRSTGRKKKRCRLPGVDSVLKGLPTEEKDENDENSLSSSSDCSENKDEEISEESDIEEKTEVKEEPELQTRREMEERTITIEIPEVLKKQLEDDCYYINRRKRLVKLPCQTNIITILESYVKHFAINAAFSANERPRHHHVMPHANMNVHYIPAEKNVDLCKEMVDGLRITFDYTLPLVLLYPYEQAQYKKVTSSKFFLPIKESATSTNRSQEELSPSPPLLNPSTPQSTESQPTTGEPATPKRRKAEPEALQSLRRSTRHSANCDRLSESSASPQPKRRQQDTSASMPKLFLHLEKSRFILGCPRPGRASVYFVFSQCQAWC

SEQ ID NO: 889493 - protein, 509 aa, Homo sapiens
MSPSVRPGAGWAPVGRPGRPIQIVDVIVGKDEKGRKIPEYLIHFNGWNRSWDRWAAEDHVLRDTDENRRLQRKLARKAVARLRSTGRKKKRCRLPGVDSVLKGLPTEEKDENDENSLSSSSDCSENKDEEISEESDIEEKTEVKEEPELQTRREMEERTITIEIPEVLKKQLEDDCYYINRRKRLVKLPCQTNIITILESYVKHFAINAAFSANERPRHHHVMPHANMNVHYIPAEKNVDLCKEMVDGLRITFDYTLPLVLLYPYEQAQYKKVTSSKFFLPIKESATSTNRSQEELSPSPPLLNPSTPQSTESQPTTGEPATPKRRKAEPEALQSLRRSTRHSANCDRLSESSASPQPKRRQQDTSASMPKLFLHLEKKTPVHSRSSSPIPLTPSKEGSAVFAGFEGRRTNEINEVLSWKLVPDNYPPGDQPPPPSYIYGAQHLLRLFVKLPEILGKMSFSEKNLKALLKHFDLFLRFLAEYHDDFFPESAYVAACEAHYSTKNPRAIY

SEQ ID NO: 889494 - protein, 346 aa, Homo sapiens
RPPPATAHRLPAPARPPPPRALRPPRSLALRHDEQMSASEGMKFKFHSGEKVLCFEPDPTKARVLYDAKIVDVIVGKDEKGRKIPEYLIHFNGWNRSWDRWAAEDHVLRDTDENRRLQRKLARKAVARLRSTGRKKKRCRLPGVDSVLKGLPTEEKDENDENSLSSSSDCSENKDEEISEESDIEEKTEVKEEPELQTRREMEERTITIEIPEVLKKQLEDDCYYINRRKRLVKLPCQTNIITILESYVKHFAINAAFSANERPRHHHVMPHANMNVHYIPAEKNVDLCKEMVDGLRITFDYTLPLVLLYPYEQAQYKKEPGGTLSQSAFVESIHATVHRESADHR

SEQ ID NO: 889495 - protein, 100 aa, Homo sapiens
AAARELVLDRERPPAIYNSKRRKAEPEALQSLRRSTRHSANCDRLSESSASPQPKRRQQDTSASMPKLFLHLEKSRFILGCPRPGRASVYFVFSQCQAWC

SEQ ID NO: 889496 - protein, 451 aa, Homo sapiens; identical to SEQ ID NO: 889492

SEQ ID NO: 889497 - protein, 451 aa, Homo sapiens; identical to SEQ ID NO: 889492

SEQ ID NO: 889498 - protein, 290 aa, Homo sapiens
RPPPATAHRLPAPARPPPPRALRPPRSLALRHDEQMSASEGMKFKFHSGEKVLCFEPDPTKARVLYDAKIVDVIVGKDEKGRKIPEYLIHFNGWNRSWDRWAAEDHVLRDTDENRRLQRKLARKAVARLRSTGRKKKRCRLPGVDSVLKGLPTEEKDENDENSLSSSSDCSENKDEEISEESDIEEKTEVKEEPELQTRREMEERTITIEIPEVLKKQLEDDCYYINRRKRLVKLPCQTNIITILESYVKHFAINAAFSANERPRHHHVMPHANMNVHYIPAEKKSIFFS

SEQ ID NO: 889499 - protein, 355 aa, Homo sapiens
MEERTITIEIPEVLKKQLEDDCYYINRRKRLVKLPCQTNIITILESYVKHFAINAAFSANERPRHHHVMPHANMNVHYIPAEKNVDLCKEMVDGLRITFDYTLPLVLLYPYEQAQYKKVTSSKFFLPIKESATSTNRSQEELSPSPPLLNPSTPQSTESQPTTGEPATPKRRKAEPEALQSLRRSTRHSANCDRLSESSASPQPKRRQQDTSASMPKLFLHLEKKTPVHSRSSSPIPLTPSKEGSAVFAGFEGRRTNEINEVLSWKLVPDNYPPGDQPPPPSYIYGAQHLLRLFVKLPEILGKMSFSEKNLKALLKHFDLFLRFLAEYHDDFFPESAYVAACEAHYSTKNPRAIY

SEQ ID NO: 889500 - protein, 355 aa, Homo sapiens; identical to SEQ ID NO: 889499

SEQ ID NO: 889501 - protein, 457 aa, Homo sapiens
RPPPATAHRLPAPARPPPPRALRPPRSLALRHDEQMSASEGMKFKFHSGEKVLCFEPDPTKARVLYDAKIVDVIVGKDEKGRKIPEYLIHFNGWNRSWDRWAAEDHVLRDTDENRRLQRKLARKAVARLRSTGRKKKRCRLPGVDSVLKGLPTEEKDENDENSLSSSSDCSENKDEEISEESDIEEKTEVKEEPELQTRREMEERTITIEIPEVLKKQLEDDCYYINRRKRESATSTNRSQEELSPSPPLLNPSTPQSTESQPTTGEPATPKRRKAEPEALQSLRRSTRHSANCDRLSESSASPQPKRRQQDTSASMPKLFLHLEKKTPVHSRSSSPIPLTPSKEGSAVFAGFEGRRTNEINEVLSWKLVPDNYPPGDQPPPPSYIYGAQHLLRLFVKLPEILGKMSFSEKNLKALLKHFDLFLRFLAEYHDDFFPESAYVAACEAHYSTKNPRAIY

SEQ ID NO: 889502 - protein, 451 aa, Homo sapiens; identical to SEQ ID NO: 889492

SEQ ID NO: 889503 - protein, 364 aa, Homo sapiens
RPPPATAHRLPAPARPPPPRALRPPRSLALRHDEQMSASEGMKFKFHSGEKVLCFEPDPTKARVLYDAKIVDVIVGKDEKGRKIPEYLIHFNGWNRSWDRWAAEDHVLRDTDENRRLQRKLARKAVARLRSTGRKKKRCRLPGVDSVLKGLPTEEKDENDENSLSSSSDCSENKDEEISEESDIEEKTEVKEEPELQTRREMEERTITIEIPEVLKKQLEDDCYYINRRKRLVKLPCQTNIITILESYVKHFAINAAFSANERPRHHHVMPHANMNVHYIPAEKNVDLCKEMVDGLRITFDYTLPLVLLYPYEQAQYKKVTSSKFFLPIKESATSTNSPQRVSRPPVNQPPPKGAKLSQKHCSL

SEQ ID NO: 889504 - protein, 725 aa, Homo sapiens
RPFRLTQRRHLEGRAPAMERTAGKELALAPLQDWGEETEDGAVYSVSLRRQRSQRRSPAEGPGGSQAPSPIANTFLHYRTSKVRVLRAARLERLVGELVFGDREQDPSFMPAFLATYRTFVPTACLLGFLLPPMPPPPPPGVEIKKTAVQDLSFNKNLRCVSAGLLAAGPPSGFPRPPCPFGPGQCPNLSGLGGPGSAEAQKAEKLLEDFLEEAEREQEEEPPQVWTGPPRVAQTSDPDSSEACAEEEEGLMPQGPQLLDFSVDEVAEQLTLIDLELFSKVRLYECLGSVWSQRDRPGAAGASPTVRATVAQFNTVTGCVLGSVLGAPGLAAPQRAQRLEKWIRIAQRCRELRNFSSLRAILSALQSNPIYRLKRSWGAVSREPLSTFRKLSQIFSDENNHLSSREILFQEEATEGSQEEDNTPGSLPSKPPPGPVPYLGTFLTDLVMLDTALPDMLEGDLINFEKRRKEWEILARIQQLQRRCQSYTLSPHPPILAALHAQNQLTEEQSYRLSRVIEPPAASCPSSPRIRRRISLTKRLSAKLAREKSSSPSGSPGDPSSPTSSVSPGSPPSSPRSRDAPAGSPPASPGPQGPSTKLPLSLDLPSPRPFALPLGSPRIPLPAQQSSEARVIRVSIDNDHGNLYRSILLTSQDKAPSVVRRALQKHNVPQPWACDYQLFQVLPGDRVLLIPDNANVFYAMSPVAPRDFMLRRKEGTRNTLSVSPS

SEQ ID NO: 889505 - protein, 782 aa, Homo sapiens
RPFRLTQRRHLEGRAPAMERTAGKELALAPLQDWGEETEDGAVYSVSLRRQRSQRRSPAEGPGGSQAPSPIANTFLHYRTSKVRVLRAARLERLVGELVFGDREQDPSFMPAFLATYRTFVPTACLLGFLLPPMPPPPPPGSVANHNLRILHPRTPTGHPPPPPQVWNLETPPRPRALFLSPLLGSPFFTCWGASSQGRDQEDSGTRSELQQEPEVVSVLGSWLQDHPQDFRDPPAHSDLGSVRTFLGWAAPGSAEAQKAEKLLEDFLEEAEREQEEEPPQVWTGPPRVAQTSDPDSSEACAEEEEGLMPQGPQLLDFSVDEVAEQLTLIDLELFSKVRLYECLGSVWSQRDRPGAAGASPTVRATVAQFNTVTGCVLGSVLGAPGLAAPQRAQRLEKWIRIAQRCRELRNFSSLRAILSALQSNPIYRLKRSWGAVSREPLSTFRKLSQIFSDENNHLSSREILFQEEATEGSQEEDNTPGSLPSKPPPGPVPYLGTFLTDLVMLDTALPDMLEGDLINFEKRRKEWEILARIQQLQRRCQSYTLSPHPPILAALHAQNQLTEEQSYRLSRVIEPPAASCPSSPRIRRRISLTKRLSAKLAREKSSSPSGSPGDPSSPTSSVSPGSPPSSPRSRDAPAGSPPASPGPQGPSTKLPLSLDLPSPRPFALPLGSPRIPLPAQQSSEARVIRVSIDNDHGNLYRSILLTSQDKAPSVVRRALQKHNVPQPWACDYQLFQVLPGDRVLLIPDNANVFYAMSPVAPRDFMLRRKEGTRNTLSVSPS

SEQ ID NO: 889506 - protein, 690 aa, Homo sapiens
RPFRLTQRRHLEGRAPAMERTAGKELALAPLQDWGEETEDGAVYSVSLRRQRSQRRSPAEGPGGSQAPSPIANTFLHYRTSKVRVLRAARLERLVGELVFGDREQDPSFMPAFLATYRTFVPTACLLGFLLPPMPPPPPPGVEIKKTAVQDLSFNKNLRCVSAGLLAAGPPSGFPRPPCPFGPGQCPNLSGLGGPGSAEAQKAEKLLEDFLEEAEREQEEEPPQVWTGPPRVAQTSDPDSSEACAEEEEGLMPQGPQLLDFSVDEVAEQLTLIDLELFSKVRLYECLGSVWSQRDRPGAAGASPTVRATVAQFNTVTGCVLGSVLGAPGLAAPQRAQRWRSGSASPREPLSTFRKLSQIFSDENNHLSSREILFQEEATEGSQEEDNTPGSLPSKPPPGPVPYLGTFLTDLVMLDTALPDMLEGDLINFEKRRKEWEILARIQQLQRRCQSYTLSPHPPILAALHAQNQLTEEQSYRLSRVIEPPAASCPSSPRIRRRISLTKRLSAKLAREKSSSPSGSPGDPSSPTSSVSPGSPPSSPRSRDAPAGSPPASPGPQGPSTKLPLSLDLPSPRPFALPLGSPRIPLPAQQSSEARVIRVSIDNDHGNLYRSILLTSQDKAPSVVRRALQKHNVPQPWACDYQLFQVLPGDRVLLIPDNANVFYAMSPVAPRDFMLRRKEGTRNTLSVSPS

SEQ ID NO: 889507 - protein, 689 aa, Homo sapiens
RPFRLTQRRHLEGRAPAMERTAGKELALAPLQDWGEETEDGAVYSVSLRRQRSQRRSPAEGPGGSQAPSPIANTFLHYRTSKVRVLRAARLERLVGELVFGDREQDPSFMPAFLATYRTFVPTACLLGFLLPPMPPPPPPGVEIKKTAVQDLSFNKNLRCVSAGLLAAGPPSGFPRPPCPFGPGQCPNLSGLGGPGSAEAQKAEKLLEDFLEEAEREQEEEPPQVWTGPPRVAQTSDPDSSEACAEEEEGLMPQGPQLLDFSVDEVAEQLTLIDLELFSKVRLYECLGSVWSQRDRPGAAGASPTVRATVAQFNTVTGCVLGSVLGAPGLAAPQRAQRLEKWIRIAQRCRELRNFSSLRAILSALQSNPIYRLKRSWGAVSREPLSTFRKLSQIFSDENNHLSSREILFQEEATEGSQEEDNTPGSLPSKPPPGPVPYLGTFLTDLVMLDTALPDMLEGDLINFEKRRKEWEILARIQQLQRRCQSYTLSPHPPILAALHAQNQLTEEQSYRLSRVIEPPAASCPSSPRIRRRISLTKRLSAKLAREKSSSPSGSPGDPSSPTSSVSPGSPPSSPRSRDAPAGSPPASPGPQGPSTKLPLSLDLPSPRPFALPLGSPRIPLPAQQSSEARVIRVSIDNDHGNLYRSILLTSQDKAPSVVRRALQKHNVPQPWACDYQLFQVLPGDRGSQ

SEQ ID NO: 889508 - protein, 709 aa, Homo sapiens
RPFRLTQRRHLEGRAPAMERTAGKELALAPLQDWGEETEDGAVYSVSLRRQRSQRRSPAEGPGGSQAPSPIANTFLHYRTSKVRVLRAARLERLVGELVFGDREQDPSFMPAFLATYRTFVPTACLLGFLLPPMPPPPPPGVEIKKTAVQDLSFNKNLRCVSAGLLAAGPPSGFPRPPCPFGPGQCPNLSGLGGPGSAEAQKAEKLLEDFLEEAEREQEEEPPQVWTGPPRVAQTSDPDSSEACAEEEEGLMPQGPQLLDFSVDEVAEQLTLIDLELFSKVRLYECLGSVWSQRDRPGAAGASPTVRATVAQFNTVTGCVLGSVLGAPGLAAPQRAQRLEKWIRIAQRCRELRNFSSLRAILSALQSNPIYRLKRSWGAVSREPLSTFRKLSQIFSDENNHLSSREILFQEEATEGSQEEDNTPGSLPSKPPPGPVPYLGTFLTDLVMLDTALPDMLEGDLINFEKRRKEWEILARIQQLQRRCQSYTLSPHPPILAALHAQNQLTEEQSYRLSRVIEPPAASCPSSPRIRRRISLTKRLSAKLAREKSSSPSGSPGDPSSPTSSVSPGSPPSSPRSRDAPAGSPPASPGPQGPSTKLPLSLDLPSPRPFALPLGSPRIPLPAQQSSEARVIRVSIDNDHGNLYRSILLTSQDKAPSVVRRALQKHNVPQPWACDYQLFQVLPGDRVAPRDFMLRRKEGTRNTLSVSPS

SEQ ID NO: 889509 - protein, 715 aa, Homo sapiens
RPFRLTQRRHLEGRAPAMERTAGKELALAPLQDWGEETEDGAVYSVSLRRQRSQRRSPAEGPGGSQAPSPIANTFLHYRTSKVRVLRAARLERLVGELVFGDREQDPSFMPAFLATYRTFVPTACLLGFLLPPMPPPPPPGVEIKKTAVQDLSFNKNLRCVSAGLLAAGPPSGFPRPPCPFGPGQCPNLSGLGGPGSAEAQKAEKLLEDFLEEAEREQEEEPPQVWTGPPRVAQTSDPDSSEACAEEEEGLMPQGPQLLDFSVDEVAEQLTLIDLELFSKVRLYECLGSVWSQRDRPGAAGASPTVRATVAQFNTVTGCVLGSVLGAPGLAAPQRAQRLEKWIRIAQRCRELRNFSSLRAILSALQSNPIYRLKRSWGAVSREPLSTFRKLSQIFSDENNHLSSREILFQEEATEGSQEEDNTPGSLPSKPPPGPVPYLGTFLTDLVMLDTALPDMLEGDLINFEKRRKEWEILARIQQLQRRCQSYTLSPHPPILAALHAQNQLTEEQSYRLSRVIEPPAASCPSSPRIRRRISLTKRLSAKLAREKSSSPSGSPGDPSSPTSSVSPGSPPSSPRSRDAPAGSPPASPGPQGPSTKLPLSLDLPSPRPFALPLGSPRIPLPAQQSSEARVIRVSIDNDHGNLYRSILLTSQDKAPSVVRRALQKHNVPQPWACDYQLFQVLPGDRGWEEMLISAIKSVGTFFGMFAMCQARFYR

SEQ ID NO: 889510 - protein, 724 aa, Homo sapiens
RPFRLTQRRHLEGRAPAMERTAGKELALAPLQDWGEETEDGAVYSVSLRRQRSQRRSPAEGPGGSQAPSPIANTFLHYRTSKVRVLRAARLERLVGELVFGDREQDPSFMPAFLATYRTFVPTACLLGFLLPPMPPPPPPGVEIKKTAVQDLSFNKNLRCVSAGLLAAGPPSGFPRPPCPFGPGQCPNLSGLGGPGSAEAQKAEKLLEDFLEEAEREQEEEPPQVWTGPPRVAQTSDPDSSEACAEEEEGLMPQGPQLLDFSVDEVAEQLTLIDLELFSKVRLYECLGSVWSQRDRPGAAGASPTVRATVAQFNTVTGCVLGSVLGAPGLAAPQRAQRLEKWIRIAQRCRELRNFSSLRAILSALQSNPIYRLKRSWGAVSREPLSTFRKLSQIFSDENNHLSSREILFQEEATEGSQEEDNTPGSLPSKPPPGPVPYLGTFLTDLVMLDTALPDMLEGDLINFEKRRKEWEILARIQQLQRRCQSYTLSPHPPILAALHAQNQLTEEQSYRLSRVIEPPAASCPSSPRIRRRISLTKRLSAKLAREKSSSPSGSPGDPSSPTSSVSPGSPPSSPRSRDAPAGSPPASPGPQGPSTKLPLSLDLPSPRPFALPLGSPRIPLPAQQSSEARVIRVSIDNDHGNLYRSILLTSQDKAPSVVRRALQKHNVPQPWACDYQLFQVLPGDRGWEEMLISAIKSVGTFFGMFAMCQARFYRWEKTAPLHV

SEQ ID NO: 889511 - protein, 198 aa, Homo sapiens
RPFRLTQRRHLEGRAPAMERTAGKELALAPLQDWGEETEDGAVYSVSLRRQRSQRRSPAEGPGGSQAPSPIANTFLHYRTSKVRVLRAARLERLVGELVFGDREQDPSFMPAFLATYRTFVPTACLLGFLLPPMPPPPPPGSVANHNLRILHPRTPTWAPPSTSSGVEPGNTSQTQSPLPKPPSRFPLLHLLGGLFPG

SEQ ID NO: 889512 - protein, 459 aa, Homo sapiens
RPFRLTQRRHLEGRAPAMERTAGKELALAPLQDWGEETEDGAVYSVSLRRQRSQRRSPAEGPGGSQAPSPIANTFLHYRTSKVRVLRAARLERLVGELVFGDREQDPSFMPAFLATYRTFVPTACLLGFLLPPMPPPPPPGVEIKKTAVQDLSFNKNLRCVSAGLLAAGPPSGFPRPPCPFGPGQCPNLSGLGGPGSAEAQKAEKLLEDFLEEAEREQEEEPPQVWTGPPRVAQTSDPDSSEACAEEEEGLMPQGPQLLDFSVDEVAEQLTLIDLELFSKVRLYECLGSVWSQRDRPGAAGASPTVRATVAQFNTVTGCVLGSVLGAPGLAAPQRAQRLEKWIRIAQRCRELRNFSSLRAILSALQSNPIYRLKRSWGAVSREPLSTFRKLSQIFSDENNHLSSREILFQEEATEGSQEEDNTPGSLPSKPPPGPVPYLGTFLTDLVMLDTALPDMLEV

SEQ ID NO: 889513 - protein, 231 aa, Homo sapiens
RPFRLTQRRHLEGRAPAMERTAGKELALAPLQDWGEETEDGAVYSVSLRRQRSQRRSPAEGPGGSQAPSPIANTFLHYRTSKVRVLRAARLERLVGELVFGDREQDPSFMPAFLATYRTFVPTACLLGFLLPPMPPPPPPGSVANHNLRILHPRTPTGHPPPPPQGRDQEDSGTRSELQQEPEVAVVSVLGSWLQDHPQDFRDHPAHSDLGSVRTFLGWAAPGSAEAQKAE

SEQ ID NO: 889514 - protein, 978 aa, Homo sapiens
NSEKAGQRACSSWSSGRPGNLTLPSSCVVFVTALPLLLALKMEKMLAGCFLLILGQIVLLPAEARERSRGRSISRGRHARTHPQTALLESSCENKRADLVFIIDSSRSVNTHDYAKVKEFIVDILQFLDIGPDVTRVGLLQYGSTVKNEFSLKTFKRKSEVERAVKRMRHLSTGTMTGLAIQYALNIAFSEAEGARPLRENVPRVIMIVTDGRPQDSVAEVAAKARDTGILIFAIGVGQVDFNTLKSIGSEPHEDHVFLVANFSQIETLTSVFQKKLCTAHMCSTLEHNCAHFCINIPGSYVCRCKQGYILNSDQTTCRIQDLCAMEDHNCEQLCVNVPGSFVCQCYSGYALAEDGKRCVAVDYCASENHGCEHECVNADGSYLCQCHEGFALNPDEKTCTKIDYCASSNHGCQHECVNTDDSYSCHCLKGFTLNPDKKTCRRINYCALNKPGCEHECVNMEESYYCRCHRGYTLDPNGKTCSRVDHCAQQDHGCEQLCLNTEDSFVCQCSEGFLINEDLKTCSRVDYCLLSDHGCEYSCVNMDRSFACQCPEGHVLRSDGKTCAKLDSCALGDHGCEHSCVSSEDSFVCQCFEGYILREDGKTCRRKDVCQAIDHGCEHICVNSDDSYTCECLEGFRLAEDGKRCRRKDVCKSTHHGCEHICVNNGNSYICKCSEGFVLAEDGRRCKKCTEGPIDLVFVIDGSKSLGEENFEVVKQFVTGIIDSLTISPKAARVGLLQYSTQVHTEFTLRNFNSAKDMKKAVAHMKYMGKGSMTGLALKHMFERSFTQGEGARPLSTRVPRAAIVFTDGRAQDDVSEWASKAKANGITMYAVGVGKAIEEELQEIASEPTNKHLFYAEDFSTMDEISEKLKKGICEALEDSDGRQDSPAGELPKTVQQPTVQHRYLFEEDNLLRSTQKLSHSTKPSGSPLEEKHDQCKCENLIMFQNLANEEVRKLTQRLEEMTQRMEALENRLRYR

SEQ ID NO: 889515 - protein, 785 aa, Homo sapiens
HASPTRRTSSRSRAALAQAASERRERSGMGLGASGGGGDRGRGRSWGSVLASHERSPRRAAALGEAKRPTRKTLEHNCAHFCINIPGSYVCRCKQGYILNSDQTTCRIQDLCAMEDHNCEQLCVNVPGSFVCQCYSGYALAEDGKRCVAVDYCASENHGCEHECVNADGSYLCQCHEGFALNPDEKTCTKIDYCASSNHGCQHECVNTDDSYSCHCLKGFTLNPDKKTCRRINYCALNKPGCEHECVNMEESYYCRCHRGYTLDPNGKTCSRVDHCAQQDHGCEQLCLNTEDSFVCQCSEGFLINEDLKTCSRVDYCLLSDHGCEYSCVNMDRSFACQCPEGHVLRSDGKTCAKLDSCALGDHGCEHSCVSSEDSFVCQCFEGYILREDGKTCRRKDVCQAIDHGCEHICVNSDDSYTCECLEGFRLAEDGKRCRRKDVCKSTHHGCEHICVNNGNSYICKCSEGFVLAEDGRRCKKCTEGPIDLVFVIDGSKSLGEENFEVVKQFVTGIIDSLTISPKAARVGLLQYSTQVHTEFTLRNFNSAKDMKKAVAHMKYMGKGSMTGLALKHMFERSFTQGEGARPLSTRVPRAAIVFTDGRAQDDVSEWASKAKANGITMYAVGVGKAIEEELQEIASEPTNKHLFYAEDFSTMDEISEKLKKGICEALEDSDGRQDSPAGELPKTVQQPTESEPVTINIQDLLSCSNFAVQHRYLFEEDNLLRSTQKLSHSTKPSGSPLEEKHDQCKCENLIMFQNLANEEVRKLTQRLEEMTQRMEALENRLRYR

SEQ ID NO: 889516 - protein, 691 aa, Homo sapiens
MESWREKASVESEVQDLCAMEDHNCEQLCVNVPGSFVCQCYSGYALAEDGKRCVAVDYCASENHGCEHECVNADGSYLCQCHEGFALNPDEKTCTKIDYCASSNHGCQHECVNTDDSYSCHCLKGFTLNPDKKTCRRINYCALNKPGCEHECVNMEESYYCRCHRGYTLDPNGKTCSRVDHCAQQDHGCEQLCLNTEDSFVCQCSEGFLINEDLKTCSRVDYCLLSDHGCEYSCVNMDRSFACQCPEGHVLRSDGKTCAKLDSCALGDHGCEHSCVSSEDSFVCQCFEGYILREDGKTCRRKDVCQAIDHGCEHICVNSDDSYTCECLEGFRLAEDGKRCRRKDVCKSTHHGCEHICVNNGNSYICKCSEGFVLAEDGRRCKKCTEGPIDLVFVIDGSKSLGEENFEVVKQFVTGIIDSLTISPKAARVGLLQYSTQVHTEFTLRNFNSAKDMKKAVAHMKYMGKGSMTGLALKHMFERSFTQGEGARPLSTRVPRAAIVFTDGRAQDDVSEWASKAKANGITMYAVGVGKAIEEELQEIASEPTNKHLFYAEDFSTMDEISEKLKKGICEALEDSDGRQDSPAGELPKTVQQPTESEPVTINIQDLLSCSNFAVQHRYLFEEDNLLRSTQKLSHSTKPSGSPLEEKHDQCKCENLIMFQNLANEEVRKLTQRLEEMTQRMEALENRLRYR

SEQ ID NO: 889517 - protein, 1053 aa, Homo sapiens
MRRPRVGLVLDRERPSRRQPASEGSALGWDLEQAAAAETEAEAEAGAPSSPPTSDPRGEPRPSARRRGRRGRPGWLRPCLASQAPAAAALPLLLALKMEKMLAGCFLLILGQIVLLPAEARERSRGRSISRGRHARTHPQTALLESSCENKRADLVFIIDSSRSVNTHDYAKVKEFIVDILQFLDIGPDVTRVGLLQYGSTVKNEFSLKTFKRKSEVERAVKRMRHLSTGTMTGLAIQYALNIAFSEAEGARPLRENVPRVIMIVTDGRPQDSVAEVAAKARDTGILIFAIGVGQVDFNTLKSIGSEPHEDHVFLVANFSQIETLTSVFQKKLCTAHMCSTLEHNCAHFCINIPGSYVCRCKQGYILNSDQTTCRIQDLCAMEDHNCEQLCVNVPGSFVCQCYSGYALAEDGKRCVAVDYCASENHGCEHECVNADGSYLCQCHEGFALNPDEKTCTKIDYCASSNHGCQHECVNTDDSYSCHCLKGFTLNPDKKTCRRINYCALNKPGCEHECVNMEESYYCRCHRGYTLDPNGKTCSRVDHCAQQDHGCEQLCLNTEDSFVCQCSEGFLINEDLKTCSRVDYCLLSDHGCEYSCVNMDRSFACQCPEGHVLRSDGKTCAKLDSCALGDHGCEHSCVSSEDSFVCQCFEGYILREDGKTCRRKDVCQAIDHGCEHICVNSDDSYTCECLEGFRLAEDGKRCRRKDVCKSTHHGCEHICVNNGNSYICKCSEGFVLAEDGRRCKKCTEGPIDLVFVIDGSKSLGEENFEVVKQFVTGIIDSLTISPKAARVGLLQYSTQVHTEFTLRNFNSAKDMKKAVAHMKYMGKGSMTGLALKHMFERSFTQGEGARPLSTRVPRAAIVFTDGRAQDDVSEWASKAKANGITMYAVGVGKAIEEELQEIASEPTNKHLFYAEDFSTMDEISEKLKKGICEALEDSDGRQDSPAGELPKTVQQPTESEPVTINIQDLLSCSNFAVQHRYLFEEDNLLRSTQKLSHSTKPSGSPLEEKHDQCKCENLIMFQNLANEEVRKLTQRLEEMTQRMEALENRLRYR

SEQ ID NO: 889518 - protein, 597 aa, Homo sapiens
MRRPRVGLVLDRERPSRRQPASEGSALGWDLEQAAAAETEAEAEAGAPSSPPTSDPRGEPRPSARRRGRRGRPGWLRPCLASQAPAAAALPLLLALKMEKMLAGCFLLILGQIVLLPAEARERSRGRSISRGRHARTHPQTALLESSCENKRADLVFIIDSSRSVNTHDYAKVKEFIVDILQFLDIGPDVTRVGLLQYGSTVKNEFSLKTFKRKSEVERAVKRMRHLSTGTMTGLAIQYALNIAFSEAEGARPLRENVPRVIMIVTDGRPQDSVAEVAAKARDTGILIFAIGVGQVDFNTLKSIGSEPHEDHVFLVANFSQIETLTSVFQKKLCTAHMCSTLEHNCAHFCINIPGSYVCRCKQGYILNSDQTTCRIQDLCAMEDHNCEQLCVNVPGSFVCQCYSGYALAEDGKRCVAVDYCASENHGCEHECVNADGSYLCQCHEGFALNPDEKTCTKIDYCASSNHGCQHECVNTDDSYSCHCLKGFTLNPDKKTCRRINYCALNKPGCEHECVNMEESYYCRCHRGYTLDPNGKTCSRVDNVHNRNMAWSICVLTRGIPLSQLLGFLITRALRTGSRWFTVLSRYHGGTLWCWLF

SEQ ID NO: 889519 - protein, 997 aa, Homo sapiens
NSEKAGQRACSSWSSGRPGNLTLPSSCVVFVTALPLLLALKMEKMLAGCFLLILGQIVLLPAEARERSRGRSISRGRHARTHPQTALLESSCENKRADLVFIIDSSRSVNTHDYAKVKEFIVDILQFLDIGPDVTRVGLLQYGSTVKNEFSLKTFKRKSEVERAVKRMRHLSTGTMTGLAIQYALNIAFSEAEGARPLRENVPRVIMIVTDGRPQDSVAEVAAKARDTGILIFAIGVGQVDFNTLKSIGSEPHEDHVFLVANFSQIETLTSVFQKKLCTAHMCSTLEHNCAHFCINIPGSYVCRCKQGYILNSDQTTCRIQDLCAMEDHNCEQLCVNVPGSFVCQCYSGYALAEDGKRCVAVDYCASENHGCEHECVNADGSYLCQCHEGFALNPDEKTCTKIDYCASSNHGCQHECVNTDDSYSCHCLKGFTLNPDKKTCRRINYCALNKPGCEHECVNMEESYYCRCHRGYTLDPNGKTCSRVDHCAQQDHGCEQLCLNTEDSFVCQCSEGFLINEDLKTCSRVDYCLLSDHGCEYSCVNMDRSFACQCPEGHVLRSDGKTCAKLDSCALGDHGCEHSCVSSEDSFVCQCFEGYILREDGKTCRRKDVCQAIDHGCEHICVNSDDSYTCECLEGFRLAEDGKRCRRKDVCKSTHHGCEHICVNNGNSYICKCSEGFVLAEDGRRCKKCTEGPIDLVFVIDGSKSLGEENFEVVKQFVTGIIDSLTISPKAARVGLLQYSTQVHTEFTLRNFNSAKDMKKAVAHMKYMGKGSMTGLALKHMFERSFTQGEGARPLSTRVPRAAIVFTDGRAQDDVSEWASKAKANGITMYAVGVGKAIEEELQEIASEPTNKHLFYAEDFSTMDEISEKLKKGICEALEDSDGRQDSPAGELPKTVQQPTESEPVTINIQDLLSCSNFAVQHRYLFEEDNLLRSTQKLSHSTKPSGSPLEEKHDQCKCENLIMFQNLANEEVRKLTQRLEEMTQRMEALENRLRYR

SEQ ID NO: 889520 - protein, 1034 aa, Homo sapiens
MRRPRVGLVLDRERPSRRQPASEGSALGWDLEQAAAAETEAEAEAGAPSSPPTSDPRGEPRPSARRRGRRGRPGWLRPCLASQAPAAAALPLLLALKMEKMLAGCFLLILGQIVLLPAEARERSRGRSISRGRHARTHPQTALLESSCENKRADLVFIIDSSRSVNTHDYAKVKEFIVDILQFLDIGPDVTRVGLLQYGSTVKNEFSLKTFKRKSEVERAVKRMRHLSTGTMTGLAIQYALNIAFSEAEGARPLRENVPRVIMIVTDGRPQDSVAEVAAKARDTGILIFAIGVGQVDFNTLKSIGSEPHEDHVFLVANFSQIETLTSVFQKKLCTAHMCSTLEHNCAHFCINIPGSYVCRCKQGYILNSDQTTCRIQDLCAMEDHNCEQLCVNVPGSFVCQCYSGYALAEDGKRCVAVDYCASENHGCEHECVNADGSYLCQCHEGFALNPDEKTCTKIDYCASSNHGCQHECVNTDDSYSCHCLKGFTLNPDKKTCRRINYCALNKPGCEHECVNMEESYYCRCHRGYTLDPNGKTCSRVDHCAQQDHGCEQLCLNTEDSFVCQCSEGFLINEDLKTCSRVDYCLLSDHGCEYSCVNMDRSFACQCPEGHVLRSDGKTCAKLDSCALGDHGCEHSCVSSEDSFVCQCFEGYILREDGKTCRRKDVCQAIDHGCEHICVNSDDSYTCECLEGFRLAEDGKRCRRKDVCKSTHHGCEHICVNNGNSYICKCSEGFVLAEDGRRCKKCTEGPIDLVFVIDGSKSLGEENFEVVKQFVTGIIDSLTISPKAARVGLLQYSTQVHTEFTLRNFNSAKDMKKAVAHMKYMGKGSMTGLALKHMFERSFTQGEGARPLSTRVPRAAIVFTDGRAQDDVSEWASKAKANGITMYAVGVGKAIEEELQEIASEPTNKHLFYAEDFSTMDEISEKLKKGICEALEDSDGRQDSPAGELPKTVQQPTVQHRYLFEEDNLLRSTQKLSHSTKPSGSPLEEKHDQCKCENLIMFQNLANEEVRKLTQRLEEMTQRMEALENRLRYR

SEQ ID NO: 889521 - protein, 658 aa, Homo sapiens
GLEERVLVVVGTEAEEGKRCVAVDYCASENHGCEHECVNADGSYLCQCHEGFALNPDEKTCTKIDYCASSNHGCQHECVNTDDSYSCHCLKGFTLNPDKKTCRRINYCALNKPGCEHECVNMEESYYCRCHRGYTLDPNGKTCSRVDHCAQQDHGCEQLCLNTEDSFVCQCSEGFLINEDLKTCSRVDYCLLSDHGCEYSCVNMDRSFACQCPEGHVLRSDGKTCAKLDSCALGDHGCEHSCVSSEDSFVCQCFEGYILREDGKTCRRKDVCQAIDHGCEHICVNSDDSYTCECLEGFRLAEDGKRCRRKDVCKSTHHGCEHICVNNGNSYICKCSEGFVLAEDGRRCKKCTEGPIDLVFVIDGSKSLGEENFEVVKQFVTGIIDSLTISPKAARVGLLQYSTQVHTEFTLRNFNSAKDMKKAVAHMKYMGKGSMTGLALKHMFERSFTQGEGARPLSTRVPRAAIVFTDGRAQDDVSEWASKAKANGITMYAVGVGKAIEEELQEIASEPTNKHLFYAEDFSTMDEISEKLKKGICEALEDSDGRQDSPAGELPKTVQQPTESEPVTINIQDLLSCSNFAVQHRYLFEEDNLLRSTQKLSHSTKPSGSPLEEKHDQCKCENLIMFQNLANEEVRKLTQRLEEMTQRMEALENRLRYR

SEQ ID NO: 889522 - protein, 1005 aa, Homo sapiens
MRRPRVGLVLDRERPSRRQPASEGSALGWDLEQAAAAETEAEAEAGAPSSPPTSDPRGEPRPSARRRGRRGRPGWLRPCLASQAPAAAALPLLLALKMEKMLAGCFLLILGQIVLLPAEARERSRGRSISRGRHARTHPQTALLESSCENKRADLVFIIDSSRSVNTHDYAKVKEFIVDILQFLDIGPDVTRVGLLQYGSTVKNEFSLKTFKRKSEVERAVKRMRHLSTGTMTGLAIQYALNIAFSEAEGARPLRENVPRVIMIVTDGRPQDSVAEVAAKARDTGILIFAIGVGQVDFNTLKSIGSEPHEDHVFLVANFSQIETLTSVFQKKLCTAHMCSTLEHNCAHFCINIPGSYVCRCKQGYILNSDQTTCRIQDLCAMEDHNCEQLCVNVPGSFVCQCYSGYALAEDGKRCVAVDYCASENHGCEHECVNADGSYLCQCHEGFALNPDEKTCTKIDYCASSNHGCQHECVNTDDSYSCHCLKGFTLNPDKKTCRRINYCALNKPGCEHECVNMEESYYCRCHRGYTLDPNGKTCSRVDHCAQQDHGCEQLCLNTEDSFVCQCSEGFLINEDLKTCSRVDYCLLSDHGCEYSCVNMDRSFACQCPEGHVLRSDGKTCAKLDSCALGDHGCEHSCVSSEDSFVCQCFEGYILREDGKTCRRKDVCQAIDHGCEHICVNSDDSYTCECLEGFRLAEDGKRCRRKDVCKSTHHGCEHICVNNGNSYICKCSEGFVLAEDGRRCKKCTEGPIDLVFVIDGSKSLGEENFEVVKQFVTGIIDSLTISPKAARVGLLQYSTQVHTEFTLRNFNSAKDMKKAVAHMKYMGKGSMTGLALKHMFERSFTQGEGARPLSTRVPRAAIVFTDGRAQDDVSEWASKAKANGITMYAVGVGKAIEEELQEIASEPTNKHLFYAEDFSTMDEISEKLKKGICEALEDSDGRQDSPAGELPKTVQQPTESEPVTINIQDLLSCSNFAVQHRYLFEEDNLLRSTHLEFKKTGLEKNH

SEQ ID NO: 889523 - protein, 403 aa, Homo sapiens [sequence omitted]

SEQ ID NO: 889524 - protein, 458 aa, Homo sapiens
EEAGILTAELLEDLGPWVRDGLECNGVISAHCNLCFLGLSDSPASASRVAGITGIMDRSKENCISGPVKATAPVGGPKRVLVTQQFPCQNPLPVNSGQAQRVLCPSNSSQRVPLQAQKLVSSHKPVQNQKQKQLQATSVPHPVSRPLNNTQKSKQPLPSAPENNPEEELASKQKNEESKKRQWALEDFEIGRPLGKGKFGNVYLAREKQSKFILALKVLFKAQLEKAGVEHQLRREVEIQSHLRHPNILRLYGYFHDATRVYLILEYAPLGTVYRELQKLSKFDEQRTATYITELANALSYCHSKRVIHRDIKPENLLLGSAGELKIADFGWSVHAPSSRRTTLCGTLDYLPPEMIEGRMHDEKVDLWSLGVLCYEFLVGKPPFEANTYQETYKRISRVEFTFPDFVTEGARDLISRLLKHNPSQRPMLREVLEHPWITANSSKPSNCQNKESASKQS

SEQ ID NO: 889525 - protein, 403 aa, Homo sapiens [sequence omitted]

SEQ ID NO: 889526 - protein, 403 aa, Homo sapiens [sequence omitted]

SEQ ID NO: 889527 - protein, 403 aa, Homo sapiens [sequence omitted]

SEQ ID NO: 889528 - protein, 403 aa, Homo sapiens [sequence omitted]

SEQ ID NO: 889529 - protein, 403 aa, Homo sapiens [sequence omitted]

SEQ ID NO: 889530 - protein, 403 aa, Homo sapiens [sequence omitted]

SEQ ID NO: 889531 - protein, 403 aa, Homo sapiens [sequence omitted]

SEQ ID NO: 889532 - protein, 403 aa, Homo sapiens [sequence omitted]

SEQ ID NO: 889533 - protein, 403 aa, Homo sapiens [sequence omitted]

SEQ ID NO: 889534 - protein, 403 aa, Homo sapiens [sequence omitted]

SEQ ID NO: 889535 - protein, 403 aa, Homo sapiens [sequence omitted]

SEQ ID NO: 889536 - protein, 124 aa, Homo sapiens
PPSVFRRTTLCGTLDYLPPEMIEGRMHDEKVDLWSLGVLCYEFLVGKPPFEANTYQETYKRISRVEFTFPDFVTEGARDLISRLLKHNPSQRPMLREVLEHPWITANSSKPSNCQNKESASKQS

SEQ ID NO: 889537 - protein, 361 aa, Homo sapiens
MDRSKENCISGPVKATAPVGGPKRVLVTQQFPCQNPLPVNSGQAQRVLCPSNSSQRVPLQAQKLVSSHKPVQNQKQKQLQATSVPHPVSRPLNNTQKSKQPLPSAPENNPEEELASKQKNEESKKRQWALEDFEIGRPLGKGKFGNVYLAREKQSKFILALKVLFKAQLEKAGVEHQLRREVEIQSHLRHPNILRLYGYFHDATRVYLILEYAPLGTVYRELQKLSKFDEQRTATYITELANALSYCHSKRVIHRDIKPENLLLGSAGELKIADFGWSVHAPSSRRTTLCGTLDYLPPEMIEGELRKGTRAEEEQEKGSPWDTPDTRYGDTRWQGEPKGNPQAKIPENTTNDGEGAKRHNA

SEQ ID NO: 889538 - protein, 195 aa, Homo sapiens
MAAPPGEYFSVGSQVSCRTCQEQRLQGEVVAFDYQSKMLALKCPSSSGKPNHADILLINLQYVSEVEIINDRTETPPPLASLNVSKLASKARTEKEEKLSQAYAISAGVSLEGQQLFQTIHKTIKDCKWQEKNIVVMEEVVITPPYQVENCKGKEGSALSHVRKIVEKHFRDVESQKILQRSQAQQPQKEAALSS

SEQ ID NO: 889539 - protein, 195 aa, Homo sapiens; identical to SEQ ID NO: 889538

SEQ ID NO: 889540 - protein, 115 aa, Homo sapiens
MAAPPGEYFSVGSQVSCRTCQEQRLQGEVVAFDYQSKMLALKCPSSSGKPNHADILLINLQYVSEVEIINDRTETPPPLASLNVSKVLGNARMIKTPLLPSRISHLLGVVRDSSI

SEQ ID NO: 889541 - protein, 195 aa, Homo sapiens; identical to SEQ ID NO: 889538

SEQ ID NO: 889542 - protein, 186 aa, Homo sapiens
MAAPPGEYFSVGSQVSCRTCQEQRLQGEVVAFDYQSKMLALKCPSSSGKPNHADILLINLQYVSEVEIINDRTETPPPLASLNVSKLASKARTEKEEKLSQAYAISAGVSLEGQQLFQTIHKTIKDCKWQEKNIVVMEEVVITPPYQVENCKGKEGSALSHVRKIVERTFYETWKAEEILNITLQT

SEQ ID NO: 889543 - protein, 517 aa, Homo sapiens
MDFRTACEETKTGICLLQDGNQEPFKVRLHLAKDILMIQEQDVICVSGEPFYSGERTVTIRRQTVGGFGLSIKGGAEHNIPVVVSKISKEQRAELSGLLFIGDAILQINGINVRKCRHEEVVQVLRNAGEEVTLTVSFLKRAPAFLKLPLNEDCACAPSDQSSGTSSPLCDSGLHLNYHPNNTDTLSCSSWPTSPGLRWEKRWCDLRLIPLLHSRFSQYVPGTDLSRQNAFQVIAVDGVCTGIIQCLSAEDCVDWLQAIATNISNLTKHNIKKINRNFPVNQQIVYMGWCEAREQDPLQDRVYSPTFLALRGSCLYKFLAPPVTTWDWTRAEKTFSVYEIMCKILKDSDLLDRRKQCFTVQSESGEDLYFSVELESDLAQWERAFQTATFLEVERIQCKTYACVLESHLMGLTIDFSTGFICFDAATKAVLWRYKFSQLKGSSDDGKSKIKFLFQNPDTKQIEAKELEFSNLFAVLHCIHSFFAAKVACLDPLFLGNQATASTAASSATTSKAKYTT

SEQ ID NO: 889544 - protein, 480 aa, Homo sapiens
MDFRTACEETKTGICLLQDGNQEPFKVRLHLAKDILMIQEQDVICVSGEPFYSGERTVTIRRQTVGGFGLSIKGGAEHNIPVVVSKISKEQRAELSGLLFIGDAILQINGINVRKCRHEEVVQVLRNAGEEVTLTVSFLKRAPAFLKLPLNEDCACAPSDQSSGTSSPLCDSGLHLNYHPNNTDTLSCSSWPTSPGLRWEKRWCDLRLIPLLHSRFSQYVPGTDLSRQNAFQVIAVDGVCTGIIQCLSAEDCVDWLQAIATNISNLTKHNIKKINRNFPVNQQIVYMGWCEAREQDPLQDRVYSPTFLALRGSCLYKFLAPPVTTWDWTRAEKTFSVYEIMCKILKDSDLLDRRKQCFTVQSESGEDLYFSVELESDLAQWERAFQTATFLEVERIQCKTYACVLESHLMGLTIDFSTGFICFDAATKELEFSNLFAVLHCIHSFFAAKVACLDPLFLGNQATASTAASSATTSKAKYTT

SEQ ID NO: 889545 - protein, 101 aa, Homo sapiens
MISVPFMYQRLTDSDLLDRRKQCFTVQSESGEDLYFSVELESDLAQWERAFQTATFLEVERIQCKTYACVLESHLMGLTIDFSTGFICFDAATKVMCSGQL

SEQ ID NO: 889546 - protein, 435 aa, Homo sapiens
MDFRTACEETKTGICLLQDGNQEPFKVRLHLAKDILMIQEQDVICVSGEPFYSGERTVTIRRQTVGGFGLSIKGGAEHNIPVVVSKISKEQRAELSGLLFIGDAILQINGINVRKCRHEEVVQVLRNAGEEVTLTVSFLKRAPAFLKLPLNEDCACAPSDQSSGTSSPLCDSGLHLNYHPNNTDTLSCSSWPTSPGLRWEKRWCDLRLIPLLHSRFSQYVPGTDLSRQNAFQVIAVDGVCTGIIQCLSAEDCVDWLQAIATNISNLTKHNIKKINRNFPVNQQIVYMGWCEAREQDPLQDRVYSPTFLALRGSCLYKFLAPPVTTWDWTRAEKTFSVYEIMCKILKDSDLLDRRKQCFTVQSESGEDLYFSVELESDLAQWERAFQTATFLEVERIQCKTYACVLESHLMGLTIDFSTGFICFDAATKVMCSGQL

SEQ ID NO: 889547 - protein, 215 aa, Homo sapiens
FVLNICRQNAFQVIAVDGVCTGIIQCLSAEDCVDWLQAIATNISNLTKHNIKKINRNFPVNQQIVYMGWCEAREQDPLQDRVYSPTFLALRGSCLYKFLAPPVTTWDWTRAEKTFSVYEIMCKILKDSDLLDRRKQCFTVQSESGEDLYFSVELESDLAQWERAFQTATFLEVERIQCKTYACVLESHLMGLTIDFSTGFICFDAATKVMCSGQL

SEQ ID NO: 889548 - protein, 648 aa, Homo sapiens
MATAVEPEDQDLWEEEGILMVKLEDDFTCRPESVLQRDDPVLETSHQNFRRFRYQEAASPREALIRLRELCHQWLRPERRTKEQILELLVLEQFLTVLPGELQSWVRGQRPESGEEAVTLVEGLQKQPRRPRRWVTVHVHGQEVLSEETVHLGAEPESPNELQDPVQSSTPEQSPEETTQSPDLGAPAEQRPHQEEELQTLQESEVPVPEDPDLPAERSSGDSEMVALLTALSQGLVTFKDVAVCFSQDQWSDLDPTQKEFYGEYVLEEDCGIVVSLSFPIPRPDEISQVREEEPWVPDIQEPQETQEPEILSFTYTGDRSKDEEECLEQEDLSLEDIHRPVLGEPEIHQTPDWEIVFEDNPGRLNERRFGTNISQVNSFVNLRETTPVHPLLGRHHDCSVCGKSFTCNSHLVRHLRTHTGEKPYKCMECGKSYTRSSHLARHQKVHKMNAPYKYPLNRKNLEETSPVTQAERTPSVEKPYRCDDCGKHFRWTSDLVRHQRTHTGEKPFFCTICGKSFSQKSVLTTHQRIHLGGKPYLCGECGEDFSEHRRYLAHRKTHAAEELYLCSECGRCFTHSAAFAKHLRGHASVRPCRCNECGKSFSRRDHLVRHQRTHTGEKPFTCPTCGKSFSRGYHLIRHQRTHSEKTS

SEQ ID NO: 889549 - protein, 648 aa, Homo sapiens; identical to SEQ ID NO: 889548

SEQ ID NO: 889550 - protein, 67 aa, Homo sapiens
RPARPRAARIRRRCFGREWVGEKPGQGRSRRSCRSRDTQGSYTQKPQGMLVEPLIPPSFSSKLPRGA

SEQ ID NO: 889551 - protein, 648 aa, Homo sapiens; identical to SEQ ID NO: 889548

SEQ ID NO: 889552 - protein, 648 aa, Homo sapiens; identical to SEQ ID NO: 889548

SEQ ID NO: 889553 - protein, 648 aa, Homo sapiens; identical to SEQ ID NO: 889548

SEQ ID NO: 889554 - protein, 648 aa, Homo sapiens; identical to SEQ ID NO: 889548

SEQ ID NO: 889555 - protein, 648 aa, Homo sapiens; identical to SEQ ID NO: 889548

SEQ ID NO: 889556 - protein, 67 aa, Homo sapiens; identical to SEQ ID NO: 889550

SEQ ID NO: 889557 - protein, 551 aa, Homo sapiens
MSRQNLVALTVTTLLGVAVGGFVLWKGIQRRRRSKTSPVTQQPQQKVLGSRELPPPEDDQLHSSAPRSSWKERILKAKVVTVSQEAEWDQIEPLLRSELEDFPVLGIDCEWVNLEGKASPLSLLQMASPSGLCVLVRLPKLICGGKTLPRTLLDILADGTILKVGVGCSEDASKLLQDYGLVVRGCLDLRYLAMRQRNNLLCNGLSLKSLAETVLNFPLDKSLLLRCSNWDAETLTEDQVIYAARDAQISVALFLHLLGYPFSRNSPGEKNDDHSSWRKVLEKCQGVVDIPFRSKGMSRLGEEVNGEATESQQKPRNKKSKMDGMVPGNHQGRDPRKHKRKPLGVGYSARKSPLYDNCFLHAPDGQPLCTCDRRKAQWYLDKGIGELVSEEPFVVKLRFEPAGRPESPGDYYLMVKENLCVVCGKRDSYIRKNVIPHEYRKHFPIEMKDHNSHDVLLLCTSCHAISNYYDNHLKQQLAKEFQAPIGSEEGLRLLEDPERRQVRSGARALLNAESLPTQRKEELLQALREFYNTDVVTEEMLQEAASLETSQ

SEQ ID NO: 889558 - protein, 551 aa, Homo sapiens; identical to SEQ ID NO: 889557

SEQ ID NO: 889559 - protein, 426 aa, Homo sapiens
MASPSGLCVLVRLPKLICGGKTLPRTLLDILADGTILKVGVGCSEDASKLLQDYGLVVRGCLDLRYLAMRQRNNLLCNGLSLKSLAETVLNFPLDKSLLLRCSNWDAETLTEDQVIYAARDAQISVALFLHLLGYPFSRNSPGEKNDDHSSWRKVLEKCQGVVDIPFRSKGMSRLGEEVNGEATESQQKPRNKKSKMDGMVPGNHQGRDPRKHKRKPLGVGYSARKSPLYDNCFLHAPDGQPLCTCDRRKAQWYLDKGIGELVSEEPFVVKLRFEPAGRPESPGDYYLMVKENLCVVCGKRDSYIRKNVIPHEYRKHFPIEMKDHNSHDVLLLCTSCHAISNYYDNHLKQQLAKEFQAPIGSEEGLRLLEDPERRQVRSGARALLNAESLPTQRKEELLQALREFYNTDVVTEEMLQEAASLETSQ

SEQ ID NO: 889560 - protein, 238 aa, Homo sapiens
AFLYTSRTKQQLPATHFHPITGRKHKRKPLGVGYSARKSPLYDNCFLHAPDGQPLCTCDRRKAQWYLDKGIGELVSEEPFVVKLRFEPAGRPESPGDYYLMVKENLCVVCGKRDSYIRKNVIPHEYRKHFPIEMKDHNSHDVLLLCTSCHAISNYYDNHLKQQLAKEFQAPIGSEEGLRLLEDPERRQVRSGARALLNAESLPTQRKEELLQALREFYNTDVVTEEMLQEAASLETSQ

SEQ ID NO: 889561 - protein, 551 aa, Homo sapiens; identical to SEQ ID NO: 889557

SEQ ID NO: 889562 - protein, 155 aa, Homo sapiens
APRRDPLAPVAHGGAVQHPGAQGGPHPCPRPPTPSLGLSFRPPYPLPGRLYQTFEAACPSQLKRRPRPRHLVAPRALRVRRGNSSCFLSWIRVSRHPRYHPCPPRPHPALGLAGSHLFGFSHPWDGSKLRTLIIIYYKIDICSLKYKQTNPPISF

SEQ ID NO: 889563 - protein, 551 aa, Homo sapiens; identical to SEQ ID NO: 889557

SEQ ID NO: 889564 - protein, 436 aa, Homo sapiens
MASPSGLCVLVRLPKLICGGKTLPRTLLDILADGTILKVGVGCSEDASKLLQDYGLVVRGCLDLRYLAMRQRNNLLCNGLSLKSLAETVLNFPLDKSLLLRCSNWDAETLTEDQIPLISDFSLQVIYAARDAQISVALFLHLLGYPFSRNSPGEKNDDHSSWRKVLEKCQGVVDIPFRSKGMSRLGEEVNGEATESQQKPRNKKSKMDGMVPGNHQGRDPRKHKRKPLGVGYSARKSPLYDNCFLHAPDGQPLCTCDRRKAQWYLDKGIGELVSEEPFVVKLRFEPAGRPESPGDYYLMVKENLCVVCGKRDSYIRKNVIPHEYRKHFPIEMKDHNSHDVLLLCTSCHAISNYYDNHLKQQLAKEFQAPIGSEEGLRLLEDPERRQVRSGARALLNAESLPTQRKEELLQALREFYNTDVVTEEMLQEAASLETSQ

SEQ ID NO: 889565 - protein, 215 aa, Homo sapiens
MSRQNLVALTVTTLLGVAVGGFVLWKGIQRRRRSKTSPVTQQPQQKVLGSRELPPPEDDQLHSSAPRSSWKERILKAKVVTVSQEAEWDQIEPLLRSELEDFPVLGIDCEWVNLEGKASPLSLLQMASPSGLCVLVRLPKLICGGKTLPRFLASPLSESNVIFYQNQYQFPCILCFIEFARLTSFKHLIHSQSHLVRLQYEDFSVSSEAWDTELT

SEQ ID NO: 889566 - protein, 341 aa, Homo sapiens
MSRQNLVALTVTTLLGVAVGGFVLWKGIQRRRRSKTSPVTQQPQQKVLGSRELPPPEDDQLHSSAPRSSWKERILKAKVVTVSQEAEWDQIEPLLRSELEDFPVLGIDCEWVNLEGKASPLSLLQMASPSGLCVLVRLPKLICGGKTLPRTLLDILADGTILKVGVGCSEDASKLLQDYGLVVRGCLDLRYLAMRQRNNLLCNGLSLKSLAETVLNFPLDKSLLLRCSNWDAETLTEDQIYAARDAQISVASINIGVYRCHYNLCHPGSSDCLASASLVTGTTGAHHHARLFSFLNFLFLVETGLVSTKCCPGWSQTPGLKRSTLLGLPKCLGLQEWHSDK

SEQ ID NO: 889567 - protein, 495 aa, Homo sapiens
MSESGHSQPGLYGIERRRRWKEPGSGGPQNLSGPGGRERDYIAPWERERRDASEETSTSVMQKTPIILSKPPAERSKQPPPPTAPAAPPAPAPLEKPIVLMKPREEGKGPVAVTGASTPEGTAPPPPAAPAPPKGEKEGQRPTQPVYQIQNRGMGTAAPAAMDPVVGQAKLLPPERMKHSIKLVDDQMNWCDSAIEYLLDQTDVLVVGVLGLQGTGKSMVMSLLSANTPEEDQRTYVFRAQSAEMKERGGNQTSGIDFFITQERIVFLDTQPILSPSILDHLINNDRKLPPEYNLPHTYVEMQSLQIAAFLFTVCHVVIVVQDWFTDLSLYRFLQTAEMVKPSTPSPSHESSSSSGSDEGTEYYPHLVFLQNKARREDFCPRKLRQMHLMIDQLMAHSHLRYKGTLSMLQCNVFPGLPPDFLDSEVNLFLVPFMDSEAESENPPRAGPGSSPLFSLLPGYRGHPSFQSLVSKLRSQVMSMARPQLSHTILTEKNW

SEQ ID NO: 889568 - protein, 520 aa, Homo sapiens
MSESGHSQPGLYGIERRRRWKEPGSGGPQNLSGPGGRERDYIAPWERERRDASEETSTSVMQKTPIILSKPPAERSKQPPPPTAPAAPPAPAPLEKPIVLMKPREEGKGPVAVTGASTPEGTAPPPPAAPAPPKGEKEGQRPTQPVYQIQNRGMGTAAPAAMDPVVGQAKLLPPERMKHSIKLVDDQMNWCDSAIEYLLDQTDVLVVGVLGLQGTGKSMVMSLLSANTPEEDQRTYVFRAQSAEMKERGGNQTSGIDFFITQERIVFLDTQPILSPSILDHLINNDRKLPPEYNLPHTYVEMQSLQIAAFLFTVCHVVIVVQDWFTDLSLYRFLQTAEMVKPSTPSPSHESSSSSGSDEGTEYYPHLVFLQNKARREDFCPRKLRQMHLMIDQLMAHSHLRYKGTLSMLQCNVFPGLPPDFLDSEVNLFLVPFMDSEAESENPPRAGPGSSPLFSLLPGYRGHPSFQSLVSKLRSQVMSMARPQLSHTILTEKNWFHYAARIWDGVRKSSALAEYSRLLA

SEQ ID NO: 889569 - protein, 520 aa, Homo sapiens; identical to SEQ ID NO: 889568

SEQ ID NO: 889570 - protein, 520 aa, Homo sapiens; identical to SEQ ID NO: 889568

SEQ ID NO: 889571 - protein, 298 aa, Homo sapiens
SNFGSTPEEDQRTYVFRAQSAEMKERGGNQTSGIDFFITQERIVFLDTQPILSPSILDHLINNDRKLPPEYNLPHTYVEMQSLQIAAFLFTVCHVVIVVQDWFTDLSLYRFLQTAEMVKPSTPSPSHESSSSSGSDEGTEYYPHLVFLQNKARREDFCPRKLRQMHLMIDQLMAHSHLRYKGTLSMLQCNVFPGLPPDFLDSEVNLFLVPFMDSEAESENPPRAGPGSSPLFSLLPGYRGHPSFQSLVSKLRSQVMSMARPQLSHTILTEKNWFHYAARIWDGVRKSSALAEYSRLLA

SEQ ID NO: 889572 - protein, 476 aa, Homo sapiens
MSESGHSQPGLYGIERRRRWKEPGSGGPQNLSGPGGRERDYIAPWERERRDASEETSTSVMQKTPIILSKPPAERSKQPPPPTAPAAPPAPAPLEKPIVLMKPREEGKGPVAVTGASTPEGTAPPPPAAPAPPKGEKEGQRPTQPVYQIQNRGMGTAAPAAMDPVVGQAKLLPPERMKHSIKLVDDQMNWCDSAIEYLLDQTDVLVVGVLGLQGTGKSMVMSLLSANTPEEDQRTYVFRAQSAEMKERGGNQTSGIDFFITQERIVFLDTQPILSPSILDHLINNDRKLPPEYNLPHTYVEMQSLQIAAFLFTVCHVVIVVQDWFTDLSLYRFLQTAEMVKPSTPSPSHESSSSSGSDEGTEYYPHLVFLQNKARREDFCPRKLRQMHLMIVASRPRDMRCPGPGPPPSVGAVPGVTVSDPTPNLRWGSPSCVLHRDKQWEESEWSPGSPGSILTSFFRDRSNRPLFPDSKPFPVR

SEQ ID NO: 889573 - protein, 145 aa, Homo sapiens
QPGLNSQVLLEAQDAVNWEKDPGSLSLLPSLPQLSRTWFQPTLLPAAWVSWPPQFPVLGEQAPEPSDVHGPATAVTHDPHREELVPLRCPDLGWGEKVLCSGRVQPPAGLRPRRGMSCRGPPGSAVYCEGAQMSIPRWGGERQQA

SEQ ID NO: 889574 - protein, 520 aa, Homo sapiens; identical to SEQ ID NO: 889568

SEQ ID NO: 889575 - protein, 420 aa, Homo sapiens [sequence omitted]

SEQ ID NO: 889576 - protein, 528 aa, Homo sapiens
MAAIDEEGGREIGDEVNILVKEQTQLGVKTLMRLLKEPEKERDSDSDFSPLQQTEGCQRRDKHFRHAENPHHPLKTSSRAAPLEKPIVLMKPREEGKGPVAVTGASTPEGTAPPPPAAPAPPKGEKEGQRPTQPVYQIQNRGMGTAAPAAMDPVVGQAKLLPPERMKHSIKLVDDQMNWCDSAIEYLLDQTDVLVVGVLGLQGTGKSMVMSLLSANTPEEDQRTYVFRAQSAEMKERGGNQTSGIDFFITQERIVFLDTQPILSPSILDHLINNDRKLPPEYNLPHTYVEMQSLQIAAFLFTVCHVVIVVQDWFTDLSLYRLWDLGCKCKSNSHSPQTPRFLQTAEMVKPSTPSPSHESSSSSGSDEGTEYYPHLVFLQNKARREDFCPRKLRQMHLMIDQLMAHSHLRYKGTLSMLQCNVFPGLPPDFLDSEVNLFLVPFMDSEAESENPPRAGPGSSPLFSLLPGYRGHPSFQSLVSKLRSQVMSMARPQLSHTILTEKNWFHYAARIWDGVRKSSALAEYSRLLA

SEQ ID NO: 889577 - protein, 286 aa, Homo sapiens
MSESGHSQPGLYGIERRRRWKEPGSGGPQNLSGPGGRERDYIAPWERERRDASEETSTSVMQKTPIILSKPPAERSKQPPPPTAPAAPPAPAPLEKPIVLMKPREEGKGPVAVTGASTPEGTAPPPPAAPAPPKGEKEGQRPTQPVYQIQNRGMGTAAPAAMDPVVGQAKLLPPERMKHSIKLVDDQMNWCDSAIEYLLDQTDVLVVGVLGLQGTGKSMVMSLLSANTPEEDQRTYVFRAQSAEMKERGGNQTSGIDFFITQERIVFLDTQVPAPPAFAPPCHILH

SEQ ID NO: 889578 - protein, 186 aa, Homo sapiens
MDADSDVALDILITNVVCVFRTRCHLNLRKIALEGANVIYKRDVGKVLMKLRKPRITATIWSSGKIICTGATSEEEAKFGARRLARSLQKLGFQVIFTDFKVVNVLAVCNMPFEIRLPEFTKNNRPHASYEPELHPAVCYRIKSLRATLQIFSTGSITVTGPNVKAVATAVEQIYPFVFESRKEIL

SEQ ID NO: 889579 - protein, 186 aa, Homo sapiens; identical to SEQ ID NO: 889578

SEQ ID NO: 889580 - protein, 186 aa, Homo sapiens; identical to SEQ ID NO: 889578

SEQ ID NO: 889581 - protein, 186 aa, Homo sapiens; identical to SEQ ID NO: 889578

SEQ ID NO: 889582 - protein, 178 aa, Homo sapiens
MDADSDVALDILITNVVCVFRTRCHLNLRKIALEGANVIYKRDVGKVLMKLRKPRITATIWSSGKIICTGATSEEEAKFGARRLARSLQKLGFQVIFTDFKVVNVLAVCNMPFEIRLPEFTKNNRPHASYEPELHPAVCYRIKSLRATLQIFSTGSITVTALCFYTLEHGCLRSHKAY

SEQ ID NO: 889583 - protein, 186 aa, Homo sapiens; identical to SEQ ID NO: 889578

SEQ ID NO: 889584 - protein, 163 aa, Homo sapiens
MDADSDVALDILITNVVCVFRTRCHLNLRKIALEGANVIYKRDVGKVLMKLRKPRITATIWSSGKIICTGATSEEEAKFGARRLARSLQKLGFQVIFTDFKVVNVLAVCNMPFEIRLPEFTKNNRPHASYEPELHPAVCYRIKSLRATLQIFSTGSITVTGIL

SEQ ID NO: 889585 - protein, 97 aa, Homo sapiens
AVTRFSLPRAAPLRPLPRDPEDALGPQGDGSNGPLCAPGVPRPLQGYLGAEPRRVSVPRGPPIPGCLSPRQHPPSPTPILPGSASRFPRDSPDRKPT

SEQ ID NO: 889586 - protein, 198 aa, Homo sapiens
MARLFSPRPPPSEDLFYETYYSLSQQYPLLLLLLGIVLCALAALLAVAWASGRELTSDPSFLTTVLCALGGFSLLLGLASREQRLQRWTRPLSGLVWVALLALGHAFLFTGGVVSAWDQVSYFLFVIFTAYAMLPLGMRDAAVAGLASSLSHLLVLGLYLGPQPDSRPALLPQVSTQVAQAALRTALPRASRLLLGGC

SEQ ID NO: 889587 - protein, 518 aa, Homo sapiens
MSCVKLWPSGAPAPLVSIEELENQELVGKGGFGTVFRAQHRKWGYDVAVKIVNSKAISREVKAMASLDNEFVLRLEGVIEKVNWDQDPKPALVTKFMENGSLSGLLQSQCPRPWPLLCRLLKEVVLGMFYLHDQNPVLLHRDLKPSNVLLDPELHVKLADFGLSTFQGGSQSGTGSGEPGGTLGYLAPELFVNVNRKASTASDVYSFGILMWAVLAGREVELPTEPSLVYEAVCNRQNRPSLAELPQAGPETPGLEGLKELMQLCWSSEPKDRPSFQECLPKTDEVFQMVENNMNAAVSTVKDFLSQLRSSNRRFSIPESGQGGTEMDGFRRTIENQHSRNDVMVSEWLNKLNLEEPPSSVPKKCPSLTKRSRAQEEQVPQAWTAGTSSDSMAQPPQTPETSTFRNQMPSPTSTGTPSPGPRGNQGAERQGMNWSCRTPEPNPVTGRPLVNIYNCSGVQVGDNNYLTMQQTTALPTWGLAPSGKGRGLQHPPPVGSQEGPKDPEAWSRPQGWYNHSGK

SEQ ID NO: 889588 - protein, 582 aa, Homo sapiens
MSCVKLWPSGAPAPLVSIEELENQELVGKGGFGTVFRAQHRKWGYDVAVKIVNSKAISREVKAMASLDNEFVLRLEGVIEKVNWDQDPKPALVTKFMENGSLSGLLQSQCPRPWPLLCRLLKEVVLGMFYLHDQNPVLLHRDLKPSNVLLDPELHVKLADFGLSTFQGGSQSGTGSGEPGGTLGYLAPELFVNVNRKASTASDVYSFGILMWAVLAGREVELPTEPSLVYEAVCNRQNRPSLAELPQAGPETPGLEGLKELMQLCWSSEPKDRPSFQECLPKTDEVFQMVENNMNAAVSTVKDFLSQLRSSNRRFSIPESGQGGTEMDGFRRTIENQHSRNDVMVSEWLNKLNLEEPPSSVPKKCPSLTKRSRAQEEQVPQAWTAGTSSDSMAQPPQTPETSTFRNQMPSPTSTGTPSPGPRGNQGAERQGMNWSCRTPEPNPVTGADLRPELPDHCAVRAGRLLAAAGPRFPGAATAALDASPVRLGMGRAASARPRLPVHRGRGERLGPGVLFSLRHLHGVCHAALGHAGRRRRGPRLLTLASAGPRAVSWATAGLTACTAAAGEHASSTGCAQDGSATC

SEQ ID NO: 889589 - protein, 567 aa, Homo sapiens
MASLDNEFVLRLEGVIEKVNWDQDPKPALVTKFMENGSLSGLLQSQCPRPWPLLCRLLKEVVLGMFYLHDQNPVLLHRDLKPSNVLLDPELHVKLADFGLSTFQGGSQSGTGSGEPGGTLGYLAPELFVNVNRKASTASDVYRKDPGPNTQPGFLHFSGPSQGMMYRKGVLPVIGPILSFVSPGSFGILMWAVLAGREVECKTLGGFWDPYTPGALLLKAPRLPLPAHLLRLPSSLLVPPHYSSLPLSMMKQIIPFYPECLLFSPSSPTPVPTEPSLVYEAVCNRQNRPSLAELPQAGPETPGLEGLKELMQLCWSSEPKDRPSFQECLPKTDEVFQMVENNMNAAVSTVKDFLSQLRSSNRRFSIPESGQGGTEMDGFRRTIENQHSRNDVMVSEWLNKLNLEEPPSSVPKKCPSLTKRSRAQEEQVPQAWTAGTSSDSMAQPPQTPETSTFRNQMPSPTSTGTPSPGPRGNQGAERQGMNWSCRTPEPNPVTGRPLVNIYNCSGVQVGDNNYLTMQQTTALPTWGLAPSGKGRGLQHPPPVGSQEGPKDPEAWSRPQGWYNHSGK

SEQ ID NO: 889590 - protein, 244 aa, Homo sapiens [sequence omitted]

SEQ ID NO: 889591 - protein, 133 aa, Homo sapiens
MDRETTPLGLLWLIQVIPSKLLPSLQVKDFLSQLRSSNRRFSIPESGQGGTEMDGFRRTIENQHSRNDVMVSEWLNKLNLEEPPSSVPKKCPSLTKRSRAQEEQVPQAWTAGTSSDSMAQPPQTPETGLRDKA

SEQ ID NO: 889592 - protein, 128 aa, Homo sapiens
MARLFSPRPPPSEDLFYETYYSLSQQYPLLLLLLGIVLCALAALLAVAWASGRVTEPLLREGLYLGSIFGVGVCGVFFSMCFRCWEQRKKGPLSLARNCSDPGQVTLPFWVCSGRKLSPGCFSFLSGF

SEQ ID NO: 889593 - protein, 181 aa, Homo sapiens
MSCVKLWPSGAPAPLVSIEELENQELVGKGGFGTVFRAQHRKWGYDVAVKIVNSKAISREVKAMASLDNEFVLRLEGVIEKVNWDQDPKPALVTKFMENGSLSGLLQSQCPRPWPLLCRLLKEVVLGMFYLHDQNPVLLHRDLKPSNVLLDPELHVKVSWSTPLSASRQGPRAAPARPAGH

SEQ ID NO: 889594 - protein, 518 aa, Homo sapiens; identical to SEQ ID NO: 889587

SEQ ID NO: 889595 - protein, 597 aa, Homo sapiens
MAKGGIFPRPRCDSSSLLECRKAISREVKAMASLDNEFVLRLEGVIEKVNWDQDPKPALVTKFMENGSLSGLLQSQCPRPWPLLCRLLKEVVLGMFYLHDQNPVLLHRDLKPSNVLLDPELHVKLADFGLSTFQGGSQSGTGSGEPGGTLGYLAPELFVNVNRKASTASDVYRKDPGPNTQPGFLHFSGPSQGMMYRKGVLPVIGPILSFVSPGSFGILMWAVLAGREVECKTLGGFWDPYTPGALLLKAPRLPLPAHLLRLPSSLLVPPHYTSLPLSMMKQIIPFYPECLLFSPSSPTPVPTEPSLVYEAVCNRQNRPSLAELPQAGPETPGLEGLKELMQLCWSSEPKDRPSFQECLPKTDEVFQMVENNMNAAVSTVKDFLSQLRSSNRRFSIPESGQGGTEMDGFRRTIENQHSRNDVMVSEWLNKLNLEEPPSSVPKKCPSLTKRSRAQEEQVPQAWTAGTSSDSMAQPPQTPETSTFRNQMPSPTSTGTPSPGPRGNQGAERQGMNWSCRTPEPNPVTGRPLVNIYNCSGVQVGDNNYLTMQQTTALPTWGLAPSGKGRGLQHPPPVGSQEGPKDPEAWSRPQGWYNHSGK

SEQ ID NO: 889596 - protein, 318 aa, Homo sapiens [sequence omitted]

SEQ ID NO: 889597 - protein, 156 aa, Homo sapiens
MQAKMNSDNGNAGPDQDSELLSDNHILTTIGDIFGAGVETTTSVVKWTLAFLLHNASEKLYEEIDQNVGFSRTPTISDRNRLLLLEATIREVLRLRPVAPMLIPHKANVDIQEFAVDKGTEVIINLWALHHNEKEWHQPDQFMPERFLNPAGTQLI

SEQ ID NO: 889598 - protein, 97 aa, Homo sapiens
MRLSKEGSTKSQTHFSSSTLEQHRSSVSYLPFGAGPRSCIGEILARQELFLIMAWLLQRFDLEVPDDGQLPSLEGIPKVVFLIDSFKVKIKVRQAWR

SEQ ID NO: 889599 - protein, 73 aa, Homo sapiens
MRGHEAEARKGVRSPRPTFPLPLWSSIGEFAVDKGTEVIINLWALHHNEKEWHQPDQFMPERFLNPAGTQLIS

SEQ ID NO: 889600 - protein, 1594 aa, Homo sapiens
MPKIIQTVGGGAVQERAPELDGGGPTEQDKSHSNSSTLSDRRLSNSSLCSIEEEHRMVYEMVQRILLSTRGYVNFVNEVFHQAFLLPSCEIAVTRKVVQVYRKWILQDKPVFMEEPDRKDVAQEDAEKLGFSETDSKEASSESSGHKRSSSWGRTYSFTSAMSRGCVTEEENTNVKAGVQALLQVFLTNSANIFLLEPCAEVPVLLKEQVDACKAVLIIFRRMIMELTMNKKTWEQMLQILLRITEAVMQKPKDKRIKDLFAQSLAGLLFRTLMVAWIRANLCVYISRELWDDFLGVLSSLTEWEELINEWANIMDSLTAVLARTVYGVEMTNLPLDKLSEQKEKKQRGKGCVLDPQKGTTVGRSFSLSWRSHPDVTEPMRFRSATTSGAPGVEKARNIVRQKATEVEECQQSENAPAAGSGHLTVGQQQQVLRSSSTSDIPEPLCSDSSQGQKAENTQNSSSSEPQPIQENKGHVKREHEGITILVRRSSSPAELDLKDDLQQTQGKCRERQKSESTNSDTTLGCTNEAELSMGPWQTCEEDPELNTPTDVVADADARHWLQLSPTDASNLTDSSECLTDDCSIIAGGSLTGWHPDSAAVLWRRVLGILGDVNNIQSPKIHARVFCYLYELWYKLAKIRDNLAISLDNQSSPSPPVLIPPLRMFASWLFKAATLPNEYKEGKLQAYRLICAMMTRRQDVLPNSDFLVHFYLVMHLGLTSEDQDILNTIIRHCPPRFFSLGFPGFSMLVGDFITAAARVLSTDILTAPRSEAVTVLGSLVCFPNTYQEIPLLQSVPEVNEAITGTEDVKHYLINILLKNATEEPNEYARCIAVCSLGVWICEELAQCTSHPQVKEAINVIGVTLKFPNKIVAQVACDVLQLLVSYWEKLQMFETSLPRKMAEILVATVAFLLPSAEYSSVETDKKFIVSLLLCLLDWCMALPVSVLLHPVSTAVLEEQHSARAPLLDYIYRVLHCCVCGSSTYTQQSHYILTLADLSSTDYDPFLPLANVKSSEPVQYHSSAELGNLLTVEEEKKRRSLELIPLTARMVMAHLVNHLGHYPLSGGPAILHSLVSENHDNAHVEGSELSFEVFRSPNLQLFVFNDSTLISYLQTPTEGPVGGSPVGSLSDVRVIVRDISGKYSWDGKVLYGPLEGCLAPNGRNPSFLISSWHRDTFGPQKDSSQVEEGDDVLDKLLENIGHTSPECLLPSQLNLNEPSLTPCGMNYDQEKEIIEVILRQNAQEDEYIQSHNFDSAMKVTSQGQPSPVEPRGPFYFCRLLLDDLGMNSWDRRKNFHLLKKNSKLLRELKNLDSRQCRETHKIAVFYIAEGQEDKCSILSNERGSQAYEDFVAGLGWEVDLSTHCGFMGGLQRNGSTGQTAPYYATSTVEVIFHVSTRMPSDSDDSLTKKLRHLGNDEVHIVWSEHSRDYRRGIIPTAFGDVSIIIYPMKNHMFFIAITKKPEVPFFGPLFDGAIVSGKLLPSLVCATCINASRAVKCLIPLYQSFYEERALYLEAIIQNHREVMTFEDFAAQVFSPSPSYSLSGTGALASSLSADLEEPLSEEETEHPLLPLPRATKPRISRKFRCCTSALSRSSH

SEQ ID NO: 889601 - protein, 1506 aa, Homo sapiens
MPKIIQTVGGGAVQERAPELDGGGPTEQDKSHSNSSTLSDRRLSNSSLCSIEEEHRMVYEMVQRILLSTRGYVNFVNEVFHQAFLLPSCEIAVTRKVVQVYRKWILQDKPVFMEEPDRKDVAQEDAEKLGFSETDSKEASSESSGHKRSSSWGRTYSFTSAMSRGCVTEEENTNVKAGVQALLQVFLTNSANIFLLEPCAEVPVLLKEQVDACKAVLIIFRRMIMELTMNKKTWEQMLQILLRITEAVMQKPKDKRIKDLFAQSLAGLLFRTLMVAWIRANLCVYISRELWDDFLGVLSSLTEWEELINEWANIMDSLTAVLARTVYGVEMTNLPLDKLSEQKEKKQRGKGCVLDPQKGTTVGRSFSLSWRSHPDVTEPMRFRSATTSGAPGVEKARNIVRQKATEVEECQQSENAPAAGSGHLTVGQQQQVLRSSSTSDIPEPLCSDSSQGQKAENTQNSSSSEPQPIQENKGHVKREHEGITILVRRSSSPAELDLKDDLQQTQGKCRERQKSESTNSDTTLGCTNEAELSMGPWQTCEEDPELNTPTDVVADADARHWLQLSPTDASNLTDSSECLTDDCSIIAGGSLTGWHPDSAAVLWRRVLGILGDVNNIQSPKIHARVFCYLYELWYKLAKIRDNLAISLDNQSSPSPPVLIPPLRMFASWLFKAATLPNEYKEGKLQAYRLICAMMTRRQDVLPNSDFLVHFYLVMHLGLTSEDQDILNTIIRHCPPRFFSLGFPGFSMLVGDFITAAARVLSTDILTAPRSEAVTVLGSLVCFPNTYQEIPLLQSVPEVNEAITGTEDVKHYLINILLKNATEEPNEYARCIAVCSLGVWICEELAQCTSHPQVKEAINVIGVTLKFPNKIVAQVACDVLQLLVSYWEKLQMFETSLPRKMAEILVATVAFLLPSAEYSSVETDKKFIVSLLLCLLDWCMALPVSVLLHPVSTAVLEEQHSARAPLLDYIYRVLHCCVCGSSTYTQQSHYILTLADLSSTDYDPFLPLANVKSSEPVQYHSSAELGNLLTVEEEKKRRSLELIPLTARMVMAHLVNHLGHYPLSGGPAILHSLVSENHDNAHVEGSELSFEVFRSPNLQLFVFNDSTLISYLQTPTEGPVGGSPVGSLSDVRVIVRDISGKYSWDGKVLYGPLEGCLAPNGRNPSFLISSWHRDTFGPQKDSSQVEEGDDVLDKLLENIGHTSPECLLPSQLNLNEPSLTPCGMNYDQEKEIIEVILRQNAQEDEYIQSHNFDSAMKVTSQGQPSPVEPRGPFYFCRLLLDDLGMNSWDRRKNFHLLKKNSKLLRELKNLDSRQCRETHKIAVFYIAEGQEDKCSILSNERGSQAYEDFVAGLGWEVDLSTHCGFMGGLQRNGSTGQTAPYYATSTVEVIFHVSTRMPSDSDDSLTKKLRHLGNDEVHIVWSEHSRDYRRGIIPTAFGDVSIIIYPMKNHMFFIAITKKPEVPFFGPLFDGAIVSGKLLPSLVCATCINASRAVKCLIPLYQSLRVR

SEQ ID NO: 889602 - protein, 1544 aa, Homo sapiens
MPKIIQTVGGGAVQERAPELDGGGPTEQDKSHSNSSTLSDRRLSNSSLCSIEEEHRMVYEMVQRILLSTRGYVNFVNEVFHQAFLLPSCEIAVTRKVVQVYRKWILQDKPVFMEEPDRKDVAQEDAEKLGFSETDSKEASSESSGHKRSSSWGRTYSFTSAMSRGCVTEEENTNVKAGVQALLQVFLTNSANIFLLEPCAEVPVLLKEQVDACKAVLIIFRRMIMELTMNKKTWEQMLQILLRITEAVMQKPKDKRIKDLFAQSLAGLLFRTLMVAWIRANLCVYISRELWDDFLGVLSSLTEWEELINEWANIMDSLTAVLARTVYGVEMTNLPLDKLSEQKEKKQRGKGCVLDPQKGTTVGRSFSLSWRSHPDVTEPMRFRSATTSGAPGVEKARNIVRQKATEVEECQQSENAPAAGSGHLTVGQQQQVLRSSSTSDIPEPLCSDSSQGQKAENTQNSSSSEPQPIQENKGHVKREHEGITILVRRSSSPAELDLKDDLQQTQGKCRERQKSESTNSDTTLGCTNEAELSMGPWQTCEEDPELNTPTDVVADADARHWLQLSPTDASNLTDSSECLTDDCSIIAGGSLTGWHPDSAAVLWRRVLGILGDVNNIQSPKIHARVFCYLYELWYKLAKIRDNLAISLDNQSSPSPPVLIPPLRMFASWLFKAATLPNEYKEGKLQAYRLICAMMTRRQDVLPNSDFLVHFYLVMHLGLTSEDQDILNTIIRHCPPRFFSLGFPGFSMLVGDFITAAARVLSTDILTAPRSEAVTVLGSLVCFPNTYQEIPLLQSVPEVNEAITGTEDVKHYLINILLKNATEEPNEYARCIAVCSLGVWICEELAQCTSHPQVKEAINVIGVTLKFPNKIVAQVACDVLQLLVSYWEKLQMFETSLPRKMAEILVATVAFLLPSAEYSSVETDKKFIVSLLLCLLDWCMALPVSVLLHPVSTAVLEEQHSARAPLLDYIYRVLHCCVCGSSTYTQQSHYILTLADLSSTDYDPFLPLANVKSSEPVQYHSSAELGNLLTVEEEKKRRSLELIPLTARMVMAHLVNHLGHYPLSGGPAILHSLVSENHDNAHVEGSELSFEVFRSPNLQLFVFNDSTLISYLQTPTEGPVGGSPVGSLSDVRVIVRDISGKYSWDGKVLYGPLEGCLAPNGRNPSFLISSWHRDTFGPQKDSSQVEEGDDVLDKLLENIGHTSPECLLPSQLNLNEPSLTPCGMNYDQEKEIIEVILRQNAQEDEYIQSHNFDSAMKVTSQGQPSPVEPRGPFYFCRLLLDDLGMNSWDRRKNFHLLKKNSKLLRELKNLDSRQCRETHKIAVFYIAEGQEDKCSILSNERGSQAYEDFVAGLGWEVDLSTHCGFMGGLQRNGSTGQTAPYYATSTVEVIFHVSTRMPSDSDDSLTKKLRHLGNDEVHIVWSEHSRDYRRGIIPTAFGDVSIIIYPMKNHMFFIAITKKPEVPFFGPLFDGAIVSGKLLPSLVCATCINASRAVKCLIPLYQSFYEERALYLEAIIQNHREVMTFEDFAAQVFSPSPSYSLSGTD

SEQ ID NO: 889603 - protein, 1510 aa, Homo sapiens
MPKIIQTVGGGAVQERAPELDGGGPTEQDKSHSNSSTLSDRRLSNSSLCSIEEEHRMVYEMVQRILLSTRGYVNFVNEVFHQAFLLPSCEIAVTRKVVQVYRKWILQDKPVFMEEPDRKDVAQEDAEKLGFSETDSKEASSESSGHKRSSSWGRTYSFTSAMSRGCVTEEENTNVKAGVQALLQVFLTNSANIFLLEPCAEVPVLLKEQVDACKAVLIIFRRMIMELTMNKKTWEQMLQILLRITEAVMQKPKDKRIKDLFAQSLAGLLFRTLMVAWIRANLCVYISRELWDDFLGVLSSLTEWEELINEWANIMDSLTAVLARTVYGVEMTNLPLDKLSEQKEKKQRGKGCVLDPQKGTTVGRSFSLSWRSHPDVTEPMRFRSATTSGAPGVEKARNIVRQKATEVEECQQSENAPAAGSGHLTVGQQQQVLRSSSTSDIPEPLCSDSSQGQKAENTQNSSSSEPQPIQENKGHVKREHEGITILVRRSSSPAELDLKDDLQQTQGKCRERQKSESTNSDTTLGCTNEAELSMGPWQTCEEDPELNTPTDVVADADARHWLQLSPTDASNLTDSSECLTDDCSIIAGGSLTGWHPDSAAVLWRRVLGILGDVNNIQSPKIHARVFCYLYELWYKLAKIRDNLAISLDNQSSPSPPVLIPPLRMFASWLFKAATLPNEYKEGKLQAYRLICAMMTRRQDVLPNSDFLVHFYLVMHLGLTSEDQDILNTIIRHCPPRFFSLGFPGFSMLVGDFITAAARVLSTDILTAPRSEAVTVLGSLVCFPNTYQEIPLLQSVPEVNEAITGTEDVKHYLINILLKNATEEPNEYARCIAVCSLGVWICEELAQCTSHPQVKEAINVIGVTLKFPNKIVAQVACDVLQLLVSYWEKLQMFETSLPRKMAEILVATVAFLLPSAEYSSVETDKKFIVSLLLCLLDWCMALPVSVLLHPVSTAVLEEQHSARAPLLDYIYRVLHCCVCGSSTYTQQSHYILTLADLSSTDYDPFLPLANVKSSEPVQYHSSAELGNLLTVEEEKKRRSLELIPLTARMVMAHLVNHLGHYPLSGGPAILHSLVSENHDNAHVEGSELSFEVFRSPNLQLFVFNDSTLISYLQTPTEGPVGGSPVGSLSDVRVIVRDISGKYSWDGKVLYGPLEGCLAPNGRNPSFLISSWHRDTFGPQKDSSQVEEGDDVLDKLLENIGHTSPECLLPSQLNLNEPSLTPCGMNYDQEKEIIEVILRQNAQEDEYIQSHNFDSAMKVTSQGQPSPVEPRGPFYFCRLLLDDLGMNSWDRRKNFHLLKKNSKLLRELKNLDSRQCRETHKIAVFYIAEGQEDKCSILSNERGSQAYEDFVAGLGWEVDLSTHCGFMGGLQRNGSTGQTAPYYATSTVEVIFHVSTRMPSDSDDSLTKKLRHLGNDEVHIVWSEHSRDYRRGIIPTAFGDVSIIIYPMKNHMFFIAITKKPEVPFFGPLFDGAIVSGKLLPSLVCATCINASRAVKCLIPLYQSLYLFALNV

SEQ ID NO: 889604 - protein, 1476 aa, Homo sapiens
MPKIIQTVGGGAVQERAPELDGGGPTEQDKSHSNSSTLSDRRLSNSSLCSIEEEHRMVYEMVQRILLSTRGYVNFVNEVFHQAFLLPSCEIAVTRKVVQVYRKWILQDKPVFMEEPDRKDVAQEDAEKLGFSETDSKEASSESSGHKRSSSWGRTYSFTSAMSRGCVTEEENTNVKAGVQALLQVFLTNSANIFLLEPCAEVPVLLKEQVDACKAVLIIFRRMIMELTMNKKTWEQMLQILLRITEAVMQKPKDKRIKDLFAQSLAGLLFRTLMVAWIRANLCVYISRELWDDFLGVLSSLTEWEELINEWANIMDSLTAVLARTVYGVEMTNLPLDKLSEQKEKKQRGKGCVLDPQKGTTVGRSFSLSWRSHPDVTEPMRFRSATTSGAPGVEKARNIVRQKATEVEECQQSENAPAAGSGHLTVGQQQQVLRSSSTSDIPEPLCSDSSQGQKAENTQNSSSSEPQPIQENKGHVKREHEGITILVRRSSSPAELDLKDDLQQTQGKCRERQKSESTNSDTTLGCTNEAELSMGPWQTCEEDPELNTPTDVVADADARHWLQLSPTDASNLTDSSECLTDDCSIIAGGSLTGWHPDSAAVLWRRVLGILGDVNNIQSPKIHARVFCYLYELWYKLAKIRDNLAISLDNQSSPSPPVLIPPLRMFASWLFKAATLPNEYKEGKLQAYRLICAMMTRRQDVLPNSDFLVHFYLVMHLGLTSEDQDILNTIIRHCPPRFFSLGFPGFSMLVGDFITAAARVLSTDILTAPRSEAVTVLGSLVCFPNTYQEIPLLQSVPEVNEAITGTEDVKHYLINILLKNATEEPNEYARCIAVCSLGVWICEELAQCTSHPQVKEAINVIGVTLKFPNKIVAQVACDVLQLLVSYWEKLQMFETSLPRKMAEILVATVAFLLPSAEYSSVETDKKFIVSLLLCLLDWCMALPVSVLLHPVSTAVLEEQHSARAPLLDYIYRVLHCCVCGSSTYTQQSHYILTLADLSSTDYDPFLPLANVKSSEPVQYHSSAELGNLLTVEEEKKRRSLELIPLTARMVMAHLVNHLGHYPLSGGPAILHSLVSENHDNAHVEGSELSFEVFRSPNLQLFVFNDSTLISYLQTPTEGPVGGSPVGSLSDVRVIVRDISGKYSWDGKVLYGPLEGCLAPNGRNPSFLISSWHRDTFGPQKDSSQVEEGDDVLDKLLENIGHTSPECLLPSQLNLNEPSLTPCGMNYDQEKEIIEVILRQNAQEDEYIQSHNFDSAMKVTSQGQPSPVEPRGPFYFCRLLLDDLGMNSWDRRKNFHLLKKNSKLLRELKNLDSRQCRETHKIAVFYIAEGQEDKCSILSNERGSQAYEDFVAGLGWEVDLSTHCGFMGGLQRNGSTGQTAPYYATSTVEVIFHVSTRMPSDSDDSLTKKLRHLGNDEVHIVWSEHSRDYRRGIIPTAFGDVSIIIYPMKNHMFFIAITKKPEVRFHCIVVLTHKAFAM

SEQ ID NO: 889605 - protein, 357 aa, Homo sapiens
MPKIIQTVGGGAVQERAPELDGGGPTEQDKSHSNSSTLSDRRLSNSSLCSIEEEHRMVYEMVQRILLSTRGYVNFVNEVFHQAFLLPSCEIAVTRKVVQVYRKWILQDKPVFMEEPDRKDVAQEDAEKLGFSETDSKEASSESSGHKRSSSWGRTYSFTSAMSRGCVTEEENTNVKAGVQALLQVFLTNSANIFLLEPCAEVPVLLKEQVDACKAVLIIFRRMIMELTMNKKTWEQMLQILLRITEAVMQKPKDKRIKDLFAQSLAGLLFRTLMVAWIRANLCVYISRELWDDFLGVLSSLTEWEELINEWANIMDSLTAVLARTVYGVEMTNLPLDKLSEQKEKKQRGKGISTLPG

SEQ ID NO: 889606 - protein, 626 aa, Homo sapiens
AGRLVAPLSYGGQVGRRGGGSGGPEAKERPGARRAGSDINKAAERRNMNTAPSRPSPTRRDPYGFGDSRDSRRDRSPIRGSPRREPRDGRNGRDARDSRDIRDPRDLRDHRHSRDLRDHRDSRSVRDVRDVRDLRDFRDLRDSRDFRDQRDPMYDRYRDMRDSRDPMYRREGSYDRYLRMDDYCRRKDDSYFDRYRDSFDGRGPPGPESQSRAKERLKREERRREELYRQYFEEIQRRFDAERPVDCSVIVVNKQTKDYAESVGRKVRDLGMVVDLIFLNTEVSLSQALEDVSRGGSPFAIVITQQHQIHRSCTVNIMFGTPQEHRNMPQADAMVLVARNYERYKNECREKEREEIARQAAKMADEAILQERERGGPEEGVRGGHPPAIQSLINLLADNRYLTAEETDKIINYLRERKERLMRSSTDSLPGPISRQPLGATSGASLKTQPSSQPLQSGQVLPSATPTPSAPPTSQQELQAKILSLFNSGTVTANSSSASPSVAAGNTPNQNFSTAANSQPQQRSQASGNQPPSILGQGGSAQNMGPRPGAPSQGLFGQPSSRLAPASNMTSQRPVSSTGINFDNPSVQKALDTLIQSGPALSHLVSQTTAQMGQPQAPMGSYQRHY

SEQ ID NO: 889607 - protein, 626 aa, Homo sapiens; identical to SEQ ID NO: 889606

SEQ ID NO: 889608 - protein, 474 aa, Homo sapiens
MYDRYRDMRDSRDPMYRREGSYDRYLRMDDYCRRKDDSYFDRYRDSFDGRGPPGPESQSRAKERLKREERRREELYRQYFEEIQRRFDAERPVDCSVIVVNKQTKDYAESVGRKVRDLGMVVDLIFLNTEVSLSQALEDVSRGGSPFAIVITQQHQIHRSCTVNIMFGTPQEHRNMPQADAMVLVARNYERYKNECREKEREEIARQAAKMADEAILQERERGGPEEGVRGGHPPAIQSLINLLADNRYLTAEETDKIINYLRERKERLMRSSTDSLPGPISRQPLGATSGASLKTQPSSQPLQSGQVLPSATPTPSAPPTSQQELQAKILSLFNSGTVTANSSSASPSVAAGNTPNQNFSTAANSQPQQRSQASGNQPPSILGQGGSAQNMGPRPGAPSQGLFGQPSSRLAPASNMTSQRPVSSTGINFDNPSVQKALDTLIQSGPALSHLVSQTTAQMGQPQAPMGSYQRHY

SEQ ID NO: 889609 - protein, 441 aa, Homo sapiens
AGRLVAPLSYGGQVGRRGGGSGGPEAKERPGARRAGSDINKAAERRNMNTAPSRPSPTRRDPYGFGDSRDSRRDRSPIRGSPRREPRDGRNGRDARDSRDIRDPRDLRDHRHSRDLRDHRDSRSVRDVRDVRDLRDFRDLRDSRDFRDQRDPMYDRYRDMRDSRDPMYRREGSYDRYLRMDDYCRRKDDSYFDRYRDSFDGRGPPGPESQSRAKERLKREERRREELYRQYFEEIQRRFDAERPVDCSVIVVNKQTKDYAESVGRKVRDLGMVVDLIFLNTEVSLSQALEDVSRGGSPFAIVITQQHQIHRSCTVNIMFGTPQEHRNMPQADAMVLVARNYERYKNECREKEREEIARQAAKMADEAILQERERGGPEEGVRGGHPPAIQSLINLLADNRYLTAEETDKIINYLRERKERLMRSSTDSLPGELRGRAEVKF

SEQ ID NO: 889610 - protein, 385 aa, Homo sapiens
AGRLVAPLSYGGQVGRRGGGSGGPEAKERPGARRAGSDINKAAERRNMNTAPSRPSPTRRDPYGFGDSRDSRRDRSPIRGSPRREPRDGRNGRDARDSRDIRDPRDLRDHRHSRDLRDHRDSRSVRDVRDVRDLRDFRDLRDSRDFRDQRDPMYDRYRDMRDSRDPMYRREGSYDRYLRMDDYCRRKDDSYFDRYRDSFDGRGPPGPESQSRAKERLKREERRREELYRQYFEEIQRRFDAERPVDCSVIVVNKQTKDYAESVGRKVRDLGMVVDLIFLNTEVSLSQALEDVSRGGSPFAIVITQQHQIHRSCTVRNVRRLPDRQPRWPMKPSCRKEREEALRRECVGATLQPSRASSTCWQTTGTSLLKRLTRSSTTCESGRSG

SEQ ID NO: 889611 - protein, 427 aa, Homo sapiens
AGRLVAPLSYGGQVGRRGGGSGGPEAKERPGARRAGSDINKAAERRNMNTAPSRPSPTRRDPYGFGDSRDSRRDRSPIRGSPRREPRDGRNGRDARDSRDIRDPRDLRDHRHSRDLRDHRDSRSVRDVRDVRDLRDFRDLRDSRDFRDQRDPMYDRYRDMRDSRDPMYRREGSYDRYLRMDDYCRRKDDSYFDRYRDSFDGRGPPGPESQSRAKERLKREERRREELYRQYFEEIQRRFDAERPVDCSVIVVNKQTKDYAESVGRKVRDLGMVVDLIFLNTEVSLSQALEDVSRGGSPFAIVITQQHQIHRSCTVNIMFGTPQEHRNMPQADAMVLVARNYERYKNECREKEREEIARQAAKMADEAILQERERGGPEEGVRGGHPPAIQSLINLLADNRYLTAEETDKIINLPSPLIPWPPPTYLF

SEQ ID NO: 889612 - protein, 72 aa, Homo sapiens
GVEREWGGIWFKVPPKGRRLAAKGRTTITEYTSIIQYTDDNINYLRERKERLMRSSTDSLPGELRGRAEVKF

SEQ ID NO: 889613 - protein, 225 aa, Homo sapiens
AGRLVAPLSYGGQVGRRGGGSGGPEAKERPGARRAGSDINKAAERRNMNTAPSRPSPTRRDPYGFGDSRDSRRDRSPIRGSPRREPRDGRNGRDARDSRDIRDPRDLRDHRHSRDLRDHRDSRSVRDVRDVRDLRDFRDLRDSRDFRDQRDPMYDRYRDMRDSRDPMYRREGSYDRYLRMDDYCRRKDDSYFDRYRDSFDGRGPPGPESQSRAKGKVAETVYSYY

SEQ ID NO: 889614 - protein, 138 aa, Homo sapiens
RRLVSLAAALHPSPPWRQAPRPRGGGSHFEEVKFCAPPPPCPPPAASCAPPSWRMELRSGSVGSQAVARRMDGDSRDGGGGKDATGSEDYENLPTSASVSTHMTAGAMAGILEHSVMYPVDSVKVMWTVELCAGHFQP

SEQ ID NO: 889615 - protein, 155 aa, Homo sapiens
MELRSGSVGSQAVARRMDGDSRDGGGGKDATGSEDYENLPTSASVSTHMTAGAMAGILEHSVMYPVDSVKTRMQSLSPDPKAQYTSIYGALKKIMRTEGFWRPLRGVNVMIMGAGPAHAMYFACYENMKRTLNDVFHHQGNSHLANGILKAFVWS

SEQ ID NO: 889616 - protein, 155 aa, Homo sapiens; identical to SEQ ID NO: 889615

SEQ ID NO: 889617 - protein, 155 aa, Homo sapiens; identical to SEQ ID NO: 889615

SEQ ID NO: 889618 - protein, 300 aa, Homo sapiens
MATLLHDAVMNPAEVVKQRLQMYNSQHRSAISCIRTVWRTEGLGAFYRSYTTQLTMNIPFQSIHFITYEFLQEQVNPHRTYNPQSHIISGGLAGALAAAATTPLDVCKTLLNTQENVALSLANISGRLSGMANAFRTVYQLNGLAGYFKGIQARVIYQMPSTAISWSVYEFFKYFLTKRQLGKSSSILKEGIIESFLKVILCLHPAPCPLLTRRSFFFLQGAAYGPSAPQCLRERRGRHGRSPEGCVRGHPRWWWTGRTWEGEREIAFSLPPWAECSFSASLWQPPPWILRSQRREENLQ

SEQ ID NO: 889619 - protein, 279 aa, Homo sapiens
MYNSQHRSAISCIRTVWRTEGLGAFYRSYTTQLTMNIPFQSIHFITYEFLQEQVNPHRTYNPQSHIISGGLAGALAAAATTPLDVCKTLLNTQENVALSLANISGRLSGMANAFRTVYQLNGLAGYFKGIQARVIYQMPSTAISWSVYEFFKYFLTKRQLGKSSSILKEGIIESFLKVILCLHPAPCPLLTRRSFFFLQGAAYGPSAPQCLRERRGRHGRSPEGCVRGHPRWWWTGRTWEGEREIAFSLPPWAECSFSASLWQPPPWILRSQRREENLQ

SEQ ID NO: 889620 - protein, 155 aa, Homo sapiens; identical to SEQ ID NO: 889615

SEQ ID NO: 889621 - protein, 451 aa, Homo sapiens
MELRSGSVGSQAVARRMDGDSRDGGGGKDATGSEDYENLPTSASVSTHMTAGAMAGILEHSVMYPVDSVKTRMQSLSPDPKAQYTSIYGALKKIMRTEGFWRPLRGVNVMIMGAGPAHAMYFACYENMKRTLNDVFHHQGNSHLANGIAGSMATLLHDAVMNPAEVVKQRLQMYNSQHRSAISCIRTVWRTEGLGAFYRSYTTQLTMNIPFQSIHFITYEFLQEQVNPHRTYNPQSHIISGGLAGALAAAATTPLDVCKTLLNTQENVALSLANISGRLSGMANAFRTVYQLNGLAGYFKGIQARVIYQMPSTAISWSVYEFFKYFLTKRQLGKSSSILKEGIIESFLKVILCLHPAPCPLLTRRSFFFLQGAAYGPSAPQCLRERRGRHGRSPEGCVRGHPRWWWTGRTWEGEREIAFSLPPWAECSFSASLWQPPPWILRSQRREENLQ

SEQ ID NO: 889622 - protein, 279 aa, Homo sapiens; identical to SEQ ID NO: 889619

SEQ ID NO: 889623 - protein, 300 aa, Homo sapiens; identical to SEQ ID NO: 889618

SEQ ID NO: 889624 - protein, 300 aa, Homo sapiens; identical to SEQ ID NO: 889618

SEQ ID NO: 889625 - protein, 300 aa, Homo sapiens; identical to SEQ ID NO: 889618

SEQ ID NO: 889626 - protein, 283 aa, Homo sapiens
MATLLHDAVMNPAEVVKQRLQMYNSQHRSAISCIRTVWRTEGLGAFYRSYTTQLTMNIPFQSIHFITYEFLQEQVNPHRTYNPQSHIISGGLAGALAAAATTPLDVCKTLLNTQENVALSLANISGRLSGMANAFRTVYQLNGLAGYFKGIQARVIYQMPSTAISWSVYEFFKYFLTKRQLVSACIQPLALSSHVDHFFFCRVLPMGPLLPNALERGGDGTAAHRKAVCGDIRGGGGQEGLGKGSEKLLFLFLPGQNVAFLLHCGSLLPGSLDPRGGKKICSD

SEQ ID NO: 889627 - protein, 493 aa, Homo sapiens
MELRSGSVGSQAVARRMDGDSRDGGGGKDATGSEDYENLPTSASVSTHMTAGAMAGILEHSVMYPVDSVKRQGLALSPRLECSVEIIVYCSLELLGYKESSLLSLLSELGLQTRMQSLSPDPKAQYTSIYGALKKIMRTEGFWRPLRGVNVMIMGAGPAHAMYFACYENMKRTLNDVFHHQGNSHLANGIAGSMATLLHDAVMNPAEVVKQRLQMYNSQHRSAISCIRTVWRTEGLGAFYRSYTTQLTMNIPFQSIHFITYEFLQEQVNPHRTYNPQSHIISGGLAGALAAAATTPLDVCKTLLNTQENVALSLANISGRLSGMANAFRTVYQLNGLAGYFKGIQARVIYQMPSTAISWSVYEFFKYFLTKRQLGKSSSILKEGIIESFLKVILCLHPAPCPLLTRRSFFFLQGAAYGPSAPQCLRERRGRHGRSPEGCVRGHPRWWWTGRTWEGEREIAFSLPPWAECSFSASLWQPPPWILRSQRREENLQ

SEQ ID NO: 889628 - protein, 435 aa, Homo sapiens
MELRSGSVGSQAVARRMDGDSRDGGGGKDATGSEDYENLPTSASVSTHMTAGAMAGILEHSVMYPVDSVKTRMQSLSPDPKAQYTSIYGALKKIMRTEGFWRPLRGVNVMIMGAGPAHAMYFACYENMKRTLNDVFHHQGNSHLANGIAGSMATLLHDAVMNPAEVVKQRLQMYNSQHRSAISCIRTVWRTEGLGAFYRSYTTQFLQEQVNPHRTYNPQSHIISGGLAGALAAAATTPLDVCKTLLNTQENVALSLANISGRLSGMANAFRTVYQLNGLAGYFKGIQARVIYQMPSTAISWSVYEFFKYFLTKRQLGKSSSILKEGIIESFLKVILCLHPAPCPLLTRRSFFFLQGAAYGPSAPQCLRERRGRHGRSPEGCVRGHPRWWWTGRTWEGEREIAFSLPPWAECSFSASLWQPPPWILRSQRREENLQ

SEQ ID NO: 889629 - protein, 155 aa, Homo sapiens; identical to SEQ ID NO: 889615

SEQ ID NO: 889630 - protein, 183 aa, Homo sapiens
RSRTLRQNKMADAAATAGAGGSGTRSGSKQSTNPADNYHLARRRTLQVVVSSLLTEAGFESAEKASVETLTEMLQSYISEIGRSAKSYCEHTARTQPTLSDIVVTLVEMGFNVDTLPAYAKRSQRMVITAPPVTNQPVTPKALTAGQNRPHPPHIPSHFPEFPDPHTYIKTPVSDEALGLRVV

SEQ ID NO: 889631 - protein, 320 aa, Homo sapiens
RSRTLRQNKMADAAATAGAGGSGTRSGSKQSTNPADNYHLARRRTLQVVVSSLLTEAGFESAEKASVETLTEMLQSYISEIGRSAKSYCEHTARTQPTLSDIVVTLVEMGFNVDTLPAYAKRSQRMVITAPPVTNQPVTPKALTAGQNRPHPPHIPSHFPEFPDPHTYIKTPVRTVEPVSDYQVLREKAASQRRDVERALTRFMAKTGETQSLFKDDVSTFPLIAARPFTIPYLTALLPSELEMQQMEETDSSEQDEQTDTENLALHISMEDSGAEKENTSVLQQNPSLSGSRNGEENIIDNPYLRPVKKPKIRRKKSLS

SEQ ID NO: 889632 - protein, 361 aa, Homo sapiens
RSRTLRQNKMADAAATAGAGGSGTRSGSKQSTNPADNYHLARRRTLQVVVSSLLTEAGFESAEKASVETLTEMLQSYISEIGRSAKSYCEHTARTQPTLSDIVVTLVEMGFNVDTLPAYAKRSQRMVITAPPVTNQPVTPKALTAGQNRPHPPHIPSHFPEFPDPHTYIKTPVRTVEPVSDYQVLREKAASQRRDVERALTRFMAKTGETQSLFKDDVSTFPLIAARPFTIPYLTALLPSELEMQQMEETDSSEQDEQTDTENLALHISMIESRSVTQAGVQWQDLGSLQPPPPGFKRFSSLSLLSELELQEDSGAEKENTSVLQQNPSLSGSRNGEENIIDNPYLRPVKKPKIRRKKSLS

SEQ ID NO: 889633 - protein, 198 aa, Homo sapiens
RSRTLRQNKMADAAATAGAGGSGTRSGSKQSTNPADNYHLARRRTLQVVVSSLLTEAGFESAEKASVETLTEMLQSYISEIGRSAKSYCEHTARTQPTLSDIVVTLVEMGFNVDTLPAYAKRSQRMVITAPPVTNQPVTPKALTAGQNRPHPPHIPSHFPEFPDPHTYIKTPVEPRCPAHLLVFHSLGEFGNLKNLGT

SEQ ID NO: 889634 - protein, 118 aa, Homo sapiens
MQQMEETDSSEQDEQTDTENLALHISMIESRSVTQAGVQWQDLGSLQPPPPGFKRFSSLSLLSELELQEDSGAEKENTSVLQQNPSLSGSRNGEENIIDNPYLRPVKKPKIRRKKSLS

SEQ ID NO: 889635 - protein, 336 aa, Homo sapiens
MSQAVQTNGTQPLSKTWELSLYELQRTPQEAITDGLEIVVSPRSLHSELMCPICLDMLKNTMTTKECLHRFCADCIITALRSGNKECPTCRKKLVSKRSLRPDPNFDALISKIYPSRDEYEAHQERVLARINKHNNQQALSHSIEEGLKIQAMNRLQRGKKQQIENGSGAEDNGDSSHCSNASTHSNQEAGPSNKRTKTSDDSGLELDNNNAAMAIDPVMDGASEIELVFRPHPTLMEKDDSAQTRYIKTSGNATVDHLSKYLAVRLALEELRSKGESNQMNLDTASEKQYTIYIATASGQFTVLNGSFSLELVSEKYWKVNKPMELYYAPTKEHK

SEQ ID NO: 889636 - protein, 336 aa, Homo sapiens; identical to SEQ ID NO: 889635

SEQ ID NO: 889637 - protein, 336 aa, Homo sapiens; identical to SEQ ID NO: 889635

SEQ ID NO: 889638 - protein, 364 aa, Homo sapiens
PQGAVPGVLRGGAEGAGVSSAGGCRGTMAAPRDNVTLLFKLYCLAVMTLMAAVYTIALRYTRTSDKELYFSTTAVCITEVIKLLLSVGILAKETGSLGRFKASLRENVLGSPKELLKLSVPSLVYAVQNNMAFLALSNLDAAVYQVTYQLKIPCTALCTVLMLNRTLSKLQWVSVFMLCAGVTLVQWKPAQATKVVVEQNPLLGFGAIAIAVLCSGFAGVYFEKVLKSSDTSLWVRNIQMYLSGIIVTLAGVYLSDGAEIKEKGFFYGYTYYVWFVIFLASVGGLYTSVVVKYTDNIMKGFSAAAAIVLSTIASVMLFGLQITLTFALGTLLVCVSIYLYGLPRQDTTSIQQGETASKERVIGV

SEQ ID NO: 889639 - protein, 364 aa, Homo sapiens; identical to SEQ ID NO: 889638

SEQ ID NO: 889640 - protein, 201 aa, Homo sapiens
SHQAPPPTLRITIQHHIWAGTNTHFISEGINNVTLLFKLYCLAVMTLMAAVYTIALRYTRTSDKELYFSTTAVCITEVIKLLLSVGILAKETGSLGRFKASLRENVLGSPKELLKLSVPSLVYAVQNNMAFLALSNLDAAVYQVTYQLKIPCTALCTVLMLNRTLSKLQWVSVFMLCAGVTLVQWKPAQATKVVEYILKKF

SEQ ID NO: 889641 - protein, 98 aa, Homo sapiens
PQGAVPGVLRGGAEGAGVSSAGGCRGTMAAPRDNVTLLFKLYCLAVMTLMAAVYTIALRYTRTSDKELYFSTTAVCITEVIKLLLSVGILAKSKFLSY

SEQ ID NO: 889642 - protein, 119 aa, Homo sapiens
MAFLALSNLDAAVYQVTYQLKIPCTALCTVLMLNRTLSKLQWVSVFMLCAGVTLVQWKPAQATKVVVEQNPLLGFGAIAIAVLCSGFAEYIRKSYRVQILLLDCILSGSKSCKCSGLYT

SEQ ID NO: 889643 - protein, 364 aa, Homo sapiens; identical to SEQ ID NO: 889638

SEQ ID NO: 889644 - protein, 285 aa, Homo sapiens
PQGAVPGVLRGGAEGAGVSSAGGCRGTMAAPRDNVTLLFKLYCLAVMTLMAAVYTIALRYTRTSDKELYFSTTAVCITEVIKLLLSVGILAKETGSLGRFKASLRENVLGSPKELLKLSVPSLVYAVQNNMAFLALSNLDAAVYQVTYQLKIPCTALCTVLMLNRTLSKLQWVSVFMLCAGVTLVQWKPAQATKVVVEQNPLLGFGAIAIAVLCSGFAGVYFEKVLKSSDTSLWVRNIQMYLSGIIVTLAGVYLSDGAEIKEKGFFYGYTYYVWFVICKVWHLWG

SEQ ID NO: 889645 - protein, 124 aa, Homo sapiens [sequence omitted]

SEQ ID NO: 889646 - protein, 379 aa, Homo sapiens
PQGAVPGVLRGGAEGAGVSSAGGCRGTMAAPRDNVTLLFKLYCLAVMTLMAAVYTIALRYTRTSDKELYFSTTAVCITEVIKLLLSVGILAKKNRFGGKRYQQFDFGETGSLGRFKASLRENVLGSPKELLKLSVPSLVYAVQNNMAFLALSNLDAAVYQVTYQLKIPCTALCTVLMLNRTLSKLQWVSVFMLCAGVTLVQWKPAQATKVVVEQNPLLGFGAIAIAVLCSGFAGVYFEKVLKSSDTSLWVRNIQMYLSGIIVTLAGVYLSDGAEIKEKGFFYGYTYYVWFVIFLASVGGLYTSVVVKYTDNIMKGFSAAAAIVLSTIASVMLFGLQITLTFALGTLLVCVSIYLYGLPRQDTTSIQQGETASKERVIGV

SEQ ID NO: 889647 - protein, 364 aa, Homo sapiens; identical to SEQ ID NO: 889638

SEQ ID NO: 889648 - protein, 173 aa, Homo sapiens
HKGRSPVSCAGARRGRASVPRGAVGEPWLPREVTYQLKIPCTALCTVLMLNRTLSKLQWVSVFMLCAGVTLVQWKPAQATKVVVEQNPLLGFGAIAIAVLCSGFAGVYFEKVLKSSDTSLWVRNIQMYLSGIIVTLAGVYLSDGAEIKEKGFFYGYTYYVWFVICKYPGIKGS

SEQ ID NO: 889649 - protein, 124 aa, Homo sapiens [sequence omitted]

SEQ ID NO: 889650 - protein, 124 aa, Homo sapiens [sequence omitted]

SEQ ID NO: 889651 - protein, 124 aa, Homo sapiens [sequence omitted]

SEQ ID NO: 889652 - protein, 286 aa, Homo sapiens
PQGAVPGVLRGGAEGAGVSSAGGCRGTMAAPRDNVTLLFKLYCLAVMTLMAAVYTIALRYTRTSDKELYFSTTAVCITEVIKLLLSVGILAKETGSLGRFKASLRENVLGSPKELLKLSVPSLVYAVQNNMAFLALSNLDAAVYQVTYQLKIPCTALCTVLMLNRTLSKLQWVSVFMLCAGVTLVQWKPAQATKVVVEQNPLLGFGAIAIAVLCSGFAGVYFEKVLKSSDTSLWVRNIQMYLSGIIVTLAGVYLSDGAEIKEKGFFYGYTYYVWFVICKYPGIKGS

SEQ ID NO: 889653 - protein, 318 aa, Homo sapiens
MTLMAAVYTIALRYTRTSDKELYFSTTAVCITEVIKLLLSVGILAKETGSLGRFKASLRENVLGSPKELLKLSVPSLVYAVQNNMAFLALSNLDAAVYQVTYQLKIPCTALCTVLMLNRTLSKLQWVSVFMLCAGVTLVQWKPAQATKVVVEQNPLLGFGAIAIAVLCSGFAGVYFEKVLKSSDTSLWVRNIQMYLSGIIVTLAGVYLSDGAEIKEKGFFYGYTYYVWFVIFLASVGGLYTSVVVKYTDNIMKGFSAAAAIVLSTIASVMLFGLQITLTFALGTLLVCVSIYLYGLPRQDTTSIQQGETASKERVIGV

SEQ ID NO: 889654 - protein, 407 aa, Homo sapiens
PQGAVPGVLRGGAEGAGVSSAGGCRGTMAAPRDNVTLLFKLYCLAVMTLMAAVYTIALRYTRTSDKELYFSTTAVCITEVIKLLLSVGILAKDRVSPCKSGWSRSPDLVIRPPQPPRVLGLRREPPCLANQSLFRETGSLGRFKASLRENVLGSPKELLKLSVPSLVYAVQNNMAFLALSNLDAAVYQVTYQLKIPCTALCTVLMLNRTLSKLQWVSVFMLCAGVTLVQWKPAQATKVVVEQNPLLGFGAIAIAVLCSGFAGVYFEKVLKSSDTSLWVRNIQMYLSGIIVTLAGVYLSDGAEIKEKGFFYGYTYYVWFVIFLASVGGLYTSVVVKYTDNIMKGFSAAAAIVLSTIASVMLFGLQITLTFALGTLLVCVSIYLYGLPRQDTTSIQQGETASKERVIGV

SEQ ID NO: 889655 - protein, 124 aa, Homo sapiens [sequence omitted]

SEQ ID NO: 889656 - protein, 124 aa, Homo sapiens [sequence omitted]

SEQ ID NO: 889657 - protein, 219 aa, Homo sapiens
PQGAVPGVLRGGAEGAGVSSAGGCRGTMAAPRDNVTLLFKLYCLAVMTLMAAVYTIALRYTRTSDKELYFSTTAVCITEVIKLLLSVGILAKETGSLGRFKASLRENVLGSPKELLKLSVPSLVYAVQNNMAFLALSNLDAAVYQVTYQLKIPCTALCTVLMLNRTLSKLQWVSVFMLCAGVTLVQWKPAQATKVVVEQNPLLGFGAIAIAVLCSGFAG

SEQ ID NO: 889658 - protein, 125 aa, Homo sapiens
FTTDSLESLGAEFRKIPTSMKAKRSHQAIIMSTSLRVSPSIHGYHFDTASRKKAVGNIFENTDQESLERLFRNSGDKKAEERAKIIFAIDQDVEEKTRALMALKKRTKDKLFQFLKLRKYSIKVH

SEQ ID NO: 889659 - protein, 125 aa, Homo sapiens; identical to SEQ ID NO: 889658

SEQ ID NO: 889660 - protein, 125 aa, Homo sapiens; identical to SEQ ID NO: 889658

SEQ ID NO: 889661 - protein, 125 aa, Homo sapiens; identical to SEQ ID NO: 889658

SEQ ID NO: 889662 - protein, 125 aa, Homo sapiens
FTTDSLESLGAEFRKIPTSMKAKRSHQAIIMSTSLRVSPSIHGYHFDTASRKKAVGNIFENTDQESLERLFRNSGDKKAEERAKIIFAIDQDVEEKTRALMALKKRMKRRGWIRTLSKNGHSKTK

SEQ ID NO: 889663 - protein, 156 aa, Homo sapiens
FTTDSLESLGAEFRKIPTSMKAKRSHQAIIMSTSLRVSPSIHGYHFDTASRKKAVGNIFENTDQESLERLFRNSGDKKAEERAKIIFAIDQDVEEKTRALMALKKRKQNAFSKDLKTLPSLQERIDADRRAWTDVMRTKENRWLEMTFIQGHFVRP

SEQ ID NO: 889664 - protein, 98 aa, Homo sapiens
KERPCFTPNLAGEERTRGSRVKKKPPIPAGGDSSGTGPRSCVGSRHTHPSTGTRPEPEPGPGQSAAVHPAWSLLSQPCLGLPPAQLCLGPSGHAAAVA

SEQ ID NO: 889665 - protein, 98 aa, Homo sapiens; identical to SEQ ID NO: 889664

SEQ ID NO: 889666 - protein, 114 aa, Homo sapiens
MWRAVQAQTNSFICPVPANCGSRRRRRNSRAATASPRSMGLPRRAGDAAELRKSLKPLLEKRRRARINQSLSQLKGLILPLLGREDASGWHTWLPLHAQNCFLLYIQAPEQPPA

SEQ ID NO: 889667 - protein, 638 aa, Homo sapiens
MKGGCVSQWKAAAGFLFCVMVFASAERPVFTNHFLVELHKGGEDKARQVAAEHGFGVRKLPFAEGLYHFYHNGLAKAKRRRSLHHKQQLERDPRVKMALQQEGFDRKKRGYRDINEIDINMNDPLFTKQWYLINTGQADGTPGLDLNVAEAWELGYTGKGVTIGIMDDGIDYLHPDLASNYNAEASYDFSSNDPYPYPRYTDDWFNSHGTRCAGEVSAAANNNICGVGVAYNSKVAGIRMLDQPFMTDIIEASSISHMPQLIDIYSASWGPTDNGKTVDGPRELTLQAMADGVNKGRGGKGSIYVWASGDGGSYDDCNCDGYASSMWTISINSAINDGRTALYDESCSSTLASTFSNGRKRNPEAGVATTDLYGNCTLRHSGTSAAAPEAAGVFALALEANLGLTWRDMQHLTVLTSKRNQLHDEVHQWRRNGVGLEFNHLFGYGVLDAGAMVKMAKDWKTVPERFHCVGGSVQDPEKIPSTGKLVLTLTTDACEGKENFVRYLEHVQAVITVNATRRGDLNINMTSPMGTKSILLSRRPRDDDSKVGFDKWPFMTTHTWGEDARGTWTLELGFVGSAPQKGVLKEWTLMLHGTQSAPYIDQVVRDYQSKLAMSKKEELEEELDEAVERSLKSILNKN

SEQ ID NO: 889668 - protein, 722 aa, Homo sapiens
PTSTLAVLVQWNVPRSENAPPAVSTPAASLLKADLGGAARTPRGASSSHHRGWGEPGLLLGFPAASLRTCLEPTKNKGSSLHSRPPWITPEKWKAAAGFLFCVMVFASAERPVFTNHFLVELHKGGEDKARQVAAEHGFGVRKLPFAEGLYHFYHNGLAKAKRRRSLHHKQQLERDPRVKMALQQEGFDRKKRGYRDINEIDINMNDPLFTKQWYLINTGQADGTPGLDLNVAEAWELGYTGKGVTIGIMDDGIDYLHPDLASNYNAEASYDFSSNDPYPYPRYTDDWFNSHGTRCAGEVSAAANNNICGVGVAYNSKVAGIRMLDQPFMTDIIEASSISHMPQLIDIYSASWGPTDNGKTVDGPRELTLQAMADGVNKGRGGKGSIYVWASGDGGSYDDCNCDGYASSMWTISINSAINDGRTALYDESCSSTLASTFSNGRKRNPEAGVATTDLYGNCTLRHSGTSAAAPEAAGVFALALEANLGLTWRDMQHLTVLTSKRNQLHDEVHQWRRNGVGLEFNHLFGYGVLDAGAMVKMAKDWKTVPERFHCVGGSVQDPEKIPSTGKLVLTLTTDACEGKENFVRYLEHVQAVITVNATRRGDLNINMTSPMGTKSILLSRRPRDDDSKVGFDKWPFMTTHTWGEDARGTWTLELGFVGSAPQKGVLKEWTLMLHGTQSAPYIDQVVRDYQSKLAMSKKEELEEELDEAVERSLKSILNKN

SEQ ID NO: 889669 - protein, 399 aa, Homo sapiens
MLDQPFMTDIIEASSISHMPQLIDIYSASWGPTDNGKTVDGPRELTLQAMADGVNKGRGGKGSIYVWASGDGGSYDDCNCDGYASSMWTISINSAINDGRTALYDESCSSTLASTFSNGRKRNPEAGVATTDLYGNCTLRHSGTSAAAPEAAGVFALALEANLGLTWRDMQHLTVLTSKRNQLHDEVHQWRRNGVGLEFNHLFGYGVLDAGAMVKMAKDWKTVPERFHCVGGSVQDPEKIPSTGKLVLTLTTDACEGKENFVRYLEHVQAVITVNATRRGDLNINMTSPMGTKSILLSRRPRDDDSKVGFDKWPFMTTHTWGEDARGTWTLELGFVGSAPQKGVLKEWTLMLHGTQSAPYIDQVVRDYQSKLAMSKKEELEEELDEAVERSLKSILNKN

SEQ ID NO: 889670 - protein, 638 aa, Homo sapiens; identical to SEQ ID NO: 889667

SEQ ID NO: 889671 - protein, 568 aa, Homo sapiens
MKGGCVSQWKAAAGFLFCVMVFASAERPVFTNHFLVELHKGGEDKARQVAAEHGFGVRKLPFAEGLYHFYHNGLDLNVAEAWELGYTGKGVTIGIMDDGIDYLHPDLASNYNAEASYDFSSNDPYPYPRYTDDWFNSHGTRCAGEVSAAANNNICGVGVAYNSKVAGIRMLDQPFMTDIIEASSISHMPQLIDIYSASWGPTDNGKTVDGPRELTLQAMADGVNKGRGGKGSIYVWASGDGGSYDDCNCDGYASSMWTISINSAINDGRTALYDESCSSTLASTFSNGRKRNPEAGVATTDLYGNCTLRHSGTSAAAPEAAGVFALALEANLGLTWRDMQHLTVLTSKRNQLHDEVHQWRRNGVGLEFNHLFGYGVLDAGAMVKMAKDWKTVPERFHCVGGSVQDPEKIPSTGKLVLTLTTDACEGKENFVRYLEHVQAVITVNATRRGDLNINMTSPMGTKSILLSRRPRDDDSKVGFDKWPFMTTHTWGEDARGTWTLELGFVGSAPQKGVLKEWTLMLHGTQSAPYIDQVVRDYQSKLAMSKKEELEEELDEAVERSLKSILNKN

SEQ ID NO: 889672 - protein, 243 aa, Homo sapiens
GQVGKPWCRPSSRFIYRLVVSSKRNQLHDEVHQWRRNGVGLEFNHLFGYGVLDAGAMVKMAKDWKTVPERFHCVGGSVQDPEKIPSTGKLVLTLTTDACEGKENFVRYLEHVQAVITVNATRRGDLNINMTSPMGTKSILLSRRPRDDDSKVGFDKWPFMTTHTWGEDARGTWTLELGFVGSAPQKGVLKEWTLMLHGTQSAPYIDQVVRDYQSKLAMSKKEELEEELDEAVERSLKSILNKN

SEQ ID NO: 889673 - protein, 894 aa, Homo sapiens
MLVQKLEDKISLLNSEKWSLMEQIRRLKSEMDFLKNEHFAIPAVCDSVQPPLDQLPHKDSEDSGQHPDVNSSDKGKNTDIHLSISDEADSTIPKENSPNSFPRREREGMPPSSLSSKKTVHFDKPNRKLSPAFHQALLSFCRMSADSRLGYEVSRIADSEKSVMLMLGRCLPHIVPNVLLAKREELIPLILCTACLHPEPKERDQLLHILFNLIKRPDDEQRQMILTGCVAFARHVGPTRVEAELLPQCWEQINHKYPERRLLVAESCGALAPYLPKEIRSSLVLSMLQQMLMEDKADLVREAVIKSLGIIMGYIDDPDKYHQGFELLLSALGDPSERVVSATHQVFLPAYAAWTTELGNLQSHLILTLLNKIEKLLREGEHGLDEHKLHMYLSALQSLIPSLFALVLQNAPFSSKAKLHGEVPQIEVTRFPRPMSPLQDVSTIIGSREQLAVLLQLYDYQLEQEGTTGWESLLWVVNQLLPQLIEIVGKINVTSTACVHEFSRFFWRLCRTFGKIFTNTKVKPQFQEILRLSEENIDSSAGNGVLTKATVPIYATGVLTCYIQIKEYLHIHNEISWEWDPSLNTKCVSYTHYTHSLKEEDRKLLVGFLEDVMTLLSLSHAPLDSLKASFVELGANPAYHELLLTVLWYGVVHTSALVRCTAARMFELLVKGVNETLVAQRVVPALITLSSDPEISVRIATIPAFGTIMETVIQRELLERVKMQLASFLEDPQYQDQHSLHTEIIKTFGRVGPNAEPRFRDEFVIPHLHKLALVNNLQIVDSKRLDIATHLFEAYSALSCCFISEDLMVNHFLPGLRCLRTDMEHLSPEHEVILSSMIKECEQKVENKTVQEPQGSMSIAASLVSEDTKTKFLNKMGQLTTSGAMLANVFQRKK

SEQ ID NO: 889674 - protein, 1004 aa, Homo sapiens
KAKETIQALRANLTKAAEHEVPLQERKNYKSSPEIQEPIKPLEKRALNFLVNEFLLKNNYKLTSITFSDENDDQDFELWDDVGLNIPKPPDLLQLYRDFGNHQVTGKDLVDVASGVEEDELEALTPIISNLPPTLETPQPAENSMLVQKLEDKISLLNSEKWSLMEQIRRLKSEMDFLKNEHFAIPAVCDSVQPPLDQLPHKDSEDSGQHPDVNSSDKGKNTDIHLSISDEADSTIPKENSPNSFPRREREGMPPSSLSSKKTVHFDKPNRKLSPAFHQALLSFCRMSADSRLGYEVSRIADSEKSVMLMLGRCLPHIVPNVLLAKREELIPLILCTACLHPEPKERDQLLHILFNLIKRPDDEQRQMILTGCVAFARHVGPTRVEAELLPQCWEQINHKYPERRLLVAESCGALAPYLPKEIRSSLVLSMLQQMLMEDKADLVREAVIKSLGIIMGYIDDPDKYHQGFELLLSALGDPSERVVSATHQVFLPAYAAWTTELGNLQSHLILTLLNKIEKLLREGEHGLDEHKLHMYLSALQSLIPSLFALVLQNAPFSSKAKLHGEVPQIEVTRFPRPMSPLQDVSTIIGSREQLAVLLQLYDYQLEQEGTTGWESLLWVVNQLLPQLIEIVGKINVTSTACVHEFSRFFWRLCRTFGKIFTNTKVKPQFQEILRLSEENIDSSAGNGVLTKATVPIYATGVLTCYIQEEDRKLLVGFLEDVMTLLSLSHAPLDSLKASFVELGANPAYHELLLTVLWYGVVHTSALVRCTAARMFELLVKGVNETLVAQRVVPALITLSSDPEISVRIATIPAFGTIMETVIQRELLERVKMQLASFLEDPQYQDQHSLHTEIIKTFGRVGPNAEPRFRDEFVIPHLHKLALVNNLQIVDSKRLDIATHLFEAYSALSCCFISEDLMVNHFLPGLRCLRTDMEHLSPEHEVILSSMIKECEQKVENKTVQEPQGSMSIAASLVSEDTKTKFLNKMGQLTTSGAMLANVFQRKK

SEQ ID NO: 889675 - protein, 1004 aa, Homo sapiens
KAKETIQALRANLTKAAEHEVPLQERKNYKSSPEIQEPIKPLEKRALNFLVNEFLLKNNYKLTSITFSDENDDQDFELWDDVGLNIPKPPDLLQLYRDFGNHQVTGKDLVDVASGVEEDELEALTPIISNLPPTLETPQPAENSMLVQKLEDKISLLNSEKWSLMEQIRRLKSEMDFLKNEHFAIPAVCDSVQPPLDQLPHKDSEDSGQHPDVNSSDKGKNTDIHLSISDEADSTIPKENSPNSFPRREREGMPPSSLSSKKTVHFDKPNRKLSPAFHQALLSFCRMSADSRLGYEVSRIADSEKSVMLMLGRCLPHIVPNVLLAKREELIPLILCTACLHPEPKERDQLLHILFNLIKRPDDEQRQMILTGCVAFARHVGPTRVEAELLPQCWEQINHKYPERRLLVAESCGALAPYLPKEIRSSLVLSMLQQMLMEDKADLVREAVIKSLGIIMGYIDDPDKYHQGFELLLSALGDPSERVVSATHQVFLPAYAAWTTELGNLQSHLILTLLNKIEKLLREGEHGLDEHKLHMYLSALQSLIPSLFALVLQNAPFSSKAKLHGEVPQIEVTRFPRPMSPLQDVSTIIGSREQLAVLLQLYDYQLEQEGTTGWESLLWVVNQLLPQLIEIVGKINVTSTACVHEFSRFFWRLCRTFGKIFTNTKVKPQFQEILRLSEENIDSSAGNGVLTKATVPIYATGVLTCYIQEEDRKLLVGFLEDVMTLLSLSHAPLDSLKASFVELGANPAYHELLLTVLWYGVVHTSALVRCTAARMFELTLRGMSEALVDKRVAPALVTLSSDPEFSVRIATIPAFGTIMETVIQRELLERVKMQLASFLEDPQYQDQHSLHTEIIKTFGRVGPNAEPRFRDEFVIPHLHKLALVNNLQIVDSKRLDIATHLFEAYSALSCCFISEDLMVNHFLPGLRCLRTDMEHLSPEHEVILSSMIKECEQKVENKTVQEPQGSMSIAASLVSEDTKTKFLNKMGQLTTSGAMLANVFQRKK

SEQ ID NO: 889676 - protein, 1004 aa, Homo sapiens; identical to SEQ ID NO: 889675

SEQ ID NO: 889677 - protein, 470 aa, Homo sapiens
MYLSALQSLIPSLFALVLQNAPFSSKAKLHGEVPQIEVTRFPRPMSPLQDVSTIIGSREQLAVLLQLYDYQLEQEGTTGWESLLWVVNQLLPQLIEIVGKINVTSTACVHEFSRFFWRLCRTFGKIFTNTKVKPQFQEILRLSEENIDSSAGNGVLTKATVPIYATGVLTCYIQEEDRKLLVGFLEDVMTLLSLSHAPLDSLKASFVELGANPAYHELLLTVLWYGVVHTSALVRCTAARMFELLVKGVNETLVAQRVVPALITLSSDPEISVRIATIPAFGTIMETVIQRELLERVKMQLASFLEDPQYQDQHSLHTEIIKTFGRVGPNAEPRFRDEFVIPHLHKLALVNNLQIVDSKRLDIATHLFEAYSALSCCFISEDLMVNHFLPGLRCLRTDMEHLSPEHEVILSSMIKECEQKVENKTVQEPQGSMSIAASLVSEDTKTKFLNKMGQLTTSGAMLANVFQRKK

SEQ ID NO: 889678 - protein, 238 aa, Homo sapiens
TIFYCMLTGLQLTLRGMSEALVDKRVAPALVTLSSDPEFSVRIATIPAFGTIMETVIQRELLERVKMQLASFLEDPQYQDQHSLHTEIIKTFGRVGPNAEPRFRDEFVIPHLHKLALVNNLQIVDSKRLDIATHLFEAYSALSCCFISEDLMVNHFLPGLRCLRTDMEHLSPEHEVILSSMIKECEQKVENKTVQEPQGSMSIAASLVSEDTKTKFLNKMGQLTTSGAMLANVFQRKK

SEQ ID NO: 889679 - protein, 1004 aa, Homo sapiens; identical to SEQ ID NO: 889674

SEQ ID NO: 889680 - protein, 1004 aa, Homo sapiens; identical to SEQ ID NO: 889674

SEQ ID NO: 889681 - protein, 875 aa, Homo sapiens
KAKETIQALRANLTKAAEHEVPLQERKNYKSSPEIQEPIKPLEKRALNFLVNEFLLKNNYKLTSITFSDENDDQDFELWDDVGLNIPKPPDLLQLYRDFGNHQVTGKDLVDVASGVEEDELEALTPIISNLPPTLETPQPAENSMLVQKLEDKISLLNSEKWSLMEQIRRLKSEMDFLKNEHFAIPAVCDSVQPPLDQLPHKDSEDSGQHPDVNSSDKGKNTDIHLSISDEADSTIPKENSPNSFPRREREGMPPSSLSSKKTVHFDKPNRKLSPAFHQALLSFCRMSADSRLGYEVSRIADSEKSVMLMLGRCLPHIVPNVLLAKREELIPLILCTACLHPEPKERDQLLHILFNLIKRPDDEQRQMILTGCVAFARHVGPTRVEAELLPQCWEQINHKYPERRLLVAESCGALAPYLPKEIRSSLVLSMLQQMLMEDKADLVREAVIKSLGIIMGYIDDPDKYHQGFELLLSALGDPSERVVSATHQVFLPAYAAWTTELGNLQSHLILTLLNKIEKLLREGEHGLDEHKLHMYLSALQSLIPSLFALVLQNAPFSSKAKLHGEVPQIEVTRFPRPMSPLQDVSTIIGSREQLAVLLQLYDYQLEQEGTTGWESLLWVVNQLLPQLIEIVGKINVTSTACVHEFSRFFWRLCRTFGKIFTNTKVKPQFQEILRLSEENIDSSAGNGVLTKATVPIYATGVLTCYIQEEDRKLLVGFLEDVMTLLSLSHAPLDSLKASFVELGANPAYHELLLTVLWYGVVHTSALVRCTAARMFELLVKGVNETLVAQRVVPALITLSSDPEISVRIATIPAFGTIMETVIQRELLERVKMQLASFLEDPQYQDQHSLHTEIIKTFGRVGPNAEPRFRDEFLL

SEQ ID NO: 889682 - protein, 567 aa, Homo sapiens
ASTPDGVTRPTRAPRFASAASWPKGGDRGGWRGAARTRSPGAGPVRTAREGRSVGRSRPRDSISARSDNSPFPWRSLRAWHPAGRLKTVVSSIASLDLATISEMSSRSTKDLIKSKWGSKPSNSKSETTLEKLKGEIAHLKTSVDEITSGKGKLTDKERHRLLEKIRVLEAEKEKNAYQLTEKDKEIQRLRDQLKARYSTTALLEQLEETTREGERREQVLKALSEEKDVLKQQLSAATSRIAELESKTNTLRLSQTVAPNCFNSSINNIHEMEIQLKDALEKNQQWLVYDQQREVYVKGLLAKIFELEKKTETAAHSLPQQTKKPESEGYLQEEKQKCYNDLLASAKKDLEVERQTITQLSFELSEFRRKYEETQKEVHNLNQLLYSQRRADVQHLEDDRHKTEKIQKLREENDIARGKLEEEKKRSEELLSQVQFLYTSLLKQQEEQTRVALLEQQMQACTLDFENEKLDRQHVQHQLLVILKELRKARNQITQLESLKQLHEFAITEPLVTFQGETENREKVAASPKSPTAALNESLVECPKCNIQYPATEHRDLLVHVEYCSK

SEQ ID NO: 889683 - protein, 504 aa, Homo sapiens
ASTPDGVTRPTRAPRFASAASWPKGGDRGGWRGAARTRSPGAGPVRTAREGRSVGRSRPRDSISARSDNSPFPWRSLRAWHPAGRLKTVVSSIASLDLATISEMSSRSTKDLIKSKWGSKPSNSKSETTLEKLKGEIAHLKTSVDEITSGKGKLTDKERHRLLEKIRVLEAEKEKNAYQLTEKDKEIQRLRDQLKARYSTTALLEQLEETTREGERREQVLKALSEEKDVLKQQLSAATSRIAELESKTNTLRLSQTVAPNCFNSSINNIHEMEIQLKDALEKNQQWLVYDQQREVYVKGLLAKIFELEKKTETAAHSLPQQTKKPESEGYLQEEKQKCYNDLLASAKKDLEVERQTITQLSFELSEFRRKYEETQKEVHNLNQLLYSQRRADVQHLEDDRHKTEKIQKLREENDIARGKLEEEKKRSEELLSQVQFLYTSLLKQQEEQTRVALLEQQMQACTLDFENEKLDRQHVQHQLLVILKELRKARNQITQLESLVSLE

SEQ ID NO: 889684 - protein, 295 aa, Homo sapiens
MEIQLKDALEKNQQWLVYDQQREVYVKGLLAKIFELEKKTETAAHSLPQQTKKPESEGYLQEEKQKCYNDLLASAKKDLEVERQTITQLSFELSEFRRKYEETQKEVHNLNQLLYSQRRADVQHLEDDRHKTEKIQKLREENDIARGKLEEEKKRSEELLSQVQFLYTSLLKQQEEQTRVALLEQQMQACTLDFENEKLDRQHVQHQLLVILKELRKARNQITQLESLKQLHEFAITEPLVTFQGETENREKVAASPKSPTAALNESLVECPKCNIQYPATEHRDLLVHVEYCSK

SEQ ID NO: 889685 - protein, 578 aa, Homo sapiens
PSVPPSPGRLRQGEESKISAMDASPRNISPGLQNGEKEDRFLTTLSSQSSTSSTHLQLPTPPEVMSEQSVGGPPELDTASSSEDVFDGHLLGSTDSQVKEKSTMKAIFANLLPGNSYNPIPFPFDPDKHYLMYEHERVPIAVCEKEPSSIIAFALSCKEYRNALEELSKATQWNSAEEGLPTNSTSDSRPKSSSPIRLPEMSGGQTNRTTETEPQPTKKASGMLSFFRGTAGKSPDLSSQKRETLRGADSAYYQVGQTGKEGTENQGVEPQDEVDGGDTQKKQLINPHVELQFSDANAKFYCRLYYAGEFHKMREVILDSSEEDFIRSLSHSSPWQARGGKSGAAFYATEDDRFILKQMPRLEVQSFLDFAPHYFNYITNAVQQKRPTALAKILGVYRIGYKNSQNNTEKKLDLLVMENLFYGRKMAQVFDLKGSLRNRNVKTDTGKESCDVVLLDENLLKMVRDNPLYIRSHSKAVLRTSIHSDSHFLSSHLIIDYSLLVGRDDTSNELVVGIIDYIRTFTWDKKLEMVVKSTGILGGQGKMPTVVSPELYRTRFCEAMDKYFLMVPDHWTGLGLNC

SEQ ID NO: 889686 - protein, 119 aa, Homo sapiens
MYFKNLHSDPDKHYLMYEHERVPIAVCEKEPSSIIAFALSCKEYRNALEELSKATQWNSAEEGLPTNSTSDSRPKSSSPIRLPEMSGGQTNRTTETEPQPSKITHGGIFIIRFTYNYGL

SEQ ID NO: 889687 - protein, 356 aa, Homo sapiens [sequence omitted]

SEQ ID NO: 889688 - protein, 356 aa, Homo sapiens [sequence omitted]

SEQ ID NO: 889689 - protein, 356 aa, Homo sapiens [sequence omitted]

SEQ ID NO: 889690 - protein, 284 aa, Homo sapiens
RHEAGWPPAPGPGSPGPGPRLGCAALRNVSGAQYMGSGYTKAVYRVRLPGGAAVALKAVDFSGHDLGSCVREFGVRRGCYRLAAHKLLKEMVLLERLRHPNVLQLYGYCYQDSEDIPDTLTTITELGAPVEMIQLLQTSWEDRFRICLSLGRLLHHLAHSPLGSVTLLDFRPRQFVLVDGELKVTDLDDARVEETPCAGSTDCILEFPARNFTLPCSAQGWCEGMNEKRNLYNAYRFFFTYLLPHSAPPSLRPLLDSIVNATGRLPLLAILPPRELPPFSVQPG

SEQ ID NO: 889691 - protein, 384 aa, Homo sapiens
RHEAGWPPAPGPGSPGPGPRLGCAALRNVSGAQYMGSGYTKAVYRVRLPGGAAVALKAVDFSGHDLGSCVREFGVRRGCYRLAAHKLLKEMVLLERLRHPNVLQLYGYCYQDSEDIPDTLTTITELGAPVEMIQLLQTSWEDRFRICLSLGRLLHHLAHSPLGSVTLLDFRPRQFVLVDGELKVTDLDDARVEETPCAGSTDCILEFPARNFTLPCSAQGWCEGMNEKRNLYNAYRFFFTYLLPHSAPPSLRPLLDSIVNATGELAWGVDETLAQLEKVLHLYRSGQYLQNSTASSSTEYQCIPDSTIPQEDYRCWPSYHHGSCLLSVFNLAEAVDVCESHAQCRAFVVTNQTTWTGRQLVFFKTGWSQVVPDPNKTTYVKASG

SEQ ID NO: 889692 - protein, 384 aa, Homo sapiens; identical to SEQ ID NO: 889691

SEQ ID NO: 889693 - protein, 206 aa, Homo sapiens
RHEAGWPPAPGPGSPGPGPRLGCAALRNVSGAQYMGSGYTKAVYRVRLPGGAAVALKAVDFSGHDLGSCVREFGVRRGCYRLAAHKLLKEMVLLERLRHPNVLQLYGYCYQDSEDIPDTLTTITELGAPVEMIQLLQTSWEDRFRICLSLGRLLHHLAHSPLGSVTLLDFRPRQFVLVDGELKVTDLDDARVMHGLASPKRDRRYL

SEQ ID NO: 889694 - protein, 384 aa, Homo sapiens; identical to SEQ ID NO: 889691

SEQ ID NO: 889695 - protein, 384 aa, Homo sapiens; identical to SEQ ID NO: 889691

SEQ ID NO: 889696 - protein, 384 aa, Homo sapiens; identical to SEQ ID NO: 889691

SEQ ID NO: 889697 - protein, 105 aa, Homo sapiens
PRRKAVSSLFLCPQICLSLGRLLHHLAHSPLGSVTLLDFRPRQFVLVDGELKVTDLDDARVEETPCAGSTDCILEFPARNFTLPCSAQGWCEGMNEKRNLYNAYR

SEQ ID NO: 889698 - protein, 238 aa, Homo sapiens
MYAPGGAGLPGGRRRRSPGGSALPKQPERSLASALPGALSITALCTALAEPAWLHIHGGTCSRQELGVSDVLGYVHPDLLKDFCMNPQTVLLLRVIAAFCFLGILCSLSAFLLDVFGPKHPALKITRRYAFAHILTVLQCATVIGFSYWASELILAQQQQHKKYHGSQVYVTFAVSFYLVAGAGGASILATAANLLRHYPTEEEEQALELLSEMEENEPYPAEYEVINQFQPPPAYTP

SEQ ID NO: 889699 - protein, 154 aa, Homo sapiens
MNPQTVLLLRVIAAFCFLGILCSLSAFLLDVFGPKHPALKITRRYAFAHILTVLQCATVIGFSYWASELILAQQQQHKKYHGSQVYVTFAVSFYLVAGAGGASILATAANLLRHYPTEEEEQALELLSEMEENEPYPAEYEVINQFQPPPAYTP

SEQ ID NO: 889700 - protein, 154 aa, Homo sapiens; identical to SEQ ID NO: 889699

SEQ ID NO: 889701 - protein, 238 aa, Homo sapiens; identical to SEQ ID NO: 889698

SEQ ID NO: 889702 - protein, 238 aa, Homo sapiens; identical to SEQ ID NO: 889698

SEQ ID NO: 889703 - protein, 238 aa, Homo sapiens; identical to SEQ ID NO: 889698

SEQ ID NO: 889704 - protein, 85 aa, Homo sapiens
TCGVAARSGLAYEMAQKRPCPTGAPPREKDRWSPQMPPDNVAAQRQGWGGTLVPMVASTPGVKGFPTEAECRGLAVSPHGPGKAF

SEQ ID NO: 889705 - protein, 238 aa, Homo sapiens; identical to SEQ ID NO: 889698

SEQ ID NO: 889706 - protein, 238 aa, Homo sapiens; identical to SEQ ID NO: 889698

SEQ ID NO: 889707 - protein, 319 aa, Homo sapiens
PQSHSGVSCLRPPNSRSPPRLRQPRVPPPYPLVSTLTAQSRLHLQRTRSVAILHRTVRLCAPRGGRRRPAATAERRRAAPGMYAPGGAGLPGGRRRRSPGGSALPKQPERSLASALPGALSITALCTALAEPAWLHIHGGTCSRQELGVSDVLGYVHPDLLKDFCMNPQTVLLLRVIAAFCFLGILCSLSAFLLDVFGPKHPALKITRRYAFAHILTVLQCATVIGFSYWASELILAQQQQHKKYHGSQVYVTFAVSFYLVAGAGGASILATAANLLRHYPTEEEEQALELLSEMEENEPYPAEYEVINQFQPPPAYTP

SEQ ID NO: 889708 - protein, 154 aa, Homo sapiens; identical to SEQ ID NO: 889699

SEQ ID NO: 889709 - protein, 238 aa, Homo sapiens; identical to SEQ ID NO: 889698

SEQ ID NO: 889710 - protein, 238 aa, Homo sapiens; identical to SEQ ID NO: 889698

SEQ ID NO: 889711 - protein, 238 aa, Homo sapiens; identical to SEQ ID NO: 889698

SEQ ID NO: 889712 - protein, 238 aa, Homo sapiens; identical to SEQ ID NO: 889698

SEQ ID NO: 889713 - protein, 402 aa, Homo sapiens
LQAGGDACAVRSRGCRCPASRRPGLERDGRGGEEGGSVRSGAGPDSDPRGASSPPAGHRGTAASPRPVAAPSRTPAPPHTRARASPGLPSGPAWRRGQWFSRVSGQVSTLMKATVLMRQPGRVQEIVGALRKGGGDRLQVISDFDMTLSRFAYNGKRCPSSYNILDNSKIISEECRKELTALLHHYYPIEIDPHRTVKEKLPHMVEWWTKAHNLLCQQKIQKFQIAQVVRESNAMLREGYKTFFNTLYHNNIPLFIFSAGIGDILEEIIRQMKVFHPNIHIVSNYMDFNEDGFLQGFKGQLIHTYNKNSSVCENCGYFQQLEGKTNVILLGDSIGDLTMADGVPGVQNILKIGFLNDKVEERRERYMDSYDIVLEKDETLDVVNGLLQHILCQGVQLEMQGP

SEQ ID NO: 889714 - protein, 402 aa, Homo sapiens; identical to SEQ ID NO: 889713

SEQ ID NO: 889715 - protein, 402 aa, Homo sapiens; identical to SEQ ID NO: 889713

SEQ ID NO: 889716 - protein, 402 aa, Homo sapiens; identical to SEQ ID NO: 889713

SEQ ID NO: 889717 - protein, 292 aa, Homo sapiens
MKATVLMRQPGRVQEIVGALRKGGGDRLQVISDFDMTLSRFAYNGKRCPSSYNILDNSKIISEECRKELTALLHHYYPIEIDPHRTVKEKLPHMVEWWTKAHNLLCQQKIQKFQIAQVVRESNAMLREGYKTFFNTLYHNNIPLFIFSAGIGDILEEIIRQMKVFHPNIHIVSNYMDFNEDGFLQGFKGQLIHTYNKNSSVCENCGYFQQLEGKTNVILLGDSIGDLTMADGVPGVQNILKIGFLNDKVEERRERYMDSYDIVLEKDETLDVVNGLLQHILCQGVQLEMQGP

SEQ ID NO: 889718 - protein, 257 aa, Homo sapiens
MTLSRFAYNGKRCPSSYNILDNSKIISEECRKELTALLHHYYPIEIDPHRTVKEKLPHMVEWWTKAHNLLCQQKIQKFQIAQVVRESNAMLREGYKTFFNTLYHNNIPLFIFSAGIGDILEEIIRQMKVFHPNIHIVSNYMDFNEDGFLQGFKGQLIHTYNKNSSVCENCGYFQQLEGKTNVILLGDSIGDLTMADGVPGVQNILKIGFLNDKVEERRERYMDSYDIVLEKDETLDVVNGLLQHILCQGVQLEMQGP

SEQ ID NO: 889719 - protein, 257 aa, Homo sapiens; identical to SEQ ID NO: 889718

SEQ ID NO: 889720 - protein, 257 aa, Homo sapiens; identical to SEQ ID NO: 889718

SEQ ID NO: 889721 - protein, 257 aa, Homo sapiens; identical to SEQ ID NO: 889718

SEQ ID NO: 889722 - protein, 199 aa, Homo sapiens [sequence omitted]

SEQ ID NO: 889723 - protein, 246 aa, Homo sapiens
LQAGGDACAVRSRGCRCPASRRPGLERDGRGGEEGGSVRSGAGPDSDPRGASSPPAGHRGTAASPRPVAAPSRTPAPPHTRARASPGLPSGPAWRRGQWFSRVSGQVSTLMKATVLMRQPGRVQEIVGALRKGGGDRLQVISDFDMTLSRFAYNGKRCPSSYNILDNSKIISEECRKELTALLHHYYPIEIDPHRTVKEKLPHMVEWWTKAHNLLCQQKIQKFQIAQVVRESNAMLRVFSRDLRAS

SEQ ID NO: 889724 - protein, 296 aa, Homo sapiens
SRREATPAQCGRGAVVVPRAADQASNGMAEVSTLMKATVLMRQPGRVQEIVGALRKGGGDRLQVISDFDMTLSRFAYNGKRCPSSYNILDNSKIISEECRKELTALLHHYYPIEIDPHRTVKEKLPHMVEWEGYKTFFNTLYHNNIPLFIFSAGIGDILEEIIRQMKVFHPNIHIVSNYMDFNEDGFLQGFKGQLIHTYNKNSSVCENCGYFQQLEGKTNVILLGDSIGDLTMADGVPGVQNILKIGFLNDKVEERRERYMDSYDIVLEKDETLDVVNGLLQHILCQGVQLEMQGP

SEQ ID NO: 889725 - protein, 225 aa, Homo sapiens
MKATVLMRQPGRVQEIVGALRKGGGDRLQVISDFDMTLSRFAYNGKRCPSSYNILDNSKIISEECRKELTALLHHYYPIEIDPHRTVKEKLPHMVEWWTKAHNLLCQQKIQKFQIAQVVRESNAMLREGYKTFFNTLYHNNIPLFIFSAGIGDILEEIIRQMKVFHPNIHIVSNYMDFNEDVEERRERYMDSYDIVLEKDETLDVVNGLLQHILCQGVQLEMQGP

SEQ ID NO: 889726 - protein, 37 aa, Homo sapiens
MWQGTGTVPGEPWTTACQCSRDCLLQGFSSKFLNMGS

SEQ ID NO: 889727 - protein, 292 aa, Homo sapiens; identical to SEQ ID NO: 889717

SEQ ID NO: 889728 - protein, 402 aa, Homo sapiens; identical to SEQ ID NO: 889713

SEQ ID NO: 889729 - protein, 292 aa, Homo sapiens; identical to SEQ ID NO: 889717

SEQ ID NO: 889730 - protein, 257 aa, Homo sapiens; identical to SEQ ID NO: 889718

SEQ ID NO: 889731 - protein, 326 aa, Homo sapiens
SRREATPAQCGRGAVVVPRAADQASNGMAEVSTLMKATVLMRQPGRVQEIVGALRKGGGDRLQVISDFDMTLSRFAYNGKRCPSSYNILDNSKIISEECRKELTALLHHYYPIEIDPHRTVKEKLPHMVEWWTKAHNLLCQQKIQKFQIAQVVRESNAMLREGYKTFFNTLYHNNIPLFIFSAGIGDILEEIIRQMKVFHPNIHIVSNYMDFNEDGFLQGFKGQLIHTYNKNSSVCENCGYFQQLEGKTNVILLGDSIGDLTMADGVPGVQNILKIGFLNDKVEERRERYMDSYDIVLEKDETLDVVNGLLQHILCQGVQLEMQGP

SEQ ID NO: 889732 - protein, 257 aa, Homo sapiens; identical to SEQ ID NO: 889718

SEQ ID NO: 889733 - protein, 297 aa, Homo sapiens
MKESVAVNHQISMVMLGSSSGQKAPTPVPRADYPPSQGPGSDLIPEQVLMERMPFFFNILDNSKIISEECRKELTALLHHYYPIEIDPHRTVKEKLPHMVEWWTKAHNLLCQQKIQKFQIAQVVRESNAMLREGYKTFFNTLYHNNIPLFIFSAGIGDILEEIIRQMKVFHPNIHIVSNYMDFNEDGFLQGFKGQLIHTYNKNSSVCENCGYFQQLEGKTNVILLGDSIGDLTMADGVPGVQNILKIGFLNDKVEERRERYMDSYDIVLEKDETLDVVNGLLQHILCQGVQLEMQGP

SEQ ID NO: 889734 - protein, 234 aa, Homo sapiens
MAFLPIWISQLTALLHHYYPIEIDPHRTVKEKLPHMVEWWTKAHNLLCQQKIQKFQIAQVVRESNAMLREGYKTFFNTLYHNNIPLFIFSAGIGDILEEIIRQMKVFHPNIHIVSNYMDFNEDGFLQGFKGQLIHTYNKNSSVCENCGYFQQLEGKTNVILLGDSIGDLTMADGVPGVQNILKIGFLNDKVEERRERYMDSYDIVLEKDETLDVVNGLLQHILCQGVQLEMQGP

SEQ ID NO: 889735 - protein, 315 aa, Homo sapiens
LQAGGDACAVRSRGCRCPASRRPGLERDGRGGEEGGSVRSGAGPDSDPRGASSPPAGHRGTAASPRPVAAPSRTPAPPHTRARASPGLPSGPAWRRGQWFSRVSGQVSTLMKATVLMRQPGRVQEIVGALRKGGGDRLQVISDFDMTLSRFAYNGKRCPSSYNILDNSKIISEECRKELTALLHHYYPIEIDPHRTVKEKLPHMVEWWTKAHNLLCQQKIQKFQIAQVVRESNAMLREGYKTFFNTLYHNNIPLFIFSAGIGDILEEIIRQMKVFHPNIHIVSNYMDFNEDVSQILFGLGKDEGWGPPARAVNSA

SEQ ID NO: 889736 - protein, 226 aa, Homo sapiens
SRREATPAQCGRGAVVVPRAADQASNGMAEVISDFDMTLSRFAYNGKRCPSSYNILDNSKIISEECRKELTALLHHYYPIEIDPHRTVKEKLPHMVEWWTKAHNLLCQQKIQKFQIAQVVRESNAMLREGYKTFFNTLYHNNIPLFIFSAGIGDILEEIIRQMKVFHPNIHIVSNYMDFNEDVEERRERYMDSYDIVLEKDETLDVVNGLLQHILCQGVQLEMQGP

SEQ ID NO: 889737 - protein, 265 aa, Homo sapiens
MVGAGREAKRRRKTLDAEVVEKPAKEETVVENATPDYAAGLVSTQKLGSLNNEPALPSTSYLPSTPSVVPASSYIPSSETPPAPSSREASRPPEEPSAPSPTLPAQFKQRAPMYNSGLSPATPTPAAPTSPLTPTTPPAVAPTTQTPPVAMVAPQTQAPAQQQPKKNLSLTREQMFAAQEMFKTANKVTRPEKALILGFMAGSRENPCQEQGDVIQIKLSEHTEDLPKADGQGSTTMLVDTVFEMNYATGQWTRFKKYKPMTNVS

SEQ ID NO: 889738 - protein, 128 aa, Homo sapiens
GRMAEAQARHGLALCVSSWEGVYVAEAGPGVDGSGLPGIEGARGAPVSSTHVAHGLPKALASLQIPGPPPGSTSANSQRRPDPGPHQSVGDGGPCPLPVPAWEFCIHLLYSCGHLRQSLGTYFHCKTI

SEQ ID NO: 889739 - protein, 541 aa, Homo sapiens
AGWYWPRVLWSPKMASMRESDTGLWLHNKLGATDELWAPPSIASLLTAAVIDNIRLCFHGLSSAVKLKLLLGTLHLPRRTVDEMKGALMEIIQLASLDSDPWVLMVADILKSFPDTGSLNLELEEQNPNVQDILGELREKVGECEASAMLPLECQYLNKNALTTLAGPLTPPVKHFQLKRKPKSATLRAELLQKSTETAQQLKRSAGVPFHAKGRGLLRKMDTTTPLKGIPKQAPFRSPTAPSVFSPTGNRTPIPPSRTLLRKERGVKLLDISELDMVGAGREAKRRRKTLDAEVVEKPAKEETVVENATPDYAAGLVSTQKLGSLNNEPALPSTSYLPSTPSVVPASSYIPSSETPPAPSSREASRPPEEPSAPSPTLPAQFKQRAPMYNSGLSPATPTPAAPTSPLTPTTPPAVAPTTQTPPVAMVAPQTQAPAQQQPKKNLSLTREQMFAAQEMFKTANKVTRPEKALILGFMAGSRENPCQEQGDVIQIKLSEHTEDLPKADGQGSTTMLVDTVFEMNYATGQWTRFKKYKPMTNVS

SEQ ID NO: 889740 - protein, 321 aa, Homo sapiens
MDTTTPLKGIPKQAPFRSPTAPSVFSPTGNRTPIPPSRTLLRKERGVKLLDISELDMVGAGREAKRRRKTLDAEVVEKPAKEETVVENATPDYAAGLVSTQKLGSLNNEPALPSTSYLPSTPSVVPASSYIPSSETPPAPSSREASRPPEEPSAPSPTLPAQFKQRAPMYNSGLSPATPTPAAPTSPLTPTTPPAVAPTTQTPPVAMVAPQTQAPAQQQPKKNLSLTREQMFAAQEMFKTANKVTRPEKALILGFMAGSRENPCQEQGDVIQIKLSEHTEDLPKADGQGSTTMLVDTVFEMNYATGQWTRFKKYKPMTNVS

SEQ ID NO: 889741 - protein, 428 aa, Homo sapiens
RSCLRSVPRAGRLRPVNSHVPACAFSPVGECEASAMLPLECQYLNKNALTTLAGPLTPPVKHFQLKRKPKSATLRAELLQKSTETAQQLKRSAGVPFHAKGRGLLRKMDTTTPLKGIPKQAPFRSPTAPSVFSPTGNRTPIPPSRTLLRKERGVKLLDISELDMVGAGREAKRRRKTLDAEVVEKPAKEETVVENATPDYAAGLVSTQKLGSLNNEPALPSTSYLPSTPSVVPASSYIPSSETPPAPSSREASRPPEEPSAPSPTLPAQFKQRAPMYNSGLSPATPTPAAPTSPLTPTTPPAVAPTTQTPPVAMVAPQTQAPAQQQPKKNLSLTREQMFAAQEMFKTANKVTRPEKALILGFMAGSRENPCQEQGDVIQIKLSEHTEDLPKADGQGSTTMLVDTVFEMNYATGQWTRFKKYKPMTNVS

SEQ ID NO: 889742 - protein, 455 aa, Homo sapiens
MPGQRRALSPKMASMRESDTGLWLHNKLGATDELWAPPSIASLLTAAVIDNIRLCFHGLSSAVKLKLLLGTLHLPRRTVDEMKGALMEIIQLASLDSDPWVLMVADILKSFPDTGSLNLELEEQNPNVQDILGELREKVGECEASAMLPLECQYLNKNALTTLAGPLTPPVKHFQLKRKPKSATLRAELLQKSTETAQQLKRSAGVPFHAKGRGLLRKMDTTTPLKGIPKQAPFRSPTAPSVFSPTGNRTPIPPSRTLLRKERGVKLLDISELDMVGAGREAKRRRKTLDAEVVEKPAKEETVVENATPDYAAGLVSTQKLGSLNNEPALPSTSYLPSTPSVVPASSYIPSSETPPAPSSREASRPPEEPSAPSPTLPAQFKQRAPMYNSGLSPATPTPAAPTSPLTPTTRPHQSVGDGGPCPLPVPAWEFCIHLLYSCGHLRQSLGTYFHCKTI

SEQ ID NO: 889743 - protein, 348 aa, Homo sapiens
MPGQRRALSPKMASMRESDTGLWLHNKLGATDELWAPPSIASLLTAAVIDNIRLCFHGLSSAVKLKLLLGTLHLPRRTVDEMKGALMEIIQLASLDSDPWVLMVADILKSFPDTGSLNLELEEQNPNVQDILGELREKVGECEASAMLPLECQYLNKNALTTLAGPLTPPVKHFQLKRKPKSATLRAELLQKSTETAQQLKRSAGVPFHAKGRGLLRKMDTTTPLKGIPKQAPFRSPTAPSVFSPTGNRTPIPPSRTLLRKERGVKLLDISELDMVGAGREANGKENPERRWGETATRNALEPTGCSGGHQMAERRRPRNPPGRPQQQTTTGPRPPPPTAHAHTPHTQ

SEQ ID NO: 889744 - protein, 46 aa, Homo sapiens
MLPLECQYLNKNALTTLAGPLTPPVKHFQLKRKPKSATLRAELLQK

SEQ ID NO: 889745 - protein, 539 aa, Homo sapiens
MPGQRRALSPKMASMRESDTGLWLHNKLGATDELWAPPSIASLLTAAVIDNIRLCFHGLSSAVKLKLLLGTLHLPRRTVDEMKGALMEIIQLASLDSDPWVLMVADILKSFPDTGSLNLELEEQNPNVQDILGELREKVGECEASAMLPLECQYLNKNALTTLAGPLTPPVKHFQLKRKPKSATLRAELLQKSTETAQQLKRSAGVPFHAKGRGLLRKMDTTTPLKGIPKQAPFRSPTAPSVFSPTGNRTPIPPSRTLLRKERGVKLLDISELDMVGAGREAKRRRKTLDAEVVEKPAKEETVVENATPDYAAGLVSTQKLGSLNNEPALPSTSYLPSTPSVVPASSYIPSSETPPAPSSREASRPPEEPSAPSPTLPAQFKQRAPMYNSGLSPATPTPAAPTSPLTPTTPPAVAPTTQTPPVAMVAPQTQAPAQQQPKKNLSLTREQMFAAQEMFKTANKVTRPEKALILGFMAGSRENPCQEQGDVIQIKLSEHTEDLPKADGQGSTTMLVDTVFEMNYATGQWTRFKKYKPMTNVS

SEQ ID NO: 889746 - protein, 542 aa, Homo sapiens
GLGRGWCQSAESPKMASMRESDTGLWLHNKLGATDELWAPPSIASLLTAAVIDNIRLCFHGLSSAVKLKLLLGTLHLPRRTVDEMKGALMEIIQLASLDSDPWVLMVADILKSFPDTGSLNLELEEQNPNVQDILGELREKVGECEASAMLPLECQYLNKNALTTLAGPLTPPVKHFQLKRKPKSATLRAELLQKSTETAQQLKRSAGVPFHAKGRGLLRKMDTTTPLKGIPKQAPFRSPTAPSVFSPTGNRTPIPPSRTLLRKERGVKLLDISELDMVGAGREAKRRRKTLDAEVVEKPAKEETVVENATPDYAAGLVSTQKLGSLNNEPALPSTSYLPSTPSVVPASSYIPSSETPPAPSSREASRPPEEPSAPSPTLPAQFKQRAPMYNSGLSPATPTPAAPTSPLTPTTPPAVAPTTQTPPVAMVAPQTQAPAQQQPKKNLSLTREQMFAAQEMFKTANKVTRPEKALILGFMAGSRENPCQEQGDVIQIKLSEHTEDLPKADGQGSTTMLVDTVFEMNYATGQWTRFKKYKPMTNVS

SEQ ID NO: 889747 - protein, 265 aa, Homo sapiens; identical to SEQ ID NO: 889737

SEQ ID NO: 889748 - protein, 429 aa, Homo sapiens
RLVLAPGVMVPQDGVHAGERHGPVAAQQAGGHGRAVGAAQHRVPAHGRGHRQHPSLLPWPLVGSEAQVATRDAAPPAPHGGRATETAQQLKRSAGVPFHAKGRGLLRKMDTTTPLKGIPKQAPFRSPTAPSVFSPTGNRTPIPPSRTLLRKERGVKLLDISELDMVGAGREAKRRRKTLDAEVVEKPAKEETVVENATPDYAAGLVSTQKLGSLNNEPALPSTSYLPSTPSVVPASSYIPSSETPPAPSSREASRPPEEPSAPSPTLPAQFKQRAPMYNSGLSPATPTPAAPTSPLTPTTPPAVAPTTQTPPVAMVAPQTQAPAQQQPKKNLSLTREQMFAAQEMFKTANKVTRPEKALILGFMAGSRENPCQEQGDVIQIKLSEHTEDLPKADGQGSTTMLVDTVFEMNYATGQWTRFKKYKPMTNVS

SEQ ID NO: 889749 - protein, 227 aa, Homo sapiens
MPGQRRALSPKMASMRESDTGLWLHNKLGATDELWAPPSIASLLTAAVIDNIRLCFHGLSSAVKLKLLLGTLHLPRRTVDEMKGALMEIIQLASLDSDPWVLMVADILKSFPDTGSLNLELEEQNPNVQDILGELREKVGECEASAMLPLECQYLNKKAQRPEPHVASAVQAAGAHVQQRPEPCHTHACGAHLASDTHHTSGCRPYHSDTPGCHGGPADPGPCSAAA

SEQ ID NO: 889750 - protein, 143 aa, Homo sapiens
AGWYWPRVLWSPKMASMRESDTGLWLHNKLGATDELWAPPSIASLLTAAVIDNIRLCFHGLSSAVKLKLLLGTLHLPRRTVDETPAVRSALCPFYSFLHAVLRHSNKWVCEGLALSTRLECSGTIVTHCSLDLLTSDLPISAS

SEQ ID NO: 889751 - protein, 84 aa, Homo sapiens
SPQKNRQSDENNLKDPGGSEFDSISKNTWAPAPDTWAPAPDQTEQDQNRLSQNSVNLSPSSHANNLSVVTYSKGLHGPYPFGQS

SEQ ID NO: 889752 - protein, 84 aa, Homo sapiens; identical to SEQ ID NO: 889751

SEQ ID NO: 889753 - protein, 84 aa, Homo sapiens; identical to SEQ ID NO: 889751

SEQ ID NO: 889754 - protein, 84 aa, Homo sapiens; identical to SEQ ID NO: 889751

SEQ ID NO: 889755 - protein, 130 aa, Homo sapiens
MAFCLRASLGPDCCCWYQSPETLPPWSPCMPSCSYCLVALKQHISTVPGRIVGGFTTPAFLTSSSAQHWVPLPSFPAGASWATVSGSGPARVVLLFLLLLGNHTWQVKCPKHLVSLPKNKPFLCTSLEAR

SEQ ID NO: 889756 - protein, 84 aa, Homo sapiens; identical to SEQ ID NO: 889751

SEQ ID NO: 889757 - protein, 84 aa, Homo sapiens; identical to SEQ ID NO: 889751

SEQ ID NO: 889758 - protein, 147 aa, Homo sapiens
MAERPEDLNLPNAVITRIIKEALPDGVNISKEARSAISRAASVFVLYATSCANNFAMKGKRKTLNASDVLSAMEEMEFQRFVTPLKEALEAYRREQKGKKEASEQKKKDKDKKTDSEEQDKSRDEDNDEDEERLEEEEQNEEEEVDN

SEQ ID NO: 889759 - protein, 147 aa, Homo sapiens; identical to SEQ ID NO: 889758

SEQ ID NO: 889760 - protein, 147 aa, Homo sapiens; identical to SEQ ID NO: 889758

SEQ ID NO: 889761 - protein, 147 aa, Homo sapiens; identical to SEQ ID NO: 889758

SEQ ID NO: 889762 - protein, 147 aa, Homo sapiens; identical to SEQ ID NO: 889758

SEQ ID NO: 889763 - protein, 93 aa, Homo sapiens
RTEAPLSQISCEKVPDAAMARSREMDLGRGVRGAVGLDGSLGGPKPLRLQNPDAPVFEAEAGLWGEEGGYGAQSTVGHCRPRGAERKPRRVRP

SEQ ID NO: 889764 - protein, 147 aa, Homo sapiens; identical to SEQ ID NO: 889758

SEQ ID NO: 889765 - protein, 147 aa, Homo sapiens; identical to SEQ ID NO: 889758

SEQ ID NO: 889766 - protein, 176 aa, Homo sapiens
MAERPEDLNLPNAVITRIIKEAVSSSGGADERAGGKQVLERQLCSPPVSSQLPDGVNISKEARSAISRAASVFVLYATSCANNFAMKGKRKTLNASDVLSAMEEMEFQRFVTPLKEALEAYRREQKGKKEASEQKKKDKDKKTDSEEQDKSRDEDNDEDEERLEEEEQNEEEEVDN

SEQ ID NO: 889767 - protein, 147 aa, Homo sapiens; identical to SEQ ID NO: 889758

SEQ ID NO: 889768 - protein, 147 aa, Homo sapiens; identical to SEQ ID NO: 889758

SEQ ID NO: 889769 - protein, 598 aa, Homo sapiens
MAASVTNAVPPHNFKSQEVTPACLDGKSLRAGITEVKEPSVTSPTPSDIQQNKGLPKPEFRFKGQSTKSDSAEDYLLWKRLQGVSAACPAPSSAAHQLEHLSAKLQKIDEQLLAIQNIAENIEQDFPKPEMLDLHCDKIGPVDHIEFSSGPEFKKTLASKTISISEEVRFLTHMDEEDQSDKKETSEPEFSITENYSGQKTCVFPTADSAVSLSSSSDQNTTSPGMNSSDELCESVSVHPLQMTGLTDIADIIDDLIIKDGVSSEELGLTEQAMGTSRIQHYSGRHSQRTDKERREIQAWMKRKRKERMAKYLNELAEKRGQEHDPFCPRSNPLYMTSREIRLRQKMKHEKDRLLLSEHYSRRISQAYGLMNELLSESVQLPTLPQKPLPNKPSPTQSSSCQHCPSPRGENQHGHSFLINRPGKVKYMSKPSYIHKRKSFGQPQGSPWPHGTATFTIQKKAGGAKAAVRKATQSPVTFQKGSNAPCHSLQHTKKHGSAGLAPQTKQVCVEYEREETVVSPWTIPSEIHKILHESHNSLLQDLSPTEEEEPEHPFGVGGVDSVSESTGSILSKLDWNAIEDMVASVEDQGLSVHWALDL

SEQ ID NO: 889770 - protein, 722 aa, Homo sapiens
PGHTNIVVPILWMIRRTFEMLQDDNTSAGLHFMASVKKKAIGSQDASTNTDPEHEPLTAPQLLVPDVYLNLKLSSEMSEKPWSPSIPHTVTNLELPVREEPSNDNVIKQQSDHLAVPSSAELHYMAASVTNAVPPHNFKSQEVTPACLDGKSLRAGITEVKEPSVTSPTPSDIQQNKGLPKPEFRFKGQSTKSDSAEDYLLWKRLQGVSAACPAPSSAAHQLEHLSAKLQKIDEQLLAIQNIAENIEQDFPKPEMLDLHCDKIGPVDHIEFSSGPEFKKTLASKTISISEEVRFLTHMDEEDQSDKKETSEPEFSITENYSGQKTCVFPTADSAVSLSSSSDQNTTSPGMNSSDELCESVSVHPLQMTGLTDIADIIDDLIIKDGVSSEELGLTEQAMGTSRIQHYSGRHSQRTDKERREIQAWMKRKRKERMAKYLNELAEKRGQEHDPFCPRSNPLYMTSREIRLRQKMKHEKDRLLLSEHYSRRISQAYGLMNELLSESVQLPTLPQKPLPNKPSPTQSSSCQHCPSPRGENQHGHSFLINRPGKVKYMSKPSYIHKRKSFGQPQGSPWPHGTATFTIQKKAGGAKAAVRKATQSPVTFQKGSNAPCHSLQHTKKHGSAGLAPQTKQVCVEYEREETVVSPWTIPSEIHKILHESHNSLLQDLSPTEEEEPEHPFGVGGVDSVSESTGSILSKLDWNAIEDMVASVEDQGLSVHWALDL

SEQ ID NO: 889771 - protein, 667 aa, Homo sapiens
MLQDDNTSAGLHFMASVKKKAIGSQDASTNTDPEHEPLTAPQLLVPDVYLNLKLSSEMSEKPWSPSIPHTVTNLELPVREEPSNDNVIKQQSDHLAVPSSAELHYMAASVTNAVPPHNFKSQGLPKPEFRFKGQSTKSDSAEDYLLWKRLQGVSAACPAPSSAAHQLEHLSAKLQKIDEQLLAIQNIAENIEQDFPKPEMLDLHCDKIGPVDHIEFSSGPEFKKTLASKTISISEEVRFLTHMDEEDQSDKKETSEPEFSITENYSGQKTCVFPTADSAVSLSSSSDQNTTSPGMNSSDELCESVSVHPLQMTGLTDIADIIDDLIIKDGVSSEELGLTEQAMGTSRIQHYSGRHSQRTDKERREIQAWMKRKRKERMAKYLNELAEKRGQEHDPFCPRSNPLYMTSREIRLRQKMKHEKDRLLLSEHYSRRISQAYGLMNELLSESVQLPTLPQKPLPNKPSPTQSSSCQHCPSPRGENQHGHSFLINRPGKVKYMSKPSYIHKRKSFGQPQGSPWPHGTATFTIQKKAGGAKAAVRKATQSPVTFQKGSNAPCHSLQHTKKHGSAGLAPQTKQVCVEYEREETVVSPWTIPSEIHKILHESHNSLLQDLSPTEEEEPEHPFGVGGVDSVSESTGSILSKLDWNAIEDMVASVEDQGLSVHWALDL

SEQ ID NO: 889772 - protein, 228 aa, Homo sapiens
MNELLSESVQLPTLPQKPLPNKPSPTQSSSCQHCPSPRGENQHGHSFLINRPGKVKYMSKPSYIHKRKSFGQPQGSPWPHGTATFTIQKKAGGAKAAVRKATQSPVTFQKGSNAPCHSLQHTKKHGSAGLAPQTKQVCVEYEREETVVSPWTIPSEIHKILHESHNSLLQDLSPTEEEEPEHPFGVGGVDSVSESTGSILSKLDWNAIEDMVASVEDQGLSVHWALDL

SEQ ID NO: 889773 - protein, 588 aa, Homo sapiens
MAASVTNAVPPHNFKSQEVTPACLDGKSLRAGITEVKEPSVTSPTPSDIQQNKGLPKPEFRFKGQSTKSDSAEDYLLWKRLQGVSAACPAPSSAAHQLEHLSAKLQKIDEQLLAIQNIAENIEQDFPKPEMLDLHCDKIGPVDHIEFSSGPEFKKTLASKTISISEEVRFLTHMDEEDQSDKKETSEPEFSITENYSGQKTCVFPTADSAVSLSSSSDQNTTSPVFQYIPLQMTGLTDIADIIDDLIIKDGVSSEELGLTEQAMGTSRIQHYSGRHSQRTDKERREIQAWMKRKRKERMAKYLNELAEKRGQEHDPFCPRSNPLYMTSREIRLRQKMKHEKDRLLLSEHYSRRISQAYGLMNELLSESVQLPTLPQKPLPNKPSPTQSSSCQHCPSPRGENQHGHSFLINRPGKVKYMSKPSYIHKRKSFGQPQGSPWPHGTATFTIQKKAGGAKAAVRKATQSPVTFQKGSNAPCHSLQHTKKHGSAGLAPQTKQVCVEYEREETVVSPWTIPSEIHKILHESHNSLLQDLSPTEEEEPEHPFGVGGVDSVSESTGSILSKLDWNAIEDMVASVEDQGLSVHWALDL

SEQ ID NO: 889774 - protein, 598 aa, Homo sapiens; identical to SEQ ID NO: 889769

SEQ ID NO: 889775 - protein, 550 aa, Homo sapiens
MAASVTNAVPPHNFKSQEVTPACLDGKSLRAGITEVKEPSVTSPTPSDIQQNKGLPKPEFRFKGQSTKSDSAEDYLLWKRLQGVSAACPAPSSAAHQLEHLSAKLQKIDEQLLAIQNIAENIEQDFPKPEMLDLHCDKIGPVDHIEFSSGPEFKKTLASKTISISEEVRFLTHMDEEDQSDKKETSEPEFSITENYSGQKTCVFPTADSAVSLSSSSDQNTTSPGMNSSDELCESVSVHPLQMTGLTDIADIIDDLIIKDGVSSEELGLTEQAMGTSRIQHYSGRHSQRTDKERREIQAWMKRKRKERMAKYLNELAEKRGQEHDPFCPRSNPLYMTSREIRLRQKMKHEKDRLLLSEHYSRRISQAYGLMNELLSESVQLPTLPQKPLPNKPSPTQSSSCQHCPSPRGENQHGHSFLINRPGKVKYMSKPSYIHKRKSFGQPQGSPWPHGTATFTIQKKAGGAKAAVRKATQSPVTFQKGSNAPCHSLQHTKKHGSAGLAPQTKQVCVEYEREETVVSPWTIPSEIHKILHESHNSLLQEERINMVTVF

SEQ ID NO: 889776 - protein, 349 aa, Homo sapiens
MAASVTNAVPPHNFKSQEVTPACLDGKSLRAGITEVKEPSVTSPTPSDIQQNKGLPKPEFRFKGQSTKSDSAEDYLLWKRLQGVSAACPAPSSAAHQLEHLSAKLQKIDEQLLAIQNIAENIEQDFPKPEMLDLHCDKIGPVDHIEFSSGPEFKKTLASKTISISEEVRFLTHMDEEDQSDKKETSEPEFSITENYSGQKTCVFPTADSAVSLSSSSDQNTTSPGMNSSDELCESVSVHPLQMTGLTDIADIIDDLIIKDGVSSEELGLTEQAMGTSRIQHYSGRHSQRTDKERREIQAWMKRKRKERMAKYLNELAEKRGQEHDPFCPRSNPVLCHSSISLSYSSALI

SEQ ID NO: 889777 - protein, 320 aa, Homo sapiens
AVVVGHSVGSSSGGARSSRSRLLGGSYGWVCRTGPGLGLGPLVETQVREARTLQLPAFWVSSLFKLLLLASFTGRCPAGELETSDVVTVVLGQDAKLPCFYRGDSGEQVGQVAWARVDAGEGAQELALLHSKYGLHVSPAYEGRVEQPPPPRNPLDGSVLLRNAVQADEGEYECRVSTFPAGSFQARLRLRVLVPPLPSLNPGPALEEGQGLTLAASCTAEGSPAPSVTWDTEVKGTTSSRSFKHSRSAAVTSEFHLVPSRSMNGQPLTCVVSHPGLLQDQRITHILHVSSWGALEGLEQILHGEGLVLLDGPLYWGVGF

SEQ ID NO: 889778 - protein, 510 aa, Homo sapiens
MPLSLGAEMWGPEAWLLLLLLLASFTGRCPAGELETSDVVTVVLGQDAKLPCFYRGDSGEQVGQVAWARVDAGEGAQELALLHSKYGLHVSPAYEGRVEQPPPPRNPLDGSVLLRNAVQADEGEYECRVSTFPAGSFQARLRLRVLVPPLPSLNPGPALEEGQGLTLAASCTAEGSPAPSVTWDTEVKGTTSSRSFKHSRSAAVTSEFHLVPSRSMNGQPLTCVVSHPGLLQDQRITHILHVSFLAEASVRGLEDQNLWHIGREGAMLKCLSEGQPPPSYNWTRLDGPLPSGVRVDGDTLGFPPLTTEHSGIYVCHVSNEFSSRDSQVTVDVLDPQEDSGKQVDLVSASVVVVGVIAALLFCLLVVVVVLMSRYHRRKAQQMTQKYEEELTLTRENSIRRLHSHHTDPRSQPEESVGLRAEGHPDSLKDNSSCSVMSEEPEGRSYSTLTTVREIETQTELLSPGSGRAEEEEDQDEGIKQAMNHFVQENGTLRAKPTGNGIYINGRGHLV

SEQ ID NO: 889779 - protein, 510 aa, Homo sapiens; identical to SEQ ID NO: 889778

SEQ ID NO: 889780 - protein, 98 aa, Homo sapiens
NSLRLWVTSWGWRVESCLDTLGGGGFSPSRWHPSASLSSRLDGPLPSGVRVDGDTLGFPPLTTEHSGIYVCHVSNEFSSRDSQVTVDVLGKHWSRSPW

SEQ ID NO: 889781 - protein, 510 aa, Homo sapiens; identical to SEQ ID NO: 889778

SEQ ID NO: 889782 - protein, 510 aa, Homo sapiens; identical to SEQ ID NO: 889778

SEQ ID NO: 889783 - protein, 35 aa, Homo sapiens
MTQPCPTMCSCPAFVPDLPFALGLQSEEPEGRSYS

SEQ ID NO: 889784 - protein, 462 aa, Homo sapiens
MESTPSRGLNRVHLQCRNLQEFLGGLSPGVLDRLYGHPATCLAVFRELPSLAKNWVMRMLFLEQPLPQAAVALWVKKEFSKAQEESTGLLSGLRIWHTQLLPGGLQGLILNPIFRQNLRIALLGGGKAWSDDTSQLGPDKHARDVPSLDKYAEERWEVVLHFMVGSPSAAVSQDLAQLLSQAGLMKSTEPGEPPCITSAGFQFLLLDTPAQLWYFMLQYLQTAQSRGMDLVEILSFLFQLSFSTLGKDYSVEGMSDSLLNFLQHLREFGLVFQRKRKSRRYYPTRLAINLSSGVSGAGGTVHQPGFIVVETNYRLYAYTESELQIALIALFSEMLYRFPNMVVAQVTRESVQQAIASGITAQQIIHFLRTRAHPVMLKQTPVLPPTITDQIRLWELERDRLRFTEGVLYNQFLSQVDFELLLAHARELGVLVFENSAKRLMVVTPAGHSDVKRFWKRQKHSS

SEQ ID NO: 889785 - protein, 544 aa, Homo sapiens
MESTPSRGLNRVHLQCRNLQEFLGGLSPGVLDRLYGHPATCLAVFRELPSLAKNWVMRMLFLEQPLPQAAVALWVKKEFSKAQEESTGLLSGLRIWHTQLLPGGLQGLILNPIFRQNLRIALLGGGKAWSDDTSQLGPDKHARDVPSLDKYAEERWEVVLHFMVGSPSAAVSQDLAQLLSQAGLMKSTEPGEPPCITSAGFQFLLLDTPAQLWYFMLQYLQTAQSRGMDLVEILSFLFQLSFSTLGKDYSVEGMSDSLLNFLQHLREFGLVFQRKDERLDKWLPGKKQGGVLPLPLKRSGVLGQYQEAVARTEYLGLSGEEKLGVEVLHLGRDLIFQAGRCKAVTSETRHLPFYSFQRKSRRYYPTRLAINLSSGVSGAGGTVHQPGFIVVETNYRLYAYTESELQIALIALFSEMLYRFPNMVVAQVTRESVQQAIASGITAQQIIHFLRTRAHPVMLKQTPVLPPTITDQIRLWELERDRLRFTEGVLYNQFLSQVDFELLLAHARELGVLVFENSAKRLMVVTPAGHSDVKRFWKRQKHSS

SEQ ID NO: 889786 - protein, 523 aa, Homo sapiens
MESTPSRGLNRVHLQCRNLQEFLGGLSPGVLDRLYGHPATCLAVFRELPSLAKNWVMRMLFLEQPLPQAAVALWVKKEFSKAQEESTGLLSGLRIWHTQLLPGGLQGLILNPIFRQNLRIALLGGGKAWSDDTSQLGPDKHARDVPSLDKYAEERWEVVLHFMVGSPSAAVSQDLAQLLSQAGLMKSTEPGEPPCITSAGFQFLLLDTPAQLWYFMLQYLQTAQSRGMDLVEILSFLFQLSFSTLGKDYSVEGMSDSLLNFLQHLREFGLVFQRKRKSRRYYPTRLAINLSSGVSGAGGTVHQPGFIVVETNYRLYAYTGEAGQRAPGRGGWGLRECQFMFVFTWQSTELSDISHDTVKEGLEGVWVWGWPPHPLSIPGSESELQIALIALFSEMLYRFPNMVVAQVTRESVQQAIASGITAQQIIHFLRTRAHPVMLKQTPVLPPTITDQIRLWELERDRLRFTEGVLYNQFLSQVDFELLLAHARELGVLVFENSAKRLMVVTPAGHSDVKRFWKRQKHSS

SEQ ID NO: 889787 - protein, 380 aa, Homo sapiens
MESTPSRGLNRVHLQCRNLQEFLGGLSPGVLDRLYGHPATCLAVFRELPSLAKNWVMRMLFLEQPLPQAAVALWVKKEFSKAQEESTGLLSGLRIWHTQLLPGGLQGLILNPIFRQNLRIALLGGGKAWSDDTSQLGPDKHARDVPSLDKYAEERWEVVLHFMVGSPSAAVSQDLAQLLSQAGLMKSTEPGEPPCITSAGFQFLLLDTPAQLWYFMLQYLQTAQSRGMDLVEILSFLFQLSFSTLGKDYSVEGMSDSLLNFLQHLREFGLVFQRKRKSRRYYPTRLAINLSSGVSGAGGTVHQPGFIVVETNYRLYAYTESELQIALIALFSEMLYRFPNMVVAQVTRESVQQAIASGITAQQIIHFLRTRAHPVMLKQV

SEQ ID NO: 889788 - protein, 276 aa, Homo sapiens
MESTPSRGLNRVHLQCRNLQEFLGGLSPGVLDRLYGHPATCLAVFRELPSLAKNWVMRMLFLEQPLPQAAVALWVKKEFSKAQEESTGLLSGLRIWHTQLLPGGLQGLILNPIFRQNLRIALLGGGKAWSDDTSQLGPDKHARDVPSLDKYAEERWEVVLHFMVGSPSAAVSQDLAQLLSQAGLMKSTEPGEPPCITSAGFQFLLLDTPAQLWYFMLQYLQTAQSRGMDLVEILSFLFQLSFSTLGKDYSVEGMSDSLLNFLQHLREFGLVFQRKV

SEQ ID NO: 889789 - protein, 462 aa, Homo sapiens; identical to SEQ ID NO: 889784

SEQ ID NO: 889790 - protein, 175 aa, Homo sapiens
MTQVSWDQTTGGTVHQPGFIVVETNYRLYAYTESELQIALIALFSEMLYRFPNMVVAQVTRESVQQAIASGITAQQIIHFLRTRAHPVMLKQTPVLPPTITDQIRLWELERDRLRFTEGVLYNQFLSQVDFELLLAHARELGVLVFENSAKRLMVVTPAGHSDVKRFWKRQKHSS

SEQ ID NO: 889791 - protein, 183 aa, Homo sapiens
MESTPSRGLNRVHLQCRNLQEFLGGLSPGVLDRLYGHPATCLAVFRELPSLAKNWVMRMLFLEQPLPQAAVALWVKKEFSKAQEESTGLLSGLRIWHTQLLPGGLQGLILNPIFRQNLRIALLGGGKAWSDDTSQLGPDKDSGSLRVSCITSSCRKWTLSCCWPTRGSWACSCSRTRPSGSWW

SEQ ID NO: 889792 - protein, 171 aa, Homo sapiens
MVRLSELKSTVQNSRPIKTATTLPDDMITQREDAEGVAAEEEQEGDSGEQETGATDARPRRRKPARLLEATAKPEPEEKSRAKRQKDFDIAEQNESSDEESLRKERARSAEEPWTQNQQKLLELALQQYPRGSSDRWDKIARCVPSKSKEDCIARYKLLVELVQKKKQAKS

SEQ ID NO: 889793 - protein, 109 aa, Homo sapiens
MTAPCSQPAQLPGRRQLGLVPFPPPPPRTPLLWLLLLLLAAVAPARGWESGDLELFDLVEEVQLNFYQFLGVQQDASSADIRKAYRKLSLTLHPDKNKDENAETQFRQV

SEQ ID NO: 889794 - protein, 340 aa, Homo sapiens
MKPQWHDLLPCKLGIWFCLTLKALPHLIQDAGQFYAKYKETRLKEKEDALTRTELETLQKQKKVKKPKPEFPVYTPLETTYIQSYDHGTSIEEIEEQMDDWLENRNRTQKKQAPEWTEEDLSQLTRSMVKFPGGTPGRWEKIAHELGRSVTDVTTKAKQLKDSVTCSPGMVRLSELKSTVQNSRPIKTATTLPDDMITQREDAEGVAAEEEQEGDSGEQETGATDARPRRRKPARLLEATAKPEPEEKSRAKRQKDFDIAEQNESSDEESLRKERARSAEEPWTQNQQKLLELALQQYPRGSSDRWDKIARCVPSKSKEDCIARYKLLVELVQKKKQAKS

SEQ ID NO: 889795 - protein, 213 aa, Homo sapiens [sequence omitted]

SEQ ID NO: 889796 - protein, 456 aa, Homo sapiens
MKMQKLSLDKLVAIYEVLKDDERRQRYDDILINGLPDWRQPVFYYRRVRKMSNAELALLLFIILTVGHYAVVWSIYLEKQLDELLSRKKREKKKKTGSKSVDVSKLGASEKNERLLMKPQWHDLLPCKLGIWFCLTLKALPHLIQDAGQFYAKYKETRLKEKEDALTRTELETLQKQKKVKKPKPEFPVYTPLETTYIQSYDHGTSIEEIEEQMDDWLENRNRTQKKQAPEWTEEDLSQLTRSMVKFPGGTPGRWEKIAHELGRSVTDVTTKAKQLKDSVTCSPGMVRLSELKSTVQNSRPIKTATTLPDDMITQREDAEGVAAEEEQEGDSGEQETGATDARPRRRKPARLLEATAKPEPEEKSRAKRQKDFDIAEQNESSDEESLRKERARSAEEPWTQNQQKLLELALQQYPRGSSDRWDKIARCVPSKSKEDCIARYKLLVELVQKKKQAKS

SEQ ID NO: 889797 - protein, 437 aa, Homo sapiens
MMNDRQRYDDILINGLPDWRQPVFYYRRVRKMSNAELALLLFIILTVGHYAVVWSIYLEKQLDELLSRKKREKKKKTGSKSVDVSKLGASEKNERLLMKPQWHDLLPCKLGIWFCLTLKALPHLIQDAGQFYAKYKETRLKEKEDALTRTELETLQKQKKVKKPKPEFPVYTPLETTYIQSYDHGTSIEEIEEQMDDWLENRNRTQKKQAPEWTEEDLSQLTRSMVKFPGGTPGRWEKIAHELGRSVTDVTTKAKQLKDSVTCSPGMVRLSELKSTVQNSRPIKTATTLPDDMITQREDAEGVAAEEEQEGDSGEQETGATDARPRRRKPARLLEATAKPEPEEKSRAKRQKDFDIAEQNESSDEESLRKERARSAEEPWTQNQQKLLELALQQYPRGSSDRWDKIARCVPSKSKEDCIARYKLLVELVQKKKQAKS

SEQ ID NO: 889798 - protein, 388 aa, Homo sapiens
ADLKHRIYLEQQLDELLSRKKREKKKKTGSKSVDVSKLGASEKNERLLMKPQWHDLLPCKLGIWFCLTLKALPHLIQDAGQFYAKYKETRLKEKEDALTRTELETLQKQKKVKKPKPEFPVYTPLETTYIQSYDHGTSIEEIEEQMDDWLENRNRTQKKQAPEWTEEDLSQLTRSMVKFPGGTPGRWEKIAHELGRSVTDVTTKAKQLKDSVTCSPGMVRLSELKSTVQNSRPIKTATTLPDDMITQREDAEGVAAEEEQEGDSGEQETGATDARPRRRKPARLLEATAKPEPEEKSRAKRQKDFDIAEQNESSDEESLRKERARSAEEPWTQNQQKLLELALQQYPRGSSDRWDKIARCVPSKSKEDCIARYKLLVELVQKKKQAKS

SEQ ID NO: 889799 - protein, 656 aa, Homo sapiens
MEGDGSDPEPPDAGEDSKSENGENAPIYCICRKPDINCFMIGCDNCNEWFHGDCIRITEKMAKAIREWYCRECREKDPKLEIRYRHKKSRERDGNERDSSEPRDEGGGRKRPVPDPDLQRRAGSGTGVGAMLARGSASPHKSSPQPLVATPSQHHQQQQQQIKRSARMCGECEACRRTEDCGHCDFCRDMKKFGGPNKIRQKCRLRQCQLRARESYKYFPSSLSPVTPSESLPRPRRPLPTQQQPQPSQKLGRIREDEGAVASSTVKEPPEATATPEPLSDEDLPLDPDLYQDFCAGAFDDHGLPWMSDTEESPFLDPALRKRAVKVKHVKRREKKSEKKKEERYKRHRQKQKHKDKWKHPERADAKDPASLPQCLGPGCVRPAQPSSKYCSDDCGMKLAANRIYEILPQRIQQWQQSPCIAEEHGKKLLERIRREQQSARTRLQEMERRFHELEAIILRAKQQAVREDEESNEGDSDDTDLQIFCVSCGHPINPRVALRHMERCYAKYESQTSFGSMYPTRIEGATRLFCDVYNPQSKTYCKRLQVLCPEHSRDPKVPADEVCGCPLVRDVFELTGDFCRLPKRQCNRHYCWEKLRRAEVDLERVRVWYKLDELFEQERNVRTAMTNRAGLLALMLHQTIQHDPLTTDLRSSADR

SEQ ID NO: 889800 - protein, 154 aa, Homo sapiens
GNQPGQMDLPSLPLLPSLLQIPRATRLFCDVYNPQSKTYCKRLQVLCPEHSRDPKVPADEVCGCPLVRDVFELTGDFCRLPKRQCNRHYCWEKLRRAEVDLERVRVWYKLDELFEQERNVRTAMTNRAGLLALMLHQTIQHDPLTTDLRSSADR

SEQ ID NO: 889801 - protein, 529 aa, Homo sapiens
MEGDGSDPEPPDAGEDSKSENGENAPIYCICRKPDINCFMIGCDNCNEWFHGDCIRITEKMAKAIREWYCRECREKDPKLEIRYRHKKSRERDGNERDSSEPRDEGGGRKRPVPDPDLQRRAGSGTGVGAMLARGSASPHKSSPQPLVATPSQHHQQQQQQIKRSARMCGECEACRRTEDCGHCDFCRDMKKFGGPNKIRQKCRLRQCQLRARESYKYFPSSLSPVTPSESLPRPRRPLPTQQQPQPSQKLGRIREDEGAVASSTVKEPPEATATPEPLSDEDLPLDPDLYQDFCAGAFDDHGLPWMSDTEESPFLDPALRKRAVKVKHVKRREKKSEKKKEERYKRHRQKQKHKDKWKHPERADAKDPASLPQCLGPGCVRPAQPSSKYCSDDCGMKLAANRIYEILPQRIQQWQQSPCIAEEHGKKLLERIRREQQSARTRLQEMERRFHELEAIILRAKQQAVREDEESNEGDSDDTDLQIFCVSCGHPINPRVALRHMERCYAKYESQTSFGSMYPTRIEGQNIL

SEQ ID NO: 889802 - protein, 742 aa, Homo sapiens
MEGDGSDPEPPDAGEDSKSENGENAPIYCICRKPDINCFMIGCDNCNEWFHGDCIRITEKMAKAIREWYCRECREKDPKLEIRYRHKKSRERDGNERDSSEPRDEGGGRKRPVPDPDLQRRAGSGTGVGAMLARGSASPHKSSPQPLVATPSQHHQQQQQQIKRSARMCGECEACRRTEDCGHCDFCRDMKKFGGPNKIRQKCRLRQCQLRARESYKYFPSSLSPVTPSESLPRPRRPLPTQQQPQPSQKLGRIREDEGAVASSTVKEPPEATATPEPLSDEDLPLDPDLYQDFCAGAFDDHGLPWMSDTEESPFLDPALRKRAVKVKHVKRREKKSEKKKEERYKRHRQKQKHKDKWKHPERADAKDPASLPQCLGPGCVRPAQPSSKYCSDDCGMKLAANRIYEILPQRIQQWQQSPCIAEEHGKKLLERIRREQQSARTRLQEMERRFHELEAIILRAKQQAVREDEESNEGDSDDTDLQIFCVSCGHPINPRVALRHMERCYAKYESQTSFGSMYPTRIEGATRLFCDVYNPQSKTYCKRLQVLCPEHSRDPKVRFSLSSSHFAPPPCLAVPHSSLPSSPHFSFTFSSQLPCCFTLHSSFSMPPHRSLNPPFFSFSLLEPPFLFSLITAIHPPNLASLQVPADEVCGCPLVRDVFELTGDFCRLPKRQCNRHYCWEKLRRAEVDLERVRVWYKLDELFEQERNVRTAMTNRAGLLALMLHQTIQHDPLTTDLRSSADR

SEQ ID NO: 889803 - protein, 703 aa, Homo sapiens
MEGDGSDPEPPDAGEDSKSENGENAPIYCICRKPDINCFMIGCDNCNEWFHGDCIRITEKMAKAIREWYCRECREKDPKLEIRYRHKKSRERDGNERDSSEPRDEGGGRKRPVPDPDLQRRAGSGTGVGAMLARGSASPHKSSPQPLVATPSQHHQQQQQQIKRSARMCGECEACRRTEDCGHCDFCRDMKKFGGPNKIRQKCRLRQCQLRARESYKYFPSSLSPVTPSESLPRPRRPLPTQQQPQPSQKLGRIREDEGAVASSTVKEPPEATATPEPLSDEDLPLDPDLYQDFCAGAFDDHGLPWMSDTEESPFLDPALRKRAVKVKHVKRREKKSEKKKEERYKRHRQKQKHKDKWKHPERADAKDPASLPQCLGPGCVRPAQPSSKYCSDDCGMKLAANRIYEILPQRIQQWQQSPCIAEEHGKKLLERIRREQQSARTRLQEMERRFHELEAIILRAKQQAVREDEESNEGDSDDTDLQIFCVSCGHPINPRVALRHMERCYAKVGVSELRGRTMWEHQWASGGQICCLGGVLGGHAAHIHSSLHLCSSLQYESQTSFGSMYPTRIEGATRLFCDVYNPQSKTYCKRLQVLCPEHSRDPKVPADEVCGCPLVRDVFELTGDFCRLPKRQCNRHYCWEKLRRAEVDLERVRVWYKLDELFEQERNVRTAMTNRAGLLALMLHQTIQHDPLTTDLRSSADR

SEQ ID NO: 889804 - protein, 789 aa, Homo sapiens
MEGDGSDPEPPDAGEDSKSENGENAPIYCICRKPDINCFMIGCDNCNEWFHGDCIRITEKMAKAIREWYCRECREKDPKLEIRYRHKKSRERDGNERDSSEPRDEGGGRKRPVPDPDLQRRAGSGTGVGAMLARGSASPHKSSPQPLVATPSQHHQQQQQQIKRSARMCGECEACRRTEDCGHCDFCRDMKKFGGPNKIRQKCRLRQCQLRARESYKYFPSSLSPVTPSESLPRPRRPLPTQQQPQPSQKLGRIREDEGAVASSTVKEPPEATATPEPLSDEDLPLDPDLYQDFCAGAFDDHGLPWMSDTEESPFLDPALRKRAVKVKHVKRREKKSEKKKEERYKRHRQKQKHKDKWKHPERADAKDPASLPQCLGPGCVRPAQPSSKYCSDDCGMKLAANRIYEILPQRIQQWQQSPCIAEEHGKKLLERIRREQQSARTRLQEMERRFHELEAIILRAKQQAVREDEESNEGDSDDTDLQIFCVSCGHPINPRVALRHMERCYAKVGVSELRGRTMWEHQWASGGQICCLGGVLGGHAAHIHSSLHLCSSLQYESQTSFGSMYPTRIEGATRLFCDVYNPQSKTYCKRLQVLCPEHSRDPKVRFSLSSSHFAPPPCLAVPHSSLPSSPHFSFTFSSQLPCCFTLHSSFSMPPHRSLNPPFFSFSLLEPPFLFSLITAIHPPNLASLQVPADEVCGCPLVRDVFELTGDFCRLPKRQCNRHYCWEKLRRAEVDLERVRVWYKLDELFEQERNVRTAMTNRAGLLALMLHQTIQHDPLTTDLRSSADR

SEQ ID NO: 889805 - protein, 728 aa, Homo sapiens
MEGDGSDPEPPDAGEDSKSENGENAPIYCICRKPDINCFMIGCDNCNEWFHGDCIRITEKMAKAIREWYCRECREKDPKLEIRYRHKKSRERDGNERDSSEPRDEGGGRKRPVPDPDLQRRAGSGTGVGAMLARGSASPHKSSPQPLVATPSQHHQQQQQQIKRSARMCGECEACRRTEDCGHCDFCRDMKKFGGPNKIRQKCRLRQCQLRARESYKYFPSSLSPVTPSESLPRPRRPLPTQQQPQPSQKLGRIREDEGAVASSTVKEPPEATATPEPLSDEDLPLDPDLYQDFCAGAFDDHGLPWMSDTEESPFLDPALRKRAVKVKHVKRREKKSEKKKEERYKRHRQKQKHKDKWKHPERADAKDPASLPQCLGPGCVRPAQPSSKYCSDDCGMKLAANRIYEILPQRIQQWQQSPCIAEEHGKKLLERIRREQQSARTRLQEMERRFHELEAIILRAKQQAVREDEEEQAGAQQSRACTLSFPALFSFHSMQSNEGDSDDTDLQIFCVSCGHPINPRVALRHMERCYAKVGVSELRGRTMWEHQWASGGQICCLGGVLGGHAAHIHSSLHLCSSLQYESQTSFGSMYPTRIEGATRLFCDVYNPQSKTYCKRLQVLCPEHSRDPKVPADEVCGCPLVRDVFELTGDFCRLPKRQCNRHYCWEKLRRAEVDLERVRVWYKLDELFEQERNVRTAMTNRAGLLALMLHQTIQHDPLTTDLRSSADR

SEQ ID NO: 889806 - protein, 656 aa, Homo sapiens; identical to SEQ ID NO: 889799

SEQ ID NO: 889807 - protein, 656 aa, Homo sapiens; identical to SEQ ID NO: 889799

SEQ ID NO: 889808 - protein, 452 aa, Homo sapiens
MEGDGSDPEPPDAGEDSKSENGENAPIYCICRKPDINCFMIGCDNCNEWFHGDCIRITEKMAKAIREWYCRECREKDPKLEIRYRHKKSRERDGNERDSSEPRDEGGGRKRPVPDPDLQRRAGSGTGVGAMLARGSASPHKSSPQPLVATPSQHHQQQQQQIKRSARMCGECEACRRTEDCGHCDFCRDMKKFGGPNKIRQKCRLRQCQLRARESYKYFPSSLSPVTPSESLPRPRRPLPTQQQPQPSQKLGRIREDEGAVASSTVKEPPEATATPEPLSDEDLPLDPDLYQDFCAGAFDDHGLPWMSDTEESPFLDPALRKRAVKVKHVKRREKKSEKKKEERYKRHRQKQKHKDKWKHPERADAKDPASLPQCLGPGCVRPAQPSSKYCSDDCGMKLAANRIYEILPQRIHAIAITAGRSCGVRKWTWSACVCGTSWTSCLSRSAMCAQP

SEQ ID NO: 889809 - protein, 554 aa, Homo sapiens
MEGDGSDPEPPDAGEDSKSENGENAPIYCICRKPDINCFMIGCDNCNEWFHGDCIRITEKMAKAIREWYCRECREKDPKLEIRYRHKKSRERDGNERDSSEPRDEGGGRKRPVPDPDLQRRAGSGTGVGAMLARGSASPHKSSPQPLVATPSQHHQQQQQQIKRSARMCGECEACRRTEDCGHCDFCRDMKKFGGPNKIRQKCRLRQCQLRARESYKYFPSSLSPVTPSESLPRPRRPLPTQQQPQPSQKLGRIREDEGAVASSTVKEPPEATATPEPLSDEDLPLDPDLYQDFCAGAFDDHGLPWMSDTEESPFLDPALRKRAVKVKHVKRREKKSEKKKEERYKRHRQKQKHKDKWKHPERADAKDPASLPQCLGPGCVRPAQPSSKYCSDDCGMKLAANRIYEILPQRIQQWQQSPCIAEEHGKKLLERIRREQQSARTRLQEMERRFHELEAIILRAKQQAVREDEESNEGDSDDTDLQIFCVSCGHPINPRVALRHMERCYAKYESQTSFGSMYPTRIEGATRLFCDVYNPQTQTSNHMVSLSGDQPQL

SEQ ID NO: 889810 - protein, 687 aa, Homo sapiens
MEGDGSDPEPPDAGEDSKSENGENAPIYCICRKPDINCFMIGCDNCNEWFHGDCIRITEKMAKAIREWYCRECREKDPKLEIRYRHKKSRERDGNERDSSEPRDEGGGRKRPVPDPDLQRRAGSGTGVGAMLARGSASPHKSSPQPLVATPSQVSGCIKVNGCVKWFRFSPAWVLISVLGPLLQHHQQQQQQIKRSARMCGECEACRRTEDCGHCDFCRDMKKFGGPNKIRQKCRLRQCQLRARESYKYFPSSLSPVTPSESLPRPRRPLPTQQQPQPSQKLGRIREDEGAVASSTVKEPPEATATPEPLSDEDLPLDPDLYQDFCAGAFDDHGLPWMSDTEESPFLDPALRKRAVKVKHVKRREKKSEKKKEERYKRHRQKQKHKDKWKHPERADAKDPASLPQCLGPGCVRPAQPSSKYCSDDCGMKLAANRIYEILPQRIQQWQQSPCIAEEHGKKLLERIRREQQSARTRLQEMERRFHELEAIILRAKQQAVREDEESNEGDSDDTDLQIFCVSCGHPINPRVALRHMERCYAKYESQTSFGSMYPTRIEGATRLFCDVYNPQSKTYCKRLQVLCPEHSRDPKVPADEVCGCPLVRDVFELTGDFCRLPKRQCNRHYCWEKLRRAEVDLERVRVWYKLDELFEQERNVRTAMTNRAGLLALMLHQTIQHDPLTTDLRSSADR

SEQ ID NO: 889811 - protein, 121 aa, Homo sapiens
HERWRRLRGLGGSRPATYWFAAETTHGACAIGVRCLGGVTRSGSSCGRLCNRLGRRRVVCAGSRVAGGGREGVRRERRYGGRWFRPRASRCRGGQQVREWGECAHLLHLPQTGHQLLHDRV

SEQ ID NO: 889812 - protein, 531 aa, Homo sapiens
MSGSMGTASGSLRRWPRPSGSGTVGSAEHHQQQQQQIKRSARMCGECEACRRTEDCGHCDFCRDMKKFGGPNKIRQKCRLRQCQLRARESYKYFPSSLSPVTPSESLPRPRRPLPTQQQPQPSQKLGRIREDEGAVASSTVKEPPEATATPEPLSDEDLPLDPDLYQDFCAGAFDDHGLPWMSDTEESPFLDPALRKRAVKVKHVKRREKKSEKKKEERYKRHRQKQKHKDKWKHPERADAKDPASLPQCLGPGCVRPAQPSSKYCSDDCGMKLAANRIYEILPQRIQQWQQSPCIAEEHGKKLLERIRREQQSARTRLQEMERRFHELEAIILRAKQQAVREDEESNEGDSDDTDLQIFCVSCGHPINPRVALRHMERCYAKYESQTSFGSMYPTRIEGATRLFCDVYNPQSKTYCKRLQVLCPEHSRDPKVPADEVCGCPLVRDVFELTGDFCRLPKRQCNRHYCWEKLRRAEVDLERVRVWYKLDELFEQERNVRTAMTNRAGLLALMLHQTIQHDPLTTDLRSSADR

SEQ ID NO: 889813 - protein, 504 aa, Homo sapiens
MHHQQQQQQIKRSARMCGECEACRRTEDCGHCDFCRDMKKFGGPNKIRQKCRLRQCQLRARESYKYFPSSLSPVTPSESLPRPRRPLPTQQQPQPSQKLGRIREDEGAVASSTVKEPPEATATPEPLSDEDLPLDPDLYQDFCAGAFDDHGLPWMSDTEESPFLDPALRKRAVKVKHVKRREKKSEKKKEERYKRHRQKQKHKDKWKHPERADAKDPASLPQCLGPGCVRPAQPSSKYCSDDCGMKLAANRIYEILPQRIQQWQQSPCIAEEHGKKLLERIRREQQSARTRLQEMERRFHELEAIILRAKQQAVREDEESNEGDSDDTDLQIFCVSCGHPINPRVALRHMERCYAKYESQTSFGSMYPTRIEGATRLFCDVYNPQSKTYCKRLQVLCPEHSRDPKVPADEVCGCPLVRDVFELTGDFCRLPKRQCNRHYCWEKLRRAEVDLERVRVWYKLDELFEQERNVRTAMTNRAGLLALMLHQTIQHDPLTTDLRSSADR

SEQ ID NO: 889814 - protein, 535 aa, Homo sapiens
LPKPKKNSLTFPPGQKAPLFRGFGEAPKTPSQHHQQQQQQIKRSARMCGECEACRRTEDCGHCDFCRDMKKFGGPNKIRQKCRLRQCQLRARESYKYFPSSLSPVTPSESLPRPRRPLPTQQQPQPSQKLGRIREDEGAVASSTVKEPPEATATPEPLSDEDLPLDPDLYQDFCAGAFDDHGLPWMSDTEESPFLDPALRKRAVKVKHVKRREKKSEKKKEERYKRHRQKQKHKDKWKHPERADAKDPASLPQCLGPGCVRPAQPSSKYCSDDCGMKLAANRIYEILPQRIQQWQQSPCIAEEHGKKLLERIRREQQSARTRLQEMERRFHELEAIILRAKQQAVREDEESNEGDSDDTDLQIFCVSCGHPINPRVALRHMERCYAKYESQTSFGSMYPTRIEGATRLFCDVYNPQSKTYCKRLQVLCPEHSRDPKVPADEVCGCPLVRDVFELTGDFCRLPKRQCNRHYCWEKLRRAEVDLERVRVWYKLDELFEQERNVRTAMTNRAGLLALMLHQTIQHDPLTTDLRSSADR

SEQ ID NO: 889815 - protein, 439 aa, Homo sapiens
MSALQLSPVTPSESLPRPRRPLPTQQQPQPSQKLGRIREDEGAVASSTVKEPPEATATPEPLSDEDLPLDPDLYQDFCAGAFDDHGLPWMSDTEESPFLDPALRKRAVKVKHVKRREKKSEKKKEERYKRHRQKQKHKDKWKHPERADAKDPASLPQCLGPGCVRPAQPSSKYCSDDCGMKLAANRIYEILPQRIQQWQQSPCIAEEHGKKLLERIRREQQSARTRLQEMERRFHELEAIILRAKQQAVREDEESNEGDSDDTDLQIFCVSCGHPINPRVALRHMERCYAKYESQTSFGSMYPTRIEGATRLFCDVYNPQSKTYCKRLQVLCPEHSRDPKVPADEVCGCPLVRDVFELTGDFCRLPKRQCNRHYCWEKLRRAEVDLERVRVWYKLDELFEQERNVRTAMTNRAGLLALMLHQTIQHDPLTTDLRSSADR

SEQ ID NO: 889816 - protein, 365 aa, Homo sapiens
RPSEEGNGRREKIQEEEGDRDERRGRWRGGGRWEEGEDTGGGRSWGGREKEERYKRHRQKQKHKDKWKHPERADAKDPASLPQCLGPGCVRPAQPSSKYCSDDCGMKLAANRIYEILPQRIQQWQQSPCIAEEHGKKLLERIRREQQSARTRLQEMERRFHELEAIILRAKQQAVREDEESNEGDSDDTDLQIFCVSCGHPINPRVALRHMERCYAKYESQTSFGSMYPTRIEGATRLFCDVYNPQSKTYCKRLQVLCPEHSRDPKVPADEVCGCPLVRDVFELTGDFCRLPKRQCNRHYCWEKLRRAEVDLERVRVWYKLDELFEQERNVRTAMTNRAGLLALMLHQTIQHDPLTTDLRSSADR

SEQ ID NO: 889817 - protein, 314 aa, Homo sapiens
MEGDGSDPEPPDAGEDSKSENGENAPIYCICRKPDINCFMIGCDNCNEWFHGDCIRITEKMAKAIREWYCRECREKDPKLEIRYRHKKSRERDGNERDSSEPRDEGGGRKRPVPDPDLQRRAGSGTGVGAMLARGSASPHKSSPQPLVATPSQHHQQQQQQIKRSARMCGECEACRRTEDCGHCDFCRDMKKFGGPNKIRQKCRLRQCQLRARESYKYFPSSLSPVTPSESLPRPRRPLPTQQQPQPSQKLGRIREDEGAVASSTVKEPPEATATPEPLSDEDLPLDPDLYQDFCAGAFDDHGLVSRQEHPLVE

SEQ ID NO: 889818 - protein, 185 aa, Homo sapiens [sequence omitted]

SEQ ID NO: 889819 - protein, 154 aa, Homo sapiens; identical to SEQ ID NO: 889800

SEQ ID NO: 889820 - protein, 131 aa, Homo sapiens
TIPPVTYLLLLLPFASILPFSLTDHLTHSVACYLPCSRIYEILPQRIQQWQQSPCIAEEHGKKLLERIRREQQSARTRLQEMERRFHELEAIILRAKQQAVREDEEEQAGAQQSRACTLSFPALLFLPFHA

SEQ ID NO: 889821 - protein, 112 aa, Homo sapiens
MGLRAGKQGMMGPHSSFSRYPSGVQGSRYSTCQVSDQRGTGNGKDLKEGQAELWEATSSRKPSLIHPSQAVSICSQISTALILRSASISLPRLQALLGPRLFLTCAQWHPCT

SEQ ID NO: 889822 - protein, 112 aa, Homo sapiens; identical to SEQ ID NO: 889821

SEQ ID NO: 889823 - protein, 112 aa, Homo sapiens; identical to SEQ ID NO: 889821

SEQ ID NO: 889824 - protein, 755 aa, Homo sapiens
LQSRLSLEVAVTCMKRKKGGPRDERGLHAWGPEWWAGTVVLLQGCWPSLAPAPVGPAREPPCARAGFTHPGEVIPCARAGARAAREPSNPSMRHQPFPPGTSFLFPNSREGGPGTYKLEPWPIRMSEAASQGLRAAARSVWAGTDRRGCRHRRPVPLCSGTALSQCPRFPRRLHAARLGNMLGVLVLGALALAGLGFPAPAEPQPGGSQCVEHDCFALYPGPATFLNASQICDGLRGHLMTVRSSVAADVISLLLNGDGGVGRRRLWIGLQLPPGCGDPKRLGPLRGFQWVTGDNNTSYSRWARLDLNGAPLCGPLCVAVSAAEATVPSEPIWEEQQCEVKADGFLCEFHFPATCRPLAVEPGAAAAAVSITYGTPFAARGADFQALPVGSSAAVAPLGLQLMCTAPPGAVQGHWAREAPGAWDCSVENGGCEHACNAIPGAPRCQCPAGAALQADGRSCTASATQSCNDLCEHFCVPNPDQPGSYSCMCETGYRLAADQHRCEDVDDCILEPSPCPQRCVNTQGGFECHCYPNYDLVDGECVEPVDPCFRANCEYQCQPLNQTSYLCVCAEGFAPIPHEPHRCQMFCNQTACPADCDPNTQASCECPEGYILDDGFICTDIDECENGGFCSGVCHNLPGTFECICGPDSALARHIGTDCDSGKVDGGDSGSGEPPPSPTPGSTLTPPAVGLVHSGLLIGISIASLCLVVALLALLCHLRKKQGAARAKMEYKCAAPSKEVVLQHVRTERTPQRL

SEQ ID NO: 889825 - protein, 755 aa, Homo sapiens; identical to SEQ ID NO: 889824

SEQ ID NO: 889826 - protein, 755 aa, Homo sapiens; identical to SEQ ID NO: 889824

SEQ ID NO: 889827 - protein, 681 aa, Homo sapiens
LQSRLSLEVAVTCMKRKKGGPRDERGLHAWGPEWWAGTVVLLQGCWPSLAPAPVGPAREPPCARAGFTHPGEVIPCRGRAQGRPENPAIRVCGISPSHQALPSFSRTSREGGPGTYKLEPWPIRMSEAASQGLRAAARSVWAGTDRRGCRHRRPVPLCSGTALSQCPRFPRRLHAARLGNMLGVLVLGALALAGLGFPAPGCGDPKRLGPLRGFQWVTGDNNTSYSRWARLDLNGAPLCGPLCVAVSAAEATVPSEPIWEEQQCEVKADGFLCEFHFPATCRPLAVEPGAAAAAVSITYGTPFAARGADFQALPVGSSAAVAPLGLQLMCTAPPGAVQGHWAREAPGAWDCSVENGGCEHACNAIPGAPRCQCPAGAALQADGRSCTASATQSCNDLCEHFCVPNPDQPGSYSCMCETGYRLAADQHRCEDVDDCILEPSPCPQRCVNTQGGFECHCYPNYDLVDGECVEPVDPCFRANCEYQCQPLNQTSYLCVCAEGFAPIPHEPHRCQMFCNQTACPADCDPNTQASCECPEGYILDDGFICTDIDECENGGFCSGVCHNLPGTFECICGPDSALARHIGTDCDSGKVDGGDSGSGEPPPSPTPGSTLTPPAVGLVHSGLLIGISIASLCLVVALLALLCHLRKKQGAARAKMEYKCAAPSKEVVLQHVRTERTPQRL

SEQ ID NO: 889828 - protein, 98 aa, Homo sapiens
QNCRFCLQCSLHLIRSRQARCSTRILGARLRPFSCARSLVPSLGYGGMIYILISLFSVYRHFMVFVCFLCSYLYVSSIHFAQLSGLSLSTNSHLSCDR

SEQ ID NO: 889829 - protein, 755 aa, Homo sapiens; identical to SEQ ID NO: 889824

SEQ ID NO: 889830 - protein, 755 aa, Homo sapiens; identical to SEQ ID NO: 889824

SEQ ID NO: 889831 - protein, 510 aa, Homo sapiens
MAAAALRDPAQVPVAADLLTDHEEGYVTFEDVAVYFSQEEWRLLDDAQRLLYRNVMLENFTLLASLGLASSKTHEITQLESWEEPFMPAWEVVTSAIPRGCWHGAEAEEAPEQIASVGLLSSNIQQHQKQHCGEKPLKRQQGRVPVLRSCKVHLSEKSLQSREVGKALLISSGVLKHQVTHTGEKSHRSSKSREAFHAGKRHYKCSECGKAFGQKYLLVQHQRLHAGKKTYECSECGKLFRDMSNLFIHQIVHTGERPYGCSNCGKSFSRNAHLIEHQRVHTGEKPFTCSECGKAFRHNSTLVQHHKIHTGVRPYECSECGKLFSFNSSLMKHQRIHTGERPYKCSECGKFYSHKSNLIKHWRVHTGERPYKCSDCGKFFTQCSSLMQHQKVHTGEKPFKCNECGRFFRENSTLVRHQRVHTGAKPYECRECGKFFSQSSTLMQHRKVHIGEKPFKCNECGRLFRENSSLVKHQRVHTGAKPYECRECGKFFRHNSSLFKHRRIHTGEMQ

SEQ ID NO: 889832 - protein, 491 aa, Homo sapiens
MNLTEGYVTFEDVAVYFSQEEWRLLDDAQRLLYRNVMLENFTLLASLGLASSKTHEITQLESWEEPFMPAWEVVTSAIPRGCWHGAEAEEAPEQIASVGLLSSNIQQHQKQHCGEKPLKRQQGRVPVLRSCKVHLSEKSLQSREVGKALLISSGVLKHQVTHTGEKSHRSSKSREAFHAGKRHYKCSECGKAFGQKYLLVQHQRLHAGKKTYECSECGKLFRDMSNLFIHQIVHTGERPYGCSNCGKSFSRNAHLIEHQRVHTGEKPFTCSECGKAFRHNSTLVQHHKIHTGVRPYECSECGKLFSFNSSLMKHQRIHTGERPYKCSECGKFYSHKSNLIKHWRVHTGERPYKCSDCGKFFTQCSSLMQHQKVHTGEKPFKCNECGRFFRENSTLVRHQRVHTGAKPYECRECGKFFSQSSTLMQHRKVHIGEKPFKCNECGRLFRENSSLVKHQRVHTGAKPYECRECGKFFRHNSSLFKHRRIHTGEMQ

SEQ ID NO: 889833 - protein, 115 aa, Homo sapiens
MAAAALRDPAQGYVTFEDVAVYFSQEEWRLLDDAQRLLYRNVMLENFTLLASLGLASSKTHEITQLESWEEPFMPAWEVVTSAIPRETLRMAFMRELAIEHHSSKYAHWRQDENS

SEQ ID NO: 889834 - protein, 34 aa, Homo sapiens
MVSSSNCTSLPHLPTGSIAVAAMHKDPAQVSQGF

SEQ ID NO: 889835 - protein, 477 aa, Homo sapiens
MAAAALRDPAQVPVAADLLTDHEEGYVTFEDVAVYFSQEEWRLLDDAQRLLYRNVMLENFTLLASLGCWHGAEAEEAPEQIASVGLLSSNIQQHQKQHCGEKPLKRQQGRVPVLRSCKVHLSEKSLQSREVGKALLISSGVLKHQVTHTGEKSHRSSKSREAFHAGKRHYKCSECGKAFGQKYLLVQHQRLHAGKKTYECSECGKLFRDMSNLFIHQIVHTGERPYGCSNCGKSFSRNAHLIEHQRVHTGEKPFTCSECGKAFRHNSTLVQHHKIHTGVRPYECSECGKLFSFNSSLMKHQRIHTGERPYKCSECGKFYSHKSNLIKHWRVHTGERPYKCSDCGKFFTQCSSLMQHQKVHTGEKPFKCNECGRFFRENSTLVRHQRVHTGAKPYECRECGKFFSQSSTLMQHRKVHIGEKPFKCNECGRLFRENSSLVKHQRVHTGAKPYECRECGKFFRHNSSLFKHRRIHTGEMQ

SEQ ID NO: 889836 - protein, 182 aa, Homo sapiens
MVFEDVAIYFSQEEWGILNDAQRHLHSNVMLENFALLSSVGCWHGAKDEEVPSKQCVSVRVLQVTIPKPALSTLKAQPCKMCSSILKDILHLAEHDGTHPEQGLYTCAAEHDLHQKEQIREKLTRSDEWRPSFVNHSAHVGERNFTCTQGGKDFTASSDLLQQQVLNSGWKLYRDTQDGEAF

SEQ ID NO: 889837 - protein, 497 aa, Homo sapiens
MAAAALRDPAQGYVTFEDVAVYFSQEEWRLLDDAQRLLYRNVMLENFTLLASLGLASSKTHEITQLESWEEPFMPAWEVVTSAIPRGCWHGAEAEEAPEQIASVGLLSSNIQQHQKQHCGEKPLKRQQGRVPVLRSCKVHLSEKSLQSREVGKALLISSGVLKHQVTHTGEKSHRSSKSREAFHAGKRHYKCSECGKAFGQKYLLVQHQRLHAGKKTYECSECGKLFRDMSNLFIHQIVHTGERPYGCSNCGKSFSRNAHLIEHQRVHTGEKPFTCSECGKAFRHNSTLVQHHKIHTGVRPYECSECGKLFSFNSSLMKHQRIHTGERPYKCSECGKFYSHKSNLIKHWRVHTGERPYKCSDCGKFFTQCSSLMQHQKVHTGEKPFKCNECGRFFRENSTLVRHQRVHTGAKPYECRECGKFFSQSSTLMQHRKVHIGEKPFKCNECGRLFRENSSLVKHQRVHTGAKPYECRECGKFFRHNSSLFKHRRIHTGEMQ

SEQ ID NO: 889838 - protein, 182 aa, Homo sapiens; identical to SEQ ID NO: 889836

SEQ ID NO: 889839 - protein, 1209 aa, Homo sapiens
NSARALPSRLDYLKLLSVLEMILPPNVCVSLSSPTCIVDIYNVPAIVLQVHHIFVFVLGGKGRARQPGFIFLQVHASRLLYLQCFQHLLIKGESFIASTMKETSRKGMELENYKQPVVLREDNCRRRRRMKPRSAAASLSSMELIPIEFVLPTSQRKCKSPETALLHVAGHGNVEQMKAQVWLRALETSVAADFYHRLGPHHFLLLYQKKGQWYEIYDKYQVVQTLDCLRYWKATHRSPGQIHLVQRHPPSEESQAFQRQLTALIGYDVTDVSNVHDDELEFTRRGLVTPRMAEVASRDPKLYAMHPWVTSKPLPEYLWKKIANNCIFIVIHRSTTSQTIKVSPDDTPGAILQSFFTKMAKKKSLMDIPESQSEQDFVLRVCGRDEYLVGETPIKNFQWVRHCLKNGEEIHVVLDTPPDPALDEVRKEEWPLVDDCTGVTGYHEQLTIHGKDHESVFTVSLWDCDRKFRVKIRGIDIPVLPRNTDLTVFVEANIQHGQQVLCQRRTSPKPFTEEVLWNVWLEFSIKIKDLPKGALLNLQIYCGKAPALSSKASAESPSSESKGKVRLLYYVNLLLIDHRFLLRRGEYVLHMWQISGKGEDQGSFNADKLTSATNPDKENSMSISILLDNYCHPIALPKHQPTPDPEGDRVRAEMPNQLRKQLEAIIATDPLNPLTAEDKELLWHFRYESLKHPKAYPKLFSSVKWGQQEIVAKTYQLLARREVWDQSALDVGLTMQLLDCNFSDENVRAIAVQKLESLEDDDVLHYLLQLVQAVKFEPYHDSALARFLLKRGLRNKRIGHFLFWFLRSEIAQSRHYQQRFAVILEAYLRGCGTAMLHDFTQQVQVIEMLQKVTLDIKSLSAEKYDVSSQVISQLKQKLENLQNSQLPESFRVPYDPGLKAGALAIEKCKVMASKKKPLWLEFKCADPTALSNETIGIIFKHGDDLRQDMLILQILRIMESIWETESLDLCLLPYGCISTGDKIGMIEIVKDATTIAKIQQSTVGNTGAFKDEVLNHWLKEKSPTEEKFQAAVERFVYSCAGYCVATFVLGIGDRHNDNIMITETGNLFHIDFGHILGNYKSFLGINKERVPFVLTPDFLFVMGTSGKKTSPHFQKFQDICVKAYLALRHHTNLLIILFSMMLMTGMPQLTSKEDIEYIRDALTVGKNEEDAKKYFLDQIEVCRDKGWTVQFNWFLHLVLGIKQGEKHSA

SEQ ID NO: 889840 - protein, 375 aa, Homo sapiens
MLHDFTQQVQVIEMLQKVTLDIKSLSAEKYDVSSQVISQLKQKLENLQNSQLPESFRVPYDPGLKAGALAIEKCKVMASKKKPLWLEFKCADPTALSNETIGIIFKHGDDLRQDMLILQILRIMESIWETESLDLCLLPYGCISTGDKIGMIEIVKDATTIAKIQQSTVGNTGAFKDEVLNHWLKEKSPTEEKFQAAVERFVYSCAGYCVATFVLGIGDRHNDNIMITETGNLFHIDFGHILGNYKSFLGINKERVPFVLTPDFLFVMGTSGKKTSPHFQKFQDICVKAYLALRHHTNLLIILFSMMLMTGMPQLTSKEDIEYIRDALTVGKNEEDAKKYFLDQIEVCRDKGWTVQFNWFLHLVLGIKQGEKHSA

SEQ ID NO: 889841 - protein, 404 aa, Homo sapiens
PEVGAFPAAIPAVLTSRLFFCAGGLPAVMKDVPGFLQQSQSSGPGQPAVWHRLEELYTKKLWHQLTLQVLDFVQDPCFAQGDGLIKLYENFISEFEHRVNPLSLVEIILHVVRQMTDPNVALTFLEKTREKVKSSDEAVILCKTAIGALKLNIGDLQVTKETIEDVEEMLNNLPGVTSVHSRFYDLSSKYYQTIGNHASYYKDALRFLGCVDIKDLPVSEQQERAFTLGLAGLLGEGVFNFGELLMHPVLESLRNTDRQWLIDTLYAFNSGNVERFQTLKTAWGQQPDLAANEAQLLRKIQLLCLMEMTFTRPANHRQLTFEEIAKSAKITVNEVELLVMKALSVGLVKGSIDEVDKRVHMTWVQPRVLDLQQIKGMKDRLEFWCTDVKSMEMLVEHQAHDILT

SEQ ID NO: 889842 - protein, 404 aa, Homo sapiens; identical to SEQ ID NO: 889841

SEQ ID NO: 889843 - protein, 205 aa, Homo sapiens
PEVGAFPAAIPAVLTSRLFFCAGGLPAVMKDVPGFLQQSQSSGPGQPAVWHRLEELYTKKLWHQLTLQVLDFVQDPCFAQGDGLIKLYENFISEFEHRVNPLSLVEIILHVVRQMTDPNVALTFLEKTREKVKSSDEAVILCKTAIGALKLNIGDLQVTKETIEDVEEMLNNLPGVTSVHSRFYDLSIPIHLYGHLFRCGLRMFL

SEQ ID NO: 889844 - protein, 139 aa, Homo sapiens
PEVGAFPAAIPAVLTSRLFFCAGGLPAVMKDVPGFLQQSQSSGPGQPAVWHRLEELYTKKLWHQLTLQVLDFVQDPCFAQGDGLIKLFVKIYQKILNTEGVPCAPREITLNGEREMSLLIVALPLLEKTLERGKEGDAQ

SEQ ID NO: 889845 - protein, 92 aa, Homo sapiens
VRRRLSKVKLLLGEGVFNFGGLLMHPVLESLRNTDRQWLIDTLYAFNSGNVERFQTLKTAWGQQLKALSCCSDTGRSLMSTQQERVSVELGT

SEQ ID NO: 889846 - protein, 404 aa, Homo sapiens; identical to SEQ ID NO: 889841

SEQ ID NO: 889847 - protein, 404 aa, Homo sapiens; identical to SEQ ID NO: 889841

SEQ ID NO: 889848 - protein, 404 aa, Homo sapiens; identical to SEQ ID NO: 889841

SEQ ID NO: 889849 - protein, 404 aa, Homo sapiens; identical to SEQ ID NO: 889841

SEQ ID NO: 889850 - protein, 338 aa, Homo sapiens
PEVGAFPAAIPAVLTSRLFFCAGGLPAVMKDVPGFLQQSQSSGPGQPAVWHRLEELYTKKLWHQLTLQVLDFVQDPCFAQGDGLIKLYENFISEFEHRVNPLSLVEIILHVVRQMTDPNVALTFLEKTREKVKSSDEAVILCKTAIGALKLNIGDLQVTKETIEDVEEMLNNLPGVTSVHSRFYDLSSKYYQTIGNHASYYKDALRFLGCVDIKDLPVSEQQERAFTLGLAGLLGEGVFNFGELLMHPVLESLRNTDRQWLIDTLYAFNSGNVERFQTLKTAWGQQPDLAANEAQLLRKIQLLCLMEIKGMKDRLEFWCTDVKSMEMLVEHQAHDILT

SEQ ID NO: 889851 - protein, 410 aa, Homo sapiens
PEVGAFPAAIPAVLTSRLFFCAGGLPAVMKDVPGFLQQSQSSGPGQPAVWHRLEELYTKKLWHQLTLQVLDFVQDPCFAQGDGLIKLYENFISEFEHRVNPLSLVEIILHVVRQMTDPNVALTFLEKTREKVKSSDEAVILCKTAIGALKLNIGDLQVTKETIEDVEEMLNNLPGVTSVHSRFYDLSSKYYQTIGNHASYYKDALRFLGCVDIKDLPVSEQQERAFTLGLAGLLGEGVFNFGELLMHPVLESLRNTDRQWLIDTLYAFNSGNVERFQTLKTAWGQQPDLAANEAQLLRKIQLLCLMEMTFTRPANHRQLTFEEIAKSAKITVNEVELLVMKALSVGLVKGSIDEVDKRVHMTWVQPRVLDLQQIKGMKDRLEFWCTDVKSMEMLVEHQAHDIYTALFRRF

SEQ ID NO: 889852 - protein, 311 aa, Homo sapiens
MVSLRVNPLSLVEIILHVVRQMTDPNVALTFLEKTREKVKSSDEAVILCKTAIGALKLNIGDLQVTKETIEDVEEMLNNLPGVTSVHSRFYDLSSKYYQTIGNHASYYKDALRFLGCVDIKDLPVSEQQERAFTLGLAGLLGEGVFNFGELLMHPVLESLRNTDRQWLIDTLYAFNSGNVERFQTLKTAWGQQPDLAANEAQLLRKIQLLCLMEMTFTRPANHRQLTFEEIAKSAKITVNEVELLVMKALSVGLVKGSIDEVDKRVHMTWVQPRVLDLQQIKGMKDRLEFWCTDVKSMEMLVEHQAHDILT

SEQ ID NO: 889853 - protein, 432 aa, Homo sapiens
PEVGAFPAAIPAVLTSRLFFCAGGLPAVMKDVPGFLQQSQSSGPGQPAVWHRLEELYTKKLWHQLTLQVLDFVQDPCFAQGDGLIKLYENFISEFEHSKSLSSVFHFGDEYIDARWCSKTGGFYFRVNPLSLVEIILHVVRQMTDPNVALTFLEKTREKVKSSDEAVILCKTAIGALKLNIGDLQVTKETIEDVEEMLNNLPGVTSVHSRFYDLSSKYYQTIGNHASYYKDALRFLGCVDIKDLPVSEQQERAFTLGLAGLLGEGVFNFGELLMHPVLESLRNTDRQWLIDTLYAFNSGNVERFQTLKTAWGQQPDLAANEAQLLRKIQLLCLMEMTFTRPANHRQLTFEEIAKSAKITVNEVELLVMKALSVGLVKGSIDEVDKRVHMTWVQPRVLDLQQIKGMKDRLEFWCTDVKSMEMLVEHQAHDILT

SEQ ID NO: 889854 - protein, 412 aa, Homo sapiens
PEVGAFPAAIPAVLTSRLFFCAGGLPAVMKDVPGFLQQSQSSGPGQPAVWHRLEELYTKKLWHQLTLQVLDFVQDPCFAQGDGLIKLYENFISEFEHRVNPLSLVEIILHVVRQMTDFHEGQRIHPNVALTFLEKTREKVKSSDEAVILCKTAIGALKLNIGDLQVTKETIEDVEEMLNNLPGVTSVHSRFYDLSSKYYQTIGNHASYYKDALRFLGCVDIKDLPVSEQQERAFTLGLAGLLGEGVFNFGELLMHPVLESLRNTDRQWLIDTLYAFNSGNVERFQTLKTAWGQQPDLAANEAQLLRKIQLLCLMEMTFTRPANHRQLTFEEIAKSAKITVNEVELLVMKALSVGLVKGSIDEVDKRVHMTWVQPRVLDLQQIKGMKDRLEFWCTDVKSMEMLVEHQAHDILT

SEQ ID NO: 889855 - protein, 208 aa, Homo sapiens
FDGDSPDALRFLGCVDIKDLPVSEQQERAFTLGLAGLLGEGVFNFGELLMHPVLESLRNTDRQWLIDTLYAFNSGNVERFQTLKTAWGQQPDLAANEAQLLRKIQLLCLMEMTFTRPANHRQLTFEEIAKSAKITVNEVELLVMKALSVGLVKGSIDEVDKRVHMTWVQPRVLDLQQIKGMKDRLEFWCTDVKSMEMLVEHQAHDILT

SEQ ID NO: 889856 - protein, 320 aa, Homo sapiens
PEVGAFPAAIPAVLTSRLFFCAGGLPAVMKDVPGFLQQSQSSGPGQPAVWHRLEELYTKKLWHQLTLQVLDFVQDPCFAQGDGLIKLYENFISEFEHRVNPLSLVEIILHVVRQMTDPNVALTFLEKTREKVKSSDEAVILCKTAIGALKLNIGDLQVTKETIEDVEEMLNNLPGVTSVHSRFYDLSSKYYQTIGNHASYYKDALRFLGCVDIKDLPVSEQQERAFTLGLAGLLGEGVFNFGELLMHPVLESLRNTDRQWLIDTLYAFNSGNVERFQTLKTAWGQQPELAANEAKLLREIHVMLMGYFTHPAHPDPLWEC

SEQ ID NO: 889857 - protein, 313 aa, Homo sapiens
PEVGAFPAAIPAVLTSRLFFCAGGLPAVMKDVPGFLQQSQSSGPGQPAVWHRLEELYTKKLWHQLTLQVLDFVQDPCFAQGDGLIKLYENFISEFEHRVNPLSLVEIILHVVRQMTDPNVALTFLEKTREKVKSSDEAVILCKTAIGALKLNIGDLQVTKETIEDVEEMLNNLPGVTSVHSRFYDLSSKYYQTIGNHASYYKDALRFLGCVDIKDLPVSEQQERAFTLGLAGLLGEGVFNFGELLMHPVLESLRNTDRQWLIDTLYAFNSGNVERFQTLKTAWGQQVGLPRCPALIPPCVYSLIQQMFIERLP

SEQ ID NO: 889858 - protein, 159 aa, Homo sapiens [sequence omitted]

SEQ ID NO: 889859 - protein, 163 aa, Homo sapiens
PVMQLLPHCMSLLVYTHICLSPLELKLLRKWPLDFWFAVVTPGQPWQIVASSTCSGIEQWLLSETPMTFTRPANHRQLTFEEIAKSAKITVNEVELLVMKALSVGLVKGSIDEVDKRVHMTWVQPRVLDLQQIKGMKDRLEFWCTDVKSMEMLVEHQAHDILT

SEQ ID NO: 889860 - protein, 246 aa, Homo sapiens
PEVGAFPAAIPAVLTSRLFFCAGGLPAVMKDVPGFLQQSQSSGPGQPAVWHRLEELYTKKLWHQLTLQVLDFVQDPCFAQGDGLIKLYENFISEFEHRVNPLSLVEIILHVVRQMTDPNVALTFLEKTREKVKSSDEAVILCKTAIGALKLNIGDLQVTKETIEDVEEMLNNLPGVTSVHSRFYDLSSKYYQTIGNHASYYKDALRFLGCVDIKDLPVSEQQERAFTLGLAGLLGEGVFNFGELVS

SEQ ID NO: 889861 - protein, 150 aa, Homo sapiens
PEVGAFPAAIPAVLTSRLFFCAGGLPAVMKDVPGFLQQSQSSGPGQPAVWHRLEELYTKKLWHQLTLQVLDFVQDPCFAQGDGLIKLYENFISEFEHRVNPLSLVEIILHVVRQMTDPNVALTFLEKTREKVKSSDEAVILCKTAIGALK

SEQ ID NO: 889862 - protein, 373 aa, Homo sapiens
PEVGAFPAAIPAVLTSRLFFCAGGLPAVMKDVPGFLQQSQSSGPGQPAVWHRLEELYTKKLWHQLTLQVLDFVQDPCFAQGDGLIKLYENFISEFEHRVNPLSLVEIILHVVRQMTDPNVALTFLEKTREKVKSSDEAVILCKTAIGALKLNIGDLQVTKETIEDVEEMLNNLPGVTSVHSRFYDLSSKYYQTIGNHASYYKDALRFLGCVDIKDLPVSEQQERAFTLGLAGLLGEGVFNFGELLMHPVLESLRNTDRQWLIDTLYAFNSGNVERFQTLKTAWGQQPDLAANEAQLLRKIQLLCLMEMTFTRPANHRQLTFEEIAKSAKITVNEVELLVMKALSVGLVKGSIDEVDKRVHMTWVQPRVLDLQQ

SEQ ID NO: 889863 - protein, 347 aa, Homo sapiens
GDGRHYCYPHFTCAVDTENIRRVFNDCRGIDKHQKSKSHIRISHLSNYVKNDFHEGQRIHPNVALTFLEKTREKVKSSDEAVILCKTAIGALKLNIGDLQVTKETIEDVEEMLNNLPGVTSVHSRFYDLSSKYYQTIGNHASYYKDALRFLGCVDIKDLPVSEQQERAFTLGLAGLLGEGVFNFGELLMHPVLESLRNTDRQWLIDTLYAFNSGNVERFQTLKTAWGQQPDLAANEAQLLRKIQLLCLMEMTFTRPANHRQLTFEEIAKSAKITVNEVELLVMKALSVGLVKGSIDEVDKRVHMTWVQPRVLDLQQIKGMKDRLEFWCTDVKSMEMLVEHQAHDILT

SEQ ID NO: 889864 - protein, 386 aa, Homo sapiens
PEVGAFPAAIPAVLTSRLFFCAGGLPAVMKDVPGFLQQSQSSGPGQPAVWHRLEELYTKKLWHQLTLQVLDFVQDPCFAQGDGLIKLYENFISEFEHRVNPLSLVEIILHVVRQMTDPNVALTFLEKTREKVKSSDEAVILCKTAIGALKMLNNLPGVTSVHSRFYDLSSKYYQTIGNHASYYKDALRFLGCVDIKDLPVSEQQERAFTLGLAGLLGEGVFNFGELLMHPVLESLRNTDRQWLIDTLYAFNSGNVERFQTLKTAWGQQPDLAANEAQLLRKIQLLCLMEMTFTRPANHRQLTFEEIAKSAKITVNEVELLVMKALSVGLVKGSIDEVDKRVHMTWVQPRVLDLQQIKGMKDRLEFWCTDVKSMEMLVEHQAHDILT

SEQ ID NO: 889865 - protein, 430 aa, Homo sapiens
PEVGAFPAAIPAVLTSRLFFCAGGLPAVMKDVPGFLQQSQSSGPGQPAVWHRLEELYTKKLWHQLTLQVLDFVQDPCFAQGDGLIKLYENFISEFEHRVNPLSLVEIILHVVRQMTDPNVALTFLEKTREKVKSSDEAVILCKTAIGALKLNIGDLQVTKETIEDVEEMLNNLPGVTSVHSRFYDLSSKYYQTIGNHASYYKDALRFLGCVDIKDLPVSEQQERAFTLGLAGLLGEGVFNFGELVKLTLSSASLTRETKVLLADQSPSSQLMHPVLESLRNTDRQWLIDTLYAFNSGNVERFQTLKTAWGQQPDLAANEAQLLRKIQLLCLMEMTFTRPANHRQLTFEEIAKSAKITVNEVELLVMKALSVGLVKGSIDEVDKRVHMTWVQPRVLDLQQIKGMKDRLEFWCTDVKSMEMLVEHQAHDILT

SEQ ID NO: 889866 - protein, 297 aa, Homo sapiens
PEVGAFPAAIPAVLTSRLFFCAGGLPAVMKDVPGFLQQSQSSGPGQPAVWHRLEELYTKKLWHQLTLQVLDFVQDPCFAQGDGLIKLYENFISEFEHRVNPLSLVEIILHVVRQMTDPNVALTFLEKTREKVKSSDEAVILCKTAIGALKLNIGDLQVTKETIEDVEEMLNNLPGVTSVHSRFYDLSSKYYQTIGNHASYYKDALRFLGCVDIKDLPEFPVNEGEAFWLNKGPLRWALGKRPVYEVGKRVPHDPGVQSPKCWNLQQIKGMKDRLEFWCTDVKSMEMLVEHQAHDILT

SEQ ID NO: 889867 - protein, 281 aa, Homo sapiens
PEVGAFPAAIPAVLTSRLFFCAGGLPAVMKDVPGFLQQSQSSGPGQPAVWHRLEELYTKKLWHQLTLQVLDFVQDPCFAQGDGLIKLYENFISEFEHRVNPLSLVEIILHVVRQMTDPNVALTFLEKTREKVKSSDEAVILCKTAIGALKLNIGDLQVTKETIEDVEEMLNNLPGVTSVHSRFYDLSSKYYQTIGNHASYYKDALRFLGCVDIKDLPVSEQQERAFTLGLAGLLGEGVFNFGELLMHPVLESLRNTDRGGWFDLFLTVAVGSHWMRARRYD

SEQ ID NO: 889868 - protein, 218 aa, Homo sapiens
PEVGAFPAAIPAVLTSRLFFCAGGLPAVMKDVPGFLQQSQSSGPGQPAVWHRLEELYTKKLWHQLTLQVLDFVQDPCFAQGDGLIKLYENFISEFEHRVNPLSLVEIILHVVRQMTDPNVALTFLEKTREKVKSSDEAVILCKTAIGALKLNIGDLQVTKETIEDVEEMLNNLPGVTSVHSRFYDLSSKYYQTIGNHASYYKDALRFLGCVDIKDLPG

SEQ ID NO: 889869 - protein, 518 aa, Homo sapiens
MAENHAQNKAKLISETRRRFEAEYVTDKSDKYDARDVERLQQDDNWVESYLSWRHNIVDETLKMLDESFQWRKEISVNDLNESSIPRWLLEIGVIYLHGYDKEGNKLFWIRVKYHVKDQKTILDKKKLIAFWLERYAKRENGKPVTVMFDLSETGINSIDMDFVRFIINCFKVYYPKYLSKIVIFDMPWLMNAAFKIVKTWLGPEAVSLLKFTSKNEVQDYVSVEYLPPHMGGTDPFKYSYPPLVDDDFQTPLCENGPITSEDETSSKEDIESDGKETLETISNEEQTPLLKKINPTESTSKAEENEKVDSKVKAFKKPLSVFKGPLLHISPAEELYFGSTESGEKKTLIVLTNVTKNIVAFKVRTTAPEKYRVKPSNSSCDPGASVDIVVSPHGGLTVSAQDRFLIMAAEMEQSSGTGPAELTQFWKEVPRNKVMEHRLRCHTVESSKPNTLTLKDNAFNMSDKTSEDICLQLSRLLESNRKLEDQVQRCIWFQQLLLSLTMLLLAFVTSFFYLLYS

SEQ ID NO: 889870 - protein, 518 aa, Homo sapiens; identical to SEQ ID NO: 889869

SEQ ID NO: 889871 - protein, 518 aa, Homo sapiens; identical to SEQ ID NO: 889869

SEQ ID NO: 889872 - protein, 518 aa, Homo sapiens; identical to SEQ ID NO: 889869

SEQ ID NO: 889873 - protein, 188 aa, Homo sapiens
MAENHAQNKAKLISETRRRFEAEYVTDKSDKYDARDVERLQQDDNWVESYLSWRHNIVDETLKMLDESFQWRKEISVNDLNESSIPRWLLEIGVIYLHGYDKEGNKLFWIRVKYHVKDQKTILDKKKLIAFWLERYAKRENGKPVTVMFDLSETGINSIDMDFVRFIINCFKVYYPKYLSPIVISDMP

SEQ ID NO: 889874 - protein, 194 aa, Homo sapiens
MATGTRYAGKVVVVTGGGRGIGAGIVRAFVNSGARVVICDKDESGGRALEQELPGAVFILCDVTQEDDVKTLVSETIRRFGRLDCVVNNAGHPACLSLPKCWDYQLALPYLRKSQGNVINISSLVGAIGQAQAVPYVATKGAVTAMTKALALDESPYGVRVNCHWAAWASPLRSGLRQCSWPPKPTSARALNCS

SEQ ID NO: 889875 - protein, 107 aa, Homo sapiens [sequence omitted]

SEQ ID NO: 889876 - protein, 140 aa, Homo sapiens
MATGTRYAGKVVVVTGGGRGIGAGIVRAFVNSGARVVICDKDESGGRALEQELPGAVFILCDVTQEDDVKTLVSETIRRFGRLDCVVNNAGHPRPPLPAEESRECHQHLQPGGGNRPGPGSSLCGHQGGSNSHDQSFGPG

SEQ ID NO: 889877 - protein, 136 aa, Homo sapiens
MATGTRYAGKVVVVTGGGRGIGAGIVRAFVNSGARVVICDKDESGGRALEQELPGAVFILCDVTQEDDVKTLVSETIRRFGRLDCVVNNAGHPRPPLPAEESRECHQHLQPGGGNRPGPGSSLCGHQATGPHGPAR

SEQ ID NO: 889878 - protein, 195 aa, Homo sapiens
MATGTRYAGKVVVVTGGGRGIGAGIVRAFVNSGARVVICDKDESGGRALEQELPGAVFILCDVTQEDDVKTTGFSERQFRSHYGTARGIMWLVESKLLGADKSTSRSSMSLTEDHRVARGIPAKGWRWKLEAYLGGTVHLMNQCSHRPSTQDGKDVKAKVVTTTSSKTLSEEEQLRGESAPKAKISRYCCAHPKV

SEQ ID NO: 889879 - protein, 270 aa, Homo sapiens
MATGTRYAGKVVVVTGGGRGIGAGIVRAFVNSGARVVICDKDESGGRALEQELPGAVFILCDVTQEDDVKTLVSETIRRFGRLDCVVNNAGHHPPPQRPEETSAQGFRQLLELNLLGTYTLTKLALPYLRKSQGNVINISSLVGAIGQAQAVPYVATKGAVTAMTKALALDESPYGVRVNCISPGNIWTPLWEELAALMPDPRATIREGMLAQPLGRMGQPAEVGAAAVFLASEANFCTGIELLVTGGAELGYGCKASRSTPVDAPDIPS

SEQ ID NO: 889880 - protein, 270 aa, Homo sapiens; identical to SEQ ID NO: 889879

SEQ ID NO: 889881 - protein, 252 aa, Homo sapiens
MATGTRYAGKVVVVTGGGRGIGAGIVRAFVNSGARVVICDKDESGGRALEQELPGAVFILCDVTQEDDVKTLVSETIRRFGRLDCVVNNAGHHPPPQRPEETSAQGFRQLLELNLLGTYTLTKLALPYLRKSQGNVINISSLVGAIGQAQAVPYVATKGAVTAMTKALALDESPYGVRVNCISPGNIWTPLWEELAALMPDPRATIREGMLAQVEVGFRSSHWAAWASPLRSGLRQCSWPPKPTSARALNCS

SEQ ID NO: 889882 - protein, 238 aa, Homo sapiens
MATGTRYAGKVVVVTGGGRGIGAGIVRAFVNSGARVVICDKDESGGRALEQELPGAVFILCDVTQEDDVKTLVSETIRRFGRLDCVVNNAGHPRPPLPAEESRECHQHLQPGGGNRPGPGSSLCGHQVSSIGGSYSQRRRRLGQGWKSISVVTDSEIGNSDVSLGQEPIETIEGAMRAKVYAGLRSRYVGKGNALLVSTGKQKREQRRARGYGGEPSWNRTPIALLESISHMLSRGTM

SEQ ID NO: 889883 - protein, 66 aa, Homo sapiens
NSGARVVICDKDVVSDGPSALTLALPPSDPEVQTPSTSSLRPRSPGPQALLPQTQESRPQPLLPQT

SEQ ID NO: 889884 - protein, 83 aa, Homo sapiens
MYGNILCPTLHTLCTQILYCMNYALSRIQCQGELGEINYFNFFFILYKAMDFIWLMCALYTSHFNRMELLIIFQRVIDMQKFQ

SEQ ID NO: 889885 - protein, 83 aa, Homo sapiens; identical to SEQ ID NO: 889884

SEQ ID NO: 889886 - protein, 83 aa, Homo sapiens; identical to SEQ ID NO: 889884

SEQ ID NO: 889887 - protein, 83 aa, Homo sapiens; identical to SEQ ID NO: 889884

SEQ ID NO: 889888 - protein, 83 aa, Homo sapiens; identical to SEQ ID NO: 889884

SEQ ID NO: 889889 - protein, 128 aa, Homo sapiens
MESKEERALNNLIVENVNQENDEKDEKEQVANKGEPLALPLNVSEYCVPRGNRRRFRVRQPILQYRWDIMHRLGEPQARMREENMERIGEEVRQLMEKLREKQLSHSLRAVSTDPPHHDHHDEFCLMP

SEQ ID NO: 889890 - protein, 128 aa, Homo sapiens; identical to SEQ ID NO: 889889

SEQ ID NO: 889891 - protein, 100 aa, Homo sapiens
SGITATRDRPTLSLTSLWRQNRRRSLPSRQWYLFPVSLRTCGPGTAPKVGSGGGAGLRGQVLRRRTSRRESGGGDCKDRPRSNGVQEERAIYSAGILYNP

SEQ ID NO: 889892 - protein, 128 aa, Homo sapiens; identical to SEQ ID NO: 889889

SEQ ID NO: 889893 - protein, 128 aa, Homo sapiens; identical to SEQ ID NO: 889889

SEQ ID NO: 889894 - protein, 128 aa, Homo sapiens; identical to SEQ ID NO: 889889

SEQ ID NO: 889895 - protein, 307 aa, Homo sapiens
MASVLSYESLVHAVAGAVGSVTAMTVFFPLDTARLRLQVDEKRKSKTTHMVLLEIIKEEGLLAPYRGWFPVISSLCCSNFVYFYTFNSLKALWVKGQHSTTGKDLVVGFVAGVVNVLLTTPLWVVNTRLKLQGAKFRNEDIVPTNYKGIIDAFHQIIRDEGISALWNGTFPSLLLVFNPAIQFMFYEGLKRQLLKKRMKLSSLDVFIIGAVAKAIATTVTYPLQTVQSILRFGRHRLNPENRTLGSLRNILYLLHQRVRRFGIMGLYKGLEAKLLQTVLTAALMFLVYEKLTAATFTVMGLKRAHQH

SEQ ID NO: 889896 - protein, 307 aa, Homo sapiens; identical to SEQ ID NO: 889895

SEQ ID NO: 889897 - protein, 242 aa, Homo sapiens
MASVLSYESLVHAVAGAVGSVTAMTVFFPLDTARLRLQVDEKRKSKTTHMVLLEIIKEEGLLAPYRGWFPVISSLCCSNFVYFYTFNSLKALWVKGQHSTTGKDLVVGFVAGVVNVLLTTPLWVVNTRLKLQGAKFRNEDIVPTNYKGIIDAFHQIIRDEGISALWNGTFPSLLLVFNPAIQFMFYEGLKRQLLKKRMKLSSLDVFIIGAVAKAIATTVTYPLQTVQSILRTFWNNGTLQRP

SEQ ID NO: 889898 - protein, 293 aa, Homo sapiens
MASVLSYESLVHAVAGAVLRLRLQVDEKRKSKTTHMVLLEIIKEEGLLAPYRGWFPVISSLCCSNFVYFYTFNSLKALWVKGQHSTTGKDLVVGFVAGVVNVLLTTPLWVVNTRLKLQGAKFRNEDIVPTNYKGIIDAFHQIIRDEGISALWNGTFPSLLLVFNPAIQFMFYEGLKRQLLKKRMKLSSLDVFIIGAVAKAIATTVTYPLQTVQSILRFGRHRLNPENRTLGSLRNILYLLHQRVRRFGIMGLYKGLEAKLLQTVLTAALMFLVYEKLTAATFTVMGLKRAHQH

SEQ ID NO: 889899 - protein, 234 aa, Homo sapiens
MASVLSYESLVHAVAGAVGSVTAMTVFFPLDTARLRLQGVVNVLLTTPLWVVNTRLKLQGAKFRNEDIVPTNYKGIIDAFHQIIRDEGISALWNGTFPSLLLVFNPAIQFMFYEGLKRQLLKKRMKLSSLDVFIIGAVAKAIATTVTYPLQTVQSILRFGRHRLNPENRTLGSLRNILYLLHQRVRRFGIMGLYKGLEAKLLQTVLTAALMFLVYEKLTAATFTVMGLKRAHQH

SEQ ID NO: 889900 - protein, 124 aa, Homo sapiens
MFYEGLKRQLLKKRMKLSSLDVFIIGAVAKAIATTVTYPLQTVQSILRFGRHRLNPENRTLGSLRNILYLLHQRVRRFGIMGLYKGLEAKLLQTVLTAALMFLVYEKLTAATFTVMGLKRAHQH

SEQ ID NO: 889901 - protein, 221 aa, Homo sapiens
MASVLSYESLVHAVAGAVGSVTAMTVFFPLDTARLRLQGVVNVLLTTPLWVVNTRLKLQGAKFRNEDIVPTNYKGIIDAFHQIIRDEGISALWNGTFPSLLLVFNPAIQFMFYEGLKRQLLKKRMKLSSLDVFIIGAVAKAIATTVTYPLQTVQSILRFGRHRLNPENRTLGSLRNILYLLHQRVRRFGIMGLYKGLEAKLLQTVLTAALMFLVYEKLTLD

SEQ ID NO: 889902 - protein, 294 aa, Homo sapiens
MASVLSYESLVHAVAGAVGSVTAMTVFFPLDTARLRLQVDEKRKSKTTHMVLLEIIKEEGLLAPYRGWFPVISSLCCSNFVYFYTFNSLKALWVKGQHSTTGKDLVVGFVAGVVNVLLTTPLWVVNTRLKLQGAKFRNEDIVPTNYKGIIDAFHQIIRDEGISALWNGTFPSLLLVFNPAIQFMFYEGLKRQLLKKRMKLSSLDVFIIGAVAKAIATTVTYPLQTVQSILRFGRHRLNPENRTLGSLRNILYLLHQRVRRFGIMGLYKGLEAKLLQTVLTAALMFLVYEKLTLD

SEQ ID NO: 889903 - protein, 124 aa, Homo sapiens; identical to SEQ ID NO: 889900

SEQ ID NO: 889904 - protein, 231 aa, Homo sapiens
MSKIQLSIVIQSLKALWVKGQHSTTGKDLVVGFVAGVVNVLLTTPLWVVNTRLKLQGAKFRNEDIVPTNYKGIIDAFHQIIRDEGISALWNGTFPSLLLVFNPAIQFMFYEGLKRQLLKKRMKLSSLDVFIIGAVAKAIATTVTYPLQTVQSILRFGRHRLNPENRTLGSLRNILYLLHQRVRRFGIMGLYKGLEAKLLQTVLTAALMFLVYEKLTAATFTVMGLKRAHQH

SEQ ID NO: 889905 - protein, 237 aa, Homo sapiens
MASVLSYESLVHAVAGAVGSVTAMTVFFPLDTARLRLQVDEKRKSKTTHMVLLEIIKEEGLLAPYRGWFPVISSLCCSNFVYFYTFNSLKALWVKGQHSTTGKDLVVGFVAGVVNVLLTTPLWVVNTRLKLQGAKFRNEDIVPTNYKGIIDAFHQIIRDEGISALWNGTFPSLLLVFNPAIQFMFYEGLKRQLLKKRMKLSSLDVFIIGAVAKAIATTVTYPLQTVQSILRVSAGVL

SEQ ID NO: 889906 - protein, 132 aa, Homo sapiens
MTVFFPLDTARLRLQVDEKRKSKTTHMVLLEIIKEEGLLAPYRGWFPVISSLCCSNFVYFYTFNSLKALWVKGQHSTTGKDLVVGFVAGLVRNILISQDGVKLGSYVFKKEAPGSLYCSTLRQPWGAKIPIL

SEQ ID NO: 889907 - protein, 220 aa, Homo sapiens
MTTMQGMEQAMPGAGPGVPQLGNMAVIHSHLWKGLQEKFLKGEPKVLGVVQILTALMSLSMGITMMCMASNTYGSNPISVYIGYTIWGSVMFIISGSLSIAAGIRTTKGLVRGSLGMNITSSVLAASGILINTFSLAFYSFHHPYCNYYGNSNNCHGTMSILMGLDGMVLLLSVLEFCIAVSLSAFGCKVLCCTPGGVVLILPSHSHMAETASPTPLNEV

SEQ ID NO: 889908 - protein, 239 aa, Homo sapiens [sequence omitted]

SEQ ID NO: 889909 - protein, 239 aa, Homo sapiens [sequence omitted]

SEQ ID NO: 889910 - protein, 220 aa, Homo sapiens; identical to SEQ ID NO: 889907

SEQ ID NO: 889911 - protein, 220 aa, Homo sapiens; identical to SEQ ID NO: 889907

SEQ ID NO: 889912 - protein, 119 aa, Homo sapiens
MHQTYSRHCRPEESTFSAAMTTMQGMEQAMPGAGPGVPQLGNMAVIHSHLWKGLQEKFLKGEPKVLGVVQILTALMSLSMGITMMCMASNTYGSNPISVYIGYTIWGSVMFIFFRLLVP

SEQ ID NO: 889913 - protein, 167 aa, Homo sapiens
MTTMQGMEQAMPGAGPGVPQLGNMAVIHSHLWKGLQEKFLKGEPKVLGVVQILTALMSLSMGITMMCMASNTYGSNPISVYIGYTIWGSVMFIISGSLSIAAGIRTTKGLGLDGMVLLLSVLEFCIAVSLSAFGCKVLCCTPGGVVLILPSHSHMAETASPTPLNEV

SEQ ID NO: 889914 - protein, 2785 aa, Homo sapiens [sequence omitted]

SEQ ID NO: 889915 - protein, 1442 aa, Homo sapiens
DPTGLDTPYLSPNLTVKSTKLLARDTEVDILVTVQNLLKHCVDPTSFLKPIAKLFSVIKNKLSRKLLCTVFETLSDFESGLKYITDVVKLNAFDQRHLDDINFDVRFETFQTITSYIKEMQIVDVNYLIPVMHNCFYNLELGDMSLSDNASMCLMSIIKKLAALNVTEKDYREIIHRSLLEKLRKGLKSQTESIQQDYTTILSCLIQTFPNQLEFKDLVQLTHYHDPEMDFFENMKHIQIHRRARALKKLAKQLMEGKVVLSSKSLQNYIMPYAMTPIFDEKMLKHENITTAATEIIGAICKHLSWSAYMYYLKHFIHVLQTGQINQKLGVSLLVIVLEAFHFDHKTLEEQMGKIENEENAIEAIELPEPEAMELERVDEEEKEYTCKSLSDNGQPGTPDPADSGGTSAKESECITKPVSFLPQNKEEIERTIKNIQGTITGDILPRLHKCLASTTKREEEHKLVKSKVVNDEEVVRVPLAFAMVKLMQSLPQEVMEANLPSILLKVCALLKNRAQEIRDIARSTLAKIIEDLGVHFLQYVLKELQTTLVRGYQVHVLTFTVHMLLQGLTNKLQVGDLDSCLDIMIEIFNHELFGAVAEEKEVKQILSKVMEARRSKSYDSYEILGKFVGKDQVTKLILPLKEILQNTTSLKLARKVHETLRRITVGLIVNQEMTAESILLLSYGLISENLPLLTEKEKNPVAPAPDPRLPPQSCLLLPPTPVRGGQKAVVSRKTNMHIFIESGLRLLHLSLKTSKIKSSGECVLEMLDPFVSLLIDCLGSMDVKVITGALQCLIWVLRFPLPSIETKAEQLTKHLFLLLKDYAKLGAARGQNFHLVVNCFKCVTILVKKVKSYQITEKQLQVLLAYAEEDIYDTSRQATAFGLLKAILSRKLLVPEIDEVMRKVSKLAVSAQSEPARVQCRQVFLKYILDYPLGDKLRPNLEFMLAQLNYEHETGRESTLEMIAYLFDTFPQGLLHENCGMFFIPLCLMTINDDSATCKKMASMTIKSLLGKISLEKKDWLFDMVTTWFGAKKRLNRQLAALICGLFVESEGVDFEKRLGTVLPVIEKEIDPENFKDIMEETEEKAADRLLFSFLTLITKLIKECNIIQFTKPAETLSKIWSHVHSHLRHPHNWVWLTAAQIFGLLFASCQPEELIQKWNTKKTKKHLPEPVAIKFLASDLDQKMKSISLASCHQLHSKFLDQSLGEQVVKNLLFAAKVLYLLELYCEDKQSKIKEDLEEQEALEDGVACADEKAESDGEEKEEVKEELGRPATLLWLIQKLSRIAKLEAAYSPRNPLKRTCIFKFLGAVAMDLGIDKVKPYLPMIIAPLFRELNSTYSEQDPLLKNLSQEIIELLKKLVGLESFSLAFASVQKQANEKRALRKKRKALEFVTNPDIAAKKKMKKHKNKSEAKKRKIEFLRPGYKAKRQKSHSLKDLAMVE

SEQ ID NO: 889916 - protein, 2645 aa, Homo sapiens
MKTKPVSHKTENTYRFLTFAERLGNVNIDIIHRIDRTASYEEEVETYFFEGLLKWRELNLTEHFGKFYKEVIDKCQSFNQLVYHQNEIVQSLKTHLQVKNSFAYQPLLDLVVQLARDLQMDFYPHFPEFFLTITSILETQDTELLEWAFTSLSYLYKYLWRLMVKDMSSIYSMYSTLLAHKKLHIRNFAAESFTFLMRKVSDKNALFNLMFLDLDKHPEKVEGVGQLLFEMCKGVRNMFHSCTGQAVKLILRKLGPVTETETQLPWMLIGETLKNMVKSTVSYISKEHFGTFFECLQESLLDLHTKVTKTNCCESSEQIKRLLETYLILVKHGSGTKIPTPADVCKVLSQTLQVASLSTSCWETLLDVISALILGENVSLPETLIKETIEKIFESRFEKRLIFSFSEVMFAMKQFEQLFLPSFLSYIVNCFLIDDAVVKDEALAILAKLILNKAAPPTAGSMAIEKYPLVFSPQMVGFYIKQKKTRSKGRNEQFPVLDHLLSIIKLPPNKDTTYLSQSWAALVVLPHIRPLEKEKVIPLVTGFIEALFMTVDKGSFGKGNLFVLCQAVNTLLSLEESSELLHLVPVERVKNLVLTFPLEPSVLLLTDLYYQRLALCGCKGPLSQEALMELFPKLQANISTGVSKIRLLTIRILNHFDVQLPESMEDDGLSERQSVFAILRQAELVPATVNDYREKLLHLRKLRHDVVQTAVPDGPLQEVPLRYLLGMLYINFSALWDPVIELISSHAHEMENKQFWKVYYEHLEKAATHAEKELQNDMTDEKSVGDESWEQTQEGDVGALYHEQLALKTDCQERLDHTNFRFLLWRALTKFPERVEPRSRELSPLFLRFINNEYYPADLQVAPTQDLRRKGKGMVAEEIEEEPAAGDDEELEEEAVPQDESSQKKKTRRAAAKQLIAHLQVFSKFSNPRALYLESKLYELYLQLLLHQDQMVQKITLDCIMTYKHPHVLPYRENLQRLLEDRSFKEEIVHFSISEDNAVVKTAHRADLFPILMRILYGRMKNKTGSKTQGKSASGTRMAIVLRFLAGTQPEEIQIFLDLLFEPVRHFKNGECHSAVIQAVEDLDLSKVLPLGRQHGILNSLEIVLKNISHLISAYLPKILQILLCMTATVSHILDQREKIQLRFINPLKNLRRLGIKMVTDIFLDWESYQFRTEEIDAVFHGAVWPQISRLGSESQYSPTPLLKLISIWSRNARYFPLLAKQKPGHPECDILTNVFAILSAKNLSDATASIVMDIVDDLLNLPDFEPTETVLNLLVTGCVYPGIAENIGESITIGGRLILPHVPAILQYLSKTTISAEKVKKKKNRAQVSKELGILSKISKFMKDKEQSSVLITLLLPFLHRGNIAEDTEVDILVTVQNLLKHCVDPTSFLKPIAKLFSVIKNKLSRKLLCTVFETLSDFESGLKYITDVVKLNAFDQRHLDDINFDVRFETFQTITSYIKEMQIVDVNYLIPVMHNCFYNLELGDMSLSDNASMCLMSIIKKLAALNVTEKDYREIIHRSLLEKLRKGLKSQTESIQQDYTTILSCLIQTFPNQLEFKDLVQLTHYHDPEMDFFENMKHIQIHRRARALKKLAKQLMEGKVVLSSKSLQNYIMPYAMTPIFDEKMLKHENITTAATEIIGAICKHLSWSAYMYYLKHFIHVLQTGQINQKLGVSLLVIVLEAFHFDHKTLEEQMGKIENEENAIEAIELPEPEAMELERVDEEEKEYTCKSLSDNGQPGTPDPADSGGTSAKESECITKPVSFLPQNKEEIERTIKNIQGTITGDILPRLHKCLASTTKREEEHKLVKSKVVNDEEVVRVPLAFAMVKLMQSLPQEVMEANLPSILLKVCALLKNRAQEIRDIARSTLAKIIEDLGVHFLQYVLKELQTTLVRGYQVHVLTFTVHMLLQGLTNKLQVGDLDSCLDIMIEIFNHELFGAVAEEKEVKQILSKVMEARRSKSYDSYEILGKFVGKDQVTKLILPLKEILQNTTSLKLARKVHETLRRITVGLIVNQEMTAESILLLSYGLISENLPLLTEKEKNPVAPAPDPRLPPQSCLLLPPTPVRGGQKAVVSRKTNMHIFIESGLRLLHLSLKTSKIKSSGECVLEMLDPFVSLLIDCLGSMDVKVITGALQCLIWVLRFPLPSIETKAEQLTKHLFLLLKDYAKLGAARGQNFHLVVNCFKCVTILVKKVKSYQITEKQLQVLLAYAEEDIYDTSRQATAFGLLKAILSRKLLVPEIDEVMRKVSKLAVSAQSEPARVQCRQVFLKYILDYPLGDKLRPNLEFMLAQLNYEHETGRESTLEMIAYLFDTFPQGLLHENCGMFFIPLCLMTINDDSATCKKMASMTIKSLLGKISLEKKDWLFDMVTTWFGAKKRLNRQLAALICGLFVESEGVDFEKRLGTVLPVIEKEIDPENFKDIMEETEEKAADRLLFSFLTLITKLIKECNIIQFTKPAETLSKIWSHVHSHLRHPHNWVWLTAAQIFGLLFASCQPEELIQKWNTKKTKKHLPEPVAIKFLASDLDQKMKSISLASCHQLHSKFLDQSLGEQVVKNLLFAAKVLYLLELYCEDKQSKIKEDLEEQEALEDGVACADEKAESDGEEKEEVKEELGRPATLLWLIQKLSRIAKLEAAYSPRNPLKVR

SEQ ID NO: 889917 - protein, 2645 aa, Homo sapiens; identical to SEQ ID NO: 889916

SEQ ID NO: 889918 - protein, 2431 aa, Homo sapiens
MKTKPVSHKTENTYRFLTFAERLGNVNIDIIHRIDRTASYEEEVETYFFEGLLKWRELNLTEHFGKFYKEVIDKCQSFNQLVYHQNEIVQSLKTHLQVKNSFAYQPLLDLVVQLARDLQMDFYPHFPEFFLTITSILETQDTELLEWAFTSLSYLYKYLWRLMVKDMSSIYSMYSTLLAHKKLHIRNFAAESFTFLMRKVSDKNALFNLMFLDLDKHPEKVEGVGQLLFEMCKGVRNMFHSCTGQAVKLILRKLGPVTETETQLPWMLIGETLKNMVKSTVSYISKEHFGTFFECLQESLLDLHTKVTKTNCCESSEQIKRLLETYLILVKHGSGTKIPTPADVCKVLSQTLQVASLSTSCWETLLDVISALILGENVSLPETLIKETIEKIFESRFEKRLIFSFSEVMFAMKQFEQLFLPSFLSYIVNCFLIDDAVVKDEALAILAKLILNKAAPPTAGSMAIEKYPLVFSPQMVGFYIKQKKTRSKGRNEQFPVLDHLLSIIKLPPNKDTTYLSQSWAALVVLPHIRPLEKEKVIPLVTGFIEALFMTVDKGSFGKGNLFVLCQAVNTLLSLEESSELLHLVPVERVKNLVLTFPLEPSVLLLTDLYYQRLALCGCKGPLSQEALMELFPKLQANISTGVSKIRLLTIRILNHFDVQLPESMEDDGLSERQSVFAILRQAELVPATVNDYREKLLHLRKLRHDVVQTAVPDGPLQEVPLRYLLGMLYINFSALWDPVIELISSHAHEMENKQFWKVYYEHLEKAATHAEKELQNDMTDEKSVGDESWEQTQEGDVGALYHEQLALKTDCQERLDHTNFRFLLWRALTKFPERVEPRSRELSPLFLRFINNEYYPADLQVAPTQDLRRKGKGMVAEEIEEEPAAGDDEELEEEAVPQDESSQKKKTRRAAAKQLIAHLQVFSKFSNPRALYLESKLYELYLQLLLHQDQMVQKITLDCIMTYKHPHVLPYRENLQRLLEDRSFKEEIVHFSISEDNAVVKTAHRADLFPILMRILYGRMKNKTGSKTQGKSASGTRMAIVLRFLAGTQPEEIQIFLDLLFEPVRHFKNGECHSAVIQAVEDLDLSKVLPLGRQHGILNSLEIVLKNISHLISAYLPKILQILLCMTATVSHILDQREKIQLRFINPLKNLRRLGIKMVTDIFLDWESYQFRTEEIDAVFHGAVWPQISRLGSESQYSPTPLLKLISIWSRNARYFPLLAKQKPGHPECDILTNVFAILSAKNLSDATASIVMDIVDDLLNLPDFEPTETVLNLLVTGCVYPGIAENIGESITIGGRLILPHVPAILQYLSKTTISAEKVKKKKNRAQVSKELGILSKISKFMKDKEQSSVLITLLLPFLHRGNIAEDTEVDILVTVQNLLKHCVDPTSFLKPIAKLFSVIKNKLSRKLLCTVFETLSDFESGLKYITDVVKLNAFDQRHLDDINFDVRFETFQTITSYIKEMQIVDVNYLIPVMHNCFYNLELGDMSLSDNASMCLMSIIKKLAALNVTEKDYREIIHRSLLEKLRKGLKSQTESIQQDYTTILSCLIQTFPNQLEFKDLVQLTHYHDPEMDFFENMKHIQIHRRARALKKLAKQLMEGKVVLSSKSLQNYIMPYAMTPIFDEKMLKHENITTAATEIIGAICKHLSWSAYMYYLKHFIHVLQTGQINQKLGVSLLVIVLEAFHFDHKTLEEQMGKIENEENAIEAIELPEPEAMELERVDEEEKEYTCKSLSDNGQPGTPDPADSGGTSAKESECITKPVSFLPQNKEEIERTIKNIQGTITGDILPRLHKCLASTTKREEEHKLVKSKVVNDEEVVRVPLAFAMVKLMQSLPQEVMEANLPSILLKVCALLKNRAQEIRDIARSTLAKIIEDLGVHFLQYVLKELQTTLVRGYQVHVLTFTVHMLLQGLTNKLQVGDLDSCLDIMIEIFNHELFGAVAEEKEVKQILSKVMEARRSKSYDSYEILGKFVGKDQVTKLILPLKEILQNTTSLKLARKVHETLRRITVGLIVNQEMTAESILLLSYGLISENLPLLTEKEKNPVAPAPDPRLPPQSCLLLPPTPVRGGQKAVVSRKTNMHIFIESGLRLLHLSLKTSKIKSSGECVLEMLDPFVSLLIDCLGSMDVKVITGALQCLIWVLRFPLPSIETKAEQLTKHLFLLLKDYAKLGAARGQNFHLVVNCFKCVTILVKKVKSYQITEKQLQVLLAYAEEDIYDTSRQATAFGLLKAILSRKLLVPEIDEVMRKVSKLAVSAQSEPARVQCRQVFLKYILDYPLGDKLRPNLEFMLAQLNYEHETGRESTLEMIAYLFDTFPQGLLHENCGMFFIPLCLMTINDDSATCKKMASMTIKSLLGKISLEKKDWLFDMVTTWFGAKKVCVAFSHSSVTSLSFGDHSLSKNICHTLLNWFFSQIVLFLSDYANSIFLKFSKV

SEQ ID NO: 889919 - protein, 116 aa, Homo sapiens
KQIMCFCLFRILYGRMKNKTGSKTQGKSASGTRMAIVLRFLAGTQPEEIQIFLDLLFEPVRHFKNGNYQLPLTLIPVVCGGLLTSQATFPMLLGVFLTGLFLPILMAIFLLKCNSF

SEQ ID NO: 889920 - protein, 1783 aa, Homo sapiens
MCKQIMCFCLFRILYGRMKNKTGSKTQGKSASGTRMAIVLRFLAGTQPEEIQIFLDLLFEPVRHFKNGECHSAVIQAVEDLDLSKVLPLGRQHGILNSLEIVLKNISHLISAYLPKILQILLCMTATVSHILDQREKIQLRFINPLKNLRRLGIKMVTDIFLDWESYQFRTEEIDAVFHGAVWPQISRLGSESQYSPTPLLKLISIWSRNARYFPLLAKQKPGHPECDILTNVFAILSAKNLSDATASIVMDIVDDLLNLPDFEPTETVLNLLVTGCVYPGIAENIGESITIGGRLILPHVPAILQYLSKTTISAEKVKKKKNRAQVSKELGILSKISKFMKDKEQSSVLITLLLPFLHRGNIAEDTEVDILVTVQNLLKHCVDPTSFLKPIAKLFSVIKNKLSRKLLCTVFETLSDFESGLKYITDVVKLNAFDQRHLDDINFDVRFETFQTITSYIKEMQIVDVNYLIPVMHNCFYNLELGDMSLSDNASMCLMSIIKKLAALNVTEKDYREIIHRSLLEKLRKGLKSQTESIQQDYTTILSCLIQTFPNQLEFKDLVQLTHYHDPEMDFFENMKHIQIHRRARALKKLAKQLMEGKVVLSSKSLQNYIMPYAMTPIFDEKMLKHENITTAATEIIGAICKHLSWSAYMYYLKHFIHVLQTGQINQKLGVSLLVIVLEAFHFDHKTLEEQMGKIENEENAIEAIELPEPEAMELERVDEEEKEYTCKSLSDNGQPGTPDPADSGGTSAKESECITKPVSFLPQNKEEIERTIKNIQGTITGDILPRLHKCLASTTKREEEHKLVKSKVVNDEEVVRVPLAFAMVKLMQSLPQEVMEANLPSILLKVCALLKNRAQEIRDIARSTLAKIIEDLGVHFLQYVLKELQTTLVRGYQVHVLTFTVHMLLQGLTNKLQVGDLDSCLDIMIEIFNHELFGAVAEEKEVKQILSKVMEARRSKSYDSYEILGKFVGKDQVTKLILPLKEILQNTTSLKLARKVHETLRRITVGLIVNQEMTAESILLLSYGLISENLPLLTEKEKNPVAPAPDPRLPPQSCLLLPPTPVRGGQKAVVSRKTNMHIFIESGLRLLHLSLKTSKIKSSGECVLEMLDPFVSLLIDCLGSMDVKVITGALQCLIWVLRFPLPSIETKAEQLTKHLFLLLKDYAKLGAARGQNFHLVVNCFKCVTILVKKVKSYQITEKQLQVLLAYAEEDIYDTSRQATAFGLLKAILSRKLLVPEIDEVMRKVSKLAVSAQSEPARVQCRQVFLKYILDYPLGDKLRPNLEFMLAQLNYEHETGRESTLEMIAYLFDTFPQGLLHENCGMFFIPLCLMTINDDSATCKKMASMTIKSLLGKISLEKKDWLFDMVTTWFGAKKRLNRQLAALICGLFVESEGVDFEKRLGTVLPVIEKEIDPENFKDIMEETEEKAADRLLFSFLTLITKLIKECNIIQFTKPAETLSKIWSHVHSHLRHPHNWVWLTAAQIFGLLFASCQPEELIQKWNTKKTKKHLPEPVAIKFLASDLDQKMKSISLASCHQLHSKFLDQSLGEQVVKNLLFAAKVLYLLELYCEDKQSKIKEDLEEQEALEDGVACADEKAESDGEEKEEVKEELGRPATLLWLIQKLSRIAKLEAAYSPRNPLKRTCIFKFLGAVAMDLGIDKVKPYLPMIIAPLFRELNSTYSEQDPLLKNLSQEIIELLKKLVGLESFSLAFASVQKQANEKRALRKKRKALEFVTNPDIAAKKKMKKHKNKSEAKKRKIEFLRPGYKAKRQKSHSLKDLAMVE

SEQ ID NO: 889921 - protein, 2759 aa, Homo sapiens
MKTKPVSHKTENTYRFLTFAERLGNVNIDIIHRIDRTASYEEEVETYFFEGLLKWRELNLTEHFGKFYKEVIDKCQSFNQLVYHQNEIVQSLKTHLQVKNSFAYQPLLDLVVQLARDLQMDFYPHFPEFFLTITSILETQDTELLEWAFTSLSYLYKYLWRLMVKDMSSIYSMYSTLLAHKKLHIRNFAAESFTFLMRKVSDKNALFNLMFLDLDKHPEKVEGVGQLLFEMCKGVRNMFHSCTGQAVKLILRKLGPVTETETQLPWMLIGETLKNMVKSTVSYISKEHFGTFFECLQESLLDLHTKVTKTNCCESSEQIKRLLETYLILVKHGSGTKIPTPADVCKVLSQTLQVASLSTSCWETLLDVISALILGENVSLPETLIKETIEKIFESRFEKRLIFSFSEVMFAMKQFEQLFLPSFLSYIVNCFLIDDAVVKDEALAILAKLILNKAAPPTAGSMAIEKYPLVFSPQMVGFYIKQKKTRSKGRNEQFPVLDHLLSIIKLPPNKDTTYLSQSWAALVVLPHIRPLEKEKVIPLVTGFIEALFMTVDKGSFGKGNLFVLCQAVNTLLSLEESSELLHLVPVERVKNLVLTFPLEPSVLLLTDLYYQRLALCGCKGPLSQEALMELFPKLQANISTGVSKIRLLTIRILNHFDVQLPESMEDDGLSERQSVFAILRQAELVPATVNDYREKLLHLRKLRHDVVQTAVPDGPLQEVPLRYLLGMLYINFSALWDPVIELISSHAHEMENKQFWKVYYEHLEKAATHAEKELQNDMTDEKSVGDESWEQTQEGDVGALYHEQLALKTDCQERLDHTNFRFLLWRALTKFPERVEPRSRELSPLFLRFINNEYYPADLQVAPTQDLRRKGKGMVAEEIEEEPAAGDDEELEEEAVPQDESSQKKKTRRAAAKQLIAHLQVFSKFSNPRALYLESKLYELYLQLLLHQDQMVQKITLDCIMTYKHPHVLPYRENLQRLLEDRSFKEEIVHFSISEDNAVVKTAHRADLFPILMRILYGRMKNKTGSKTQGKSASGTRMAIVLRFLAGTQPEEIQIFLDLLFEPVRHFKNGECHSAVIQAVEDLDLSKVLPLGRQHGILNSLEIVLKNISHLISAYLPKILQILLCMTATVSHILDQREKIQLRFINPLKNLRRLGIKMVTDIFLDWESYQFRTEEIDAVFHGAVWPQISRLGSESQYSPTPLLKLISIWSRNARYFPLLAKQKPGHPECDILTNVFAILSAKNLSDATASIVMDIVDDLLNLPDFEPTETVLNLLVTGCVYPGIAENIGESITIGGRLILPHVPAILQYLSKTTISAEKVKKKKNRAQVSKELGILSKISKFMKDKEQSSVLITLLLPFLHRGNIAEDTEVDILVTVQNLLKHCVDPTSFLKPIAKLFSVIKNKLSRKLLCTVFETLSDFESGLKYITDVVKLNAFDQRHLDDINFDVRFETFQTITSYIKEMQIVDVNYLIPVMHNCFYNLELGDMSLSDNASMCLMSIIKKLAALNVTEKDYREIIHRSLLEKLRKGLKSQTESIQQDYTTILSCLIQTFPNQLEFKDLVQLTHYHDPEMDFFENMKHIQIHRRARALKKLAKQLMEGKVVLSSKSLQNYIMPYAMTPIFDEKMLKHENITTAATEIIGAICKHLSWSAYMYYLKHFIHVLQTGQINQKLGVSLLVIVLEAFHFDHKTLEEQMGKIENEENAIEAIELPEPEAMELERVDEEEKEYTCKSLSDNGQPGTPDPADSGGTSAKESECITKPVSFLPQNKEEIERTIKNIQGTITGDILPRLHKCLASTTKREEEHKLVKSKVVNDEEVVRVPLAFAMVKLMQSLPQEVMEANLPSILLKVCALLKNRAQEIRDIARSTLAKIIEDLGVHFLQYVLKELQTTLVRGYQVHVLTFTVHMLLQGLTNKLQVGDLDSCLDIMIEIFNHELFGAVAEEKEVKQILSKVMEARRSKSYDSYEILGKFVGKDQVTKLILPLKEILQNTTSLKLARKVHETLRRITVGLIVNQEMTAESILLLSYGLISENLPLLTEKEKNPVAPAPDPRLPPQSCLLLPPTPVRGGQKAVVSRKTNMHIFIESGLRLLHLSLKTSKIKSSGECVLEMLDPFVSLLIDCLGSMDVKVITGALQCLIWVLRFPLPSIETKAEQLTKHLFLLLKDYAKLGAARGQNFHLVVNCFKCVTILVKKVKSYQITEKQLQVLLAYAEEDIYDTSRQATAFGLLKAILSRKLLVPEIDEVMRKVSKLAVSAQSEPARVQCRQVFLKYILDYPLGDKLRPNLEFMLAQLNYEHETGRESTLEMIAYLFDTFPQGLLHENCGMFFIPLCLMTINDDSATCKKMASMTIKSLLGKISLEKKDWLFDMVTTWFGAKKRLNRQLAALICGLFVESEGVDFEKRLGTVLPVIEKEIDPENFKDIMEETEEKAADRLLFSFLTLITKLIKECNIIQFTKPAETLSKIWSHVHSHLRHPHNWVWLTAAQIFGLLFASCQPEELIQKWNTKKTKKHLPEPVAIKFLASDLDQKMKSISLASCHQLHSKFLDQSLGEQVVKNLLFAAKVLYLLELYCEDKQSKIKEDLEEQEALEDGVACADEKAESDGEEKEEVKEELGRPATLLWLIQKLSRIAKLEAAYSPRNPLKRTCIFKFLGAVAMDLGIDKVKPYLPMIIAPLFRELNSTYSEQDPLLKNLSQEIIELLKKLVGLESFSLAFASVQKQRSYDHWEIRLYLVYPKIHCYGAEELKDACSLYGVSRRRGR

SEQ ID NO: 889922 - protein, 256 aa, Homo sapiens
IGKVRGWVVITCIQILGSVSRRTVVKNLLFAAKVLYLLELYCEDKQSKIKEDLEEQEALEDGVACADEKAESDGEEKEEVKEELGRPATLLWLIQKLSRIAKLEAAYSPRNPLKRTCIFKFLGAVAMDLGIDKVKPYLPMIIAPLFRELNSTYSEQDPLLKNLSQEIIELLKKLVGLESFSLAFASVQKQANEKRALRKKRKALEFVTNPDIAAKKKMKKHKNKSEAKKRKIEFLRPGYKAKRQKSHSLKDLAMVE

SEQ ID NO: 889923 - protein, 1894 aa, Homo sapiens
MKTKPVSHKTENTYRFLTFAERLGNVNIDIIHRIDRTASYEEEVETYFFEGLLKWRELNLTEHFGKFYKEVIDKCQSFNQLVYHQNEIVQSLKTHLQVKNSFAYQPLLDLVVQLARDLQMDFYPHFPEFFLTITSILETQDTELLEWAFTSLSYLYKYLWRLMVKDMSSIYSMYSTLLAHKKLHIRNFAAESFTFLMRKVSDKNALFNLMFLDLDKHPEKVEGVGQLLFEMCKGVRNMFHSCTGQAVKLILRKLGPVTETETQLPWMLIGETLKNMVKSTVSYISKEHFGTFFECLQESLLDLHTKVTKTNCCESSEQIKRLLETYLILVKHGSGTKIPTPADVCKVLSQTLQVASLSTSCWETLLDVISALILGENVSLPETLIKETIEKIFESRFEKRLIFSFSEVMFAMKQFEQLFLPSFLSYIVNCFLIDDAVVKDEALAILAKLILNKAAPPTAGSMAIEKYPLVFSPQMVGFYIKQKKTRSKGRNEQFPVLDHLLSIIKLPPNKDTTYLSQSWAALVVLPHIRPLEKEKVIPLVTGFIEALFMTVDKGSFGKGNLFVLCQAVNTLLSLEESSELLHLVPVERVKNLVLTFPLEPSVLLLTDLYYQRLALCGCKGPLSQEALMELFPKLQANISTGVSKIRLLTIRILNHFDVQLPESMEDDGLSERQSVFAILRQAELVPATVNDYREKLLHLRKLRHDVVQTAVPDGPLQEVPLRYLLGMLYINFSALWDPVIELISSHAHEMENKQFWKVYYEHLEKAATHAEKELQNDMTDEKSVGDESWEQTQEGDVGALYHEQLALKTDCQERLDHTNFRFLLWRALTKFPERVEPRSRELSPLFLRFINNEYYPADLQVAPTQDLRRKGKGMVAEEIEEEPAAGDDEELEEEAVPQDESSQKKKTRRAAAKQLIAHLQVFSKFSNPRALYLESKLYELYLQLLLHQDQMVQKITLDCIMTYKHPHVLPYRENLQRLLEDRSFKEEIVHFSISEDNAVVKTAHRADLFPILMRILYGRMKNKTGSKTQGKSASGTRMAIVLRFLAGTQPEEIQIFLDLLFEPVRHFKNGECHSAVIQAVEDLDLSKVLPLGRQHGILNSLEIVLKNISHLISAYLPKILQILLCMTATVSHILDQREKIQLRFINPLKNLRRLGIKMVTDIFLDWESYQFRTEEIDAVFHGAVWPQISRLGSESQYSPTPLLKLISIWSRNARYFPLLAKQKPGHPECDILTNVFAILSAKNLSDATASIVMDIVDDLLNLPDFEPTETVLNLLVTGCVYPGIAENIGESITIGGRLILPHVPAILQYLSKTTISAEKVKKKKNRAQVSKELGILSKISKFMKDKEQSSVLITLLLPFLHRGNIAEDTEVDILVTVQNLLKHCVDPTSFLKPIAKLFSVIKNKLSRKLLCTVFETLSDFESGLKYITDVVKLNAFDQRHLDDINFDVRFETFQTITSYIKEMQIVDVNYLIPVMHNCFYNLELGDMSLSDNASMCLMSIIKKLAALNVTEKDYREIIHRSLLEKLRKGLKSQTESIQQDYTTILSCLIQTFPNQLEFKDLVQLTHYHDPEMDFFENMKHIQIHRRARALKKLAKQLMEGKVVLSSKSLQNYIMPYAMTPIFDEKMLKHENITTAATEIIGAICKHLSWSAYMYYLKHFIHVLQTGQINQKLGVSLLVIVLEAFHFDHKTLEEQMGKIENEENAIEAIELPEPEAMELERVDEEEKEYTCKSLSDNGQPGTPDPADSGGTSAKESECITKPVSFLPQNKEEIERTIKNIQGTITGDILPRLHKCLASTTKREEEHKLVKSKVVNDEEVVRVPLAFAMVKLMQSLPQEVMEANLPSILLKVCALLKNRAQEIRDIARSTLAKIIEDLGVHFLQYVLKISIIISKR

SEQ ID NO: 889924 - protein, 2129 aa, Homo sapiens
WTKALGGALRTPGAPPTEVAMDALESLLDEVALEGLDGLCLPALWSRLETRVPPFPLPLEPCTQEFLWRALATHPGISFYEEPRERPDLQLQDRYEEIDLETGILESRRDPVALEDVYPIHMILENKDGIQGSCRYFKERKNITNDIRTKSLQPRCTMVEAFDRWGKKLIIVASQAMRYRALIGQEGDPDLKLPDFSYCILERLGRSRWQGELQRDLHTTAFKVDAGKLHYHRKILNKNGLITMQSHVIRLPTGAQQHSILLLLNRFHVDRRSKYDILMEKLSVMLSTRTNHIETLGKLREELGLCERTFKRLYQYMLNAGLAKVVSLRLQEIHPECGPCKTKKGTDVMVRCLKLLKEFKRNDHDDDEDEEVISKTVPPVDIVFERDMLTQTYDLIERRGTKGISQAEIRVAMNVGKLEARMLCRLLQRFKVVKGFMEDEGRQRTTKYISCVFAEESDLSRQYQREKARSELLTTVSLASMQEESLLPEGEDTFLSESDSEEERSSSKRRGRGSQKDTRASANLRPKTQPHHSTPTKGGWKVVNLHPLKKQPPSFPGAAEERACQSLASRDSLLDTSSVSEPNVSFVSHCADSNSGDIAVIEEVRMENPKESSSSLKTGRHSSGQDKPHETYRLLKRRNLIIEAVTNLRLIESLFTIQKMIMDQEKQEGVSTKCCKKSIVRLVRNLSEEGLLRLYRTTVIQDGIKKKVDLVVHPSMDQNDPLVRSAIEQVRFRISNSSTANRVKTSQPPVPQGEAEEDSQGKEGPSGSGDSQLSASSRSESGRMKKSDNKMGITPLRNYHPIVVPGLGRSLGFLPKMPRLRVVHMFLWYLIYGHPASNTVEKPSFISERRTIKQESGRAGVRPSSSGSAWEACSEAPSKGSQDGVTWEAEVELATETVYVDDASWMRYIPPIPVHRDFGFGWALVSDILLCLPLSIFIQIVQVSYKVDNLEEFLNDPLKKHTLIRFLPRPIRQQLLYKRRYIFSVVENLQRLCYMGLLQFGPTEKFQDKDQVFIFLKKNAVIVDTTICDPHYNLARSSRPFERRLYVLNSMQDVENYWFDLQCVCLNTPLGVVRCPRVRKNSSTDQGSDEEGSLQKEQESAMDKHNLERKCAMLEYTTGSREVVDEGLIPGDGLGAAGLDSSFYGHLKRNWIWTSYIINQAKKENTAAENGLTVRLQTFLSKRPMPLSARGNSRLNIWGEARVGSELCAGWEEQFEVDREPSLDRNRRVRGGKSQKRKRLKKDPGKKIKRKKKGEFPGEKSKRLRYHDEADQSALQRMTRLRVTWSMQEDGLLVLCRIASNVLNTKVKGPFVTWQVVRDILHATFEESLDKTSHSVGRRARYIVKNPQAYLNYKVCLAEVYQDKALVGDFMNRRGDYDDPKVCANEFKEFVEKLKEKFSSALRNSNLEIPDTLQELFARYRVLAIGDEKDQTRKEDELNSVDDIHFLVLQNLIQSTLALSDSQMKSYQSFQTFRLYREYKDHVLVKAFMECQKRSLVNRRRVNHTLGPKKNRALPFVPMSYQLSQTYYRIFTWRFPSTICTESFQFLDRMRAAGKLDQPDRFSFKDQDNNEPTNDMVAFSLDGPGGNCVAVLTLFSLGLISVDVRIPEQIIVVDSSMVENEVIKSLGKDGSLEDDEDEEDDLDEGVGGKRRSMEVKPAQASHTNYLLMRGYYSPGIVSTRNLNPNDSIVVNSCQMKFQLRCTPVPARLRPAAAPLEELTMGTSCLPDTFTKLINPQENTCSLEEFVLQLELSGYSPEDLTAALEILEAIIATGCFGIDKEELRRRFSALEKAGGGRTRTFADCIQALLEQHQVLEVGGNTARLVAMGSAWPWLLHSVRLKDREDADIQREDPQARPLEGSSSEDSPPEGQAPPSHSPRGTKRRASWASENGETDAEGTQMTPAKRPALQDSNLAPSLGPGAEDGAEAQAPSPPPALEDTAAAGAAQEDQEGVGEFSSPGQEQLSGQAQPPEGSEDPRGFTESFGAANISQAARERDCESVCFIGRPWRVVDGHLNLPVCKGMMEAMLYHIMTRPGIPESSLLRHYQGVLQPVAVLELLQGLESLGCIRKRWLRKPRPVSLFSTPVVEEVEVPSSLDESPMAFYEPTLDCTLRLGRVFPHEVNWNKWIHL

SEQ ID NO: 889925 - protein, 2103 aa, Homo sapiens
WTKALGGALRTPGAPPTEVAMDALESLLDEVALEGLDGLCLPALWSRLETRVPPFPLPLEPCTQEFLWRALATHPGISFYEEPRERPDLQLQDRYEEIDLETGILESRRDPVALEDVYPIHMILENKDGIQGSCRYFKERKNITNDIRTKSLQPRCTMVEAFDRWGKKLIIVASQAMRYRALIGQEGDPDLKLPDFSYCILERLGRSRWQGELQRDLHTTAFKVDAGKLHYHRKILNKNGLITMQSHVIRLPTGAQQHSILLLLNRFHVDRRSKYDILMEKLSVMLSTRTNHIETLGKLREELGLCERTFKRLYQYMLNAGLAKVVSLRLQEIHPECGPCKTKKGTDVMVRCLKLLKEFKRNDHDDDEDEEVISKTVPPVDIVFERDMLTQTYDLIERRGTKGISQAEIRVAMNVGKLEARMLCRLLQRFKVVKGFMEDEGRQRTTKYISCVFAEESDLSRQYQREKARSELLTTVSLASMQEESLLPEGEDTFLSESDSEEERSSSKRRGRGSQKDTRASANLRPKTQPHHSTPTKGGWKVVNLHPLKKQPPSFPGAAEERACQSLASRDSLLDTSSVSEPNVSFVSHCADSNSGDIAVIEEVRMENPKESSSSLKTGRHSSGQDKPHETYRLLKRRNLIIEAVTNLRLIESLFTIQKMIMDQEKQEGVSTKCCKKSIVRLVRNLSEEGLLRLYRTTVIQDGIKKKVDLVVHPSMDQNDPLVRSAIEQVRFRISNSSTANRVKTSQPPVPQGEAEEDSQGKEGPSGSGDSQLSASSRSESGRMKKSDNKMGITPLRNYHPIVVPGLGRSLGFLPKMPRLRVVHMFLWYLIYGHPASNTVEKPSFISERRTIKQESGRAGVRPSSSGSAWEACSEAPSKGSQDGVTWEAEVELATETVYVDDASWMRYIPPIPVHRDFGFGWALVSDILLCLPLSIFIQIVQVSYKVDNLEEFLNDPLKKHTLIRFLPRPIRQQLLYKRRYIFSVVENLQRLCYMGLLQFGPTEKFQDKDQVFIFLKKNAVIVDTTICDPHYNLARSSRPFERRLYVLNSMQDVENYWFDLQCVCLNTPLGVVRCPRVRKNSSTDQGSDEEGSLQKEQESAMDKHNLERKCAMLEYTTGSREVVDEGLIPGDGLGAAGLDSSFYGHLKRNWIWTSYIINQAKKENTAAENGLTVRLQTFLSKRPMPLSARGNSRLNIWGEARVGSELCAGWEEQFEVDREPSLDRNRRVRGGKSQKRKRLKKDPGKKIKRKKKGEFPGEKSKRLRYHDEADQSALQRMTRLRVTWSMQEDGLLVLCRIASNVLNTKVKGPFVTWQVVRDILHATFEESLDKTSHSVGRRARYIVKNPQAYLNYKVCLAEVYQDKALVGDFMNRRGDYDDPKVCANEFKEFVEKLKEKFSSALRNSNLEIPDTLQELFARYRVLAIGDEKDQTRKEDELNSVDDIHFLVLQNLIQSTLALSDSQMKSYQSFQTFRLYREYKDHVLVKAFMECQKRSLVNRRRVNHTLGPKKNRALPFVPMSYQLSQTYYRIFTWRFPSTICTESFQFLDRMRAAGKLDQPDRFSFKDQDNNEPTNDMVAFSLDGPGGNCVAVLTLFSLGLISVDVRIPEQIIVVDSSMVENEVIKSLGKDGSLEDDEDEEDDLDEGVGGKRRSMEVKPAQASHTNYLLMRGYYSPGIVSTRNLNPNDSIVVNSCQMKFQLRCTPVPARLRPAAAPLEELTMGTSCLPDTFTKLINPQENTCSLEEFVLQLELSGYSPEDLTAALEILEAIIATGCFGIDKEELRRRFSALEKAGGGRTRTFADCIQALLEQHQVLEVGGNTARLVAMGSAWPWLLHSVRLKDREDADIQREDPQARPLEGSSSEDSPPEGQAPPSHSPRGTKRRASWASENGETDAEGTQMTPAKRPALQDSNLAPSLGPGAEDGAEAQAPSPPPALEDTAAAGAAQEDQEGGFTESFGAANISQAARERDCESVCFIGRPWRVVDGHLNLPVCKGMMEAMLYHIMTRPGIPESSLLRHYQGVLQPVAVLELLQGLESLGCIRKRWLRKPRPVSLFSTPVVEEVEVPSSLDESPMAFYEPTLDCTLRLGRVFPHEVNWNKWIHL

SEQ ID NO: 889926 - protein, 908 aa, Homo sapiens
TGDAVGTKPRDSGVVPVGTEEAPKVFKMAASMHGQPSPSLEDAKLRRPMVIEIIEKKKGEFPGEKSKRLRYHDEADQSALQRMTRLRVTWSMQEDGLLVLCRIASNVLNTKVKGPFVTWQVVRDILHATFEESLDKTSHSVGRRARYIVKNPQAYLNYKVCLAEVYQDKALVGDFMNRRGDYDDPKVCANEFKEFVEKLKEKFSSALRNSNLEIPDTLQELFARYRVLAIGDEKDQTRKEDELNSVDDIHFLVLQNLIQSTLALSDSQMKSYQSFQTFRLYREYKDHVLVKAFMECQKRSLVNRRRVNHTLGPKKNRALPFVPMSYQLSQTYYRIFTWRFPSTICTESFQFLDRMRAAGKLDQPDRFSFKDQDNNEPTNDMVAFSLDGPGGNCVAVLTLFSLGLISVDVRIPEQIIVVDSSMVENEVIKSLGKDGSLEDDEDEEDDLDEGVGGKRRSMEVKPAQASHTNYLLMRGYYSPGIVSTRNLNPNDSIVVNSCQMKFQLRCTPVPARLRPAAAPLEELTMGTSCLPDTFTKLINPQENTCSLEEFVLQLELSGYSPEDLTAALEILEAIIATGCFGIDKEELRRRFSALEKAGGGRTRTFADCIQALLEQHQVLEVGGNTARLVAMGSAWPWLLHSVRLKDREDADIQREDPQARPLEGSSSEDSPPEGQAPPSHSPRGTKRRASWASENGETDAEGTQMTPAKRPALQDSNLAPSLGPGAEDGAEAQAPSPPPALEDTAAAGAAQEDQEGGFTESFGAANISQAARERDCESVCFIGRPWRVVDGHLNLPVCKGMMEAMLYHIMTRPGIPESSLLRHYQGVLQPVAVLELLQGLESLGCIRKRWLRKPRPVSLFSTPVVEEVEVPSSLDESPMAFYEPTLDCTLRLGRVFPHEVNWNKWIHL

SEQ ID NO: 889927 - protein, 554 aa, Homo sapiens
MRAAGKLDQPDRFSFKDQDNNEPTNDMVAFSLDGPGGNCVAVLTLFSLGLISVDVRIPEQIIVVDSSMVENEVIKSLGKDGSLEDDEDEEDDLDEGVGGKRRSMEVKPAQASHTNYLLMRGYYSPGIVSTRNLNPNDSIVVNSCQMKFQLRCTPVPARLRPAAAPLEELTMGTSCLPDTFTKLINPQENTCSLEEFVLQLELSGYSPEDLTAALEILEAIIATGCFGIDKEELRRRFSALEKAGGGRTRTFADCIQALLEQHQVLEVGGNTARLVAMGSAWPWLLHSVRLKDREDADIQREDPQARPLEGSSSEDSPPEGQAPPSHSPRGTKRRASWASENGETDAEGTQMTPAKRPALQDSNLAPSLGPGAEDGAEAQAPSPPPALEDTAAAGAAQEDQEGGFTESFGAANISQAARERDCESVCFIGRPWRVVDGHLNLPVCKGMMEAMLYHIMTRPGIPESSLLRHYQGVLQPVAVLELLQGLESLGCIRKRWLRKPRPVSLFSTPVVEEVEVPSSLDESPMAFYEPTLDCTLRLGRVFPHEVNWNKWIHL

SEQ ID NO: 889928 - protein, 1820 aa, Homo sapiens
WTKALGGALRTPGAPPTEVAMDALESLLDEVALEGLDGLCLPALWSRLETRVPPFPLPLEPCTQEFLWRALATHPGISFYEEPRERPDLQLQDRYEEIDLETGILESRRDPVALEDVYPIHMILENKDGIQGSCRYFKERKNITNDIRTKSLQPRCTMVEAFDRWGKKLIIVASQAMRYRALIGQEGDPDLKLPDFSYCILERLGRSRWQGELQRDLHTTAFKVDAGKLHYHRKILNKNGLITMQSHVIRLPTGAQQHSILLLLNRFHVDRRSKYDILMEKLSVMLSTRTNHIETLGKLREELGLCERTFKRLYQYMLNAGLAKVVSLRLQEIHPECGPCKTKKGTDVMVRCLKLLKEFKRNDHDDDEDEEVISKTVPPVDIVFERDMLTQTYDLIERRGTKGISQAEIRVAMNVGKLEARMLCRLLQRFKVVKGFMEDEGRQRTTKYISCVFAEESDLSRQYQREKARSELLTTVSLASMQEESLLPEGEDTFLSESDSEEERSSSKRRGRGSQKDTRASANLRPKTQPHHSTPTKGGWKVVNLHPLKKQPPSFPGAAEERACQSLASRDSLLDTSSVSEPNVSFVSHCADSNSGDIAVIEEVRMENPKESSSSLKTGRHSSGQDKPHETYRLLKRRNLIIEAVTNLRLIESLFTIQKMIMDQEKQEGVSTKCCKKSIVRLVRNLSEEGLLRLYRTTVIQDGIKKKVDLVVHPSMDQNDPLVRSAIEQVRFRISNSSTANRVKTSQPPVPQGEAEEDSQGKEGPSGSGDSQLSASSRSESGRMKKSDNKMGITPLRNYHPIVVPGLGRSLGFLPKMPRLRVVHMFLWYLIYGHPASNTVEKPSFISERRTIKQESGRAGVRPSSSGSAWEACSEAPSKGSQDGVTWEAEVELATETVYVDDASWMRYIPPIPVHRDFGFGWALVSDILLCLPLSIFIQIVQVSYKVDNLEEFLNDPLKKHTLIRFLPRPIRQQLLYKRRYIFSVVENLQRLCYMGLLQFGPTEKFQDKDQVFIFLKKNAVIVDTTICDPHYNLARSSRPFERRLYVLNSMQDVENYWFDLQCVCLNTPLGVVRCPRVRKNSSTDQGSDEEGSLQKEQESAMDKHNLERKCAMLEYTTGSREVVDEGLIPGDGLGAAGLDSSFYGHLKRNWIWTSYIINQAKKENTAAENGLTVRLQTFLSKRPMPLSARGNSRLNIWGEARVGSELCAGWEEQFEVDREPSLDRNRRVRGGKSQKRKRLKKDPGKKIKRKKKGEFPGEKSKRLRYHDEADQSALQRMTRLRVTWSMQEDGLLVLCRIASNVLNTKVKGPFVTWQVVRDILHATFEESLDKTSHSVGRRARYIVKNPQAYLNYKVCLAEVYQDKALVGDFMNRRGDYDDPKVCANEFKEFVEKLKEKFSSALRNSNLEIPDTLQELFARYRVLAIGDEKDQTRKEDELNSVDDIHFLVLQNLIQSTLALSDSQMKSYQSFQTFRLYREYKDHVLVKAFMECQKRSLVNRRRVNHTLGPKKNRALPFVPMSYQLSQTYYRIFTWRFPSTICTESFQFLDRMRAAGKLDQPDRFSFKDQDNNEPTNDMVAFSLDGPGGNCVAVLTLFSLGLISVDVRIPEQIIVVDSSMVENEVIKSLGKDGSLEDDEDEEDDLDEGVGGKRRSMEVKPAQASHTNYLLMRGYYSPGIVSTRNLNPNDSIVVNSCQMKFQLRCTPVPARLRPAAAPLEELTMGTSCLPDTFTKLINPQENTCSLEEFVLQLELSGYSPEDLTAALEILEAIIATGCFGIDKEELRRRFSALEKAGGGRTRTFADCIQALLEQHQVLEATELL

SEQ ID NO: 889929 - protein, 1654 aa, Homo sapiens
WTKALGGALRTPGAPPTEVAMDALESLLDEVALEGLDGLCLPALWSRLETRVPPFPLPLEPCTQEFLWRALATHPGISFYEEPRERPDLQLQDRYEEIDLETGILESRRDPVALEDVYPIHMILENKDGIQGSCRYFKERKNITNDIRTKSLQPRCTMVEAFDRWGKKLIIVASQAMRYRALIGQEGDPDLKLPDFSYCILERLGRSRWQGELQRDLHTTAFKVDAGKLHYHRKILNKNGLITMQSHVIRLPTGAQQHSILLLLNRFHVDRRSKYDILMEKLSVMLSTRTNHIETLGKLREELGLCERTFKRLYQYMLNAGLAKVVSLRLQEIHPECGPCKTKKGTDVMVRCLKLLKEFKRNDHDDDEDEEVISKTVPPVDIVFERDMLTQTYDLIERRGTKGISQAEIRVAMNVGKLEARMLCRLLQRFKVVKGFMEDEGRQRTTKYISCVFAEESDLSRQYQREKARSELLTTVSLASMQEESLLPEGEDTFLSESDSEEERSSSKRRGRGSQKDTRASANLRPKTQPHHSTPTKGGWKVVNLHPLKKQPPSFPGAAEERACQSLASRDSLLDTSSVSEPNVSFVSHCADSNSGDIAVIEEVRMENPKESSSSLKTGRHSSGQDKPHETYRLLKRRNLIIEAVTNLRLIESLFTIQKMIMDQEKQEGVSTKCCKKSIVRLVRNLSEEGLLRLYRTTVIQDGIKKKVDLVVHPSMDQNDPLVRSAIEQVRFRISNSSTANRVKTSQPPVPQGEAEEDSQGKEGPSGSGDSQLSASSRSESGRMKKSDNKMGITPLRNYHPIVVPGLGRSLGFLPKMPRLRVVHMFLWYLIYGHPASNTVEKPSFISERRTIKQESGRAGVRPSSSGSAWEACSEAPSKGSQDGVTWEAEVELATETVYVDDASWMRYIPPIPVHRDFGFGWALVSDILLCLPLSIFIQIVQVSYKVDNLEEFLNDPLKKHTLIRFLPRPIRQQLLYKRRYIFSVVENLQRLCYMGLLQFGPTEKFQDKDQVFIFLKKNAVIVDTTICDPHYNLARSSRPFERRLYVLNSMQDVENYWFDLQCVCLNTPLGVVRCPRVRKNSSTDQGSDEEGSLQKEQESAMDKHNLERKCAMLEYTTGSREVVDEGLIPGDGLGAAGLDSSFYGHLKRNWIWTSYIINQAKKENTAAENGLTVRLQTFLSKRPMPLSARGNSRLNIWGEARVGSELCAGWEEQFEVDREPSLDRNRRVRGGKSQKRKRLKKDPGKKIKRKKKGEFPGEKSKRLRYHDEADQSALQRMTRLRVTWSMQEDGLLVLCRIASNVLNTKVKGPFVTWQVVRDILHATFEESLDKTSHSVGRRARYIVKNPQAYLNYKVCLAEVYQDKALVGDFMNRRGDYDDPKVCANEFKEFVEKLKEKFSSALRNSNLEIPDTLQELFARYRVLAIGDEKDQTRKEDELNSVDDIHFLVLQNLIQSTLALSDSQMKSYQSFQTFRLYREYKDHVLVKAFMECQKRSLVNRRRVNHTLGPKKNRALPFVPMSYQLSQTYYRIFTWRFPSTICTESFQFLDRMRAAGKLDQPDRFSFKDQDNNEPTNDMVAFSLDGPGGNCVAVLTLFSLGLISVDVRIPEQIIVGSHFVGSAAHEVESLATQCASVSVGILTKAGEVPFKVPMIES

SEQ ID NO: 889930 - protein, 1364 aa, Homo sapiens
WTKALGGALRTPGAPPTEVAMDALESLLDEVALEGLDGLCLPALWSRLETRVPPFPLPLEPCTQEFLWRALATHPGISFYEEPRERPDLQLQDRYEEIDLETGILESRRDPVALEDVYPIHMILENKDGIQGSCRYFKERKNITNDIRTKSLQPRCTMVEAFDRWGKKLIIVASQAMRYRALIGQEGDPDLKLPDFSYCILERLGRSRWQGELQRDLHTTAFKVDAGKLHYHRKILNKNGLITMQSHVIRLPTGAQQHSILLLLNRFHVDRRSKYDILMEKLSVMLSTRTNHIETLGKLREELGLCERTFKRLYQYMLNAGLAKVVSLRLQEIHPECGPCKTKKGTDVMVRCLKLLKEFKRNDHDDDEDEEVISKTVPPVDIVFERDMLTQTYDLIERRGTKGISQAEIRVAMNVGKLEARMLCRLLQRFKVVKGFMEDEGRQRTTKYISCVFAEESDLSRQYQREKARSELLTTVSLASMQEESLLPEGEDTFLSESDSEEERSSSKRRGRGSQKDTRASANLRPKTQPHHSTPTKGGWKVVNLHPLKKQPPSFPGAAEERACQSLASRDSLLDTSSVSEPNVSFVSHCADSNSGDIAVIEEVRMENPKESSSSLKTGRHSSGQDKPHETYRLLKRRNLIIEAVTNLRLIESLFTIQKMIMDQEKQEGVSTKCCKKSIVRLVRNLSEEGLLRLYRTTVIQDGIKKKVDLVVHPSMDQNDPLVRSAIEQVRFRISNSSTANRVKTSQPPVPQGEAEEDSQGKEGPSGSGDSQLSASSRSESGRMKKSDNKMGITPLRNYHPIVVPGLGRSLGFLPKMPRLRVVHMFLWYLIYGHPASNTVEKPSFISERRTIKQESGRAGVRPSSSGSAWEACSEAPSKGSQDGVTWEAEVELATETVYVDDASWMRYIPPIPVHRDFGFGWALVSDILLCLPLSIFIQIVQVSYKVDNLEEFLNDPLKKHTLIRFLPRPIRQQLLYKRRYIFSVVENLQRLCYMGLLQFGPTEKFQDKDQVFIFLKKNAVIVDTTICDPHYNLARSSRPFERRLYVLNSMQDVENYWFDLQCVCLNTPLGVVRCPRVRKNSSTDQGSDEEGSLQKEQESAMDKHNLERKCAMLEYTTGSREVVDEGLIPGDGLGAAGLDSSFYGHLKRNWIWTSYIINQAKKENTAAENGLTVRLQTFLSKRPMPLSARGNSRLNIWGEARVGSELCAGWEEQFEVDREPSLDRNRRVRGGKSQKRKRLKKDPGKKIKRKKKGEFPGEKSKRLRYHDEADQSALQRMTRLRVTWSMQEDGLLVLCRIASNVLNTKVKGPFVTWQVVRDILHATFEESLDKTSHSVGRRARYIVKNPQAYLNYKSAHMVLDKPL

SEQ ID NO: 889931 - protein, 304 aa, Homo sapiens
MGSAWPWLLHSVRLKDREDADIQREDPQARPLEGSSSEDSPPEGQAPPSHSPRGTKRRASWASENGETDAEGTQMTPAKRPALQDSNLAPSLGPGAEDGAEAQAPSPPPALEDTAAAGAAQEDQEGVGEFSSPGQEQLSGQAQPPEGSEDPRGFTESFGAANISQAARERDCESVCFIGRPWRVVDGHLNLPVCKGMMEAMLYHIMTRPGIPESSLLRHYQGVLQPVAVLELLQGLESLGCIRKRWLRKPRPVSLFSTPVVEEVEVPSSLDESPMAFYEPTLDCTLRLGRVFPHEVNWNKWIHL

SEQ ID NO: 889932 - protein, 359 aa, Homo sapiens
TQPQNESSTQNLTVSEERVNTDTRGRTRTFADCIQALLEQHQVLEVGGNTARLVAMGSAWPWLLHSVRLKDREDADIQREDPQARPLEGSSSEDSPPEGQAPPSHSPRGTKRRASWASENGETDAEGTQMTPAKRPALQDSNLAPSLGPGAEDGAEAQAPSPPPALEDTAAAGAAQEDQEGVGEFSSPGQEQLSGQAQPPEGSEDPRGFTESFGAANISQAARERDCESVCFIGRPWRVVDGHLNLPVCKGMMEAMLYHIMTRPGIPESSLLRHYQGVLQPVAVLELLQGLESLGCIRKRWLRKPRPVSLFSTPVVEEVEVPSSLDESPMAFYEPTLDCTLRLGRVFPHEVNWNKWIHL

SEQ ID NO: 889933 - protein, 235 aa, Homo sapiens
MSPPWTVPSGWAVCSPTRSTGTSGSTSRTPVGVPSLPATACHTTPAWCSADPTVPWPWVCRASCSRGRVLWPESQTDTFPTVLELWKEGLPDLPIPQALLGLPLGNWPHHTGSWCFLSLGLQSLPRLCTPHIPDSSHLGRISWLLECPGATKRKGLVGYTLQNRDRCAPLRGAPHGGCGPSAGRTSQPLAGTEPPRAERLPFQPCESPGRPQLGWLSVSLSLAGDSLQARNEESL

SEQ ID NO: 889934 - protein, 266 aa, Homo sapiens
GSAPLVGPGWLFSLWFSNRNVCFEESVPGTLHMAWSRASGSRSREFCHSLEVVSAWAASRAGKSRSHNPCPSPANVGGPTEASVTATSERTPRPGSTQLAVKGPSVQTGEKQGVWKAESKKVAGLSPVTWARPRTPLSLSVLSGRAALLPPPSPDVKPSPCRDCESVCFIGRPWRVVDGHLNLPVCKGMMEAMLYHIMTRPGIPESSLLRHYQGVLQPVAVLELLQVWGLPGFSRVWRRLGALSGPAVMFRPQATCSTTILLACTS

SEQ ID NO: 889935 - protein, 2103 aa, Homo sapiens; identical to SEQ ID NO: 889925

SEQ ID NO: 889936 - protein, 1403 aa, Homo sapiens
CSNLSLQVDLVVHPSMDQNDPLVRSAIEQVRFRISNSSTANRVKTSQPPVPQGEAEEDSQGKEGPSGSGDSQLSASSRSESGRMKKSDNKMGITPLRNYHPIVVPGLGRSLGFLPKMPRLRVVHMFLWYLIYGHPASNTVEKPSFISERRTIKQESGRAGVRPSSSGSAWEACSEAPSKGSQDGVTWEAEVELATETVYVDDASWMRYIPPIPVHRDFGFGWALVSDILLCLPLSIFIQIVQVSYKVDNLEEFLNDPLKKHTLIRFLPRPIRQQLLYKRRYIFSVVENLQRLCYMGLLQFGPTEKFQDKDQVFIFLKKNAVIVDTTICDPHYNLARSSRPFERRLYVLNSMQDVENYWFDLQCVCLNTPLGVVRCPRVRKNSSTDQGSDEEGSLQKEQESAMDKHNLERKCAMLEYTTGSREVVDEGLIPGDGLGAAGLDSSFYGHLKRNWIWTSYIINQAKKENTAAENGLTVRLQTFLSKRPMPLSARGNSRLNIWGEARVGSELCAGWEEQFEVDREPSLDRNRRVRGGKSQKRKRLKKDPGKKIKRKKKGEFPGEKSKRLRYHDEADQSALQRMTRLRVTWSMQEDGLLVLCRIASNVLNTKVKGPFVTWQVVRDILHATFEESLDKTSHSVGRRARYIVKNPQAYLNYKVCLAEVYQDKALVGDFMNRRGDYDDPKVCANEFKEFVEKLKEKFSSALRNSNLEIPDTLQELFARYRVLAIGDEKDQTRKEDELNSVDDIHFLVLQNLIQSTLALSDSQMKSYQSFQTFRLYREYKDHVLVKAFMECQKRSLVNRRRVNHTLGPKKNRALPFVPMSYQLSQTYYRIFTWRFPSTICTESFQFLDRMRAAGKLDQPDRFSFKDQDNNEPTNDMVAFSLDGPGGNCVAVLTLFSLGLISVDVRIPEQIIVVDSSMVENEVIKSLGKDGSLEDDEDEEDDLDEGVGGKRRSMEVKPAQASHTNYLLMRGYYSPGIVSTRNLNPNDSIVVNSCQMKFQLRCTPVPARLRPAAAPLEELTMGTSCLPDTFTKLINPQENTCSLEEFVLQLELSGYSPEDLTAALEILEAIIATGCFGIDKEELRRRFSALEKAGGGRTRTFADCIQALLEQHQVLEVGGNTARLVAMGSAWPWLLHSVRLKDREDADIQREDPQARPLEGSSSEDSPPEGQAPPSHSPRGTKRRASWASENGETDAEGTQMTPAKRPALQDSNLAPSLGPGAEDGAEAQAPSPPPALEDTAAAGAAQEDQEGGFTESFGAANISQAARERDCESVCFIGRPWRVVDGHLNLPVCKGMMEAMLYHIMTRPGIPESSLLRHYQGVLQPVAVLELLQGLESLGCIRKRWLRKPRPVSLFSTPVVEEVEVPSSLDESPMAFYEPTLDCTLRLGRVFPHEVNWNKWIHL

SEQ ID NO: 889937 - protein, 665 aa, Homo sapiens
IVIQALVSSDSVSPEHLLAPLQRVMMKSYQSFQTFRLYREYKDHVLVKAFMECQKRSLVNRRRVNHTLGPKKNRALPFVPMSYQLSQTYYRIFTWRFPSTICTESFQFLDRMRAAGKLDQPDRFSFKDQDNNEPTNDMVAFSLDGPGGNCVAVLTLFSLGLISVDVRIPEQIIVVDSSMVENEVIKSLGKDGSLEDDEDEEDDLDEGVGGKRRSMEVKPAQASHTNYLLMRGYYSPGIVSTRNLNPNDSIVVNSCQMKFQLRCTPVPARLRPAAAPLEELTMGTSCLPDTFTKLINPQENTCSLEEFVLQLELSGYSPEDLTAALEILEAIIATGCFGIDKEELRRRFSALEKAGGGRTRTFADCIQALLEQHQVLEVGGNTARLVAMGSAWPWLLHSVRLKDREDADIQREDPQARPLEGSSSEDSPPEGQAPPSHSPRGTKRRASWASENGETDAEGTQMTPAKRPALQDSNLAPSLGPGAEDGAEAQAPSPPPALEDTAAAGAAQEDQEGGFTESFGAANISQAARERDCESVCFIGRPWRVVDGHLNLPVCKGMMEAMLYHIMTRPGIPESSLLRHYQGVLQPVAVLELLQGLESLGCIRKRWLRKPRPVSLFSTPVVEEVEVPSSLDESPMAFYEPTLDCTLRLGRVFPHEVNWNKWIHL

SEQ ID NO: 889938 - protein, 846 aa, Homo sapiens
WTKALGGALRTPGAPPTEVAMDALESLLDEVALEGLDGLCLPALWSRLETRVPPFPLPLEPCTQEFLWRALATHPGISFYEEPRERPDLQLQDRYEEIDLETGILESRRDPVALEDVYPIHMILENKDGIQGSCRYFKERKNITNDIRTKSLQPRCTMVEAFDRWGKKLIIVASQAMRYRALIGQEGDPDLKLPDFSYCILERLGRSRWQGELQRDLHTTAFKVDAGKLHYHRKILNKNGLITMQSHVIRLPTGAQQHSILLLLNRFHVDRRSKYDILMEKLSVMLSTRTNHIETLGKLREELGLCERTFKRLYQYMLNAGLAKVVSLRLQEIHPECGPCKTKKGTDVMVRCLKLLKEFKRNDHDDDEDEEVISKTVPPVDIVFERDMLTQTYDLIERRGTKGISQAEIRVAMNVGKLEARMLCRLLQRFKVVKGFMEDEGRQRTTKYISCVFAEESDLSRQYQREKARSELLTTVSLASMQEESLLPEGEDTFLSESDSEEERSSSKRRGRGSQKDTRASANLRPKTQPHHSTPTKGGWKVVNLHPLKKQPPSFPGAAEERACQSLASRDSLLDTSSVSEPNVSFVSHCADSNSGDIAVIEEVRMENPKESSSSLKTGRHSSGQDKPHETYRLLKRRNLIIEAVTNLRLIESLFTIQKMIMDQEKQEVGEFSSPGQEQLSGQAQPPEGSEDPRGFTESFGAANISQAARERDCESVCFIGRPWRVVDGHLNLPVCKGMMEAMLYHIMTRPGIPESSLLRHYQGVLQPVAVLELLQGLESLGCIRKRWLRKPRPVSLFSTPVVEEVEVPSSLDESPMAFYEPTLDCTLRLGRVFPHEVNWNKWIHL

SEQ ID NO: 889939 - protein, 1419 aa, Homo sapiens
WTKALGGALRTPGAPPTEVAMDALESLLDEVALEGLDGLCLPALWSRLETRVPPFPLPLEPCTQEFLWRALATHPGISFYEEPRERPDLQLQDRYEEIDLETGILESRRDPVALEDVYPIHMILENKDGIQGSCRYFKERKNITNDIRTKSLQPRCTMVEAFDRWGKKLIIVASQAMRYRALIGQEGDPDLKLPDFSYCILERLGRSRWQGELQRDLHTTAFKVDAGKLHYHRKILNKNGLITMQSHVIRLPTGAQQHSILLLLNRFHVDRRSKYDILMEKLSVMLSTRTNHIETLGKLREELGLCERTFKRLYQYMLNAGLAKVVSLRLQEIHPECGPCKTKKGTDVMVRCLKLLKEFKRNDHDDDEDEEVISKTVPPVDIVFERDMLTQTYDLIERRGTKGISQAEIRVAMNVGKLEARMLCRLLQRFKVVKGFMEDEGRQRTTKYISCVFAEESDLSRQYQREKARSELLTTVSLASMQEESLLPEGEDTFLSESDSEEERSSSKRRGRGSQKDTRASANLRPKTQPHHSTPTKGGWKVVNLHPLKKQPPSFPGAAEERACQSLASRDSLLDTSSVSEPNVSFVSHCADSNSGDIAVIEEVRMENPKESSSSLKTGRHSSGQDKPHETYRLLKRRNLIIEAVTNLRLIESLFTIQKMIMDQEKQEGVSTKCCKKSIVRLVRNLSEEGLLRLYRTTVIQDGIKKKVDLVVHPSMDQNDPLVRSAIEQVRFRISNSSTANRVKTSQPPVPQGEAEEDSQGKEGPSGSGDSQLSASSRSESGRMKKSDNKMGITPLRNYHPIVVPGLGRSLGFLPKMPRLRVVHMFLWYLIYGHPASNTVEKPSFISERRTIKQESGRAGVRPSSSGSAWEACSEAPSKGSQDGVTWEAEVELATETVYVDDASWMRYIPPIPVHRDFGFGWALVSDILLCLPLSIFIQIVQVSYKVDNLEEFLNDPLKKHTLIRFLPRPIRQQLLYKRRYIFSVVENLQRLCYMGLLQFGPTEKFQDKDQVFIFLKKNAVIVDTTICDPHYNLARSSRPFERRLYVLNSMQDVENYWFDLQCVCLNTPLGVVRCPRVRKNSSTDQGSDEEGSLQKEQESAMDKHNLERKCAMLEYTTGSREVVDEGLIPGDGLGAAGLDSSFYGHLKRNWIWTSYIINQAKKENTAAENGLTVRLQTFLSKRPMPLSARGNSRLNIWGEARVGSELCAGWEEQFEVDREPSLDRNRRVRGGKSQKRKRLKKDPGKKIKRKKKGEFPGEKSKRLRYHDEADQSALQRMTRLRVTWSMQEDGLLVLCRIASNVLNTKVKGPFVTWQVVRDILHATFEESLDKTSHSVGRRARYIVKNPQAYLNYKVCLAEVYQDKALVGDFMNRRGDYDDPKVCANEFKEFVEKLKEKFSSALRNSNLEIPDTLQELFAR

SEQ ID NO: 889940 - protein, 278 aa, Homo sapiens
MGSAWPWLLHSVRLKDREDADIQREDPQARPLEGSSSEDSPPEGQAPPSHSPRGTKRRASWASENGETDAEGTQMTPAKRPALQDSNLAPSLGPGAEDGAEAQAPSPPPALEDTAAAGAAQEDQEGGFTESFGAANISQAARERDCESVCFIGRPWRVVDGHLNLPVCKGMMEAMLYHIMTRPGIPESSLLRHYQGVLQPVAVLELLQGLESLGCIRKRWLRKPRPVSLFSTPVVEEVEVPSSLDESPMAFYEPTLDCTLRLGRVFPHEVNWNKWIHL

SEQ ID NO: 889941 - protein, 1095 aa, Homo sapiens
WTKALGGALRTPGAPPTEVAMDALESLLDEVALEGLDGLCLPALWSRLETRVPPFPLPLEPCTQEFLWRALATHPGISFYEEPRERPDLQLQDRYEEIDLETGILESRRDPVALEDVYPIHMILENKDGIQGSCRYFKERKNITNDIRTKSLQPRCTMVEAFDRWGKKLIIVASQAMRYRALIGQEGDPDLKLPDFSYCILERLGRSRWQGELQRDLHTTAFKVDAGKLHYHRKILNKNGLITMQSHVIRLPTGAQQHSILLLLNRFHVDRRSKYDILMEKLSVMLSTRTNHIETLGKLREELGLCERTFKRLYQYMLNAGLAKVVSLRLQEIHPECGPCKTKKGTDVMVRCLKLLKEFKRNDHDDDEDEEVISKTVPPVDIVFERDMLTQTYDLIERRGTKGISQAEIRVAMNVGKLEARMLCRLLQRFKVVKGFMEDEGRQRTTKYISCVFAEESDLSRQYQREKARSELLTTVSLASMQEESLLPEGEDTFLSESDSEEERSSSKRRGRGSQKDTRASANLRPKTQPHHSTPTKGGWKVVNLHPLKKQPPSFPGAAEERACQSLASRDSLLDTSSVSEPNVSFVSHCADSNSGDIAVIEEVRMENPKESSSSLKTGRHSSGQDKPHETYRLLKRRNLIIEAVTNLRLIESLFTIQKMIMDQEKQEGVSTKCCKKSIVRLVRNLSEEGLLRLYRTTVIQDGIKKKVDLVVHPSMDQNDPLVRSAIEQVRFRISNSSTANRVKTSQPPVPQGEAEEDSQGKEGPSGSGDSQLSASSRSESGRMKKSDNKMGITPLRNYHPIVVPGLGRSLGFLPKMPRLRVVHMFLWYLIYGHPASNTVEKPSFISERRTIKQESGRAGVRPSSSGSAWEACSEAPSKGSQDGVTWEAEVELATETVYVDDASWMRYIPPIPVHRDFGFGWALVSDILLCLPLSIFIQIVQVSYKVDNLEEFLNDPLKKHTLIRFLPRPIRQQLLYKRRYIFSVVENLQRLCYMGLLQFGPTEKFQDKDQVFIFLKKNAVIVDTTICDPHYNLARSSRPFERRLYVLNSMQDVENYWFDLQCVCLNTPLGVVPARASGRTAAPRRRIPHHNGYA

SEQ ID NO: 889942 - protein, 846 aa, Homo sapiens; identical to SEQ ID NO: 889938

SEQ ID NO: 889943 - protein, 224 aa, Homo sapiens
MPGRAPLRTVPGALGAWLLGGLWAWTLCGLCSLGAVGAPRPCQAPQQWEGRQVMYQQSSGRNSRALLSYDGLNQRVRVLDERKALIPCKRLFEYILLYKDGVMFQIDQATKQCSKMTLTQPWDPLDIPQNSTFEDQYSIGGPQEQITVQEWSDRKSARSYETWIGIYTVKDCYPVQETFTINYSVILSTRFFDIQLGIKDPSVFTPPSTCQMAQLEKMSEDCSW

SEQ ID NO: 889944 - protein, 344 aa, Homo sapiens
MPPRMLVAPLPLHFLLAAVSSENRSGRRQWQQAVAAGSGPGRNSSRAIHWSLPRALVPATGTRASGSQKRQRPPKGQEALWSRPHSRHSAERAGGSHSDPGRLSAPLGLGLPSGRGRLTAMPGRAPLRTVPGALGAWLLGGLWAWTLCGLCSLGAVGAPRPCQAPQQWEGRQVMYQQSSGRNSRALLSYDGLNQRVRVLDERKALIPCKRLFEYILLYKDGVMFQIDQATKQCSKMTLTQPWDPLDIPQNSTFEDQYSIGGPQEQITVQEWSDRKSARSYETWIGIYTVKDCYPVQETFTINYSVILSTRFFDIQLGIKDPSVFTPPSTCQMAQLEKMSEDCSW

SEQ ID NO: 889945 - protein, 214 aa, Homo sapiens
MPPRMLVAPLPLHFLLAAVSSENRSGRRQWQQAVAAGSGPGRNSSRAIHWSLPRALVPATGTRASGSQKRQRPPKGQEALWSRPHSRHSAERAGGSHSDPGRLSAPLGLGLPSGRGRLTAMPGRAPLRTVPGALGAWLLGGLWAWTLCGLCSLGAVGAPRPCQAPQQWEGRQVMYQQSSGRNSRALLSYDGLNQRVRVLDERKALIPCKSAPGE

SEQ ID NO: 889946 - protein, 344 aa, Homo sapiens; identical to SEQ ID NO: 889944

SEQ ID NO: 889947 - protein, 210 aa, Homo sapiens
MPPRMLVAPLPLHFLLAAVSSENRSGRRQWQQAVAAGSGPGRNSSRAIHWSLPRALVPATGTRASGSQKRQRPPKGQEALWSRPHSRHSAERAGGSHSDPGRLSAPLGLGLPSGRGRLTAMPGRAPLRTVPGALGAWLLGGLWAWTLCGLCSLGAVGAPRPCQAPQQWEGRQVMYQQSSGRNSRALLSYDGLNQRVRVLDERKALIPCKR

SEQ ID NO: 889948 - protein, 1003 aa, Homo sapiens
GTAAGIRVRSAASQARAVWDPSARTPAPAKEPGMAQLERSAISGFSSKSRRNSFAYDVKREVYNEETFQQEHKRKASSSGNMNINITTFRHHVQCRCSWHRFLRCVLTIFPFLEWMCMYRLKDWLLGDLLAGISVGLVQVPQGLTLSLLARQLIPPLNIAYAAFCSSVIYVIFGSCHQMSIGSFFLVSALLINVLKVSPFNNGQLVMGSFVKNEFSAPSYLMGYNKSLSVVATTTFLTGIIQLIMGVLGLGFIATYLPESAMSAYLAAVALHIMLSQLTFIFGIMISFHAGPISFFYDIINYCVALPKANSTSILVFLTVVVALRINKCIRISFNQYPIEFPMELFLIIGFTVIANKISMATETSQTLIDMIPYSFLLPVTPDFSLLPKIILQAFSLSLVSSFLLIFLGKKIASLHNYSVNSNQDLIAIGLCNVVSSFFRSCVFTGAIARTIIQDKSGGRQQFASLVGAGVMLLLMVKMGHFFYTLPNAVLAGIILSNVIPYLETISNLPSLWRQDQYDCALWMMTFSSSIFLGLDIGLIISVVSAFFITTVRSHRAKILLLGQIPNTNIYRSINDYREIITIPGVKIFQCCSSITFVNVYYLKHKLLKEVDMVKVPLKEEEIFSLFNSSDTNLQGGKICRCFCNCDDLEPLPRILYTERFENKLDPEASSINLIHCSHFESMNTSQTASEDQVPYTVSSVSQKNQGQQYEEVEEVWLPNNSSRNSSPGLPDVAESQGRRSLIPYSDASLLPSVHTIILDFSMVHYVDSRGLVVLRQICNAFQNANILILIAGCHSSIVRAFERNDFFDAGITKTQLFLSVHDAVLFALSRKVIGSSELSIDESETVIRETYSETDKNDNSRYKMSSSFLGSQKNVSPGFIKIQQPVEEESELDLELESEQEAGLGLDLDLDRELEPEMEPKAETETKTQTEMEPQPETEPEMEPNPKSRPRAHTFPQQRYWPMYHPSMASTQSQTQTRTWSVERRRHPMDSYSPEGNSNEDV

SEQ ID NO: 889949 - protein, 970 aa, Homo sapiens
MAQLERSAISGFSSKSRRNSFAYDVKREVYNEETFQQEHKRKASSSGNMNINITTFRHHVQCRCSWHRFLRCVLTIFPFLEWMCMYRLKDWLLGDLLAGISVGLVQVPQGLTLSLLARQLIPPLNIAYAAFCSSVIYVIFGSCHQMSIGSFFLVSALLINVLKVSPFNNGQLVMGSFVKNEFSAPSYLMGYNKSLSVVATTTFLTGIIQLIMGVLGLGFIATYLPESAMSAYLAAVALHIMLSQLTFIFGIMISFHAGPISFFYDIINYCVALPKANSTSILVFLTVVVALRINKCIRISFNQYPIEFPMELFLIIGFTVIANKISMATETSQTLIDMIPYSFLLPVTPDFSLLPKIILQAFSLSLVSSFLLIFLGKKIASLHNYSVNSNQDLIAIGLCNVVSSFFRSCVFTGAIARTIIQDKSGGRQQFASLVGAGVMLLLMVKMGHFFYTLPNAVLAGIILSNVIPYLETISNLPSLWRQDQYDCALWMMTFSSSIFLGLDIGLIISVVSAFFITTVRSHRAKILLLGQIPNTNIYRSINDYREIITIPGVKIFQCCSSITFVNVYYLKHKLLKEVDMVKVPLKEEEIFSLFNSSDTNLQGGKICRCFCNCDDLEPLPRILYTERFENKLDPEASSINLIHCSHFESMNTSQTASEDQVPYTVSSVSQKNQGQQYEEVEEVWLPNNSSRNSSPGLPDVAESQGRRSLIPYSDASLLPSVHTIILDFSMVHYVDSRGLVVLRQICNAFQNANILILIAGCHSSIVRAFERNDFFDAGITKTQLFLSVHDAVLFALSRKVIGSSELSIDESETVIRETYSETDKNDNSRYKMSSSFLGSQKNVSPGFIKIQQPVEEESELDLELESEQEAGLGLDLDLDRELEPEMEPKAETETKTQTEMEPQPETEPEMEPNPKSRPRAHTFPQQRYWPMYHPSMASTQSQTQTRTWSVERRRHPMDSYSPEGNSNEDV

SEQ ID NO: 889950 - protein, 321 aa, Homo sapiens
MNTSQTASEDQVPYTVSSVSQKNQGQQYEEVEEVWLPNNSSRNSSPGLPDVAESQGRRSLIPYSDASLLPSVHTIILDFSMVHYVDSRGLVVLRQICNAFQNANILILIAGCHSSIVRAFERNDFFDAGITKTQLFLSVHDAVLFALSRKVIGSSELSIDESETVIRETYSETDKNDNSRYKMSSSFLGSQKNVSPGFIKIQQPVEEESELDLELESEQEAGLGLDLDLDRELEPEMEPKAETETKTQTEMEPQPETEPEMEPNPKSRPRAHTFPQQRYWPMYHPSMASTQSQTQTRTWSVERRRHPMDSYSPEGNSNEDV

SEQ ID NO: 889951 - protein, 150 aa, Homo sapiens
GRYLCAHLGVAEKTQLLKLSVPATFMLVSLDEGPGPPIKYQYAELGKLYSVVSQLIRCCNVSSRMQSSINGNPPLPNPFGDPNLSQPIMPIQQNVADILFVRTSYVKKIIEDCSNSEETVKLLRFCCWENPQFSSTVLSELLWQVAYSYT

SEQ ID NO: 889952 - protein, 2547 aa, Homo sapiens
MTATTRGSPVGGNDNQGQAPDGQSLPPLQQNQTSSPDSSNENSPATPPDEQGQGDAPPQLEDEEPAFPHTDLAKLDDMINRPRWVVPVLPKGELEVLLEAAIDLSKKGLDVKSEACQRFFRDGLTISFTKILTDEAVSGWKFEIHSCLVELCVAKLSQDWFPLLELLAMALNPHCKFHIYNGTRPCESVSSSVQLPEDELFARSPDPRSPKGWLVDLLNKFGTLNGFQILHDRFINGSALNVQIIAALIKPFGQCYEFLTLHTVKKYFLPIIEMVPQFLENLTDEELKKEAKNEAKNDALSMIIKSLKNLASRVPGQEETVKNLEIFRLKMILRLLQISSFNGKMNALNEVNKVISSVSYYTHRHGNPEEEEWLTAERMAEWIQQNNILSIVLRDSLHQPQYVEKLEKILRFVIKEKALTLQDLDNIWAAQAGKHEAIVKNVHDLLAKLAWDFSPEQLDHPFDCFKASRTNASKKQREKLLELIRRLAEDDKDGVMAHRVLNLLWNLAHSDDVPVDIMDLALSAHIKILDYSCSQDRDTQKIQWIDRFIEELRTNDKWVIPALKQIREICSLFGEAPQNLSQTQRSPHVFYRHDLINQLQHNHALVTLVAENLATYMESMRLYARDHEDYDPQTVRLGSRYSHVQEVQERLNFLRFLLKDGQLWLCAPQAKQIWKCLAENAVYLCDREACFKWYSKLMGDEPDLDPDINKDFFESNVLQLDPSLLTENGMKCFERFFKAVNCREGKLVAKRRAYMMDDLELIGLDYLWRVVIQSNDDIASRAIDLLKEIYTNLGPRLQVNQVVIHEDFIQSCFDRLKASYDTLCVLDGDKDSVNCARQEAVRMVRVLTVLREYINECDSDYHEERTILPMSRAFRGKHLSFVVRFPNQGRQVDDLEVWSHTNDTIGSVRRCILNRIKANVAHTKIELFVGGELIDPADDRKLIGQLNLKDKSLITAKLTQISSNMPSSPDSSSDSSTGSPGNHGNHYSDGPNPEVESCLPGVIMSLHPRYISFLWQVADLGSSLNMPPLRDGARVLMKLMPPDSTTIEKLRAICLDHAKLGESSLSPSLDSLFFGPSASQVLYLTEVVYALLMPAGAPLADDSSDFQFHFLKSGGLPLVLSMLTRNNFLPNADMETRRGAYLNALKIAKLLLTAIGYGHVRAVAEACQPGVEGVNPMTQINQVTHDQAVVLQSALQSIPNPSSECMLRNVSVRLAQQISDEASRYMPDICVIRAIQKIIWASGCGSLQLVFSPNEEITKIYEKTNAGNEPDLEDEQVCCEALEVMTLCFALIPTALDALSKEKAWQTFIIDLLLHCHSKTVRQVAQEQFFLMCTRCCMGHRPLLFFITLLFTVLGSTARERAKHSGDYFTLLRHLLNYAYNSNINVPNAEVLLNNEIDWLKRIRDDVKRTGETGIEETILEGHLGVTKELLAFQTSEKKFHIGCEKGGANLIKELIDDFIFPASNVYLQYMRNGELPAEQAIPVCGSPPTINAGFELLVALAVGCVRNLKQIVDSLTEMYYIGTAITTCEALTEWEYLPPVGPRPPKGFVGLKNAGATCYMNSVIQQLYMIPSIRNGILAIEGTGSDVDDDMSGDEKQDNESNVDPRDDVFGYPQQFEDKPALSKTEDRKEYNIGVLRHLQVIFGHLAASRLQYYVPRGFWKQFRLWGEPVNLREQHDALEFFNSLVDSLDEALKALGHPAMLSKVLGGSFADQKICQGCPHRYECEESFTTLNVDIRNHQNLLDSLEQYVKGDLLEGANAYHCEKCNKKVDTVKRLLIKKLPPVLAIQLKRFDYDWERECAIKFNDYFEFPRELDMEPYTVAGVAKLEGDNVNPESQLIQQSEQSESETAGSTKYRLVGVLVHSGQASGGHYYSYIIQRNGGDGERNRWYKFDDGDVTECKMDDDEEMKNQCFGGEYMGEVFDHMMKRMSYRRQKRWWNAYILFYERMDTIDQDDELIRYISELAITTRPHQIIMPSAIERSVRKQNVQFMHNRMQYSMEYFQFMKKLLTCNGVYLNPPPGQDHLLPEAEEITMISIQLAARFLFTTGFHTKKVVRGSASDWYDALCILLRHSKNVRFWFAHNVLFNVSNRFSEYLLECPSAEVRGAFAKLIVFIAHFSLQDGPCPSPFASPGPSSQAYDNLSLSDHLLRAVLNLLRREVSEHGRHLQQYFNLFVMYANLGVAEKTQLLKLSVPATFMLVSLDEGPGPPIKYQYAELGKLYSVVSQLIRCCNVSSRMQSSINGNPPLPNPFGDPNLSQPIMPIQQNVADILFVRTSYVKKIIEDCSNSEETVKLLRFCCWENPQFSSTVLSELLWQVAYSYTYELRPYLDLLLQILLIEDSWQTHRIHNALKGIPDDRDGLFDTIQRSKNHYQKRAYQCIKCMVALFSNCPVAYQILQGNGDLKRKWTWAVEWLGDELERRPYTGNPQYTYNNWSPPVQSNETSNGYFLERSHSARMTLAKACELCPEEEPDDQDAPDEHESPPPEDAPLYPHSPGSQYQQNNHVHGQPYTGPAAHHMNNPQRTGQRAQENYEGSEEVSPPQTKDQ

SEQ ID NO: 889953 - protein, 2547 aa, Homo sapiens; identical to SEQ ID NO: 889952

SEQ ID NO: 889954 - protein, 2547 aa, Homo sapiens; identical to SEQ ID NO: 889952

SEQ ID NO: 889955 - protein, 2563 aa, Homo sapiens
MTATTRGSPVGGNDNQGQAPDGQSLPPLQQNQTSSPDSSNENSPATPPDEQGQGDAPPQLEDEEPAFPHTDLAKLDDMINRPRWVVPVLPKGELEVLLEAAIDLSKKGLDVKSEACQRFFRDGLTISFTKILTDEAVSGWKFEIHSCLVELCVAKLSQDWFPLLELLAMALNPHCKFHIYNGTRPCESVSSSVQLPEDELFARSPDPRSPKGWLVDLLNKFGTLNGFQILHDRFINGSALNVQIIAALIKPFGQCYEFLTLHTVKKYFLPIIEMVPQFLENLTDEELKKEAKNEAKNDALSMIIKSLKNLASRVPGQEETVKNLEIFRLKMILRLLQISSFNGKMNALNEVNKVISSVSYYTHRHGNPEEEEWLTAERMAEWIQQNNILSIVLRDSLHQPQYVEKLEKILRFVIKEKALTLQDLDNIWAAQAGKHEAIVKNVHDLLAKLAWDFSPEQLDHPFDCFKASRTNASKKQREKLLELIRRLAEDDKDGVMAHRVLNLLWNLAHSDDVPVDIMDLALSAHIKILDYSCSQDRDTQKIQWIDRFIEELRTNDKWVIPALKQIREICSLFGEAPQNLSQTQRSPHVFYRHDLINQLQHNHALVTLVAENLATYMESMRLYARDHEDYDPQTVRLGSRYSHVQEVQERLNFLRFLLKDGQLWLCAPQAKQIWKCLAENAVYLCDREACFKWYSKLMGDEPDLDPDINKDFFESNVLQLDPSLLTENGMKCFERFFKAVNCREGKLVAKRRAYMMDDLELIGLDYLWRVVIQSNDDIASRAIDLLKEIYTNLGPRLQVNQVVIHEDFIQSCFDRLKASYDTLCVLDGDKDSVNCARQEAVRMVRVLTVLREYINECDSDYHEERTILPMSRAFRGKHLSFVVRFPNQGRQVDDLEVWSHTNDTIGSVRRCILNRIKANVAHTKIELFVGGELIDPADDRKLIGQLNLKDKSLITAKLTQISSNMPSSPDSSSDSSTGSPGNHGNHYSDGPNPEVESCLPGVIMSLHPRYISFLWQVADLGSSLNMPPLRDGARVLMKLMPPDSTTIEKLRAICLDHAKLGESSLSPSLDSLFFGPSASQVLYLTEVVYALLMPAGAPLADDSSDFQFHFLKSGGLPLVLSMLTRNNFLPNADMETRRGAYLNALKIAKLLLTAIGYGHVRAVAEACQPGVEGVNPMTQINQVTHDQAVVLQSALQSIPNPSSECMLRNVSVRLAQQISDEASRYMPDICVIRAIQKIIWASGCGSLQLVFSPNEEITKIYEKTNAGNEPDLEDEQVCCEALEVMTLCFALIPTALDALSKEKAWQTFIIDLLLHCHSKTVRQVAQEQFFLMCTRCCMGHRPLLFFITLLFTVLGSTARERAKHSGDYFTLLRHLLNYAYNSNINVPNAEVLLNNEIDWLKRIRDDVKRTGETGIEETILEGHLGVTKELLAFQTSEKKFHIGCEKGGANLIKELIDDFIFPASNVYLQYMRNGELPAEQAIPVCGSPPTINAGFELLVALAVGCVRNLKQIVDSLTEMYYIGTAITTCEALTEWEYLPPVGPRPPKGFVGLKNAGATCYMNSVIQQLYMIPSIRNGILAIEGTGSDVDDDMSGDEKQDNESNVDPRDDVFGYPQQFEDKPALSKTEDRKEYNIGVLRHLQVIFGHLAASRLQYYVPRGFWKQFRLWGEPVNLREQHDALEFFNSLVDSLDEALKALGHPAMLSKVLGGSFADQKICQGCPHRYECEESFTTLNVDIRNHQNLLDSLEQYVKGDLLEGANAYHCEKCNKKVDTVKRLLIKKLPPVLAIQLKRFDYDWERECAIKFNDYFEFPRELDMEPYTVAGVAKLEGDNVNPESQLIQQSEQSESETAGSTKYRLVGVLVHSGQASGGHYYSYIIQRNGGDGERNRWYKFDDGDVTECKMDDDEEMKNQCFGGEYMGEVFDHMMKRMSYRRQKRWWNAYILFYERMDTIDQDDELIRYISELAITTRPHQIIMPSAIERSVRKQNVQFMHNRMQYSMEYFQFMKKLLTCNGVYLNPPPGQDHLLPEAEEITMISIQLAARFLFTTGFHTKKVVRGSASDWYDALCILLRHSKNVRFWFAHNVLFNVSNRFSEYLLECPSAEVRGAFAKLIVFIAHFSLQDGPCPSPFASPGPSSQAYDNLSLSDHLLRAVLNLLRREVSEHGRHLQQYFNLFVMYANLGVAEKTQLLKLSVPATFMLVSLDEGPGPPIKYQYAELGKLYSVVSQLIRCCNVSSRMQSSINGNPPLPNPFGDPNLSQPIMPIQQNVADILFVRTSYVKKIIEDCSNSEETVKLLRFCCWENPQFSSTVLSELLWQVAYSYTYELRPYLDLLLQILLIEDSWQTHRIHNALKGIPDDRDGLFDTIQRSKNHYQKRAYQCIKCMVALFSNCPVAYQILQGNGDLKRKWTWAVEWLGDELERRPYTGNPQYTYNNWSPPVQSNETSNGYFLERSHSARMTLAKACELCPEEVKKATSVQQIEMEESKEPDDQDAPDEHESPPPEDAPLYPHSPGSQYQQNNHVHGQPYTGPAAHHMNNPQRTGQRAQENYEGSEEVSPPQTKDQ

SEQ ID NO: 889956 - protein, 2477 aa, Homo sapiens
MINRPRWVVPVLPKGELEVLLEAAIDLSKKGLDVKSEACQRFFRDGLTISFTKILTDEAVSGWKFEIHRCIINNTHRLVELCVAKLSQDWFPLLELLAMALNPHCKFHIYNGTRPCESVSSSVQLPEDELFARSPDPRSPKGWLVDLLNKFGTLNGFQILHDRFINGSALNVQIIAALIKPFGQCYEFLTLHTVKKYFLPIIEMVPQFLENLTDEELKKEAKNEAKNDALSMIIKSLKNLASRVPGQEETVKNLEIFRLKMILRLLQISSFNGKMNALNEVNKVISSVSYYTHRHGNPEEEEWLTAERMAEWIQQNNILSIVLRDSLHQPQYVEKLEKILRFVIKEKALTLQDLDNIWAAQAGKHEAIVKNVHDLLAKLAWDFSPEQLDHPFDCFKASRTNASKKQREKLLELIRRLAEDDKDGVMAHRVLNLLWNLAHSDDVPVDIMDLALSAHIKILDYSCSQDRDTQKIQWIDRFIEELRTNDKWVIPALKQIREICSLFGEAPQNLSQTQRSPHVFYRHDLINQLQHNHALVTLVAENLATYMESMRLYARDHEDYDPQTVRLGSRYSHVQEVQERLNFLRFLLKDGQLWLCAPQAKQIWKCLAENAVYLCDREACFKWYSKLMGDEPDLDPDINKDFFESNVLQLDPSLLTENGMKCFERFFKAVNCREGKLVAKRRAYMMDDLELIGLDYLWRVVIQSNDDIASRAIDLLKEIYTNLGPRLQVNQVVIHEDFIQSCFDRLKASYDTLCVLDGDKDSVNCARQEAVRMVRVLTVLREYINECDSDYHEERTILPMSRAFRGKHLSFVVRFPNQGRQVDDLEVWSHTNDTIGSVRRCILNRIKANVAHTKIELFVGGELIDPADDRKLIGQLNLKDKSLITAKLTQISSNMPSSPDSSSDSSTGSPGNHGNHYSDGPNPEVESCLPGVIMSLHPRYISFLWQVADLGSSLNMPPLRDGARVLMKLMPPDSTTIEKLRAICLDHAKLGESSLSPSLDSLFFGPSASQVLYLTEVVYALLMPAGAPLADDSSDFQFHFLKSGGLPLVLSMLTRNNFLPNADMETRRGAYLNALKIAKLLLTAIGYGHVRAVAEACQPGVEGVNPMTQINQVTHDQAVVLQSALQSIPNPSSECMLRNVSVRLAQQISDEASRYMPDICVIRAIQKIIWASGCGSLQLVFSPNEEITKIYEKTNAGNEPDLEDEQVCCEALEVMTLCFALIPTALDALSKEKAWQTFIIDLLLHCHSKTVRQVAQEQFFLMCTRCCMGHRPLLFFITLLFTVLGSTARERAKHSGDYFTLLRHLLNYAYNSNINVPNAEVLLNNEIDWLKRIRDDVKRTGETGIEETILEGHLGVTKELLAFQTSEKKFHIGCEKGGANLIKELIDDFIFPASNVYLQYMRNGELPAEQAIPVCGSPPTINAGFELLVALAVGCVRNLKQIVDSLTEMYYIGTAITTCEALTEWEYLPPVGPRPPKGFVGLKNAGATCYMNSVIQQLYMIPSIRNGILAIEGTGSDVDDDMSGDEKQDNESNVDPRDDVFGYPQQFEDKPALSKTEDRKEYNIGVLRHLQVIFGHLAASRLQYYVPRGFWKQFRLWGEPVNLREQHDALEFFNSLVDSLDEALKALGHPAMLSKVLGGSFADQKICQGCPHRYECEESFTTLNVDIRNHQNLLDSLEQYVKGDLLEGANAYHCEKCNKKVDTVKRLLIKKLPPVLAIQLKRFDYDWERECAIKFNDYFEFPRELDMEPYTVAGVAKLEGDNVNPESQLIQQSEQSESETAGSTKYRLVGVLVHSGQASGGHYYSYIIQRNGGDGERNRWYKFDDGDVTECKMDDDEEMKNQCFGGEYMGEVFDHMMKRMSYRRQKRWWNAYILFYERMDTIDQDDELIRYISELAITTRPHQIIMPSAIERSVRKQNVQFMHNRMQYSMEYFQFMKKLLTCNGVYLNPPPGQDHLLPEAEEITMISIQLAARFLFTTGFHTKKVVRGSASDWYDALCILLRHSKNVRFWFAHNVLFNVSNRFSEYLLECPSAEVRGAFAKLIVFIAHFSLQDGPCPSPFASPGPSSQAYDNLSLSDHLLRAVLNLLRREVSEHGRHLQQYFNLFVMYANLGVAEKTQLLKLSVPATFMLVSLDEGPGPPIKYQYAELGKLYSVVSQLIRCCNVSSRMQSSINGNPPLPNPFGDPNLSQPIMPIQQNVADILFVRTSYVKKIIEDCSNSEETVKLLRFCCWENPQFSSTVLSELLWQVAYSYTYELRPYLDLLLQILLIEDSWQTHRIHNALKGIPDDRDGLFDTIQRSKNHYQKRAYQCIKCMVALFSNCPVAYQILQGNGDLKRKWTWAVEWLGDELERRPYTGNPQYTYNNWSPPVQSNETSNGYFLERSHSARMTLAKACELCPEEEPDDQDAPDEHESPPPEDAPLYPHSPGSQYQQNNHVHGQPYTGPAAHHMNNPQRTGQRAQENYEGSEEVSPPQTKDQ

SEQ ID NO: 889957 - protein, 2554 aa, Homo sapiens
MTATTRGSPVGGNDNQGQAPDGQSLPPLQQNQTSSPDSSNENSPATPPDEQGQGDAPPQLEDEEPAFPHTDLAKLDDMINRPRWVVPVLPKGELEVLLEAAIDLSKKGLDVKSEACQRFFRDGLTISFTKILTDEAVSGWKFEIHRCIINNTHRLVELCVAKLSQDWFPLLELLAMALNPHCKFHIYNGTRPCESVSSSVQLPEDELFARSPDPRSPKGWLVDLLNKFGTLNGFQILHDRFINGSALNVQIIAALIKPFGQCYEFLTLHTVKKYFLPIIEMVPQFLENLTDEELKKEAKNEAKNDALSMIIKSLKNLASRVPGQEETVKNLEIFRLKMILRLLQISSFNGKMNALNEVNKVISSVSYYTHRHGNPEEEEWLTAERMAEWIQQNNILSIVLRDSLHQPQYVEKLEKILRFVIKEKALTLQDLDNIWAAQAGKHEAIVKNVHDLLAKLAWDFSPEQLDHPFDCFKASRTNASKKQREKLLELIRRLAEDDKDGVMAHRVLNLLWNLAHSDDVPVDIMDLALSAHIKILDYSCSQDRDTQKIQWIDRFIEELRTNDKWVIPALKQIREICSLFGEAPQNLSQTQRSPHVFYRHDLINQLQHNHALVTLVAENLATYMESMRLYARDHEDYDPQTVRLGSRYSHVQEVQERLNFLRFLLKDGQLWLCAPQAKQIWKCLAENAVYLCDREACFKWYSKLMGDEPDLDPDINKDFFESNVLQLDPSLLTENGMKCFERFFKAVNCREGKLVAKRRAYMMDDLELIGLDYLWRVVIQSNDDIASRAIDLLKEIYTNLGPRLQVNQVVIHEDFIQSCFDRLKASYDTLCVLDGDKDSVNCARQEAVRMVRVLTVLREYINECDSDYHEERTILPMSRAFRGKHLSFVVRFPNQGRQVDDLEVWSHTNDTIGSVRRCILNRIKANVAHTKIELFVGGELIDPADDRKLIGQLNLKDKSLITAKLTQISSNMPSSPDSSSDSSTGSPGNHGNHYSDGPNPEVESCLPGVIMSLHPRYISFLWQVADLGSSLNMPPLRDGARVLMKLMPPDSTTIEKLRAICLDHAKLGESSLSPSLDSLFFGPSASQVLYLTEVVYALLMPAGAPLADDSSDFQFHFLKSGGLPLVLSMLTRNNFLPNADMETRRGAYLNALKIAKLLLTAIGYGHVRAVAEACQPGVEGVNPMTQINQVTHDQAVVLQSALQSIPNPSSECMLRNVSVRLAQQISDEASRYMPDICVIRAIQKIIWASGCGSLQLVFSPNEEITKIYEKTNAGNEPDLEDEQVCCEALEVMTLCFALIPTALDALSKEKAWQTFIIDLLLHCHSKTVRQVAQEQFFLMCTRCCMGHRPLLFFITLLFTVLGSTARERAKHSGDYFTLLRHLLNYAYNSNINVPNAEVLLNNEIDWLKRIRDDVKRTGETGIEETILEGHLGVTKELLAFQTSEKKFHIGCEKGGANLIKELIDDFIFPASNVYLQYMRNGELPAEQAIPVCGSPPTINAGFELLVALAVGCVRNLKQIVDSLTEMYYIGTAITTCEALTEWEYLPPVGPRPPKGFVGLKNAGATCYMNSVIQQLYMIPSIRNGILAIEGTGSDVDDDMSGDEKQDNESNVDPRDDVFGYPQQFEDKPALSKTEDRKEYNIGVLRHLQVIFGHLAASRLQYYVPRGFWKQFRLWGEPVNLREQHDALEFFNSLVDSLDEALKALGHPAMLSKVLGGSFADQKICQGCPHRYECEESFTTLNVDIRNHQNLLDSLEQYVKGDLLEGANAYHCEKCNKKVDTVKRLLIKKLPPVLAIQLKRFDYDWERECAIKFNDYFEFPRELDMEPYTVAGVAKLEGDNVNPESQLIQQSEQSESETAGSTKYRLVGVLVHSGQASGGHYYSYIIQRNGGDGERNRWYKFDDGDVTECKMDDDEEMKNQCFGGEYMGEVFDHMMKRMSYRRQKRWWNAYILFYERMDTIDQDDELIRYISELAITTRPHQIIMPSAIERSVRKQNVQFMHNRMQYSMEYFQFMKKLLTCNGVYLNPPPGQDHLLPEAEEITMISIQLAARFLFTTGFHTKKVVRGSASDWYDALCILLRHSKNVRFWFAHNVLFNVSNRFSEYLLECPSAEVRGAFAKLIVFIAHFSLQDGPCPSPFASPGPSSQAYDNLSLSDHLLRAVLNLLRREVSEHGRHLQQYFNLFVMYANLGVAEKTQLLKLSVPATFMLVSLDEGPGPPIKYQYAELGKLYSVVSQLIRCCNVSSRMQSSINGNPPLPNPFGDPNLSQPIMPIQQNVADILFVRTSYVKKIIEDCSNSEETVKLLRFCCWENPQFSSTVLSELLWQVAYSYTYELRPYLDLLLQILLIEDSWQTHRIHNALKGIPDDRDGLFDTIQRSKNHYQKRAYQCIKCMVALFSNCPVAYQILQGNGDLKRKWTWAVEWLGDELERRPYTGNPQYTYNNWSPPVQSNETSNGYFLERSHSARMTLAKACELCPEEEPDDQDAPDEHESPPPEDAPLYPHSPGSQYQQNNHVHGQPYTGPAAHHMNNPQRTGQRAQENYEGSEEVSPPQTKDQ

SEQ ID NO: 889958 - protein, 1409 aa, Homo sapiens
SVPTSPRLADKLLLTAIGYGHVRAVAEACQPGVEGVNPMTQINQVTHDQAVVLQSALQSIPNPSSECMLRNVSVRLAQQISDEASRYMPDICVIRAIQKIIWASGCGSLQLVFSPNEEITKIYEKTNAGNEPDLEDEQVCCEALEVMTLCFALIPTALDALSKEKAWQTFIIDLLLHCHSKTVRQVAQEQFFLMCTRCCMGHRPLLFFITLLFTVLGSTARERAKHSGDYFTLLRHLLNYAYNSNINVPNAEVLLNNEIDWLKRIRDDVKRTGETGIEETILEGHLGVTKELLAFQTSEKKFHIGCEKGGANLIKELIDDFIFPASNVYLQYMRNGELPAEQAIPVCGSPPTINAGFELLVALAVGCVRNLKQIVDSLTEMYYIGTAITTCEALTEWEYLPPVGPRPPKGFVGLKNAGATCYMNSVIQQLYMIPSIRNGILAIEGTGSDVDDDMSGDEKQDNESNVDPRDDVFGYPQQFEDKPALSKTEDRKEYNIGVLRHLQVIFGHLAASRLQYYVPRGFWKQFRLWGEPVNLREQHDALEFFNSLVDSLDEALKALGHPAMLSKVLGGSFADQKICQGCPHRYECEESFTTLNVDIRNHQNLLDSLEQYVKGDLLEGANAYHCEKCNKKVDTVKRLLIKKLPPVLAIQLKRFDYDWERECAIKFNDYFEFPRELDMEPYTVAGVAKLEGDNVNPESQLIQQSEQSESETAGSTKYRLVGVLVHSGQASGGHYYSYIIQRNGGDGERNRWYKFDDGDVTECKMDDDEEMKNQCFGGEYMGEVFDHMMKRMSYRRQKRWWNAYILFYERMDTIDQDDELIRYISELAITTRPHQIIMPSAIERSVRKQNVQFMHNRMQYSMEYFQFMKKLLTCNGVYLNPPPGQDHLLPEAEEITMISIQLAARFLFTTGFHTKKVVRGSASDWYDALCILLRHSKNVRFWFAHNVLFNVSNRFSEYLLECPSAEVRGAFAKLIVFIAHFSLQDGPCPSPFASPGPSSQAYDNLSLSDHLLRAVLNLLRREVSEHGRHLQQYFNLFVMYANLGVAEKTQLLKLSVPATFMLVSLDEGPGPPIKYQYAELGKLYSVVSQLIRCCNVSSRMQSSINGNPPLPNPFGDPNLSQPIMPIQQNVADILFVRTSYVKKIIEDCSNSEETVKLLRFCCWENPQFSSTVLSELLWQVAYSYTYELRPYLDLLLQILLIEDSWQTHRIHNALKGIPDDRDGLFDTIQRSKNHYQKRAYQCIKCMVALFSNCPVAYQILQGNGDLKRKWTWAVEWLGDELERRPYTGNPQYTYNNWSPPVQSNETSNGYFLERSHSARMTLAKACELCPEEEPDDQDAPDEHESPPPEDAPLYPHSPGSQYQQNNHVHGQPYTGPAAHHMNNPQRTGQRAQENYEGSEEVSPPQTKDQ

SEQ ID NO: 889959 - protein, 1096 aa, Homo sapiens
TKLILMVHILVQLIDGFKTLINRLSQKSSKFLVVEESSDYSLVEFYTLLQGASHISDYNWGSAQRLHYHLGTQQITTCEALTEWEYLPPVGPRPPKGFVGLKNAGATCYMNSVIQQLYMIPSIRNGILAIEGTGSDVDDDMSGDEKQDNESNVDPRDDVFGYPQQFEDKPALSKTEDRKEYNIGVLRHLQVIFGHLAASRLQYYVPRGFWKQFRLWGEPVNLREQHDALEFFNSLVDSLDEALKALGHPAMLSKVLGGSFADQKICQGCPHRYECEESFTTLNVDIRNHQNLLDSLEQYVKGDLLEGANAYHCEKCNKKVDTVKRLLIKKLPPVLAIQLKRFDYDWERECAIKFNDYFEFPRELDMEPYTVAGVAKLEGDNVNPESQLIQQSEQSESETAGSTKYRLVGVLVHSGQASGGHYYSYIIQRNGGDGERNRWYKFDDGDVTECKMDDDEEMKNQCFGGEYMGEVFDHMMKRMSYRRQKRWWNAYILFYERMDTIDQDDELIRYISELAITTRPHQIIMPSAIERSVRKQNVQFMHNRMQYSMEYFQFMKKLLTCNGVYLNPPPGQDHLLPEAEEITMISIQLAARFLFTTGFHTKKVVRGSASDWYDALCILLRHSKNVRFWFAHNVLFNVSNRFSEYLLECPSAEVRGAFAKLIVFIAHFSLQDGPCPSPFASPGPSSQAYDNLSLSDHLLRAVLNLLRREVSEHGRHLQQYFNLFVMYANLGVAEKTQLLKLSVPATFMLVSLDEGPGPPIKYQYAELGKLYSVVSQLIRCCNVSSRMQSSINGNPPLPNPFGDPNLSQPIMPIQQNVADILFVRTSYVKKIIEDCSNSEETVKLLRFCCWENPQFSSTVLSELLWQVAYSYTYELRPYLDLLLQILLIEDSWQTHRIHNALKGIPDDRDGLFDTIQRSKNHYQKRAYQCIKCMVALFSNCPVAYQILQGNGDLKRKWTWAVEWLGDELERRPYTGNPQYTYNNWSPPVQSNETSNGYFLERSHSARMTLAKACELCPEEEPDDQDAPDEHESPPPEDAPLYPHSPGSQYQQNNHVHGQPYTGPAAHHMNNPQRTGQRAQENYEGSEEVSPPQTKDQ

SEQ ID NO: 889960 - protein, 422 aa, Homo sapiens
RSRGSRLPGPSSQAYDNLSLSDHLLRAVLNLLRREVSEHGRHLQQYFNLFVMYANLGVAEKTQLLKLSVPATFMLVSLDEGPGPPIKYQYAELGKLYSVVSQLIRCCNVSSRMQSSINGNPPLPNPFGDPNLSQPIMPIQQNVADILFVRTSYVKKIIEDCSNSEETVKLLRFCCWENPQFSSTVLSELLWQVAYSYTYELRPYLDLLLQILLIEDSWQTHRIHNALKGIPDDRDGLFDTIQRSKNHYQKRAYQCIKCMVALFSNCPVAYQILQGNGDLKRKWTWAVEWLGDELERRPYTGNPQYTYNNWSPPVQSNETSNGYFLERSHSARMTLAKACELCPEEEPDDQDAPDEHESPPPEDAPLYPHSPGSQYQQNNHVHGQPYTGPAAHHMNNPQRTGQRAQENYEGSEEVSPPQTKDQ

SEQ ID NO: 889961 - protein, 2477 aa, Homo sapiens; identical to SEQ ID NO: 889956

SEQ ID NO: 889962 - protein, 2477 aa, Homo sapiens; identical to SEQ ID NO: 889956

SEQ ID NO: 889963 - protein, 2477 aa, Homo sapiens; identical to SEQ ID NO: 889956

SEQ ID NO: 889964 - protein, 235 aa, Homo sapiens
SHLPLRTFIVHSPSPLFMITVISFLIIHESLSYVRLCKNRPKGAFGSGLLAAELGGAVLGGGRRAGRRAEPPEPSYSRERRENQILQGNGDLKRKWTWAVEWLGDELERRPYTGNPQYTYNNWSPPVQSNETSNGYFLERSHSARMTLAKACELCPEEEPDDQDAPDEHESPPPEDAPLYPHSPGSQYQQNNHVHGQPYTGPAAHHMNNPQRTGQRAQENYEGSEEVSPPQTKDQ

SEQ ID NO: 889965 - protein, 2396 aa, Homo sapiens
MINRPRWVVPVLPKGELEVLLEAAIDLSKKGLDVKSEACQRFFRDGLTISFTKILTDEAVSGWKFEIHRCIINNTHRLVELCVAKLSQDWFPLLELLAMALNPHCKFHIYNGTRPCESVSSSVQLPEDELFARSPDPRSPKGWLVDLLNKFGTLNGFQILHDRFINGSALNVQIIAALIKPFGQCYEFLTLHTVKKYFLPIIEMVPQFLENLTDEELKKEAKNEAKNDALSMIIKSLKNLASRVPGQEETVKNLEIFRLKMILRLLQISSFNGKMNALNEVNKVISSVSYYTHRHGNPEEEEWLTAERMAEWIQQNNILSIVLRDSLHQPQYVEKLEKILRFVIKEKALTLQDLDNIWAAQAGKHEAIVKNVHDLLAKLAWDFSPEQLDHPFDCFKASRTNASKKQREKLLELIRRLAEDDKDGVMAHRVLNLLWNLAHSDDVPVDIMDLALSAHIKILDYSCSQDRDTQKIQWIDRFIEELRTNDKWVIPALKQIREICSLFGEAPQNLSQTQRSPHVFYRHDLINQLQHNHALVTLVAENLATYMESMRLYARDHEDYDPQTVRLGSRYSHVQEVQERLNFLRFLLKDGQLWLCAPQAKQIWKCLAENAVYLCDREACFKWYSKLMGDEPDLDPDINKDFFESNVLQLDPSLLTENGMKCFERFFKAVNCREGKLVAKRRAYMMDDLELIGLDYLWRVVIQSNDDIASRAIDLLKEIYTNLGPRLQVNQVVIHEDFIQSCFDRLKASYDTLCVLDGDKDSVNCARQEAVRMVRVLTVLREYINECDSDYHEERTILPMSRAFRGKHLSFVVRFPNQGRQVDDLEVWSHTNDTIGSVRRCILNRIKANVAHTKIELFVGGELIDPADDRKLIGQLNLKDKSLITAKLTQISSNMPSSPDSSSDSSTGSPGNHGNHYSDGPNPEVESCLPGVIMSLHPRYISFLWQVADLGSSLNMPPLRDGARVLMKLMPPDSTTIEKLRAICLDHAKLGESSLSPSLDSLFFGPSASQVLYLTEVVYALLMPAGAPLADDSSDFQFHFLKSGGLPLVLSMLTRNNFLPNADMETRRGAYLNALKIAKLLLTAIGYGHVRAVAEACQPGVEGVNPMTQINQVTHDQAVVLQSALQSIPNPSSECMLRNVSVRLAQQISDEASRYMPDICVIRAIQKIIWASGCGSLQLVFSPNEEITKIYEKTNAGNEPDLEDEQVCCEALEVMTLCFALIPTALDALSKEKAWQTFIIDLLLHCHSKTVRQVAQEQFFLMCTRCCMGHRPLLFFITLLFTVLGSTARERAKHSGDYFTLLRHLLNYAYNSNINVPNAEVLLNNEIDWLKRIRDDVKRTGETGIEETILEGHLGVTKELLAFQTSEKKFHIGCEKGGANLIKELIDDFIFPASNVYLQYMRNGELPAEQAIPVCGSPPTINAGFELLVALAVGCVRNLKQIVDSLTEMYYIGTAITTCEALTEWEYLPPVGPRPPKGFVGLKNAGATCYMNSVIQQLYMIPSIRNGILAIEGTGSDVDDDMSGDEKQDNESNVDPRDDVFGYPQQFEDKPALSKTEDRKEYNIGVLRHLQVIFGHLAASRLQYYVPRGFWKQFRLWGEPVNLREQHDALEFFNSLVDSLDEALKALGHPAMLSKVLGGSFADQKICQGCPHRYECEESFTTLNVDIRNHQNLLDSLEQYVKGDLLEGANAYHCEKCNKKVDTVKRLLIKKLPPVLAIQLKRFDYDWERECAIKFNDYFEFPRELDMEPYTVAGVAKLEGDNVNPESQLIQQSEQSESETAGSTKYRLVGVLVHSGQASGGHYYSYIIQRNGGDGERNRWYKFDDGDVTECKMDDDEEMKNQCFGGEYMGEVFDHMMKRMSYRRQKRWWNAYILFYERMDTIDQDDELIRYISELAITTRPHQIIMPSAIERSVRKQNVQFMHNRMQYSMEYFQFMKKLLTCNGVYLNPPPGQDHLLPEAEEITMISIQLAARFLFTTGFHTKKVVRGSASDWYDALCILLRHSKNVRFWFAHNVLFNVSNRFSEYLLECPSAEVRGAFAKLIVFIAHFSLQDGPCPSPFASPGPSSQAYDNLSLSDHLLRAVLNLLRREVSEHGRHLQQYFNLFVMYANLGVAEKTQLLKLSVPATFMLVSLDEGPGPPIKYQYAELGKLYSVVSQLIRCCNVSSRMQSSINGNPPLPNPFGDPNLSQPIMPIQQNVADILFVRTSYVKKIIEDCSNSEETVKLLRFCCWENPQFSSTVLSELLWQVAYSYTYELRPYLDLLLQILLIEDSWQTHRIHNALKGIPDDRDGLFDTIQRSKNHYQKRAYQCIKCMVALFSNCPVAYQILQGNGDLKKKVVKITSEIPQTERMQKRAERFNVPVSLESKKAARAARLGISSVPTKGLSSDNKPMVNLD

SEQ ID NO: 889966 - protein, 1801 aa, Homo sapiens
MINRPRWVVPVLPKGELEVLLEAAIDLSKKGLDVKSEACQRFFRDGLTISFTKILTDEAVSGWKFEIHRCIINNTHRLVELCVAKLSQDWFPLLELLAMALNPHCKFHIYNGTRPCESVSSSVQLPEDELFARSPDPRSPKGWLVDLLNKFGTLNGFQILHDRFINGSALNVQIIAALIKPFGQCYEFLTLHTVKKYFLPIIEMVPQFLENLTDEELKKEAKNEAKNDALSMIIKSLKNLASRVPGQEETVKNLEIFRLKMILRLLQISSFNGKMNALNEVNKVISSVSYYTHRHGNPEEEEWLTAERMAEWIQQNNILSIVLRDSLHQPQYVEKLEKILRFVIKEKALTLQDLDNIWAAQAGKHEAIVKNVHDLLAKLAWDFSPEQLDHPFDCFKASRTNASKKQREKLLELIRRLAEDDKDGVMAHRVLNLLWNLAHSDDVPVDIMDLALSAHIKILDYSCSQDRDTQKIQWIDRFIEELRTNDKWVIPALKQIREICSLFGEAPQNLSQTQRSPHVFYRHDLINQLQHNHALVTLVAENLATYMESMRLYARDHEDYDPQTVRLGSRYSHVQEVQERLNFLRFLLKDGQLWLCAPQAKQIWKCLAENAVYLCDREACFKWYSKLMGDEPDLDPDINKDFFESNVLQLDPSLLTENGMKCFERFFKAVNCREGKLVAKRRAYMMDDLELIGLDYLWRVVIQSNDDIASRAIDLLKEIYTNLGPRLQVNQVVIHEDFIQSCFDRLKASYDTLCVLDGDKDSVNCARQEAVRMVRVLTVLREYINECDSDYHEERTILPMSRAFRGKHLSFVVRFPNQGRQVDDLEVWSHTNDTIGSVRRCILNRIKANVAHTKIELFVGGELIDPADDRKLIGQLNLKDKSLITAKLTQISSNMPSSPDSSSDSSTGSPGNHGNHYSDGPNPEVESCLPGVIMSLHPRYISFLWQVADLGSSLNMPPLRDGARVLMKLMPPDSTTIEKLRAICLDHAKLGESSLSPSLDSLFFGPSASQVLYLTEVVYALLMPAGAPLADDSSDFQFHFLKSGGLPLVLSMLTRNNFLPNADMETRRGAYLNALKIAKLLLTAIGYGHVRAVAEACQPGVEGVNPMTQINQVTHDQAVVLQSALQSIPNPSSECMLRNVSVRLAQQISDEASRYMPDICVIRAIQKIIWASGCGSLQLVFSPNEEITKIYEKTNAGNEPDLEDEQVCCEALEVMTLCFALIPTALDALSKEKAWQTFIIDLLLHCHSKTVRQVAQEQFFLMCTRCCMGHRPLLFFITLLFTVLGSTARERAKHSGDYFTLLRHLLNYAYNSNINVPNAEVLLNNEIDWLKRIRDDVKRTGETGIEETILEGHLGVTKELLAFQTSEKKFHIGCEKGGANLIKELIDDFIFPASNVYLQYMRNGELPAEQAIPVCGSPPTINAGFELLVALAVGCVRNLKQIVDSLTEMYYIGTAITTCEALTEWEYLPPVGPRPPKGFVGLKNAGATCYMNSVIQQLYMIPSIRNGILAIEGTGSDVDDDMSGDEKQDNESNVDPRDDVFGYPQQFEDKPALSKTEDRKEYNIGVLRHLQVIFGHLAASRLQYYVPRGFWKQFRLWGEPVNLREQHDALEFFNSLVDSLDEALKALGHPAMLSKVLGGSFADQKICQGCPHRYECEESFTTLNVDIRNHQNLLDSLEQYVKGDLLEGANAYHCEKCNKKVDTVKRLLIKKLPPVLAIQLKRFDYDWERECAIKFNDYFEFPRELDMEPYTVAGVAKLEGDNVNPESQLIQQSEQSESETAGTQENYEGSEEVSPPQTKDQ

SEQ ID NO: 889967 - protein, 2253 aa, Homo sapiens
MINRPRWVVPVLPKGELEVLLEAAIDLSKKGLDVKSEACQRFFRDGLTISFTKILTDEAVSGWKFEIHRCIINNTHRLVELCVAKLSQDWFPLLELLAMALNPHCKFHIYNGTRPCESVSSSVQLPEDELFARSPDPRSPKGWLVDLLNKFGTLNGFQILHDRFINGSALNVQIIAALIKPFGQCYEFLTLHTVKKYFLPIIEMVPQFLENLTDEELKKEAKNEAKNDALSMIIKSLKNLASRVPGQEETVKNLEIFRLKMILRLLQISSFNGKMNALNEVNKVISSVSYYTHRHGNPEEEEWLTAERMAEWIQQNNILSIVLRDSLHQPQYVEKLEKILRFVIKEKALTLQDLDNIWAAQAGKHEAIVKNVHDLLAKLAWDFSPEQLDHPFDCFKASRTNASKKQREKLLELIRRLAEDDKDGVMAHRVLNLLWNLAHSDDVPVDIMDLALSAHIKILDYSCSQDRDTQKIQWIDRFIEELRTNDKWVIPALKQIREICSLFGEAPQNLSQTQRSPHVFYRHDLINQLQHNHALVTLVAENLATYMESMRLYARDHEDYDPQTVRLGSRYSHVQEVQERLNFLRFLLKDGQLWLCAPQAKQIWKCLAENAVYLCDREACFKWYSKLMGDEPDLDPDINKDFFESNVLQLDPSLLTENGMKCFERFFKAVNCREGKLVAKRRAYMMDDLELIGLDYLWRVVIQSNDDIASRAIDLLKEIYTNLGPRLQVNQVVIHEDFIQSCFDRLKASYDTLCVLDGDKDSVNCARQEAVRMVRVLTVLREYINECDSDYHEERTILPMSRAFRGKHLSFVVRFPNQGRQVDDLEVWSHTNDTIGSVRRCILNRIKANVAHTKIELFVGGELIDPADDRKLIGQLNLKDKSLITAKLTQISSNMPSSPDSSSDSSTGSPGNHGNHYSDGPNPEVESCLPGVIMSLHPRYISFLWQVADLGSSLNMPPLRDGARVLMKLMPPDSTTIEKLRAICLDHAKLGESSLSPSLDSLFFGPSASQVLYLTEVVYALLMPAGAPLADDSSDFQFHFLKSGGLPLVLSMLTRNNFLPNADMETRRGAYLNALKIAKLLLTAIGYGHVRAVAEACQPGVEGVNPMTQINQVTHDQAVVLQSALQSIPNPSSECMLRNVSVRLAQQISDEASRYMPDICVIRAIQKIIWASGCGSLQLVFSPNEEITKIYEKTNAGNEPDLEDEQVCCEALEVMTLCFALIPTALDALSKEKAWQTFIIDLLLHCHSKTVRQVAQEQFFLMCTRCCMGHRPLLFFITLLFTVLGSTARERAKHSGDYFTLLRHLLNYAYNSNINVPNAEVLLNNEIDWLKRIRDDVKRTGETGIEETILEGHLGVTKELLAFQTSEKKFHIGCEKGGANLIKELIDDFIFPASNVYLQYMRNGELPAEQAIPVCGSPPTINAGFELLVALAVGCVRNLKQIVDSLTEMYYIGTAITTCEALTEWEYLPPVGPRPPKGFVGLKNAGATCYMNSVIQQLYMIPSIRNGILAIEGTGSDVDDDMSGDEKQDNESNVDPRDDVFGYPQQFEDKPALSKTEDRKEYNIGVLRHLQVIFGHLAASRLQYYVPRGFWKQFRLWGEPVNLREQHDALEFFNSLVDSLDEALKALGHPAMLSKVLGGSFADQKICQGCPHRYECEESFTTLNVDIRNHQNLLDSLEQYVKGDLLEGANAYHCEKCNKKVDTVKRLLIKKLPPVLAIQLKRFDYDWERECAIKFNDYFEFPRELDMEPYTVAGVAKLEGDNVNPESQLIQQSEQSESETAGSTKYRLVGVLVHSGQASGGHYYSYIIQRNGGDGERNRWYKFDDGDVTECKMDDDEEMKNQCFGGEYMGEVFDHMMKRMSYRRQKRWWNAYILFYERMDTIDQDDELIRYISELAITTRPHQIIMPSAIERSVRKQNVQFMHNRMQYSMEYFQFMKKLLTCNGVYLNPPPGQDHLLPEAEEITMISIQLAARFLFTTGFHTKKVVRGSASDWYDALCILLRHSKNVRFWFAHNVLFNVSNRFSEYLLECPSAEVRGAFAKLIVFIAHFSLQDGPCPSPFASPGPSSQAYDNLSLSDHLLRAVLNLLRREVSEHGRHLQQYFNLFVMYANLGVAEKTQLLKLSVPATFMLVSLDEGPGPPIKYQYAELGKLYSVVSQLIRCCNVSSRMQSSINGNPPLPNPFGDPNLSQPIMPIQQNVADILFVRTSYVKKIIEDCSNSEETVKLLRFCCWENPQFSSTVLSELLWQVAYSYT

SEQ ID NO: 889968 - protein, 1660 aa, Homo sapiens
MINRPRWVVPVLPKGELEVLLEAAIDLSKKGLDVKSEACQRFFRDGLTISFTKILTDEAVSGWKFEIHRCIINNTHRLVELCVAKLSQDWFPLLELLAMALNPHCKFHIYNGTRPCESVSSSVQLPEDELFARSPDPRSPKGWLVDLLNKFGTLNGFQILHDRFINGSALNVQIIAALIKPFGQCYEFLTLHTVKKYFLPIIEMVPQFLENLTDEELKKEAKNEAKNDALSMIIKSLKNLASRVPGQEETVKNLEIFRLKMILRLLQISSFNGKMNALNEVNKVISSVSYYTHRHGNPEEEEWLTAERMAEWIQQNNILSIVLRDSLHQPQYVEKLEKILRFVIKEKALTLQDLDNIWAAQAGKHEAIVKNVHDLLAKLAWDFSPEQLDHPFDCFKASRTNASKKQREKLLELIRRLAEDDKDGVMAHRVLNLLWNLAHSDDVPVDIMDLALSAHIKILDYSCSQDRDTQKIQWIDRFIEELRTNDKWVIPALKQIREICSLFGEAPQNLSQTQRSPHVFYRHDLINQLQHNHALVTLVAENLATYMESMRLYARDHEDYDPQTVRLGSRYSHVQEVQERLNFLRFLLKDGQLWLCAPQAKQIWKCLAENAVYLCDREACFKWYSKLMGDEPDLDPDINKDFFESNVLQLDPSLLTENGMKCFERFFKAVNCREGKLVAKRRAYMMDDLELIGLDYLWRVVIQSNDDIASRAIDLLKEIYTNLGPRLQVNQVVIHEDFIQSCFDRLKASYDTLCVLDGDKDSVNCARQEAVRMVRVLTVLREYINECDSDYHEERTILPMSRAFRGKHLSFVVRFPNQGRQVDDLEVWSHTNDTIGSVRRCILNRIKANVAHTKIELFVGGELIDPADDRKLIGQLNLKDKSLITAKLTQISSNMPSSPDSSSDSSTGSPGNHGNHYSDGPNPEVESCLPGVIMSLHPRYISFLWQVADLGSSLNMPPLRDGARVLMKLMPPDSTTIEKLRAICLDHAKLGESSLSPSLDSLFFGPSASQVLYLTEVVYALLMPAGAPLADDSSDFQFHFLKSGGLPLVLSMLTRNNFLPNADMETRRGAYLNALKIAKLLLTAIGYGHVRAVAEACQPGVEGVNPMTQINQVTHDQAVVLQSALQSIPNPSSECMLRNVSVRLAQQISDEASRYMPDICVIRAIQKIIWASGCGSLQLVFSPNEEITKIYEKTNAGNEPDLEDEQVCCEALEVMTLCFALIPTALDALSKEKAWQTFIIDLLLHCHSKTVRQVAQEQFFLMCTRCCMGHRPLLFFITLLFTVLGSTARERAKHSGDYFTLLRHLLNYAYNSNINVPNAEVLLNNEIDWLKRIRDDVKRTGETGIEETILEGHLGVTKELLAFQTSEKKFHIGCEKGGANLIKELIDDFIFPASNVYLQYMRNGELPAEQAIPVCGSPPTINAGFELLVALAVGCVRNLKQIVDSLTEMYYIGTAITTCEALTEWEYLPPVGPRPPKGFVGLKNAGATCYMNSVIQQLYMIPSIRNGILAIEGTGSDVDDDMSGDEKQDNESNVDPRDDVFGYPQQFEDKPALSKTEDRKEYNIGVLRHLQVIFGHLAASRLQYYVPRGFWKQFRLWGEPVNLREQHDALEFFNSLVDSLDEALKALGHPAMLSKVLGGSFADQKICQGCPHSSASDGTG

SEQ ID NO: 889969 - protein, 1611 aa, Homo sapiens
MINRPRWVVPVLPKGELEVLLEAAIDLSKKGLDVKSEACQRFFRDGLTISFTKILTDEAVSGWKFEIHRCIINNTHRLVELCVAKLSQDWFPLLELLAMALNPHCKFHIYNGTRPCESVSSSVQLPEDELFARSPDPRSPKGWLVDLLNKFGTLNGFQILHDRFINGSALNVQIIAALIKPFGQCYEFLTLHTVKKYFLPIIEMVPQFLENLTDEELKKEAKNEAKNDALSMIIKSLKNLASRVPGQEETVKNLEIFRLKMILRLLQISSFNGKMNALNEVNKVISSVSYYTHRHGNPEEEEWLTAERMAEWIQQNNILSIVLRDSLHQPQYVEKLEKILRFVIKEKALTLQDLDNIWAAQAGKHEAIVKNVHDLLAKLAWDFSPEQLDHPFDCFKASRTNASKKQREKLLELIRRLAEDDKDGVMAHRVLNLLWNLAHSDDVPVDIMDLALSAHIKILDYSCSQDRDTQKIQWIDRFIEELRTNDKWVIPALKQIREICSLFGEAPQNLSQTQRSPHVFYRHDLINQLQHNHALVTLVAENLATYMESMRLYARDHEDYDPQTVRLGSRYSHVQEVQERLNFLRFLLKDGQLWLCAPQAKQIWKCLAENAVYLCDREACFKWYSKLMGDEPDLDPDINKDFFESNVLQLDPSLLTENGMKCFERFFKAVNCREGKLVAKRRAYMMDDLELIGLDYLWRVVIQSNDDIASRAIDLLKEIYTNLGPRLQVNQVVIHEDFIQSCFDRLKASYDTLCVLDGDKDSVNCARQEAVRMVRVLTVLREYINECDSDYHEERTILPMSRAFRGKHLSFVVRFPNQGRQVDDLEVWSHTNDTIGSVRRCILNRIKANVAHTKIELFVGGELIDPADDRKLIGQLNLKDKSLITAKLTQISSNMPSSPDSSSDSSTGSPGNHGNHYSDGPNPEVESCLPGVIMSLHPRYISFLWQVADLGSSLNMPPLRDGARVLMKLMPPDSTTIEKLRAICLDHAKLGESSLSPSLDSLFFGPSASQVLYLTEVVYALLMPAGAPLADDSSDFQFHFLKSGGLPLVLSMLTRNNFLPNADMETRRGAYLNALKIAKLLLTAIGYGHVRAVAEACQPGVEGVNPMTQINQVTHDQAVVLQSALQSIPNPSSECMLRNVSVRLAQQISDEASRYMPDICVIRAIQKIIWASGCGSLQLVFSPNEEITKIYEKTNAGNEPDLEDEQVCCEALEVMTLCFALIPTALDALSKEKAWQTFIIDLLLHCHSKTVRQVAQEQFFLMCTRCCMGHRPLLFFITLLFTVLGSTARERAKHSGDYFTLLRHLLNYAYNSNINVPNAEVLLNNEIDWLKRIRDDVKRTGETGIEETILEGHLGVTKELLAFQTSEKKFHIGCEKGGANLIKELIDDFIFPASNVYLQYMRNGELPAEQAIPVCGSPPTINAGFELLVALAVGCVRNLKQIVDSLTEMYYIGTAITTCEALTEWEYLPPVGPRPPKGFVGLKNAGATCYMNSVIQQLYMIPSIRNGILAIEGTGSDVDDDMSGDEKQDNESNVDPRDDVFGYPQQFEDKPALSKTEDRKEYNIGVLRHLQVIFGHLAASSELAYLMLPKKGFGKSFQGFWGVKPRLNPGE

SEQ ID NO: 889970 - protein, 1595 aa, Homo sapiens
MINRPRWVVPVLPKGELEVLLEAAIDLSKKGLDVKSEACQRFFRDGLTISFTKILTDEAVSGWKFEIHRCIINNTHRLVELCVAKLSQDWFPLLELLAMALNPHCKFHIYNGTRPCESVSSSVQLPEDELFARSPDPRSPKGWLVDLLNKFGTLNGFQILHDRFINGSALNVQIIAALIKPFGQCYEFLTLHTVKKYFLPIIEMVPQFLENLTDEELKKEAKNEAKNDALSMIIKSLKNLASRVPGQEETVKNLEIFRLKMILRLLQISSFNGKMNALNEVNKVISSVSYYTHRHGNPEEEEWLTAERMAEWIQQNNILSIVLRDSLHQPQYVEKLEKILRFVIKEKALTLQDLDNIWAAQAGKHEAIVKNVHDLLAKLAWDFSPEQLDHPFDCFKASRTNASKKQREKLLELIRRLAEDDKDGVMAHRVLNLLWNLAHSDDVPVDIMDLALSAHIKILDYSCSQDRDTQKIQWIDRFIEELRTNDKWVIPALKQIREICSLFGEAPQNLSQTQRSPHVFYRHDLINQLQHNHALVTLVAENLATYMESMRLYARDHEDYDPQTVRLGSRYSHVQEVQERLNFLRFLLKDGQLWLCAPQAKQIWKCLAENAVYLCDREACFKWYSKLMGDEPDLDPDINKDFFESNVLQLDPSLLTENGMKCFERFFKAVNCREGKLVAKRRAYMMDDLELIGLDYLWRVVIQSNDDIASRAIDLLKEIYTNLGPRLQVNQVVIHEDFIQSCFDRLKASYDTLCVLDGDKDSVNCARQEAVRMVRVLTVLREYINECDSDYHEERTILPMSRAFRGKHLSFVVRFPNQGRQVDDLEVWSHTNDTIGSVRRCILNRIKANVAHTKIELFVGGELIDPADDRKLIGQLNLKDKSLITAKLTQISSNMPSSPDSSSDSSTGSPGNHGNHYSDGPNPEVESCLPGVIMSLHPRYISFLWQVADLGSSLNMPPLRDGARVLMKLMPPDSTTIEKLRAICLDHAKLGESSLSPSLDSLFFGPSASQVLYLTEVVYALLMPAGAPLADDSSDFQFHFLKSGGLPLVLSMLTRNNFLPNADMETRRGAYLNALKIAKLLLTAIGYGHVRAVAEACQPGVEGVNPMTQINQVTHDQAVVLQSALQSIPNPSSECMLRNVSVRLAQQISDEASRYMPDICVIRAIQKIIWASGCGSLQLVFSPNEEITKIYEKTNAGNEPDLEDEQVCCEALEVMTLCFALIPTALDALSKEKAWQTFIIDLLLHCHSKTVRQVAQEQFFLMCTRCCMGHRPLLFFITLLFTVLGSTARERAKHSGDYFTLLRHLLNYAYNSNINVPNAEVLLNNEIDWLKRIRDDVKRTGETGIEETILEGHLGVTKELLAFQTSEKKFHIGCEKGGANLIKELIDDFIFPASNVYLQYMRNGELPAEQAIPVCGSPPTINAGFELLVALAVGCVRNLKQIVDSLTEMYYIGTAITTCEALTEWEYLPPVGPRPPKGFVGLKNAGATCYMNSVIQQLYMIPSIRNGILAIEGTGSDVDDDMSGDEKQDNESNVDPRDDVFGYPQQFEDKPALSKTEDRKEYNIGVLRHLQVIFGHLAASRLQYYVPRGFWKQFR

SEQ ID NO: 889971 - protein, 1122 aa, Homo sapiens
MINRPRWVVPVLPKGELEVLLEAAIDLSKKGLDVKSEACQRFFRDGLTISFTKILTDEAVSGWKFEIHRCIINNTHRLVELCVAKLSQDWFPLLELLAMALNPHCKFHIYNGTRPCESVSSSVQLPEDELFARSPDPRSPKGWLVDLLNKFGTLNGFQILHDRFINGSALNVQIIAALIKPFGQCYEFLTLHTVKKYFLPIIEMVPQFLENLTDEELKKEAKNEAKNDALSMIIKSLKNLASRVPGQEETVKNLEIFRLKMILRLLQISSFNGKMNALNEVNKVISSVSYYTHRHGNPEEEEWLTAERMAEWIQQNNILSIVLRDSLHQPQYVEKLEKILRFVIKEKALTLQDLDNIWAAQAGKHEAIVKNVHDLLAKLAWDFSPEQLDHPFDCFKASRTNASKKQREKLLELIRRLAEDDKDGVMAHRVLNLLWNLAHSDDVPVDIMDLALSAHIKILDYSCSQDRDTQKIQWIDRFIEELRTNDKWVIPALKQIREICSLFGEAPQNLSQTQRSPHVFYRHDLINQLQHNHALVTLVAENLATYMESMRLYARDHEDYDPQTVRLGSRYSHVQEVQERLNFLRFLLKDGQLWLCAPQAKQIWKCLAENAVYLCDREACFKWYSKLMGDEPDLDPDINKDFFESNVLQLDPSLLTENGMKCFERFFKAVNCREGKLVAKRRAYMMDDLELIGLDYLWRVVIQSNDDIASRAIDLLKEIYTNLGPRLQVNQVVIHEDFIQSCFDRLKASYDTLCVLDGDKDSVNCARQEAVRMVRVLTVLREYINECDSDYHEERTILPMSRAFRGKHLSFVVRFPNQGRQVDDLEVWSHTNDTIGSVRRCILNRIKANVAHTKIELFVGGELIDPADDRKLIGQLNLKDKSLITAKLTQISSNMPSSPDSSSDSSTGSPGNHGNHYSDGPNPEVESCLPGVIMSLHPRYISFLWQVADLGSSLNMPPLRDGARVLMKLMPPDSTTIEKLRAICLDHAKLGESSLSPSLDSLFFGPSASQVLYLTEVVYALLMPAGAPLADDSSDFQFHFLKSGGLPLVLSMLTRNNFLPNADMETRRGAYLNALKIAKLLLTAIGYGHVRAVAEACQPGVEGVNPMTQVIQTFQKSFYNSR

SEQ ID NO: 889972 - protein, 1249 aa, Homo sapiens
MINRPRWVVPVLPKGELEVLLEAAIDLSKKGLDVKSEACQRFFRDGLTISFTKILTDEAVSGWKFEIHRCIINNTHRLVELCVAKLSQDWFPLLELLAMALNPHCKFHIYNGTRPCESVSSSVQLPEDELFARSPDPRSPKGWLVDLLNKFGTLNGFQILHDRFINGSALNVQIIAALIKPFGQCYEFLTLHTVKKYFLPIIEMVPQFLENLTDEELKKEAKNEAKNDALSMIIKSLKNLASRVPGQEETVKNLEIFRLKMILRLLQISSFNGKMNALNEVNKVISSVSYYTHRHGNPEEEEWLTAERMAEWIQQNNILSIVLRDSLHQPQYVEKLEKILRFVIKEKALTLQDLDNIWAAQAGKHEAIVKNVHDLLAKLAWDFSPEQLDHPFDCFKASRTNASKKQREKLLELIRRLAEDDKDGVMAHRVLNLLWNLAHSDDVPVDIMDLALSAHIKILDYSCSQDRDTQKIQWIDRFIEELRTNDKWVIPALKQIREICSLFGEAPQNLSQTQRSPHVFYRHDLINQLQHNHALVTLVAENLATYMESMRLYARDHEDYDPQTVRLGSRYSHVQEVQERLNFLRFLLKDGQLWLCAPQAKQIWKCLAENAVYLCDREACFKWYSKLMGDEPDLDPDINKDFFESNVLQLDPSLLTENGMKCFERFFKAVNCREGKLVAKRRAYMMDDLELIGLDYLWRVVIQSNDDIASRAIDLLKEIYTNLGPRLQVNQVVIHEDFIQSCFDRLKASYDTLCVLDGDKDSVNCARQEAVRMVRVLTVLREYINECDSDYHEERTILPMSRAFRGKHLSFVVRFPNQGRQVDDLEVWSHTNDTIGSVRRCILNRIKANVAHTKIELFVGGELIDPADDRKLIGQLNLKDKSLITAKLTQISSNMPSSPDSSSDSSTGSPGNHGNHYSDGPNPEVESCLPGVIMSLHPRYISFLWQVADLGSSLNMPPLRDGARVLMKLMPPDSTTIEKLRAICLDHAKLGESSLSPSLDSLFFGPSASQVLYLTEVVYALLMPAGAPLADDSSDFQFHFLKSGGLPLVLSMLTRNNFLPNADMETRRGAYLNALKIAKLLLTAIGYGHVRAVAEACQPGVEGVNPMTQINQVTHDQAVVLQSALQSIPNPSSECMLRNVSVRLAQQISDEASRYMPDICVIRAIQKIIWASGCGSLQLVFSPNEEITKIYEKTNAGNEPDLEDEQVCCEALEVMTLCFALIPTALDALSKEKAWQTFIIDLLLHCHSK

SEQ ID NO: 889973 - protein, 289 aa, Homo sapiens
AGPGGLVAGKEEKKKAGGGVLNRLKARRQAPHHAADDGVGAAVTEQELLAMDTIRPEHVLRLSRVTERVCTHLVRPILACPSLLACSLLTLWQQQHSLDGSKAAMVSAELLQQAAQGCSDYLCKPEDNIYSIDFTRFKIRDLETGTVLFEIAKPCVSDQEEDEEEGGGDVDISAGRFVRYQFTPAFLRLRTVGATVEFTVGDKPVSNFRMIERHYFREHLLKNFDFDFGFCIPSSRNTCEHIYEFPQLSEDVIRLMIENPYETRSDSFYFVDNKLIMHNKADYAYNGGQ

SEQ ID NO: 889974 - protein, 289 aa, Homo sapiens; identical to SEQ ID NO: 889973

SEQ ID NO: 889975 - protein, 289 aa, Homo sapiens; identical to SEQ ID NO: 889973

SEQ ID NO: 889976 - protein, 289 aa, Homo sapiens; identical to SEQ ID NO: 889973

SEQ ID NO: 889977 - protein, 289 aa, Homo sapiens; identical to SEQ ID NO: 889973

SEQ ID NO: 889978 - protein, 111 aa, Homo sapiens
AGPGGLVAGKEEKKKAGGGVLNRLKARRQAPHHAADDGVGAAVTEQELLAMDTIRPEHVLRLSRVTERVCTHLVRPILACPSLLACSLLTLWQQQHSLDGSKAAMVSAELL

SEQ ID NO: 889979 - protein, 292 aa, Homo sapiens
ADDAGAAGGPGGPGGPGMGNRGGFRGGFGSGIRGRGRGRGRGRGRGRGARGGKAEDKEWMPVTKLGRLVKDMKIKSLEEIYLFSLPIKESEIIDFFLGASLKDEVLKIMPVQKQTRAGQRTRFKAFVAIGDYNGHVGLGVKCSKEVATAIRGAIILAKLSIVPVRRGYWGNKIGKPHTVPCKVTGRCGSVLVRLIPAPRGTGIVSAPVPKKLLMMAGIDDCYTSARGCTATLGNFAKATFDAISKTYSYLTPDLWKETVFTKSPYQEFTDHLVKTHTRVSVQRTQAPAVATT

SEQ ID NO: 889980 - protein, 292 aa, Homo sapiens; identical to SEQ ID NO: 889979

SEQ ID NO: 889981 - protein, 280 aa, Homo sapiens
MVAGAAGAWALVALMEPRSAGGGGRSRGRGRGRGRGARGGKAEDKEWMPVTKLGRLVKDMKIKSLEEIYLFSLPIKESEIIDFFLGASLKDEVLKIMPVQKQTRAGQRTRFKAFVAIGDYNGHVGLGVKCSKEVATAIRGAIILAKLSIVPVRRGYWGNKIGKPHTVPCKVTGRCGSVLVRLIPAPRGTGIVSAPVPKKLLMMAGIDDCYTSARGCTATLGNFAKATFDAISKTYSYLTPDLWKETVFTKSPYQEFTDHLVKTHTRVSVQRTQAPAVATT

SEQ ID NO: 889982 - protein, 292 aa, Homo sapiens; identical to SEQ ID NO: 889979

SEQ ID NO: 889983 - protein, 244 aa, Homo sapiens
MVAGAAGAWALVALMEPRSAGGGGRSRGRGRGRGRGARGGKAEDKEWMPVTKLGRLVKDMKIKSLEEIYLFSLPIKESEIIDFFLGASLKDEVLKIMPVQKQTRAGQRTRFKAFVAIGDYNGHVGLGVKCSKEVATAIRGAIILAKLSIVPVRRGYWGNKIGKPHTVPCKVTGRCGSVLVRLIPAPRGTGIVSAPVPKKLLMMAGIDEYEVPMNSEVPMNSEVPMNSVAPKNSAVPINSVAPMY

SEQ ID NO: 889984 - protein, 122 aa, Homo sapiens
MTTATRQEVLGLYRSIFRLARKWQATSGQMEDTIKEKQYILNEARTLFRKNKNLTDTDLIKQCIDECTARIEIGLHYKIPYPRPIHLPPMGLTPLRGRGLRSQEKLRKLSKPVYLRSHDEVS

SEQ ID NO: 889985 - protein, 122 aa, Homo sapiens; identical to SEQ ID NO: 889984

SEQ ID NO: 889986 - protein, 248 aa, Homo sapiens
PPPRAPTSQRSPRTEDQSLHPLQGSSNPISPGPGLRGAGGGEAGTVGSLPPPPPPLLPPLPPPPLHLRPTGVRPPRSPAPSIASCIITSGNPAGRQLQEGEWERGKEGTSGRLRHDAHKDVRSRRQMTTATRQEVLGLYRSIFRLARKWQATSGQMEDTIKEKQYILNEARTLFRKNKNLTDTDLIKQCIDECTARIEIGLHYKIPYPRPIHLPPMGLTPLRGRGLRSQEKLRKLSKPVYLRSHDEVS

SEQ ID NO: 889987 - protein, 164 aa, Homo sapiens
PPPRAPTSQRSPRTEDQSLHPLQGSSNPISPGPGLRGAGGGEAGTVGSLPPPPPPLLPPLPPPPLHLRPTGVRPPRSPAPSIASCIITSGNPAGRQLQEGEWERGKEGTSGRLRHDAHKDVRSRRQRVPREGEASKGDDTDKTSEIKGRGPLISWNNGTHPRNQ

SEQ ID NO: 889988 - protein, 122 aa, Homo sapiens; identical to SEQ ID NO: 889984

SEQ ID NO: 889989 - protein, 195 aa, Homo sapiens
PPPRAPTSQRSPRTEDQSLHPLQGSSNPISPGPGLRGAGGGEAGTVGSLPPPPPPLLPPLPPPPLHLRPTGVRPPRSPAPSIASCIITSGNPAGRQLQEGEWERGKEGTSGRLRHDAHKDVRSRRQLTDTDLIKQCIDECTARIEIGLHYKIPYPRPIHLPPMGLTPLRGRGLRSQEKLRKLSKPVYLRSHDEVS

SEQ ID NO: 889990 - protein, 164 aa, Homo sapiens; identical to SEQ ID NO: 889987

SEQ ID NO: 889991 - protein, 88 aa, Homo sapiens
ASRKWLARPRGEAWCGDAQLTDTDLIKQCIDECTARIEIGLHYKIPYPRPIHLPPMGLTPLRGRGLRSQEKLRKLSKPVYLRSHDEVS

SEQ ID NO: 889992 - protein, 122 aa, Homo sapiens; identical to SEQ ID NO: 889984

SEQ ID NO: 889993 - protein, 122 aa, Homo sapiens; identical to SEQ ID NO: 889984

SEQ ID NO: 889994 - protein, 122 aa, Homo sapiens; identical to SEQ ID NO: 889984

SEQ ID NO: 889995 - protein, 164 aa, Homo sapiens; identical to SEQ ID NO: 889987

SEQ ID NO: 889996 - protein, 122 aa, Homo sapiens; identical to SEQ ID NO: 889984

SEQ ID NO: 889997 - protein, 122 aa, Homo sapiens; identical to SEQ ID NO: 889984

SEQ ID NO: 889998 - protein, 122 aa, Homo sapiens; identical to SEQ ID NO: 889984

SEQ ID NO: 889999 - protein, 72 aa, Homo sapiens
SVSRDSPRPGTGAPTEVGPVVWSGLAYWTSLCSVGHGSAGLLAPPPPSPPRAARFCGWGKAGLTQTHGHRPN

SEQ ID NO: 890000 - protein, 107 aa, Homo sapiens
MTTATRQEVLGLYRSIFRLARKWQATSGQMEDTIKEKQYILNEARTLFRKNKNARIEIGLHYKIPYPRPIHLPPMGLTPLRGRGLRSQEKLRKLSKPVYLRSHDEVS

SEQ ID NO: 890001 - protein, 248 aa, Homo sapiens; identical to SEQ ID NO: 889986

SEQ ID NO: 890002 - protein, 248 aa, Homo sapiens; identical to SEQ ID NO: 889986

SEQ ID NO: 890003 - protein, 840 aa, Homo sapiens
MNGEYRGRGFGRGRFQSWKRGRGGGNFSGKWREREHRPDLSKTTGKRTSEQTPQFLLSTKTPQSMQSTLDRFIPYKGWKLYFSEVYSDSSPLIEKIQAFEKFFTRHIDLYDKDEIERKGSILVDFKELTEGGEVTNLIPDIATELRDAPEKTLACMGLAIHQVLTKDLERHAAELQAQEGLSNDGETMVNVPHIHARVYNYEPLTQLKNVRANYYGKYIALRGTVVRVSNIKPLCTKMAFLCAACGEIQSFPLPDGKYSLPTKCPVPVCRGRSFTALRSSPLTVTMDWQSIKIQELMSDDQREAGRIPRTIECELVHDLVDSCVPGDTVTITGIVKVSNAEEGSRNKNDKCMFLLYIEANSISNSKGQKTKSSEDGCKHGMLMEFSLKDLYAIQEIQAEENLFKLIVNSLCPVIFGHELVKAGLALALFGGSQKYADDKNRIPIRGDPHILVVGDPGLGKSQMLQAACNVAPRGVYVCGNTTTTSGLTVTLSKDSSSGDFALEAGALVLGDQGICGIDEFDKMGNQHQALLEAMEQQSISLAKAGVVCSLPARTSIIAAANPVGGHYNKAKTVSENLKMGSALLSRFDLVFILLDTPNEHHDHLLSEHVIAIRAGKQRTISSATVARMNSQDSNTSVLEVVSEKPLSERLKVVPGETIDPIPHQLLRKYIGYARQYVYPRLSTEAARVLQDFYLELRKQSQRLNSSPITTRQLESLIRLTEARARLELREEATKEDAEDIVEIMKYSMLGTYSDEFGNLDFERSQHGSGMSNRSTAKRFISALNNVAERTYNNIFQFHQLRQIAKELNIQVADFENFIGSLNDQGYLLKKGPKVYQLQTM

SEQ ID NO: 890004 - protein, 824 aa, Homo sapiens
MNGEYRGRGFGRGRFQSWKRGRGGGNFSGKWREREHRPDLSKTTGKRTSEQTPQFLLSTKTPQSMQSTLDRFIPYKGWKLYFSEVYSDSSPLIEKIQAFEKFFTRHIDLYDKDEIERKGSILVDFKELTEGGEVTNLIPDIATELRDAPEKTLACMGLAIHQVLTKDLERHAAELQAQEGLSNDGETMVNVPHIHARVYNYEPLTQLKNVRANYYGKYIALRGTVVRVSNIKPLCTKMAFLCAACGEIQSFPLPDGKYSLPTKCPVPVCRGRSFTALRSSPLTVTMDWQSIKIQELMSDDQREAGRIPRTIECELVHDLVDSCVPGDTVTITGIVKVSNAEEANSISNSKGQKTKSSEDGCKHGMLMEFSLKDLYAIQEIQAEENLFKLIVNSLCPVIFGHELVKAGLALALFGGSQKYADDKNRIPIRGDPHILVVGDPGLGKSQMLQAACNVAPRGVYVCGNTTTTSGLTVTLSKDSSSGDFALEAGALVLGDQGICGIDEFDKMGNQHQALLEAMEQQSISLAKAGVVCSLPARTSIIAAANPVGGHYNKAKTVSENLKMGSALLSRFDLVFILLDTPNEHHDHLLSEHVIAIRAGKQRTISSATVARMNSQDSNTSVLEVVSEKPLSERLKVVPGETIDPIPHQLLRKYIGYARQYVYPRLSTEAARVLQDFYLELRKQSQRLNSSPITTRQLESLIRLTEARARLELREEATKEDAEDIVEIMKYSMLGTYSDEFGNLDFERSQHGSGMSNRSTAKRFISALNNVAERTYNNIFQFHQLRQIAKELNIQVADFENFIGSLNDQGYLLKKGPKVYQLQTM

SEQ ID NO: 890005 - protein, 840 aa, Homo sapiens; identical to SEQ ID NO: 890003

SEQ ID NO: 890006 - protein, 840 aa, Homo sapiens; identical to SEQ ID NO: 890003

SEQ ID NO: 890007 - protein, 840 aa, Homo sapiens; identical to SEQ ID NO: 890003

SEQ ID NO: 890008 - protein, 383 aa, Homo sapiens [sequence omitted]

SEQ ID NO: 890009 - protein, 272 aa, Homo sapiens
YHSDVGADCLGCCAPPRCLGDLWARARATMTDYGEEQRNELEALESIYPDSFTVLSENPPSFTITVTSEAGENDETVQTTLKFTYSEKYPDEAPLYEIFSQENLEDNDVSDILKLLALQAEENLGMVMIFTLVTAVQEKLNEIVDQIKTRREEEKKQKEKEAEEAEKQLFHGTPVTIENFLNWKAKFDAELLEIKKKRMKEEEQAGKNKLSGKQLFETDHNLDTSDIQFLEDAGNNVEVDESLFQEMDDLELEDDEDDPDYNPADPESDSAD

SEQ ID NO: 890010 - protein, 243 aa, Homo sapiens
MTDYGEEQRNELEALESIYPDSFTVLSENPPSFTITVTSEAGENDETVQTTLKFTYSEKYPDEAPLYEIFSQENLEDNDVSDILKLLALQAEENLGMVMIFTLVTAVQEKLNEIVDQIKTRREEEKKQKEKEAEEAEKQLFHGTPVTIENFLNWKAKFDAELLEIKKKRMKEEEQAGKNKLSGKQLFETDHNLDTSDIQFLEDAGNNVEVDESLFQEMDDLELEDDEDDPDYNPADPESDSAD

SEQ ID NO: 890011 - protein, 147 aa, Homo sapiens
MVMIFTLVTAVQEKLNEIVDQIKTRREEEKKQKEKEAEEAEKQLFHGTPVTIENFLNWKAKFDAELLEIKKKRMKEEEQAGKNKLSGKQLFETDHNLDTSDIQFLEDAGNNVEVDESLFQEMDDLELEDDEDDPDYNPADPESDSAD

SEQ ID NO: 890012 - protein, 147 aa, Homo sapiens; identical to SEQ ID NO: 890011

SEQ ID NO: 890013 - protein, 240 aa, Homo sapiens
MRVLRTDHNLADLISVLGGCGNNVEVDESLYQEMDDLELENDETVQTTLKFTYSEKYPDEAPLYEIFSQENLEDNDVSDILKLLALQAEENLGMVMIFTLVTAVQEKLNEIVDQIKTRREEEKKQKEKEAEEAEKQLFHGTPVTIENFLNWKAKFDAELLEIKKKRMKEEEQAGKNKLSGKQLFETDHNLDTSDIQFLEDAGNNVEVDESLFQEMDDLELEDDEDDPDYNPADPESDSAD

SEQ ID NO: 890014 - protein, 272 aa, Homo sapiens
GGRRGAAVKQAGSGFGPWAFQPGTLRLRPPGRRPLSRRGSCLGCCAPPRCLGDLWARARATMTDYGEEQRNELEALESIYPDSFTVLSENPPSFTITVTSEAGENDETVQTTLKFTYSEKYPDEAPLYEIFSQENLEDNDVSDILKLLALQAEENLGMVMIFTLVTAVQEKLNEIVDQIKTRREEEKKQKEKEAEEAEKQLFHGTPVTIENFLNWKAKFDAELLEIKKKRMKEEEQAGKNKLSGKQLFETDHNLDTSDIQFLEDGKIIVEFH

SEQ ID NO: 890015 - protein, 304 aa, Homo sapiens
GGRRGAAVKQAGSGFGPWAFQPGTLRLRPPGRRPLSRRGSCLGCCAPPRCLGDLWARARATMTDYGEEQRNELEALESIYPDSFTVLSENPPSFTITVTSEAGENDETVQTTLKFTYSEKYPDEAPLYEIFSQENLEDNDVSDILKLLALQAEENLGMVMIFTLVTAVQEKLNEIVDQIKTRREEEKKQKEKEAEEAEKQLFHGTPVTIENFLNWKAKFDAELLEIKKKRMKEEEQAGKNKLSGKQLFETDHNLDTSDIQFLEDAGNNVEVDESLFQEMDDLELEDDEDDPDYNPADPESDSAD

SEQ ID NO: 890016 - protein, 147 aa, Homo sapiens; identical to SEQ ID NO: 890011

SEQ ID NO: 890017 - protein, 237 aa, Homo sapiens
TPTQHNAAGRRNEPEGLQVLSENPPSFTITVTSEAGENDETVQTTLKFTYSEKYPDEAPLYEIFSQENLEDNDVSDILKLLALQAEENLGMVMIFTLVTAVQEKLNEIVDQIKTRREEEKKQKEKEAEEAEKQLFHGTPVTIENFLNWKAKFDAELLEIKKKRMKEEEQAGKNKLSGKQLFETDHNLDTSDIQFLEDAGNNVEVDESLFQEMDDLELEDDEDDPDYNPADPESDSAD

SEQ ID NO: 890018 - protein, 304 aa, Homo sapiens; identical to SEQ ID NO: 890015

SEQ ID NO: 890019 - protein, 121 aa, Homo sapiens
YHSDVGADCLGCCAPPRCLGDLWARARATMTDYGEEQRNELEALESIYPDSFTVLSENPPSFTITVTSEAGENDETVQTTLKFTYSEKYPDEAPLYEIFSQENLEDNDVSDNVYTLSDDKE

SEQ ID NO: 890020 - protein, 1366 aa, Homo sapiens
RENSTKVVFLITDGYSNGGDPRPIAASLRDSGVEIFTFGIWQGNIRELNDMASTPKEEHCYLLHSFEEFEALARRALHEDLPSGSFIQDDMVHCSYLCDEGKDCCDRMGSCKCGTHTGHFECICEKGYYGKGLQYECTACPSGTYKPEGSPGGISSCIPCPDENHTSPPGSTSPEDCVCREGYRASGQTCELVHCPALKPPENGYFIQNTCNNHFNAACGVRCHPGFDLVGSSIILCLPNGLWSGSESYCRVRTCPHLRQPKHGHISCSTREMLYKTTCLVACDEGYRLEGSDKLTCQGNSQWDGPEPRCVERHCSTFQMPKDVIISPHNCGKQPAKFGTICYVSCRQGFILSGVKEMLRCTTSGKWNVGVQAAVCKDVEAPQINCPKDIEAKTLEQQDSANVTWQIPTAKDNSGEKVSVHVHPAFTPPYLFPIGDVAIVYTATDLSGNQASCIFHIKVIDAEPPVIDWCRSPPPVQVSEKVHAASWDEPQFSDNSGAELVITRSHTQGDLFPQGETIVQYTATDPSGNNRTCDIHIVIKGSPCEIPFTPVNGDFICTPDNTGVNCTLTCLEGYDFTEGSTDKYYCAYEDGVWKPTYTTEWPDCAKKRFANHGFKSFEMFYKAARCDDTDLMKKFSEAFETTLGKMVPSFCSDAEDIDCRLEENLTKKYCLEYNYDYENGFAIGPGGWGAANRLDYSYDDFLDTVQETATSIGNAKSSRIKRSAPLSDYKIKLIFNITASVPLPDERNDTLEWENQQRLLQTLETITNKLKRTLNKDPMYSFQLASEILIADSNSLETKKASPFCRPGSVLRGRMCVNCPLGTYYNLEHFTCESCRIGSYQDEEGQLECKLCPSGMYTEYIHSRNISDCKAQCKQGTYSYSGLETCESCPLGTYQPKFGSRSCLSCPENTSTVKRGAVNISACGVPCPEGKFSRSGLMPCHPCPRDYYQPNAGKAFCLACPFYGTTPFAGSRSITECSSFSSTFSAAEESVVPPASLGHIKKRHEISSQVFHECFFNPCHNSGTCQQLGRGYVCLCPLGYTGLKCETDIDECSPLPCLNNGVCKDLVGEFICECPSGYTGQRCEENINECSSSPCLNKGICVDGVAGYRCTCVKGFVGLHCETEVNECQSNPCLNNAVCEDQVGGFLCKCPPGFLGTRCGKNVDECLSQPCKNGATCKDGANSFRCLCAAGFTGSHCELNINECQSNPCRNQATCVDELNSYSCKCQPGFSGKRCETEQSTGFNLDFEVSGIYGYVMLDGMLPSLHALTCTFWMKSSDDMNYGTPISYAVDNGSDNTLLLTDYNGWVLYVNGREKITNCPSVNDGRWHHIAITWTSANGIWKVYIDGKLSDGGAGLSVGLPIPGMF

SEQ ID NO: 890021 - protein, 685 aa, Homo sapiens
RENSTKVVFLITDGYSNGGDPRPIAASLRDSGVEIFTFGIWQGNIRELNDMASTPKEEHCYLLHSFEEFEALARRALHEDLPSGSFIQDDMVHCSYLCDEGKDCCDRMGSCKCGTHTGHFECICEKGYYGKGLQYECTACPSGTYKPEGSPGGISSCIPCPDENHTSPPGSTSPEDCVCREGYRASGQTCELVHCPALKPPENGYFIQNTCNNHFNAACGVRCHPGFDLVGSSIILCLPNGLWSGSESYCRVRTCPHLRQPKHGHISCSTREMLYKTTCLVACDEGYRLEGSDKLTCQGNSQWDGPEPRCVERHCSTFQMPKDVIISPHNCGKQPAKFGTICYVSCRQGFILSGVKEMLRCTTSGKWNVGVQAAVCKDVEAPQINCPKDIEAKTLEQQDSANVTWQIPTAKDNSGEKVSVHVHPAFTPPYLFPIGDVAIVYTATDLSGNQASCIFHIKVIDAEPPVIDWCRSPPPVQVSEKVHAASWDEPQFSDNSGAELVITRSHTQGDLFPQGETIVQYTATDPSGNNRTCDIHIVIKGSPCEIPFTPVNGDFICTPDNTGVNCTLTCLEGYDFTEGSTDKYYCAYEDGVWKPTYTTEWPDCAKKRFANHGFKSFEMFYKAARCDDTDLMKKFSEAFETTLGKMVPSFCSDAEDIDCRLEENLTKKYCLEYNYDYENGFAIGN

SEQ ID NO: 890022 - protein, 1603 aa, Homo sapiens
RENSTKVVFLITDGYSNGGDPRPIAASLRDSGVEIFTFGIWQGNIRELNDMASTPKEEHCYLLHSFEEFEALARRALHEDLPSGSFIQDDMVHCSYLCDEGKDCCDRMGSCKCGTHTGHFECICEKGYYGKGLQYECTACPSGTYKPEGSPGGISSCIPCPDENHTSPPGSTSPEDCVCREGYRASGQTCELVHCPALKPPENGYFIQNTCNNHFNAACGVRCHPGFDLVGSSIILCLPNGLWSGSESYCRVRTCPHLRQPKHGHISCSTREMLYKTTCLVACDEGYRLEGSDKLTCQGNSQWDGPEPRCVERHCSTFQMPKDVIISPHNCGKQPAKFGTICYVSCRQGFILSGVKEMLRCTTSGKWNVGVQAAVCKDVEAPQINCPKDIEAKTLEQQDSANVTWQIPTAKDNSGEKVSVHVHPAFTPPYLFPIGDVAIVYTATDLSGNQASCIFHIKVIDAEPPVIDWCRSPPPVQVSEKVHAASWDEPQFSDNSGAELVITRSHTQGDLFPQGETIVQYTATDPSGNNRTCDIHIVIKGSPCEIPFTPVNGDFICTPDNTGVNCTLTCLEGYDFTEGSTDKYYCAYEDGVWKPTYTTEWPDCAKKRFANHGFKSFEMFYKAARCDDTDLMKKFSEAFETTLGKMVPSFCSDAEDIDCRLEENLTKKYCLEYNYDYENGFAIGPGGWGAANRLDYSYDDFLDTVQETATSIGNAKSSRIKRSAPLSDYKIKLIFNITASVPLPDERNDTLEWENQQRLLQTLETITNKLKRTLNKDPMYSFQLASEILIADSNSLETKKASPFCRPGSVLRGRMCVNCPLGTYYNLEHFTCESCRIGSYQDEEGQLECKLCPSGMYTEYIHSRNISDCKAQCKQGTYSYSGLETCESCPLGTYQPKFGSRSCLSCPENTSTVKRGAVNISACGVPCPEGKFSRSGLMPCHPCPRDYYQPNAGKAFCLACPFYGTTPFAGSRSITECSSFSSTFSAAEESVVPPASLGHIKKRHEISSQVFHECFFNPCHNSGTCQQLGRGYVCLCPLGYTGLKCETDIDECSPLPCLNNGVCKDLVGEFICECPSGYTGQRCEENINECSSSPCLNKGICVDGVAGYRCTCVKGFVGLHCETEVNECQSNPCLNNAVCEDQVGGFLCKCPPGFLGTRCGKNVDECLSQPCKNGATCKDGANSFRCLCAAGFTGSHCELNINECQSNPCRNQATCVDELNSYSCKCQPGFSGKRCETEQSTGFNLDFEVSGIYGYVMLDGMLPSLHALTCTFWMKSSDDMNYGTPISYAVDNGSDNTLLLTDYNGWVLYVNGREKITNCPSVNDGRWHHIAITWTSANGIWKVYIDGKLSDGGAGLSVGLPIPGGGALVLGQEQDKKGEGFSPAESFVGSISQLNLWDYVLSPQQVKSLATSCPEELSKGNVLAWPDFLSGIVGKVKIDSKSIFCSDCPRLGGSVPHLRTASEDLKPGSKVNLFCDPGFQLVGNPVQYCLNQGQWTQPLPHCERISCGVPPPLENGFHSADDFYAGSTVTYQCNNGYYLLGDSRMFCTDNGSWNGVSPSCLDVDECAVGSDCSEHASCLNVDGSYICSCVPPYTGDGKNCAGN

SEQ ID NO: 890023 - protein, 924 aa, Homo sapiens
RENSTKVVFLITDGYSNGGDPRPIAASLRDSGVEIFTFGIWQGNIRELNDMASTPKEEHCYLLHSFEEFEALARRALHEDLPSGSFIQDDMVHCSYLCDEGKDCCDRMGSCKCGTHTGHFECICEKGYYGKGLQYECTACPSGTYKPEGSPGGISSCIPCPDENHTSPPGSTSPEDCVCREGYRASGQTCELVHCPALKPPENGYFIQNTCNNHFNAACGVRCHPGFDLVGSSIILCLPNGLWSGSESYCRVRTCPHLRQPKHGHISCSTREMLYKTTCLVACDEGYRLEGSDKLTCQGNSQWDGPEPRCVERHCSTFQMPKDVIISPHNCGKQPAKFGTICYVSCRQGFILSGVKEMLRCTTSGKWNVGVQAAVCKDVEAPQINCPKDIEAKTLEQQDSANVTWQIPTAKDNSGEKVSVHVHPAFTPPYLFPIGDVAIVYTATDLSGNQASCIFHIKVIDAEPPVIDWCRSPPPVQVSEKVHAASWDEPQFSDNSGAELVITRSHTQGDLFPQGETIVQYTATDPSGNNRTCDIHIVIKGSPCEIPFTPVNGDFICTPDNTGVNCTLTCLEGYDFTEGSTDKYYCAYEDGVWKPTYTTEWPDCAKKRFANHGFKSFEMFYKAARCDDTDLMKKFSEAFETTLGKMVPSFCSDAEDIDCRLEENLTKKYCLEYNYDYENGFAIGPGGWGAANRLDYSYDDFLDTVQETATSIGNAKSSRIKRSAPLSDYKIKLIFNITASVPLPDERNDTLEWENQQRLLQTLETITNKLKRTLNKDPMYSFQLASEILIADSNSLETKKASPFCRPGSVLRGRMCVNCPLGTYYNLEHFTCESCRIGSYQDEEGQLECKLCPSGMYTEYIHSRNISDCKGRGLLDISTRSSPIFVSLLGERKIYFLHPTLGSCLRPLWQKIDLQEKSIHIYSI

SEQ ID NO: 890024 - protein, 822 aa, Homo sapiens
RENSTKVVFLITDGYSNGGDPRPIAASLRDSGVEIFTFGIWQGNIRELNDMASTPKEEHCYLLHSFEEFEALARRALHEDLPSGSFIQDDMVHCSYLCDEGKDCCDRMGSCKCGTHTGHFECICEKGYYGKGLQYECTACPSGTYKPEGSPGGISSCIPCPDENHTSPPGSTSPEDCVCREGYRASGQTCELVHCPALKPPENGYFIQNTCNNHFNAACGVRCHPGFDLVGSSIILCLPNGLWSGSESYCRVRTCPHLRQPKHGHISCSTREMLYKTTCLVACDEGYRLEGSDKLTCQGNSQWDGPEPRCVERHCSTFQMPKDVIISPHNCGKQPAKFGTICYVSCRQGFILSGVKEMLRCTTSGKWNVGVQAAVCKDVEAPQINCPKDIEAKTLEQQDSANVTWQIPTAKDNSGEKVSVHVHPAFTPPYLFPIGDVAIVYTATDLSGNQASCIFHIKVIDAEPPVIDWCRSPPPVQVSEKVHAASWDEPQFSDNSGAELVITRSHTQGDLFPQGETIVQYTATDPSGNNRTCDIHIVIKGSPCEIPFTPVNGDFICTPDNTGVNCTLTCLEGYDFTEGSTDKYYCAYEDGVWKPTYTTEWPDCAKKRFANHGFKSFEMFYKAARCDDTDLMKKFSEAFETTLGKMVPSFCSDAEDIDCRLEENLTKKYCLEYNYDYENGFAIGPGGWGAANRLDYSYDDFLDTVQETATSIGNAKSSRIKRSAPLSDYKIKLIFNITASVPLPDERNDTLEWENQQRLLQTLETITNKLKRTLNKDPMYSFQLASEILIADSNSLETKKASPFCRPGSVLRGRMCGKDCSL

SEQ ID NO: 890025 - protein, 121 aa, Homo sapiens
MIETADISVTAGDAQEEEAEVFQGVEVVVDHVVANPPSVLCSIDPDSKIHSSVTYDKNEIRGILLDLRSLLGHWYCTIQLIQDARSKNQNIKSNRSKKNNGHIHVQVFIKFYSSTNNELDF

SEQ ID NO: 890026 - protein, 162 aa, Homo sapiens
VKTPGDWSLAGEDDRDAADISVTAGDAQEEEAEVFQGVEVVVDHVGGKSSISYGTNSELSNPSETESERKDELSDWSLAGEDDRDSRHQRDSRRRPGGRGRSVSGGRGRGGPRGGKSSISSGTNSELSNPSETESERKDELSDGHWQEKMIETADISVTAGD

SEQ ID NO: 890027 - protein, 642 aa, Homo sapiens
LKDPYFFNPPPPPPPGLCGSNMAELTVEVRGSNGAFYKGFIKDVHEDSLTVVFENNWQPERQVPFNEVRLPPPPDIKKEISEGDEVEVYSRANDQEPCGWWLAKVRMMKGEFYVIEYAACDATYNEIVTFERLRPVNQNKTVKKNTFFKCTVDVPEDLREACANENAHKDFKKAVGACRIFYHPETTQLMILSASEATVKRVNILSDMHLRSIRTKLMLMSRNEEATKHLECTKQLAAAFHEEFVVREDLMGLAIGTHGSNIQQARKVPGVTAIELDEDTGTFRIYGESADAVKKARGFLEFVEDFIQVPRNLVGKVIGKNGKVIQEIVDKSGVVRVRIEGDNENKLPREDGMVPFVFVGTKESIGNVQVLLEYHIAYLKEVEQLRMERLQIDEQLRQIGSRSYSGRGRGRRGPNYTSGYGTNSELSNPSETESERKDELSDWSLAGEDDRDSRHQRDSRRRPGGRGRSVSGGRGRGGPRGGKSSISSVLKDPDSNPYSLLDNTESDQTADTDASESHHSTNRRRRSRRRRTDEDAVLMDGMTESDTASVNENGLVTVADYISRAESQSRQRNLPRETLAKNKKEMAKDVIEEHGPSEKAINGPTSASGDDISKLQRTPGEEKINTLKEENTQEAAVLNGVS

SEQ ID NO: 890028 - protein, 621 aa, Homo sapiens
MAELTVEVRGSNGAFYKGFIKDVHEDSLTVVFENNWQPERQVPFNEVRLPPPPDIKKEISEGDEVEVYSRANDQEPCGWWLAKVRMMKGEFYVIEYAACDATYNEIVTFERLRPVNQNKTVKKNTFFKCTVDVPEDLREACANENAHKDFKKAVGACRIFYHPETTQLMILSASEATVKRVNILSDMHLRSIRTKLMLMSRNEEATKHLECTKQLAAAFHEEFVVREDLMGLAIGTHGSNIQQARKVPGVTAIELDEDTGTFRIYGESADAVKKARGFLEFVEDFIQVPRNLVGKVIGKNGKVIQEIVDKSGVVRVRIEGDNENKLPREDGMVPFVFVGTKESIGNVQVLLEYHIAYLKEVEQLRMERLQIDEQLRQIGSRSYSGRGRGRRGPNYTSGYGTNSELSNPSETESERKDELSDWSLAGEDDRDSRHQRDSRRRPGGRGRSVSGGRGRGGPRGGKSSISSVLKDPDSNPYSLLDNTESDQTADTDASESHHSTNRRRRSRRRRTDEDAVLMDGMTESDTASVNENGLVTVADYISRAESQSRQRNLPRETLAKNKKEMAKDVIEEHGPSEKAINGPTSASGDDISKLQRTPGEEKINTLKEENTQEAAVLNGVS

SEQ ID NO: 890029 - protein, 539 aa, Homo sapiens
MAELTVEVRGSNGAFYKGFIKDVHEDSLTVVFENNWQPERQVPFNEVRLPPPPDIKKEISEGDEVEVYSRANDQEPCGWWLAKVRMMKGEFYVIEYAACDATYNEIVTFERLRPVNQNKTVKKNTFFKCTVDVPEDLREACANENAHKDFKKAVGACRIFYHPETTQLMILSASEATVKRVNILSDMHLRSIRTKLMLMSRNEEATKHLECTKQLAAAFHEEFVVREDLMGLAIGTHGSNIQQARKVPGVTAIELDEDTGTFRIYGESADAVKKARGFLEFVEDFIQVPRNLVGKVIGKNGKVIQEIVDKSGVVRVRIEGDNENKLPREDGMVPFVFVGTKESIGNVQVLLEYHIAYLKEVEQLRMERLQIDEQLRQIGSRSYSGRGRGRRGPNYTSGYGTNSELSNPSETESERKDELSDWSLAGEDDRDSRHQRDSRRRPGGRGRSVSGGRGRGGPRGGKSSISSVLKDPDSNPYSLLDNTESDQTADTDASESHHSTNRRRRSRRRRTDEDAVLMDGMTESDTASVNENGLGKRCD

SEQ ID NO: 890030 - protein, 648 aa, Homo sapiens
MAELTVEVRGSNGAFYKGFIKDVHEDSLTVVFENNWQPERQVPFNEVRLPPPPDIKKEISEGDEVEVYSRANDQEPCGWWLAKVRMMKGEFYVIEYAACDATYNEIVTFERLRPVNQNKTVKKNTFFKCTVDVPEDLREACANENAHKDFKKAVGACRIFYHPETTQLMILSASEATVKRVNILSDMHLRSIRTKLMLMSRNEEATKHLECTKQLAAAFHEEFVVREDLMGLAIGTHGSNIQQARKVPGVTAIELDEDTGTFRIYGESADAVKKARGFLEFVEDFIQVPRNLVGKVIGKNGKVIQEIVDKSGVVRVRIEGDNENKLPREDGMVPFVFVGTKESIGNVQVLLEYHIAYLKEVEQLRMERLQIDEQLRQIGSRSYSGRGRGRRGPNYTSGYGTNSELSNPSETESERKDELSDWSLAGEDDRDSRHQRDSRRRPGGRGRSVSGGRGRGGPRGGKSSISSVLKDPDSNPYSLLDNTESDQTADTDASESHHSTNRRRRSRRRRTDEDAVLMDGMTESDTASVNENGLDDSEKKPQRRNRSRRRRFRGQAEDRQPVTVADYISRAESQSRQRNLPRETLAKNKKEMAKDVIEEHGPSEKAINGPTSASGDDISKLQRTPGEEKINTLKEENTQEAAVLNGVS

SEQ ID NO: 890031 - protein, 648 aa, Homo sapiens; identical to SEQ ID NO: 890030

SEQ ID NO: 890032 - protein, 614 aa, Homo sapiens
RTDGSRNFYKGFIKDVHEDSLTVVFENNWQPERQVPFNEVRLPPPPDIKKEISEGDEVEVYSRANDQEPCGWWLAKVRMMKGEFYVIEYAACDATYNEIVTFERLRPVNQNKTVKKNTFFKCTVDVPEDLREACANENAHKDFKKAVGACRIFYHPETTQLMILSASEATVKRVNILSDMHLRSIRTKLMLMSRNEEATKHLECTKQLAAAFHEEFVVREDLMGLAIGTHGSNIQQARKVPGVTAIELDEDTGTFRIYGESADAVKKARGFLEFVEDFIQVPRNLVGKVIGKNGKVIQEIVDKSGVVRVRIEGDNENKLPREDGMVPFVFVGTKESIGNVQVLLEYHIAYLKEVEQLRMERLQIDEQLRQIGSRSYSGRGRGRRGPNYTSGYGTNSELSNPSETESERKDELSDWSLAGEDDRDSRHQRDSRRRPGGRGRSVSGGRGRGGPRGGKSSISSVLKDPDSNPYSLLDNTESDQTADTDASESHHSTNRRRRSRRRRTDEDAVLMDGMTESDTASVNENGLVTVADYISRAESQSRQRNLPRETLAKNKKEMAKDVIEEHGPSEKAINGPTSASGDDISKLQRTPGEEKINTLKEENTQEAAVLNGVS

SEQ ID NO: 890033 - protein, 575 aa, Homo sapiens
MAELTVEVRGSNGAFYKGFIKDVHEDSLTVVFENNWQPERQVPFNEVRLPPPPDIKKEISEGDEVEVYSRANDQEPCGWWLAKVRMMKGEFYVIEYAACDATYNEIVTFERLRPVNQNKTVKKNTFFKCTVDVPEDLREACANENAHKDFKKAVGACRIFYHPETTQLMILSASEATVKRVNILSDMHLRSIRTKLMLMSRNEEATKHLECTKQLAAAFHEEFVVREDLMGLAIGTHGSNIQQARKVPGVTAIELDEDTGTFRIYGESADAVKKARGFLEFVEDFIQVPRNLVGKVIGKNGKVIQEIVDKSGVVRVRIEGDNENKLPREDGMVPFVFVGTKESIGNVQVLLEYHIAYLKEVEQLRMERLQIDEQLRQIGSRSYSGRGRGRRGPNYTSGYGTNSELSNPSETESERKDELSDWSLAGEDDRDSRHQRDSRRRPGGRGRSVSGGRGRGGPRGGKSSISSVLKDPDSNPYSLLDNTESDQTADTDASESHHSTNRRRRSRRRRTDEDAVLMDGMTESDTASVNENGLDDSEKKPQRRNRSRRRRFRGQAEDRQPGNLSGPVDTIRSQA

SEQ ID NO: 890034 - protein, 575 aa, Homo sapiens; identical to SEQ ID NO: 890033

SEQ ID NO: 890035 - protein, 258 aa, Homo sapiens
LEDPASRDDEQLRQIGSRSYSGRGRGRRGPNYTSGYGTNSELSNPSETESERKDELSDWSLAGEDDRDSRHQRDSRRRPGGRGRSVSGGRGRGGPRGGKSSISSVLKDPDSNPYSLLDNTESDQTADTDASESHHSTNRRRRSRRRRTDEDAVLMDGMTESDTASVNENGLVTVADYISRAESQSRQRNLPRETLAKNKKEMAKDVIEEHGPSEKAINGPTSASGDDISKLQRTPGEEKINTLKEENTQEAAVLNGVS

SEQ ID NO: 890036 - protein, 275 aa, Homo sapiens
VKTPGDWSLAGEDDRDAADISVTAGDAQEEEAEVFQGVEVVVDHVGGKSSISYGTNSELSNPSETESERKDELSDWSLAGEDDRDSRHQRDSRRRPGGRGRSVSGGRGRGGPRGGKSSISSVLKDPDSNPYSLLDNTESDQTADTDASESHHSTNRRRRSRRRRTDEDAVLMDGMTESDTASVNENGLVTVADYISRAESQSRQRNLPRETLAKNKKEMAKDVIEEHGPSEKAINGPTSASGDDISKLQRTPGEEKINTLKEENTQEAAVLNGVS

SEQ ID NO: 890037 - protein, 218 aa, Homo sapiens
CSRGSLIGSQERKDELSDWSLAGEDDRDSRHQRDSRRRPGGRGRSVSGGRGRGGPRGGKSSISSVLKDPDSNPYSLLDNTESDQTADTDASESHHSTNRRRRSRRRRTDEDAVLMDGMTESDTASVNENGLVTVADYISRAESQSRQRNLPRETLAKNKKEMAKDVIEEHGPSEKAINGPTSASGDDISKLQRTPGEEKINTLKEENTQEAAVLNGVS

SEQ ID NO: 890038 - protein, 102 aa, Homo sapiens
TLEYPPLTLQLMKMGFTVADYISRAESQSRQRNLPRETLAKNKKEMAKDVIEEHGPSEKAINGPTSASGDDISKLQRTPGEEKINTLKEENTQEAAVLNGVS

SEQ ID NO: 890039 - protein, 132 aa, Homo sapiens
LKDPYFFNPPPPPPPGLCGSNMAELTVEVRGSNGAFYKGFIKDVHEDSLTVVFENNWQPERQVPFNEVRLPPPPDIKKKQTTKKKKSGWGAPRDPAKKPLRKHIRGWGARGPQVRSKFGRSDAKHVWQLKRQ

SEQ ID NO: 890040 - protein, 621 aa, Homo sapiens; identical to SEQ ID NO: 890028

SEQ ID NO: 890041 - protein, 621 aa, Homo sapiens; identical to SEQ ID NO: 890028

SEQ ID NO: 890042 - protein, 650 aa, Homo sapiens
MAELTVEVRGSNGAFYKGFIKDVHEDSLTVVFENNWQPERQVPFNEVRLPPPPDIKKEISEGDEVEVYSRANDQEPCGWWLAKVRMMKGEFYVIEYAACDATYNEIVTFERLRPVNQNKTVKKNTFFKCTVDVPEDLREACANENAHKDFKKAVGACRIFYHPETTQLMILSASEATVKRVNILSDMHLRSIRTKLMLMSRNEEATKHLECTKQLAAAFHEEFVVREDLMGLAIGTHGSNIQQARKVPGVTAIELDEDTGTFRIYGESADAVKKARGFLEFVEDFIQVPRNLVGKVIGKNGKVIQEIVDKSGVVRVRIEGDNENKLPREDGMVPFVFVGTKESIGNVQVLLEYHIAYLKEVEQLRMERLQIDEQLRQIGMGFRPSSTRGPEKEKGYATDESTVSSVQGSRSYSGRGRGRRGPNYTSGYGTNSELSNPSETESERKDELSDWSLAGEDDRDSRHQRDSRRRPGGRGRSVSGGRGRGGPRGGKSSISSVLKDPDSNPYSLLDNTESDQTADTDASESHHSTNRRRRSRRRRTDEDAVLMDGMTESDTASVNENGLVTVADYISRAESQSRQRNLPRETLAKNKKEMAKDVIEEHGPSEKAINGPTSASGDDISKLQRTPGEEKINTLKEENTQEAAVLNGVS

SEQ ID NO: 890043 - protein, 539 aa, Homo sapiens; identical to SEQ ID NO: 890029

SEQ ID NO: 890044 - protein, 626 aa, Homo sapiens
MYEAGCSNRPRGGRGSNGAFYKGFIKDVHEDSLTVVFENNWQPERQVPFNEVRLPPPPDIKKEISEGDEVEVYSRANDQEPCGWWLAKVRMMKGEFYVIEYAACDATYNEIVTFERLRPVNQNKTVKKNTFFKCTVDVPEDLREACANENAHKDFKKAVGACRIFYHPETTQLMILSASEATVKRVNILSDMHLRSIRTKLMLMSRNEEATKHLECTKQLAAAFHEEFVVREDLMGLAIGTHGSNIQQARKVPGVTAIELDEDTGTFRIYGESADAVKKARGFLEFVEDFIQVPRNLVGKVIGKNGKVIQEIVDKSGVVRVRIEGDNENKLPREDGMVPFVFVGTKESIGNVQVLLEYHIAYLKEVEQLRMERLQIDEQLRQIGSRSYSGRGRGRRGPNYTSGYGTNSELSNPSETESERKDELSDWSLAGEDDRDSRHQRDSRRRPGGRGRSVSGGRGRGGPRGGKSSISSVLKDPDSNPYSLLDNTESDQTADTDASESHHSTNRRRRSRRRRTDEDAVLMDGMTESDTASVNENGLVTVADYISRAESQSRQRNLPRETLAKNKKEMAKDVIEEHGPSEKAINGPTSASGDDISKLQRTPGEEKINTLKEENTQEAAVLNGVS

SEQ ID NO: 890045 - protein, 535 aa, Homo sapiens
MKGEFYVIEYAACDATYNEIVTFERLRPVNQNKTVKKNTFFKCTVDVPEDLREACANENAHKDFKKAVGACRIFYHPETTQLMILSASEATVKRVNILSDMHLRSIRTKLMLMSRNEEATKHLECTKQLAAAFHEEFVVREDLMGLAIGTHGSNIQQARKVPGVTAIELDEDTGTFRIYGESADAVKKARGFLEFVEDFIQVPRNLVGKVIGKNGKVIQEIVDKSGVVRVRIEGDNENKLPREDGMVPFVFVGTKESIGNVQVLLEYHIAYLKEVEQLRMERLQIDEQLRQIGSRSYSGRGRGRRGPNYTSGYGTNSELSNPSETESERKDELSDWSLAGEDDRDSRHQRDSRRRPGGRGRSVSGGRGRGGPRGGKSSISSVLKDPDSNPYSLLDNTESDQTADTDASESHHSTNRRRRSRRRRTDEDAVLMDGMTESDTASVNENGLVTVADYISRAESQSRQRNLPRETLAKNKKEMAKDVIEEHGPSEKAINGPTSASGDDISKLQRTPGEEKINTLKEENTQEAAVLNGVS

SEQ ID NO: 890046 - protein, 298 aa, Homo sapiens
ISSVPTTGMVPFVFVGTKESIGNVQVLLEYHIAYLKEVEQLRMERLQIDEQLRQIGSRSYSGRGRGRRGPNYTSGYGTNSELSNPSETESERKDELSDWSLAGEDDRDSRHQRDSRRRPGGRGRSVSGGRGRGGPRGGKSSISSVLKDPDSNPYSLLDNTESDQTADTDASESHHSTNRRRRSRRRRTDEDAVLMDGMTESDTASVNENGLVTVADYISRAESQSRQRNLPRETLAKNKKEMAKDVIEEHGPSEKAINGPTSASGDDISKLQRTPGEEKINTLKEENTQEAAVLNGVS

SEQ ID NO: 890047 - protein, 545 aa, Homo sapiens
MAELTVEVRGSNGAFYKGFIKDVHEDSLTVVFENNWQPERQVPFNEVRLPPPPDIKKEISEGDEVEVYSRANDQEPCGWWLAKVRMMKGEFYVIEYAACDATYNEIVTFERLRPVNQNKTVKKNTFFKCTVDVPEDLREACANENAHKDFKKAVGACRIFYHPETTQLMILSASEATVKRVNILSDMHLRSIRTKLMLMSRNEEATKHLECTKQLAAAFHEEFVVREDLMGLAIGTHGSNIQQARKVPGVTAIELDEDTGTFRIYGESADAVKKARGFLEFVEDFIQVPRNLVGKVIGKNGKVIQEIVDKSGVVRVRIEGDNENKLPREDGMVPFVFVGTKESIGNVQVLLEYHIAYLKEVEQLRMERLQIDEQLRQIGSRSYSGRGRGRRGPNYTSGYGTNSELSNPSETESERKDELSDWSLAGEDDRDSRHQRDSRRRPGGRGRSVSGGRGRGGPRGGKSSISSGSLFYTLSASIICKQFNFTKVNSSPRATHFWKFLLLLIVLEKVVDHIAVSGKALVECFSVKVYLEYTGQNFSWQLFFI

SEQ ID NO: 890048 - protein, 182 aa, Homo sapiens
MQDVQNCLDRVYEEFCAVENPVGSSISSVLKDPDSNPYSLLDNTESDQTADTDASESHHSTNRRRRSRRRRTDEDAVLMDGMTESDTASVNENGLVTVADYISRAESQSRQRNLPRETLAKNKKEMAKDVIEEHGPSEKAINGPTSASGDDISKLQRTPGEEKINTLKEENTQEAAVLNGVS

SEQ ID NO: 890049 - protein, 121 aa, Homo sapiens
MVNFAITDDSEKKPQRRNRSRRRRFRGQAEDRQPVTVADYISRAESQSRQRNLPRETLAKNKKEMAKDVIEEHGPSEKAINGPTSASGDDISKLQRTPGEEKINTLKEENTQEAAVLNGVS

SEQ ID NO: 890050 - protein, 181 aa, Homo sapiens
EESKVSRGPVVWPVGANPHQVLKDPDSNPYSLLDNTESDQTADTDASESHHSTNRRRRSRRRRTDEDAVLMDGMTESDTASVNENGLVTVADYISRAESQSRQRNLPRETLAKNKKEMAKDVIEEHGPSEKAINGPTSASGDDISKLQRTPGEEKINTLKEENTQEAAITFTIVLVQACQR

SEQ ID NO: 890051 - protein, 140 aa, Homo sapiens
MPLPEPSEQEGESVKASQEPSPKPGTEVIPAAPRKPRKFSKLVLLTASKDSTKVAGAKRKGVHCVMSLGVPGPATLAKALLQTHPEAQRAIEAAPQEPEQKRSRQDPGTDRTEDSGLAAGPPEAAGENFAPCSVAPGKSL

SEQ ID NO: 890052 - protein, 140 aa, Homo sapiens; identical to SEQ ID NO: 890051

SEQ ID NO: 890053 - protein, 124 aa, Homo sapiens
MPLPEPSEQEGESVKASQEPSPKPGTEVIPAAPRKPRKFSKLVLLTASKDSTKVAGAKRKGVHCVMSLGVPGPATLAKALLQTHPEAQRAIEAAPVTLTTGASSQATNPAIGSSLSAGLLGPNG

SEQ ID NO: 890054 - protein, 140 aa, Homo sapiens; identical to SEQ ID NO: 890051

SEQ ID NO: 890055 - protein, 456 aa, Homo sapiens
MFEEPEWAEAAPVAAGLGPVISRPPPAASSQNKGSKRRQLLATLRALEAASLSQHPPSLCISDSEEEEEERKKKCPKKASFASASAEVGKKGKKKCQKQGPPCSDSEEEVERKKKCHKQALVGSDSAEDEKRKRKCQKHAPINSAQHLDNVDQTGPKAWKGSTTNDPPKQSPGSTSPKPPHTLSRKQWRNRQKNKRRCKNKFQPPQVPDQAPAEAPTEKTEVSPVPRTDSHEARAGALRARMAQRLDGARFRYLNEQLYSGPSSAAQRLFQEDPEAFLLYHRGFQSQVKKWPLQPVDRIARDLRQRPASLVVADFGCGDCRLASSIRNPVHCFDLASLDPRVTVCDMAQVPLEDESVDVAVFCLSLMGTNIRDFLEEANRVLKPGGLLKVAEVSSRFEDVRTFLRAVTKLGFKIVSKDLTNSHFFLFDFQKTGPPLVGPKAQLSGLQLQPCLYKRR

SEQ ID NO: 890056 - protein, 456 aa, Homo sapiens; identical to SEQ ID NO: 890055

SEQ ID NO: 890057 - protein, 108 aa, Homo sapiens
MGSATEMRIRVRYWSSMTLKREFCGEGEDKSEGQYEVAAPLSHAEPCYSGTLLALLCLNPLPYQVSIRKLDLHLMQNFIQKNPLLLESQPHLQQGTCVSSQRNAGGKH

SEQ ID NO: 890058 - protein, 487 aa, Homo sapiens
MFEEPEWAEAAPVAAGLGPVISRPPPAASSQNKGSKRRQLLATLRALEAASLSQHPPSLCISDSEEEEEERKKKCPKKASFASASAEVGKKGKKKCQKQGPPCSDSEEEVERKKKCHKQALVGSDSAEDEKRKRKCQKHAPINSAQHLDNVDQTGPKAWKGSTTNDPPKQSPGSTSPKPPHTLSRKQWRNRQKNKRRCKNKFQPPQVPDQAPAEAPTEKTEVSPVPRTDSHEARAGALRARMAQRLDGARFRYLNEQLYSGPSSAAQRLFQEDPEAFLLYHRGFQSQVKKWPLQPVDRIARDLRQRRMGVRDCEKPCGGSVIGSDQTNMGPLPSTLRPASLVVADFGCGDCRLASSIRNPVHCFDLASLDPRVTVCDMAQVPLEDESVDVAVFCLSLMGTNIRDFLEEANRVLKPGGLLKVAEVSSRFEDVRTFLRAVTKLGFKIVSKDLTNSHFFLFDFQKTGPPLVGPKAQLSGLQLQPCLYKRR

SEQ ID NO: 890059 - protein, 532 aa, Homo sapiens
MFEEPEWAEAAPVAAGLGPVISRPPPAASSQNKGSKRRQLLATLRALEAASLSQHPPSLCISDSEEEEEERKKKCPKKASFASASAEVGKKGKKKCQKQGPPCSDSEEEVERKKKCHKQALVGSDSAEDEKRKRKCQKHAPINSAQHLDNVDQTGPKAWKGSTTNDPPKQSPGSTSPKPPHTLSRKQWRNRQKNKRRCKNKFQPPQVPDQAPAEAPTEKTEVSPVPRTDSHEARAGALRARMAQRLDGARFRYLNEQLYSGPSSAAQRLFQEDPEAFLLYHRGFQSQVKKWPLQPVDRIARDLRQRRMGVRDCEKPCGGSVIGSDQTNMGPLPSTLRPASLVVADFGCGDCRLASSIRNPVHCFDLASLDPRVTVCDMAQVPLEDESVDVAVFCLSLMGTNIRDFLEEANRVLKPGGLLKVAEVSSRFEDVRTFLRAVTKLGFKIVSKVRAPRHLYLFLSHVALFRVLVFRKEALGTGTDILLPNGSGSPGKLCEQRQYIEGGVLRSWDEDLVLTGSFLPLGRPDQQPFLLV

SEQ ID NO: 890060 - protein, 359 aa, Homo sapiens [sequence omitted]

SEQ ID NO: 890061 - protein, 215 aa, Homo sapiens
MAQRLDGARFRYLNEQLYSGPSSAAQRLFQEDPEAFLLYHRGFQSQVKKWPLQPVDRIARDLRQRPASLVVADFGCGDCRLASSIRNPVHCFDLASLDPRVTVCDMAQVPLEDESVDVAVFCLSLMGTNIRDFLEEANRVLKPGGLLKVAEVSSRFEDVRTFLRAVTKLGFKIVSKDLTNSHFFLFDFQKTGPPLVGPKAQLSGLQLQPCLYKRR

SEQ ID NO: 890062 - protein, 747 aa, Homo sapiens
MFFFFFFLRQSLAAVAQAGMRWRDLRSLKPLPAGSSTSPASDSRVAGNTGTCHHAQLIFVFLVVTGFHHVGQAGLELLTSSDRPASASQSAGITGMSHCAQPVFFFFFFFMGGWAGCYLSSAIEMRENSECSGVRIAENVEGLFEVNGSGKRLLHYESPLPEFLIGPQKFISDCFDFFSGEQEASLSFESENRGEEISSRPTVHRNTQSGQNDLSVYLSSSLGPRAISSDEVERSRGEGRAYQSLLPFPVQAPRLSWGRAGRGKRDLKLQQVQIIVTQDVDILIELRLCLFLKLITGLSIKNITTSLQLFSIAGRVPPSNKIWRVVRDKNKIGFGYPCLMLVQHPFESSPNKYVTASAVIGVLQLLFPEYSPVLREHSSKRNNMILAETPLSSKPNHLCNCTKLSTAFHRDQKLEPFIPWSSSFPGEFSDQPSGFRIPNSCSNCLTGGLIASTRVPKAINFPHSHVIFLKCKSAYVTSLLKILQWILTASRTKDKLFRPRVILPRPPSPSPSASEPTPPLSQNSSHTDLLFIPQAFQTVSTESLCTCSIFLEYSFPSELIFIFLNSYHYYLCFCGRNWPDAHPNVLFLDTGKLHFPAPCIYAYVSSSQQWKMSGSDVSILDQGSERVAEPFPLFSSSFLFKVTLKHMFDGDGVIAEKKSEYLSYYLGHNSYLTKNIHLDFEQENKLDYILLVSFEGVLAVIIIYTGYIFYGILSTLLLTTVPSLFPSGCFRYLIILPDASQHFLFVP

SEQ ID NO: 890063 - protein, 140 aa, Homo sapiens
MFEEPEWAEAAPVAAGLGPVISRPPPAASSQNKVPLEDESVDVAVFCLSLMGTNIRDFLEEANRVLKPGGLLKVAEVSSRFEDVRTFLRAVTKLGFKIVSKDLTNSHFFLFDFQKTGPPLVGPKAQLSGLQLQPCLYKRR

SEQ ID NO: 890064 - protein, 116 aa, Homo sapiens
LCISDSEEEEEERKKKCPKKASFASASAEVGKKGKKKCQKQGPPCSDSEEEVERKKKCHKQALVGSDSAEDEKRKRKCQKHAPINSAQHLDNVDQTGTIGCVYVCVLVCVCRGVSW

SEQ ID NO: 890065 - protein, 1131 aa, Homo sapiens
TGGPGPPAGPSLPLRHRSSSEITLSECDAEDAGEPRGARHTGALPLFREYGSTSSIDVQGMPEQSFFDILNEFRSEQPDARGCQALTELLRADPGPHLMGGGGGAKGDSHNGQPAKDSLLPLQPTKEKEKARKKPARGLGGGDTVDSSIFRKLRSSKPEGEAGRSPGEADEGRSPPEASRPWVCQKSFAHFDVQSMLFDLNEAAANRVSVSQRRNTTTGASAASAASAMASLTASRAHSLGGLDPAFTSTEDLNCKENLEQDLGDDNSNDLLLSCPHFRNEIGGECERNVSFSRASVGSPSSGEGHLAEPALSAYRTNASISVLEVPKEQQRTQSRPRQYSIEHVDLGARYYQDYFVGKEHANYFGVDEKLGPVAVSIKREKLEDHKEHGPQYQYRIIFRTRELITLRGSILEDATPTATKHGTGRGLPLKDALEYVIPELNIHCLRLALNTPKVTEQLLKLDEQGLCRKHKVGILYCKAGQSSEEEMYNNEEAGPAFEEFLSLIGEKVCLKGFTKYAAQLDVKTDSTGTHSLYTMYQDYEIMFHVSTLLPYTPNNRQQLLRKRHIGNDIVTIIFQEPGALPFTPKNIRSHFQHVFIIVRVHNPCTDNVCYSMAVTRSKDAPPFGPPIPSGTTFRKSDVFRDFLLAKVINAENAAHKSDKFHTMATRTRQEYLKDLAENCVSNTPIDSTGKFNLISLTSKKKEKTKARAGAEQHSAGAIAWRVVAQDYAQGVEIDCILGISNEFVVLLDLRTKEVVFNCYCGDVIGWTPDSSTLKIFYGRGDHIFLQATEGSVEDIREIVQRLKVMTSGWETVDMTLRRNGLGQLGFHVKYDGTVAEVEDYGFAWQAGLRQGSRLVEICKVAVVTLTHDQMIDLLRTSVTVKVVIIPPFEDGTPRRGWPETYDMNTSEPKTEQESITPGGRPPYRSNAPWQWSGPASHNSLPASKWATPTTPGHAQSLSRPLKQTPIVPFRESQPLHSKRPVSFPETPYTVSPAGADRVPPYRQPSGSFSTPGSATYVRYKPSPERYTAAPHPLLSLDPHFSHDGTSSGDSSSGGLTSQESTMERQKPEPLWHVPAQARLSAIAGSSGNKHPSRQDAAGKDSPNRHSKGEPQYSSHSSRSSGFNLVVVGGS

SEQ ID NO: 890066 - protein, 811 aa, Homo sapiens
TGGPGPPAGPSLPLRHRSSSEITLSECDAEDAGEPRGARHTGALPLFREYGSTSSIDVQGMPEQSFFDILNEFRSEQPDARGCQALTELLRADPGPHLMGGGGGAKGDSHNGQPAKDSLLPLQPTKEKEKARKKPARGLGGGDTVDSSIFRKLRSSKPEGEAGRSPGEADEGRSPPEASRPWVCQKSFAHFDVQSMLFDLNEAAANRVSVSQRRNTTTGASAASAASAMASLTASRAHSLGGLDPAFTSTEDLNCKENLEQDLGDDNSNDLLLSCPHFRNEIGGECERNVSFSRASVGSPSSGEGHLAEPALSAYRTNASISVLEVPKEQQRTQSRPRQYSIEHVDLGARYYQDYFVGKEHANYFGVDEKLGPVAVSIKREKLEDHKEHGPQYQYRIIFRTRELITLRGSILEDATPTATKHGTGRGLPLKDALEYVIPELNIHCLRLALNTPKVTEQLLKLDEQGLCRKHKVGILYCKAGQSSEEEMYNNEEAGPAFEEFLSLIGEKVCLKGFTKYAAQLDVKTDSTGTHSLYTMYQDYEIMFHVSTLLPYTPNNRQQLLRKRHIGNDIVTIIFQEPGALPFTPKNIRSHFQHVFIIVRVHNPCTDNVCYSMAVTRSKDAPPFGPPIPSGTTFRKSDVFRDFLLAKVINAENAAHKSDKFHTMATRTRQEYLKDLAENCVSNTPIDSTGKFNLISLTSKKKEKTKARAGAEQHSAGAIAWRVVAQDYAQGVEIDCILGISNEFVVLLDLRTKEVVFNCYCGDVIGWTPDSSTLKIFYGRGDHIFLQATEGSVEDIREIVQRLKVRERARR

SEQ ID NO: 890067 - protein, 923 aa, Homo sapiens
TGGPGPPAGPSLPLRHRSSSEITLSECDAEDAGEPRGARHTGALPLFREYGSTSSIDVQGMPEQSFFDILNEFRSEQPDARGCQALTELLRADPGPHLMGGGGGAKGDSHNGQPAKDSLLPLQPTKEKEKARKKPARGLGGGDTVDSSIFRKLRSSKPEGEAGRSPGEADEGRSPPEASRPWVCQKSFAHFDVQSMLFDLNEAAANRVSVSQRRNTTTGASAASAASAMASLTASRAHSLGGLDPAFTSTEDLNCKENLEQDLGDDNSNDLLLSCPHFRNEIGGECERNVSFSRASVGSPSSGEGHLAEPALSAYRTNASISVLEVPKEQQRTQSRPRQYSIEHVDLGARYYQDYFVGKEHANYFGVDEKLGPVAVSIKREKLEDHKEHGPQYQYRIIFRTRELITLRGSILEDATPTATKHGTGRGLPLKDALEYVIPELNIHCLRLALNTPKVTEQLLKLDEQGLCRKHKVGILYCKAGQSSEEEMYNNEEAGPAFEEFLSLIGEKVCLKGFTKYAAQLDVKTDSTGTHSLYTMYQDYEIMFHVSTLLPYTPNNRQQLLRKRHIGNDIVTIIFQEPGALPFTPKNIRSHFQHVFIIVRVHNPCTDNVCYSMAVTRSKDAPPFGPPIPSGTTFRKSDVFRDFLLAKVINAENAAHKSDKFHTMATRTRQEYLKDLAENCVSNTPIDSTGKFNLISLTSKKKEKTKARAGAEQHSAGAIAWRVVAQDYAQGVEIDCILGISNEFVVLLDLRTKEVVFNCYCGDVIGWTPDSSTLKIFYGRGDHIFLQATEGSVEDIREIVQRLKVMTSGWETVDMTLRRNGLGQLGFHVKYDGTVAEVEDYGFAWQAGLRQGSRLVEICKVAVVTLTHDQMIDLLRTSVTVKVVIIPPFEDGTPRRWSLALSPRLKCSGVISTHCNLHLPGSS

SEQ ID NO: 890068 - protein, 1079 aa, Homo sapiens
LSPSVALSQLLRKRHIGNDIVTIIFQEPGALPFTPKNIRSHFQHVFIIVRVHNPCTDNVCYSMAVTRSKDAPPFGPPIPSGTTFRKSDVFRDFLLAKVINAENAAHKSDKFHTMATRTRQEYLKDLAENCVSNTPIDSTGKFNLISLTSKKKEKTKARAGAEQHSAGAIAWRVVAQDYAQGVEIDCILGISNEFVVLLDLRTKEVVFNCYCGDVIGWTPDSSTLKIFYGRGDHIFLQATEGSVEDIREIVQRLKVMTSGWETVDMTLRRNGLGQLGFHVKYDGTVAEVEDYGFAWQAGLRQGSRLVEICKVAVVTLTHDQMIDLLRTSVTVKVVIIPPFEDGTPRRGWPETYDMNTSEPKTEQESITPGGRPPYRSNAPWQWSGPASHNSLPASKWATPTTPGHAQSLSRPLKQTPIVPFRESQPLHSKRPVSFPETPYTVSPAGADRVPPYRQPSGSFSTPGSATYVRYKPSPERYTAAPHPLLSLDPHFSHDGTSSGDSSSGGLTSQESTMERQKPEPLWHVPAQARLSAIAGSSGNKHPSRQDAAGKDSPNRHSKGEPQYSSHSSSNTLSSNASSSHSDDRWFDPLDPLEPEQDPLSKGGSSDSGIDTTLYTSSPSCMSLAKAPRPAKPHKPPGSMGLCGGGREAAGRSHHADRRREVSPAPAVAGQSKGYRPKLYSSGSSTPTGLAGGSRDPPRQPSDMGSRVGYPAQVYKTASAETPRPSQLAQPSPFQLSASVPKSFFSKQPVRNKHPTGWKRTEEPPPRPLPFSDPKKQVDTNTKNVFGQPRLRASLRDLRSPRKNYKSTIEDDLKKLIIMDNLGPEQERDTGQSPQKGLQRTLSDESLCSGRREPSFASPAGLEPGLPSDVLFTSTCAFPSSTLPARRQHQHPHPPVGPGATPAAGSGFPEKKSTISASELSLADGRDRPLRRLDPGLMPLPDTAAGLEWSSLVNAAKAYEVQRAVSLFSLNDPALSPDIPPAHSPVHSHLSLERGPPTPRTTPTMSEEPPLDLTGKVYQLEVMLKQLHTDLQKEKQDKVVLQSEVASLRQNNQRLQEESQAASEQLRKFAEIFCREKKEL

SEQ ID NO: 890069 - protein, 520 aa, Homo sapiens
STSLDECASEQPQFSPMPGMYAGPALSEPPRPLEPEQDPLSKGGSSDSGIDTTLYTSSPSCMSLAKAPRPAKPHKPPGSMGLCGGGREAAGRSHHADRRREVSPAPAVAGQSKGYRPKLYSSGSSTPTGLAGGSRDPPRQPSDMGSRVGYPAQVYKTASAETPRPSQLAQPSPFQLSASVPKSFFSKQPVRNKHPTGWKRTEEPPPRPLPFSDPKKQVDTNTKNVFGQPRLRASLRDLRSPRKNYKSTIEDDLKKLIIMDNLGPEQERDTGQSPQKGLQRTLSDESLCSGRREPSFASPAGLEPGLPSDVLFTSTCAFPSSTLPARRQHQHPHPPVGPGATPAAGSGFPEKKSTISASELSLADGRDRPLRRLDPGLMPLPDTAAGLEWSSLVNAAKAYEVQRAVSLFSLNDPALSPDIPPAHSPVHSHLSLERGPPTPRTTPTMSEEPPLDLTGKVYQLEVMLKQLHTDLQKEKQDKVVLQSEVASLRQNNQRLQEESQAASEQLRKFAEIFCREKKEL

SEQ ID NO: 890070 - protein, 1629 aa, Homo sapiens
TGGPGPPAGPSLPLRHRSSSEITLSECDAEDAGEPRGARHTGALPLFREYGSTSSIDVQGMPEQSFFDILNEFRSEQPDARGCQALTELLRADPGPHLMGGGGGAKGDSHNGQPAKDSLLPLQPTKEKEKARKKPARGLGGGDTVDSSIFRKLRSSKPEGEAGRSPGEADEGRSPPEASRPWVCQKSFAHFDVQSMLFDLNEAAANRVSVSQRRNTTTGASAASAASAMASLTASRAHSLGGLDPAFTSTEDLNCKENLEQDLGDDNSNDLLLSCPHFRNEIGGECERNVSFSRASVGSPSSGEGHLAEPALSAYRTNASISVLEVPKEQQRTQSRPRQYSIEHVDLGARYYQDYFVGKEHANYFGVDEKLGPVAVSIKREKLEDHKEHGPQYQYRIIFRTRELITLRGSILEDATPTATKHGTGRGLPLKDALEYVIPELNIHCLRLALNTPKVTEQLLKLDEQGLCRKHKVGILYCKAGQSSEEEMYNNEEAGPAFEEFLSLIGEKVCLKGFTKYAAQLDVKTDSTGTHSLYTMYQDYEIMFHVSTLLPYTPNNRQQLLRKRHIGNDIVTIIFQEPGALPFTPKNIRSHFQHVFIIVRVHNPCTDNVCYSMAVTRSKDAPPFGPPIPSGTTFRKSDVFRDFLLAKVINAENAAHKSDKFHTMATRTRQEYLKDLAENCVSNTPIDSTGKFNLISLTSKKKEKTKARAGAEQHSAGAIAWRVVAQDYAQGVEIDCILGISNEFVVLLDLRTKEVVFNCYCGDVIGWTPDSSTLKIFYGRGDHIFLQATEGSVEDIREIVQRLKVMTSGWETVDMTLRRNGLGQLGFHVKYDGTVAEVEDYGFAWQAGLRQGSRLVEICKVAVVTLTHDQMIDLLRTSVTVKVVIIPPFEDGTPRRGWPETYDMNTSEPKTEQESITPGGRPPYRSNAPWQWSGPASHNSLPASKWATPTTPGHAQSLSRPLKQTPIVPFRESQPLHSKRPVSFPETPYTVSPAGADRVPPYRQPSGSFSTPGSATYVRYKPSPERYTAAPHPLLSLDPHFSHDGTSSGDSSSGGLTSQESTMERQKPEPLWHVPAQARLSAIAGSSGNKHPSRQDAAGKDSPNRHSKGEPQYSSHSSSNTLSSNASSSHSDDRWFDPLDPLEPEQDPLSKGGSSDSGIDTTLYTSSPSCMSLAKAPRPAKPHKPPGSMGLCGGGREAAGRSHHADRRREVSPAPAVAGQSKGYRPKLYSSGSSTPTGLAGGSRDPPRQPSDMGSRVGYPAQVYKTASAETPRPSQLAQPSPFQLSASVPKSFFSKQPVRNKHPTGWKRTEEPPPRPLPFSDPKKQVDTNTKNVFGQPRLRASLRDLRSPRKNYKSTIEDDLKKLIIMDNLGPEQERDTGQSPQKGLQRTLSDESLCSGRREPSFASPAGLEPGLPSDVLFTSTCAFPSSTLPARRQHQHPHPPVGPGATPAAGSGFPEKKSTISASELSLADGRDRPLRRLDPGLMPLPDTAAGLEWSSLVNAAKAYEVQRAVSLFSLNDPALSPDIPPAHSPVHSHLSLERGPPTPRTTPTMSEEPPLDLTGKVYQLEVMLKQLHTDLQKEKQDKVVLQSEVASLRQNNQRLQEESQAASEQLRKFAEIFCREKKEL

SEQ ID NO: 890071 - protein, 896 aa, Homo sapiens
TGGPGPPAGPSLPLRHRSSSEITLSECDAEDAGEPRGARHTGALPLFREYGSTSSIDVQGMPEQSFFDILNEFRSEQPDARGCQALTELLRADPGPHLMGGGGGAKGDSHNGQPAKDSLLPLQPTKEKEKARKKPARGLGGGDTVDSSIFRKLRSSKPEGEAGRSPGEADEGRSPPEASRPWVCQKSFAHFDVQSMLFDLNEAAANRVSVSQRRNTTTGASAASAASAMASLTASRAHSLGGLDPAFTSTEDLNCKENLEQDLGDDNSNDLLLSCPHFRNEIGGECERNVSFSRASVGSPSSGEGHLAEPALSAYRTNASISVLEVPKEQQRTQSRPRQYSIEHVDLGARYYQDYFVGKEHANYFGVDEKLGPVAVSIKREKLEDHKEHGPQYQYRIIFRTRELITLRGSILEDATPTATKHGTGRGLPLKDALEYVIPELNIHCLRLALNTPKVTEQLLKLDEQGLCRKHKVGILYCKAGQSSEEEMYNNEEAGPAFEEFLSLIGEKVCLKGFTKYAAQLDVKTDSTGTHSLYTMYQDYEIMFHVSTLLPYTPNNRQQLLRKRHIGNDIVTIIFQEPGALPFTPKNIRSHFQHVFIIVRVHNPCTDNVCYSMAVTRSKDAPPFGPPIPSGTTFRKSDVFRDFLLAKVINAENAAHKSDKFHTMATRTRQEYLKDLAENCVSNTPIDSTGKFNLISLTSKKKEKTKARAGAEQHSAGAIAWRVVAQDYAQGVEIDCILGISNEFVVLLDLRTKEVVFNCYCGDVIGWTPDSSTLKIFYGRGDHIFLQATEGSVEDIREIVQRLKVMTSGWETVDMTLRRNGLGQLGFHVKYDGTVAEVEDYGFAWQAGLRQGSRLVEICKVAVVTLTHDQMIDLLRTSVTVKVVIIPPFEDGTPRR

SEQ ID NO: 890072 - protein, 500 aa, Homo sapiens
TGGPGPPAGPSLPLRHRSSSEITLSECDAEDAGEPRGARHTGALPLFREYGSTSSIDVQGMPEQSFFDILNEFRSEQPDARGCQALTELLRADPGPHLMGGGGGAKGDSHNGQPAKDSLLPLQPTKEKEKARKKPARGLGGGDTVDSSIFRKLRSSKPEGEAGRSPGEADEGRSPPEASRPWVCQKSFAHFDVQSMLFDLNEAAANRVSVSQRRNTTTGASAASAASAMASLTASRAHSLGGLDPAFTSTEDLNCKENLEQDLGDDNSNDLLLSCPHFRNEIGGECERNVSFSRASVGSPSSGEGHLAEPALSAYRTNASISVLEVPKEQQRTQSRPRQYSIEHVDLGARYYQDYFVGKEHANYFGVDEKLGPVAVSIKREKLEDHKEHGPQYQYRIIFRTRELITLRGSILEDATPTATKHGTGRGLPLKDALEYVIPELNIHCLRLALNTPKVTEQLLKLDEQGVSQGLEVGVLLGQYLATPLLVAFSILVTFFFLCK

SEQ ID NO: 890073 - protein, 864 aa, Homo sapiens
LGPTGGISPEAGGYIEEHIFLQATEGSVEDIREIVQRLKVMTSGWETVDMTLRRNGLGQLGFHVKYDGTVAEVEDYGFAWQAGLRQGSRLVEICKVAVVTLTHDQMIDLLRTSVTVKVVIIPPFEDGTPRRGWPETYDMNTSEPKTEQESITPGGRPPYRSNAPWQWSGPASHNSLPASKWATPTTPGHAQSLSRPLKQTPIVPFRESQPLHSKRPVSFPETPYTVSPAGADRVPPYRQPSGSFSTPGSATYVRYKPSPERYTAAPHPLLSLDPHFSHDGTSSGDSSSGGLTSQESTMERQKPEPLWHVPAQARLSAIAGSSGNKHPSRQDAAGKDSPNRHSKGEPQYSSHSSSNTLSSNASSSHSDDRWFDPLDPLEPEQDPLSKGGSSDSGIDTTLYTSSPSCMSLAKAPRPAKPHKPPGSMGLCGGGREAAGRSHHADRRREVSPAPAVAGQSKGYRPKLYSSGSSTPTGLAGGSRDPPRQPSDMGSRVGYPAQVYKTASAETPRPSQLAQPSPFQLSASVPKSFFSKQPVRNKHPTGWKRTEEPPPRPLPFSDPKKQVDTNTKNVFGQPRLRASLRDLRSPRKNYKSTIEDDLKKLIIMDNLGPEQERDTGQSPQKGLQRTLSDESLCSGRREPSFASPAGLEPGLPSDVLFTSTCAFPSSTLPARRQHQHPHPPVGPGATPAAGSGFPEKKSTISASELSLADGRDRPLRRLDPGLMPLPDTAAGLEWSSLVNAAKAYEVQRAVSLFSLNDPALSPDIPPAHSPVHSHLSLERGPPTPRTTPTMSEEPPLDLTGKVYQLEVMLKQLHTDLQKEKQDKVVLQSEVASLRQNNQRLQEESQAASEQLRKFAEIFCREKKEL

SEQ ID NO: 890074 - protein, 109 aa, Homo sapiens
MAVTRSKDAPPFGPPIPSGTTFRKSDVFRDFLLAKVINAENAAHKSDKFHTMATRTRQEYLKDLAENCVSNTPIDSTGKFNLISLTSKKKEKTKARAGAEQHSAGAIAW

SEQ ID NO: 890075 - protein, 1638 aa, Homo sapiens
QLRGESDRSKQPPPASSPTKRKGRSRALEAVPAPPASGPRAPAKESPPKRVPDPSPVTKGTAAESGEEAARAIPRELPVKSSSLLPEIKPEHKRGPLPNHFNGRAEGGRSRELGRAAGAPGASDADGLKPRNHFGVGRSTVTTKVTLPAKPKHVELNLKTPKNLDSLGNEHNPFSQPVHKGNTATKISLFENKRTNSSPRHTDIRGQRNTPASSKTFVGRAKLNLAKKAKEMEQPEKKVMPNSPQNGVLVKETAIETKVTVSEEEILPATRGMNGDSSENQALGPQPNQDDKADVQTDAGCLSEPVASALIPVKDHKLLEKEDSEAADSKSLVLENVTDTAQDIPTTVDTKDLPPTAMPKPQHTFSDSQSPAESSPGPSLSLSAPAPGDVPKDTCVQSPISSFPCTDLKVSENHKGCVLPVSRQNNEKMPLLELGGETTPPLSTERSPEAVGSECPSRVLVQVRSFVLPVESTQDVSSQVIPESSEVREVQLPTCHSNEPEVVSVASCAPPQEEVLGNEHSHCTAELAAKSGPQVIPPASEKTLPIQAQSQGSRTPLMAESSPTNSPSSGNHLATPQRPDQTVTNGQDSPASLLNISAGSDDSVFDSSSDMEKFTEIIKQMDSAVCMPMKRKKARMPNSPAPHFAMPPIHEDHLEKVFDPKVFTFGLGKKKESQPEMSPALHLMQNLDTKSKLRPKRASAEQSVLFKSLHTNTNGNSEPLVMPEINDKENRDVTNGGIKRSRLEKSALFSSLLSSLPQDKIFSPSVTSVNTMTTAFSTSQNGSLSQSSVSQPTTEGAPPCGLNKEQSNLLPDNSLKVFNFNSSSTSHSSLKSPSHMEKYPQKEKTKEDLDSRSNLHLPETKFSELSKLKNDDMEKANHIESVIKSNLPNCANSDTDFMGLFKSSRYDPSISFSGMSLSDTMETLRGSVQNKLNPRPGKVVIYSEPDVSEKCIEVFSDIQDCSSWSLSPVILIKVVRGCWILYEQPNFEGHSIPLEEGELELSGLWGIEDILERHEEAESDKPVVIGSIRHVVQDYRVSHIDLFTEPEGLGILSSYFDDTEEMQGFGVMQKTCSMKVHWGTWLIYEEPGFQGVPFILEPGEYPDLSFWDTEAAYIGSMRPLKMGGRKVEFPTDPKVVVYEKPFFEGKCVELETGMCSFVMEGGETEEATGDDHLPFTSVGSMKVLRGIWVAYEKPGFTGHQYLLEEGEYRDWKAWGGYNGELQSLRPILGDFSNAHMIMYSEKNFGSKGSSIDVLGIVANLKETGYGVKTQSINVLSGVWVAYENPDFTGEQYILDKGFYTSFEDWGGKNCKISSVQPICLDSFTGPRRRNQIHLFSEPQFQGHSQSFEETTSQIDDSFSTKSCRVSGGSWVVYDGENFTGNQYVLEEGHYPCLSAMGCPPGATFKSLRFIDVEFSEPTIILFEREDFKGKKIELNAETVNLRSLGFNTQIRSVQVIGGIWVTYEYGSYRGRQFLLSPAEVPNWYEFSGCRQIGSLRPFVQKRIYFRLRNKATGLFMSTNGNLEDLKLLRIQVMEDVGADDQIWIYQEGCIKCRIAEDCCLTIVGSLVTSGSKLGLALDQNADSQFWSLKSDGRIYSKLKPNLVLDIKGGTQYDQNHIILNTVSKEKFTQVWEAMVLYT

SEQ ID NO: 890076 - protein, 245 aa, Homo sapiens
MQKPKTVAWENLGPEMSALGTAFSREGGRKVEFPTDPKVVVYEKPFFEGKCVELETGMCSFVMEGGETEEATGDDHLPFTSVGSMKVLRGIWVAYEKPGFTGHQYLLEEGEYRDWKAWGGYNGELQSLRPILGDFSNAHMIMYSEKNFGSKGSSIDVLGIVANLKETGYGVKTQSINVLSGVWVAYENPDFTGEQYILDKGFYTSFEDWGGKNCKISSVQPICLGFLHAPRENEIRFTCFQKPQV

SEQ ID NO: 890077 - protein, 1614 aa, Homo sapiens
QLRGESDRSKQPPPASSPTKRKGRSRALEAVPAPPASGPRAPAKESPPKRVPDPSPVTKGTAAESGEEAARAIPRELPVKSSSLLPEIKPEHKRGPLPNHFNGRAEGGRSRELGRAAGAPGASDADGLKPRNHFGVGRSTVTTKVTLPAKPKHVELNLKTPKNLDSLGNEHNPFSQPVHKGNTATKISLFENKRTNSSPRHTDIRGQRNTPASSKTFVGRAKLNLAKKAKEMEQPEKKVMPNSPQNGVLVKETAIETKVTVSEEEILPATRGMNGDSSENQALGPQPNQDDKADVQTDAGCLSEPVASALIPVKDHKLLEKEDSEAADSKSLVLENVTDTAQDIPTTVDTKDLPPTAMPKPQHTFSDSQSPAESSPGPSLSLSAPAPGDVPKDTCVQSPISSFPCTDLKVSENHKGCVLPVSRQNNEKMPLLELGGETTPPLSTERSPEAVGSECPSRVLVQVRSFVLPVESTQDVSSQVIPESSEVREVQLPTCHSNEPEVVSVASCAPPQEEVLGNEHSHCTAELAAKSGPQVIPPASEKTLPIQAQSQGSRTPLMAESSPTNSPSSGNHLATPQRPDQTVTNGQDSPASLLNISAGSDDSVFDSSSDMEKFTEIIKQMDSAVCMPMKRKKARMPNSPAPHFAMPPIHEDHLEKVFDPKVFTFGLGKKKESQPEMSPALHLMQNLDTKSKLRPKRASAEQSVLFKSLHTNTNGNSEPLVMPEINDKENRDVTNGGIKRSRLEKSALFSSLLSSLPQDKIFSPSVTSVNTMTTAFSTSQNGSLSQSSVSQPTTEGAPPCGLNKEQSNLLPDNSLKVFNFNSSSTSHSSLKSPSHMEKYPQKEKTKEDLDSRSNLHLPETKFSELSKLKNDDMEKANHIESVIKSNLPNCANSDTDFMGLFKSSRYDPSISFSGMSLSDTMEVSEKCIEVFSDIQDCSSWSLSPVILIKVVRGCWILYEQPNFEGHSIPLEEGELELSGLWGIEDILERHEEAESDKPVVIGSIRHVVQDYRVSHIDLFTEPEGLGILSSYFDDTEEMQGFGVMQKTCSMKVHWGTWLIYEEPGFQGVPFILEPGEYPDLSFWDTEAAYIGSMRPLKMGGRKVEFPTDPKVVVYEKPFFEGKCVELETGMCSFVMEGGETEEATGDDHLPFTSVGSMKVLRGIWVAYEKPGFTGHQYLLEEGEYRDWKAWGGYNGELQSLRPILGDFSNAHMIMYSEKNFGSKGSSIDVLGIVANLKETGYGVKTQSINVLSGVWVAYENPDFTGEQYILDKGFYTSFEDWGGKNCKISSVQPICLDSFTGPRRRNQIHLFSEPQFQGHSQSFEETTSQIDDSFSTKSCRVSGGSWVVYDGENFTGNQYVLEEGHYPCLSAMGCPPGATFKSLRFIDVEFSEPTIILFEREDFKGKKIELNAETVNLRSLGFNTQIRSVQVIGGIWVTYEYGSYRGRQFLLSPAEVPNWYEFSGCRQIGSLRPFVQKRIYFRLRNKATGLFMSTNGNLEDLKLLRIQVMEDVGADDQIWIYQEGCIKCRIAEDCCLTIVGSLVTSGSKLGLALDQNADSQFWSLKSDGRIYSKLKPNLVLDIKGGTQYDQNHIILNTVSKEKFTQVWEAMVLYT

SEQ ID NO: 890078 - protein, 1620 aa, Homo sapiens
QLRGESDRSKQPPPASSPTKRKGRSRALEAVPAPPASGPRAPAKESPPKRVPDPSPVTKGTAAESGEEAARAIPRELPVKSSSLLPEIKPEHKRGPLPNHFNGRAEGGRSRELGRAAGAPGASDADGLKPRNHFGVGRSTVTTKVTLPAKPKHVELNLKTPKNLDSLGNEHNPFSQPVHKGNTATKISLFENKRTNSSPRHTDIRGQRNTPASSKTFVGRAKLNLAKKAKEMEQPEKKVMPNSPQNGVLVKETAIETKVTVSEEEILPATRGMNGDSSENQALGPQPNQDDKADVQTDAGCLSEPVASALIPVKDHKLLEKEDSEAADSKSLVLENVTDTAQDIPTTVDTKDLPPTAMPKPQHTFSDSQSPAESSPGPSLSLSAPAPGDVPKDTCVQSPISSFPCTDLKVSENHKGCVLPVSRQNNEKMPLLELGGETTPPLSTERSPEAVGSECPSRVLVQVRSFVLPVESTQDVSSQVIPESSEVREVQLPTCHSNEPEVVSVASCAPPQEEVLGNEHSHCTAELAAKSGPQVIPPASEKTLPIQAQSQGSRTPLMAESSPTNSPSSGNHLATPQRPDQTVTNGQDSPASLLNISAGSDDSVFDSSSDMEKFTEIIKQMDSAVCMPMKRKKARMPNSPAPHFAMPPIHEDHLEKVFDPKVFTFGLGKKKESQPEMSPALHLMQNLDTKSKLRPKRASAEQSVLFKSLHTNTNGNSEPLVMPEINDKENRDVTNGGIKRSRLEKSALFSSLLSSLPQDKIFSPSVTSVNTMTTAFSTSQNGSLSQSSVSQPTTEGAPPCGLNKEQSNLLPDNSLKVFNFNSSSTSHSSLKSPSHMEKYPQKEKTKEDLDSRSNLHLPETKFSELSKLKNDDMESDTDFMGLFKSSRYDPSISFSGMSLSDTMETLRGSVQNKLNPRPGKVVIYSEPDVSEKCIEVFSDIQDCSSWSLSPVILIKVVRGCWILYEQPNFEGHSIPLEEGELELSGLWGIEDILERHEEAESDKPVVIGSIRHVVQDYRVSHIDLFTEPEGLGILSSYFDDTEEMQGFGVMQKTCSMKVHWGTWLIYEEPGFQGVPFILEPGEYPDLSFWDTEAAYIGSMRPLKMGGRKVEFPTDPKVVVYEKPFFEGKCVELETGMCSFVMEGGETEEATGDDHLPFTSVGSMKVLRGIWVAYEKPGFTGHQYLLEEGEYRDWKAWGGYNGELQSLRPILGDFSNAHMIMYSEKNFGSKGSSIDVLGIVANLKETGYGVKTQSINVLSGVWVAYENPDFTGEQYILDKGFYTSFEDWGGKNCKISSVQPICLDSFTGPRRRNQIHLFSEPQFQGHSQSFEETTSQIDDSFSTKSCRVSGGSWVVYDGENFTGNQYVLEEGHYPCLSAMGCPPGATFKSLRFIDVEFSEPTIILFEREDFKGKKIELNAETVNLRSLGFNTQIRSVQVIGGIWVTYEYGSYRGRQFLLSPAEVPNWYEFSGCRQIGSLRPFVQKRIYFRLRNKATGLFMSTNGNLEDLKLLRIQVMEDVGADDQIWIYQEGCIKCRIAEDCCLTIVGSLVTSGSKLGLALDQNADSQFWSLKSDGRIYSKLKPNLVLDIKGGTQYDQNHIILNTVSKEKFTQVWEAMVLYT

SEQ ID NO: 890079 - protein, 542 aa, Homo sapiens
MQKPKTVAWENLGPEMSALGTAFSREGGRKVEFPTDPKVVVYEKPFFEGKCVELETGMCSFVMEGGETEEATGDDHLPFTSVGSMKVLRGIWVAYEKPGFTGHQYLLEEGEYRDWKAWGGYNGELQSLRPILGDFSNAHMIMYSEKNFGSKGSSIDVLGIVANLKETGYGVKTQSINVLSGVWVAYENPDFTGEQYILDKGFYTSFEDWGGKNCKISSVQPICLDSFTGPRRRNQIHLFSEPQFQGHSQSFEETTSQIDDSFSTKSCRVSGGSWVVYDGENFTGNQYVLEEGHYPCLSAMGCPPGATFKSLRFIDVEFSEPTIILFEREDFKGKKIELNAETVNLRSLGFNTQIRSVQVIGGIWVTYEYGSYRGRQFLLSPAEVPNWYEFSGCRQIGSLRPFVQKRIYFRLRNKATGLFMSTNGNLEDLKLLRIQVMEDVGADDQIWIYQEGCIKCRIAEDCCLTIVGSLVTSGSKLGLALDQNADSQFWSLKSDGRIYSKLKPNLVLDIKGGTQYDQNHIILNTVSKEKFTQVWEAMVLYT

SEQ ID NO: 890080 - protein, 1342 aa, Homo sapiens
QLRGESDRSKQPPPASSPTKRKGRSRALEAVPAPPASGPRAPAKESPPKRVPDPSPVTKGTAAESGEEAARAIPRELPVKSSSLLPEIKPEHKRGPLPNHFNGRAEGGRSRELGRAAGAPGASDADGLKPRNHFGVGRSTVTTKVTLPAKPKHVELNLKTPKNLDSLGNEHNPFSQPVHKGNTATKISLFENKRTNSSPRHTDIRGQRNTPASSKTFVGRAKLNLAKKAKEMEQPEKKVMPNSPQNGVLVKETAIETKVTVSEEEILPATRGMNGDSSENQALGPQPNQDDKADVQTDAGCLSEPVASALIPVKDHKLLEKEDSEAADSKSLVLENVTDTAQDIPTTVDTKDLPPTAMPKPQHTFSDSQSPAESSPGPSLSLSAPAPGDVPKDTCVQSPISSFPCTDLKVSENHKGCVLPVSRQNNEKMPLLELGGETTPPLSTERSPEAVGSECPSRVLVQVRSFVLPVESTQDVSSQVIPESSEVREVQLPTCHSNEPEVVSVASCAPPQEEVLGNEHSHCTAELAAKSGPQVIPPASEKTLPIQAQSQGSRTPLMAESSPTNSPSSGNHLATPQRPDQTVTNGQDSPASLLNISAGSDDSVFDSSSDMEKFTEIIKQMDSAVCMPMKRKKARMPNSPAPHFAMPPIHEDHLEKVFDPKVFTFGLGKKKESQPEMSPALHLMQNLDTKSKLRPKRASAEQSVLFKSLHTNTNGNSEPLVMPEINDKENRDVTNGGIKRSRLEKSALFSSLLSSLPQDKIFSPSVTSVNTMTTAFSTSQNGSLSQSSVSQPTTEGAPPCGLNKEQSNLLPDNSLKVFNFNSSSTSHSSLKSPSHMEKYPQKEKTKEDLDSRSNLHLPETKFSELSKLKNDDMEKANHIESVIKSNLPNCANSDTDFMGLFKSSRYDPSISFSGMSLSDTMETLRGSVQNKLNPRPGKVVIYSEPDVSEKCIEVFSDIQDCSSWSLSPVILIKVVRGCWILYEQPNFEGHSIPLEEGELELSGLWGIEDILERHEEAESDKPVVIGSIRHVVQDYRVSHIDLFTEPEGLGILSSYFDDTEEMQGFGVMQKTCSMKVHWGTWLIYEEPGFQGVPFILEPGEYPDLSFWDTEAAYIGSMRPLKMGGRKVEFPTDPKVVVYEKPFFEGKCVELETGMCSFVMEGGETEEATGDDHLPFTSVGSMKVLRGIWVAYEKPGFTGHQYLLEEGEYRDWKAWGGYNGELQSLRPILGDFSNAHMIMYSEKNFGSKGSSIDVLGIVANLKETGYGVKTQSINVLSGVWVAYENPDFTGEQYILDKGFYTSFEDWGGKNCKISSVQPICLDSFTGPRRRNQVTLKIFFYINI

SEQ ID NO: 890081 - protein, 1137 aa, Homo sapiens
QLRGESDRSKQPPPASSPTKRKGRSRALEAVPAPPASGPRAPAKESPPKRVPDPSPVTKGTAAESGEEAARAIPRELPVKSSSLLPEIKPEHKRGPLPNHFNGRAEGGRSRELGRAAGAPGASDADGLKPRNHFGVGRSTVTTKVTLPAKPKHVELNLKTPKNLDSLGNEHNPFSQPVHKGNTATKISLFENKRTNSSPRHTDIRGQRNTPASSKTFVGRAKLNLAKKAKEMEQPEKKVMPNSPQNGVLVKETAIETKVTVSEEEILPATRGMNGDSSENQALGPQPNQDDKADVQTDAGCLSEPVASALIPVKDHKLLEKEDSEAADSKSLVLENVTDTAQDIPTTVDTKDLPPTAMPKPQHTFSDSQSPAESSPGPSLSLSAPAPGDVPKDTCVQSPISSFPCTDLKVSENHKGCVLPVSRQNNEKMPLLELGGETTPPLSTERSPEAVGSECPSRVLVQVRSFVLPVESTQDVSSQVIPESSEVREVQLPTCHSNEPEVVSVASCAPPQEEVLGNEHSHCTAELAAKSGPQVIPPASEKTLPIQAQSQGSRTPLMAESSPTNSPSSGNHLATPQRPDQTVTNGQDSPASLLNISAGSDDSVFDSSSDMEKFTEIIKQMDSAVCMPMKRKKARMPNSPAPHFAMPPIHEDHLEKVFDPKVFTFGLGKKKESQPEMSPALHLMQNLDTKSKLRPKRASAEQSVLFKSLHTNTNGNSEPLVMPEINDKENRDVTNGGIKRSRLEKSALFSSLLSSLPQDKIFSPSVTSVNTMTTAFSTSQNGSLSQSSVSQPTTEGAPPCGLNKEQSNLLPDNSLKVFNFNSSSTSHSSLKSPSHMEKYPQKEKTKEDLDSRSNLHLPETKFSELSKLKNDDMEKANHIESVIKSNLPNCANSDTDFMGLFKSSRYDPSISFSGMSLSDTMETLRGSVQNKLNPRPGKVVIYSEPDVSEKCIEVFSDIQDCSSWSLSPVILIKVVRGCWILYEQPNFEGHSIPLEEGELELSGLWGIEDILERHEEAESDKPVVIGSIRHVVQDYRVSHIDLFTEPEGLGILSSYFDDTEEMQGFGVMQKTCSMKVHWGTWLIYEEPGFQGVPFILEPGEYPDLSFWDTEAAYIGSMRPLKMVKMKSKCPCGDSLSA

SEQ ID NO: 890082 - protein, 1104 aa, Homo sapiens
QLRGESDRSKQPPPASSPTKRKGRSRALEAVPAPPASGPRAPAKESPPKRVPDPSPVTKGTAAESGEEAARAIPRELPVKSSSLLPEIKPEHKRGPLPNHFNGRAEGGRSRELGRAAGAPGASDADGLKPRNHFGVGRSTVTTKVTLPAKPKHVELNLKTPKNLDSLGNEHNPFSQPVHKGNTATKISLFENKRTNSSPRHTDIRGQRNTPASSKTFVGRAKLNLAKKAKEMEQPEKKVMPNSPQNGVLVKETAIETKVTVSEEEILPATRGMNGDSSENQALGPQPNQDDKADVQTDAGCLSEPVASALIPVKDHKLLEKEDSEAADSKSLVLENVTDTAQDIPTTVDTKDLPPTAMPKPQHTFSDSQSPAESSPGPSLSLSAPAPGDVPKDTCVQSPISSFPCTDLKVSENHKGCVLPVSRQNNEKMPLLELGGETTPPLSTERSPEAVGSECPSRVLVQVRSFVLPVESTQDVSSQVIPESSEVREVQLPTCHSNEPEVVSVASCAPPQEEVLGNEHSHCTAELAAKSGPQVIPPASEKTLPIQAQSQGSRTPLMAESSPTNSPSSGNHLATPQRPDQTVTNGQDSPASLLNISAGSDDSVFDSSSDMEKFTEIIKQMDSAVCMPMKRKKARMPNSPAPHFAMPPIHEDHLEKVFDPKVFTFGLGKKKESQPEMSPALHLMQNLDTKSKLRPKRASAEQSVLFKSLHTNTNGNSEPLVMPEINDKENRDVTNGGIKRSRLEKSALFSSLLSSLPQDKIFSPSVTSVNTMTTAFSTSQNGSLSQSSVSQPTTEGAPPCGLNKEQSNLLPDNSLKVFNFNSSSTSHSSLKSPSHMEKYPQKEKTKEDLDSRSNLHLPETKFSELSKLKNDDMEKANHIESVIKSNLPNCANSDTDFMGLFKSSRYDPSISFSGMSLSDTMETLRGSVQNKLNPRPGKVVIYSEPDVSEKCIEVFSDIQDCSSWSLSPVILIKVVRGCWILYEQPNFEGHSIPLEEGELELSGLWGIEDILERHEEAESDKPVVIGSIRHVVQDYRVSHIDLFTEPEGLGILSSYFDDTEEMQGFGVMQKTCSMKVHWGTFSTPFLLRRLKSDVALEVPPKREV

SEQ ID NO: 890083 - protein, 616 aa, Homo sapiens
ILTIYASIFFQDYRVSHIDLFTEPEGLGILSSYFDDTEEMQGFGVMQKTCSMKVHWGTWLIYEEPGFQGVPFILEPGEYPDLSFWDTEAAYIGSMRPLKMGGRKVEFPTDPKVVVYEKPFFEGKCVELETGMCSFVMEGGETEEATGDDHLPFTSVGSMKVLRGIWVAYEKPGFTGHQYLLEEGEYRDWKAWGGYNGELQSLRPILGDFSNAHMIMYSEKNFGSKGSSIDVLGIVANLKETGYGVKTQSINVLSGVWVAYENPDFTGEQYILDKGFYTSFEDWGGKNCKISSVQPICLDSFTGPRRRNQIHLFSEPQFQGHSQSFEETTSQIDDSFSTKSCRVSGGSWVVYDGENFTGNQYVLEEGHYPCLSAMGCPPGATFKSLRFIDVEFSEPTIILFEREDFKGKKIELNAETVNLRSLGFNTQIRSVQVIGGIWVTYEYGSYRGRQFLLSPAEVPNWYEFSGCRQIGSLRPFVQKRIYFRLRNKATGLFMSTNGNLEDLKLLRIQVMEDVGADDQIWIYQEGCIKCRIAEDCCLTIVGSLVTSGSKLGLALDQNADSQFWSLKSDGRIYSKLKPNLVLDIKGGTQYDQNHIILNTVSKEKFTQVWEAMVLYT

SEQ ID NO: 890084 - protein, 123 aa, Homo sapiens [sequence omitted]

SEQ ID NO: 890085 - protein, 1327 aa, Homo sapiens
QLRGESDRSKQPPPASSPTKRKGRSRALEAVPAPPASGPRAPAKESPPKRVPDPSPVTKGTAAESGEEAARAIPRELPVKSSSLLPEIKPEHKRGPLPNHFNGRAEGGRSRELGRAAGAPGASDADGLKPRNHFGVGRSTVTTKVTLPAKPKHVELNLKTPKNLDSLGNEHNPFSQPVHKGNTATKISLFENKRTNSSPRHTDIRGQRNTPASSKTFVGRAKLNLAKKAKEMEQPEKKVMPNSPQNGVLVKETAIETKVTVSEEEILPATRGMNGDSSENQALGPQPNQDDKADVQTDAGCLSEPVASALIPVKDHKLLEKEDSEAADSKSLVLENVTDTAQDIPTTVDTKDLPPTAMPKPQHTFSDSQSPAESSPGPSLSLSAPAPGDVPKDTCVQSPISSFPCTDLKVSENHKGCVLPVSRQNNEKMPLLELGGETTPPLSTERSPEAVGSECPSRVLVQVRSFVLPVESTQDVSSQVIPESSEVREVQLPTCHSNEPEVVSVASCAPPQEEVLGNEHSHCTAELAAKSGPQVIPPASEKTLPIQAQSQGSRTPLMAESSPTNSPSSGNHLATPQRPDQTVTNGQDSPASLLNISAGSDDSVFDSSSDMEKFTEIIKQMDSAVCMPMKRKKARMPNSPAPHFAMPPIHEDHLEKVFDPKVFTFGLGKKKESQPEMSPALHLMQNLDTKSKLRPKRASAEQSVLFKSLHTNTNGNSEPLVMPEINDKENRDVTNGGIKRSRLEKSALFSSLLSSLPQDKIFSPSVTSVNTMTTAFSTSQNGSLSQSSVSQPTTEGAPPCGLNKEQSNLLPDNSLKVFNFNSSSTSHSSLKSPSHMEKYPQKEKTKEDLDSRSNLHLPETKFSELSKLKNDDMEKANHIESVIKSNLPNCANSDTDFMGLFKSSRYDPSISFSGMSLSDTMETLRGSVQNKLNPRPGKVVIYSEPDVSEKCIEVFSDIQDCSSWSLSPVILIKVVRGCWILYEQPNFEGHSIPLEEGELELSGLWGIEDILERHEEAESDKPVVIGSIRHVVQDYRVSHIDLFTEPEGLGILSSYFDDTEEMQGFGVMQKTCSMKVHWGTWLIYEEPGFQGVPFILEPGEYPDLSFWDTEAAYIGSMRPLKMGGRKVEFPTDPKVVVYEKPFFEGKCVELETGMCSFVMEGGETEEATGDDHLPFTSVGSMKVLRGIWVAYEKPGFTGHQYLLEEGEYRDWKAWGGYNGELQSLRPILGDFSNAHMIMYSEKNFGSKGSSIDVLGIVANLKETGYGVKTQSINVLSGVWVAYENPDFTGEQYILDKGFYTSFEDWGGKNCKISSVQPICLVRSYIFV

SEQ ID NO: 890086 - protein, 93 aa, Homo sapiens
GRGPPPTTQFRQELCGPVQERTSLFFLPYNVAEAQCIANQVQLFYATDRKETYGLVETFNLRPNEFKYMSVIAELEQSGLGAELKCAQNQNKT

SEQ ID NO: 890087 - protein, 359 aa, Homo sapiens
PPYPHPQITVTITYLPSLPPPSSSCQEAGAAMAAVVVAAAGGAGPAVLQVAGLYRGLCAVRSRALGLGLVSPAQLRVFPVRPGSGRPEGGADGSGVGAEAELQANPFYDRYRDKIQLLRRSDPAAFESRLEKRSEFRKQPVGHSRQGDFIKCVEQKTDALGKQSVNRGFTKDKTLSSIFNIEMVKEKTAEEIKQIWQQYFAAKDTVYAVIPAEKFDLIWNRAQSCPTFLCALPRREGYEFFVGQWTGTELHFTALINIQTRGEAAASQLILYHYPELKEEKGIVLMTAEMDSTFLNVAEAQCIANQVQLFYATDRKETYGLVETFNLRPNEFKYMSVIAELEQSGLGAELKCAQNQNKT

SEQ ID NO: 890088 - protein, 332 aa, Homo sapiens
ARGPRAEADAPEEEEEAGAAMAAVVVAAAGGAGPAVLQVAGLYRGLCAVRSRALGLGLVSPAQLRVFPVRPGSGRPEGGADGSGVGAEAELQANPFYDRYRDKIQLLRRSDPAAFESRLEKRSEFRKQPVGHSRQGDFIKCVEQKTDALGKQSVNRGFTKDKTLSSIFNIEMVKEKTAEEIKQIWQQYFAAKDTVYAVIPAEKFDLIWNRAQSCPTFLCALPRREGYEFFVGQWTGTELHFTALINIQTRGEAAASQLILYHYPELKENVAEAQCIANQVQLFYATDRKETYGLVETFNLRPNEFKYMSVIAELEQSGLGAELKCAQNQNKT

SEQ ID NO: 890089 - protein, 378 aa, Homo sapiens
ARGPRAEADAPEEEEEAGAAMAAVVVAAAGGAGPAVLQVAGLYRGLCAVRSRALGLGLVSPAQLRVFPVRPGSGRPEGGADGSGVGAEAELQANPFYDRYRDKIQLLRRSDPAAFESRLEKRSEFRKQPVGHSRQGDFIKCVEQKDGAQNKLVRRGQRQGEYGVIQVWAAEAWIKTDALGKQSVNRGFTKDKTLSSIFNIEMVKEKTAEEIKQIWQQYFAAKDTVYAVIPAEKFDLIWNRAQSCPTFLCALPRREGYEFFVGQWTGTELHFTALINIQTRGEAAASQLILYHYPELKEEKGIVLMTAEMDSTFLNVAEAQCIANQVQLFYATDRKETYGLVETFNLRPNEFKYMSVIAELEQSGLGAELKCAQNQNKT

SEQ ID NO: 890090 - protein, 329 aa, Homo sapiens
ARGPRAEADAPEEEEEAGAAMAAVVVAAAGGAGPAVLQVAGLYRGLCAVRSRALGLGLVSPAQLRVFPVRPGSGRPEGGADGSGVGAEAELQANPFYDRYRDKIQLLRRSDPAAFESRLEKRSEFRKQPVGHSRQGDFIKCVEQKTDALGKQSVNRGFTKDKTLSSIFNIEMVKEKTAEEIKQIWQQYFAAKDTVYAVIPAEKFDLIWNRAQSCPTFLCALPRREGYEFFVGQWTGTELHFTALINIQTRGEAAASQLILYHYPELKEEKGIVLMTAEMDSTFLNVAEAQCIANQVQLFYATDRKETYGWAQLLAIHSTLIHLHQRVRK

SEQ ID NO: 890091 - protein, 280 aa, Homo sapiens
ARGPRAEADAPEEEEEAGAAMAAVVVAAAGGAGPAVLQVAGLYRGLCAVRSRALGLGLVSPAQLRVFPVRPGSGRPEGGADGSGVGAEAELQANPFYDRYRDKIQLLRRSDPAAFESRLEKRSEFRKQPVGHSRQGDFIKCVEQKTDALGKQSVNRGFTKDKTLSSIFNIEMVKEKTAEEIKQIWQQYFAAKDTVYAVIPAEKFDLIWNRAQSCPTNVAEAQCIANQVQLFYATDRKETYGLVETFNLRPNEFKYMSVIAELEQSGLGAELKCAQNQNKT

SEQ ID NO: 890092 - protein, 220 aa, Homo sapiens
ARGPRAEADAPEEEEEAGAAMAAVVVAAAGGAGPAVLQVAGLYRGLCAVRSRALGLGLVSPAQLRVFPVRPGSGRPEGGADGSGVGAEAELQANPFYDRYRDKIQLLRRSDPAAFESRLEKRSEFRKQPVGHSRQGDFIKCVEQKTDALGKQSVNRGFTKDKTLSSIFNIEMVKEKTAEEIKQIWQQYFAAKDTVYAVIPAEKFDLIWNRAQSCPTVSFW

SEQ ID NO: 890093 - protein, 205 aa, Homo sapiens
ARGPRAEADAPEEEEEAGAAMAAVVVAAAGGAGPAVLQVAGLYRGLCAVRSRALGLGLVSPAQLRVFPVRPGSGRPEGGADGSGVGAEAELQANPFYDRYRDKIQLLRRSDPAAFESRLEKRSEFRKQPVGHSRQGDFIKCVEQKTDALGKQSVNRGFTKDKTLSSIFNIEMVKEKTAEEIKQIWQQYFAAKDTVYAVIPQKSLI

SEQ ID NO: 890094 - protein, 348 aa, Homo sapiens
ARGPRAEADAPEEEEEAGAAMAAVVVAAAGGAGPAVLQVAGLYRGLCAVRSRALGLGLVSPAQLRVFPVRPGSGRPEGGADGSGVGAEAELQANPFYDRYRDKIQLLRRSDPAAFESRLEKRSEFRKQPVGHSRQGDFIKCVEQKTDALGKQSVNRGFTKDKTLSSIFNIEMVKEKTAEEIKQIWQQYFAAKDTVYAVIPAEKFDLIWNRAQSCPTFLCALPRREGYEFFVGQWTGTELHFTALINIQTRGEAAASQLILYHYPELKEEKGIVLMTAEMDSTFLNVAEAQCIANQVQLFYATDRKETYGLVETFNLRPNEFKYMSVIAELEQSGLGAELKCAQNQNKT

SEQ ID NO: 890095 - protein, 348 aa, Homo sapiens; identical to SEQ ID NO: 890094

SEQ ID NO: 890096 - protein, 177 aa, Homo sapiens
MVKEKTAEEIKQIWQQYFAAKDTVYAVIPAEKFDLIWNRAQSCPTFLCALPRREGYEFFVGQWTGTELHFTALINIQTRGEAAASQLILYHYPELKEEKGIVLMTAEMDSTFLNVAEAQCIANQVQLFYATDRKETYGLVETFNLRPNEFKYMSVIAELEQSGLGAELKCAQNQNKT

SEQ ID NO: 890097 - protein, 331 aa, Homo sapiens
ARGPRAEADAPEEEEEAGAAMAAVVVAAAGGAGPAVLQVAGLYRGLCAVRSRALGLGLVSPAQLRVFPVRPGSGRPEGGADGSGVGAEAELQANPFYDRYRDKIQLLRRSDPAAFESRLEKRSEFRKQPVGHSRQGDFIKCVEQKTDALGKQSVNRGFTKDKTLSSIFNIEMVKEKTAEEIKQAEKFDLIWNRAQSCPTFLCALPRREGYEFFVGQWTGTELHFTALINIQTRGEAAASQLILYHYPELKEEKGIVLMTAEMDSTFLNVAEAQCIANQVQLFYATDRKETYGLVETFNLRPNEFKYMSVIAELEQSGLGAELKCAQNQNKT

SEQ ID NO: 890098 - protein, 168 aa, Homo sapiens
DSGLLCFTMCRLTLFFSNLQAEKFDLIWNRAQSCPTFLCALPRREGYEFFVGQWTGTELHFTALINIQTRGEAAASQLILYHYPELKEEKGIVLMTAEMDSTFLNVAEAQCIANQVQLFYATDRKETYGLVETFNLRPNEFKYMSVIAELEQSGLGAELKCAQNQNKT

SEQ ID NO: 890099 - protein, 179 aa, Homo sapiens
ARGPRAEADAPEEEEEAGAAMAAVVVAAAGGAGPAVLQVAGLYRGLCAVRSRALGLGLVSPAQLRVFPVRPGSGRPEGGADGSGVGAEAELQANPFYDRYRDKIQLLRRSDPAAFESRLEKRSEFRKQPVGHSRQGDFIKCVEQKTDALGKQSVNRGFTKDKTLSSIFNIEMVKEKKCC

SEQ ID NO: 890100 - protein, 617 aa, Homo sapiens
MDPMNIDTGSSQMGATIVDALDTLYIMGLHDEFLDGQRWIEDNLDFSVNSEVSVFEVNIRFIGGLLAAYYLSGEEIFKIKAVQLAEKLLPAFNTPTGIPWAMVNLKSGVGRNWGWASAGSSILAEFGTLHMEFIHLSYLTGDLTYYKKVMHIRKLLQKMDRPNGLYPNYLNPRTGRWGQYHTSVGGLGDSFYEYLLKAWLMSDKTDHEARKMYDDAIEAIEKHLIKKSRGGLTFIGEWKNGHLEKKMGHLACFAGGMFALGADGSRADKAGHYLELGAEIARTCHESYDRTALKLGPESLRSMQSQAFRISQNTGPPPIDRQKRLSYPPVQSIPTGNGIPSRDSENTCHQSFMQSLLAPHLSDQVIGSQRSLSEHQRNTQCGPSSAIEYNCPPTHENVHIRRESESQNRESCDMSLGAINTRNSTLNIPFSSSSSSGDIQGRNTSPNVSVQKSNPMRITESHATKGHMNPPVTTNMHGVARPALPHPSVSHGNGDQGPAVRQANSSVPQRSRHPLQDSSGSKIRQPERNRSGNQRQSTVFDPSLPHLSLSTGGSMILGRQQPATEKRGSIVRFMPDSPQVPNDNSGPDQHTLSQNFGFSFIPEGGMNPPINANASFI

SEQ ID NO: 890101 - protein, 641 aa, Homo sapiens
MTTPALLPLSGRRIPPLNLGPPSFPHHRATLRLSEKFILLLILSAFITLCFGAFFFLPDSSKHKRFDLGLEDVLIPHVDAGKGAKNPGVFLIHGPDEHRHREEEERLRNKIRADHEKALEEAKEKLRKSREEIRAEIQTEKNKVVQEMKIKENKPLPPVPIPNLVGIRGGDPEDNDIREKREKIKEMMKHAWDNYRTYGWGHNELRPIARKGHSPNIFGSSQMGATIVDALDTLYIMGLHDEFLDGQRWIEDNLDFSVNSEVSVFEVNIRFIGGLLAAYYLSGEEIFKIKAVQLAEKLLPAFNTPTGIPWAMVNLKSGVGRNWGWASAGSSILAEFGTLHMEFIHLSYLTGDLTYYKKVMHIRKLLQKMDRPNGLYPNYLNPRTGRWGQYHTSVGGLGDSFYEYLLKAWLMSDKTDHEARKMYDDAIEAIEKHLIKKSRGGLTFIGEWKNGHLEKKMGHLACFAGGMFALGADGSRADKAGHYLELGAEIARTCHESYDRTALKLGPESFKFDGAVEAVAVRQAEKYYILRPEVIETYWYLWRFTHDPRYRQWGWEAALAIEKYCRVNGGFSGVKDVYSSTPTHDDVQQSFFLAETLKYLYLLFSGDDLLPLDHWVFNTEAHPLPVLHLANTTLSGNPAVR

SEQ ID NO: 890102 - protein, 658 aa, Homo sapiens
MTTPALLPLSGRRIPPLNLGPPSFPHHRATLRLSEKFILLLILSAFITLCFGAFFFLPDSSKHKRFDLGLEDVLIPHVDAGKGAKNPGVFLIHGPDEHRHREEEERLRNKIRADHEKALEEAKEKLRKSREEIRAEIQTEKNKVVQEMKIKENKPLPPVPIPNLVGIRGGDPEDNDIREKREKIKEMMKHAWDNYRTYGWGHNELRPIARKGHSPNIFGSSQMGATIVDALDTLYIMGLHDEFLDGQRWIEDNLDFSVNSEVSVFEVNIRFIGGLLAAYYLSGEEIFKIKAVQLAEKLLPAFNTPTGIPWAMVNLKSGVGRNWGWASAGSSILAEFGTLHMEFIHLSYLTGDLTYYKKVMHIRKLLQKMDRPNGLYPNYLNPRTGRWGQYHTSVGGLGDSFYEYLLKAWLMSDKTDHEARKMYDDAIEAIEKHLIKKSRGGLTFIGEWKNGHLEKKMGHLACFAGGMFALGADGSRADKAGHYLELGAEIARTCHESYDRTALKLGPESFKFDGAVEAVAVRQAEKYYILRPEVIETYWYLWRFTHDPRYRQWGWEAALAIEKYCRVNGGFSGVKDVYSSTPTHDDVQQSFFLAETLKYLYLLFSGDDLLPLDHWVFNTEAHPLPVLHLANTTLSGTSQGMRRQNPYFQVLYLYYPDD

SEQ ID NO: 890103 - protein, 598 aa, Homo sapiens
MTTPALLPLSGRRIPPLNLGPPSFPHHRATLRLSEKFILLLILSAFITLCFGAFFFLPDSSKHKRFDLGLEDVLIPHVDAGKGAKNPGVFLIHGPDEHRHREEEERLRNKIRADHEKALEEAKEKLRKSREEIRAEIQTEKNKVVQEMKIKENKPLPPVPIPNLVGIRGGDPEDNDIREKREKIKEMMKHAWDNYRTYGWGHNELRPIARKGHSPNIFGSSQMGATIVDALDTLYIMGLHDEFLDGQRWIEDNLDFSVNSEVSVFEVNIRFIGGLLAAYYLSGEEIFKIKAVQLAEKLLPAFNTPTGIPWAMVNLKSGVGRNWGWASAGSSILAEFGTLHMEFIHLSYLTGDLTYYKKVMHIRKLLQKMDRPNGLYPNYLNPRTGRWGQYHTSVGGLGDSFYEYLLKAWLMSDKTDHEARKMYDDAIEAIEKHLIKKSRGGLTFIGEWKNGHLEKKMGHLACFAGGMFALGADGSRADKAGHYLELGAEIARTCHESYDRTALKLGPESFKFDGAVEAVAVRQAEKYYILRPEVIETYWYLWRFTHDPRYRQWGWEAALAIEKYCRVNGGFSGVKDVYSSTPTHDDVQQSFFLAETLN

SEQ ID NO: 890104 - protein, 436 aa, Homo sapiens
MTTPALLPLSGRRIPPLNLGPPSFPHHRATLRLSEKFILLLILSAFITLCFGAFFFLPDSSKHKRFDLGLEDVLIPHVDAGKGAKNPGVFLIHGPDEHRHREEEERLRNKIRADHEKALEEAKEKLRKSREEIRAEIQTEKNKVVQEMKIKENKPLPPVPIPNLVGIRGGDPEDNDIREKREKIKEMMKHAWDNYRTYGWGHNELRPIARKGHSPNIFGSSQMGATIVDALDTLYIMGLHDEFLDGQRWIEDNLDFSVNSEVSVFEVNIRFIGGLLAAYYLSGEEIFKIKAVQLAEKLLPAFNTPTGIPWAMVNLKSGVGRNWGWASAGSSILAEFGTLHMEFIHLSYLTGDLTYYKKVMHIRKLLQKMDRPNGLYPNYLNPRTGRWGQCKYSSIPEAFLKNYLSENSLLDVVKSTLRGVRNPQCLTLWSAGAVLR

SEQ ID NO: 890105 - protein, 641 aa, Homo sapiens; identical to SEQ ID NO: 890101

SEQ ID NO: 890106 - protein, 641 aa, Homo sapiens; identical to SEQ ID NO: 890101

SEQ ID NO: 890107 - protein, 293 aa, Homo sapiens
MTTPALLPLSGRRIPPLNLGPPSFPHHRATLRLSEKFILLLILSAFITLCFGAFFFLPDSSKHKRFDLGLEDVLIPHVDAGKGAKNPGVFLIHGPDEHRHREEEERLRNKIRADHEKALEEAKEKLRKSREEIRAEIQTEKNKVVQEMKIKENKPLPPVPIPNLVGIRGGDPEDNDIREKREKIKEMMKHAWDNYRTYGWGHNELRPIARKGHSPNIFGSSQMGATIVDALDTLYIMGLHDEFLDGQRWIEDNLDFSVNSEVSVFEVNIRFIGGLLAAYYLSGEEGRGRTSEK

SEQ ID NO: 890108 - protein, 227 aa, Homo sapiens
MGNCVGRQRRERPAAPGHPRKRAGRNEPLKKERLKWKSDYPMTDGQLRSKRDEFWDTAPAFEGRKEIWDALKAAAYAAEANDHELAQAILDGASITLPHGTLCECYDELGNRYQLPIYCLSPPVNLLLEHTEEESLEPPEPPPSVRREFPLKVRLSTGKDVRLSASLPDTVGQLKRQLHAQEGIEPSWQRWFFSGKLLTDRTRLQETKIQKDFVIQVIINQPPPPQD

SEQ ID NO: 890109 - protein, 227 aa, Homo sapiens; identical to SEQ ID NO: 890108

SEQ ID NO: 890110 - protein, 227 aa, Homo sapiens; identical to SEQ ID NO: 890108

SEQ ID NO: 890111 - protein, 227 aa, Homo sapiens; identical to SEQ ID NO: 890108

SEQ ID NO: 890112 - protein, 99 aa, Homo sapiens
MPKRKSPENTEGKDGSKVTKQEPTRRSARLSAKPAPPKPEPKPRKTSAKKEPGAKISRGAKGKKEEKQEAGKEGTAPSENGETKAEEAQKTESVDNEGE

SEQ ID NO: 890113 - protein, 77 aa, Homo sapiens
MPKRKSPENTEGKDGSKVTKQEPTRRSARLSAKPAPPKPEPKPRKTSAKKEPGAKISRGAKGKKEEKQEAGKEGTEN

SEQ ID NO: 890114 - protein, 77 aa, Homo sapiens; identical to SEQ ID NO: 890113

SEQ ID NO: 890115 - protein, 134 aa, Homo sapiens
MPKRKSPENTEGKDGSKVTKQEPTRRSARLSAKPAPPKPEPKPRKTSAKKEPGAKISRGAKGKKEEKQEAGKEGTAPSENGETKAEEIHISRSTVNVSTSRGTPPSTLSVKGQIETVRVKGTAQKTESVDNEGE

SEQ ID NO: 890116 - protein, 143 aa, Homo sapiens [sequence omitted]

SEQ ID NO: 890117 - protein, 101 aa, Homo sapiens
FNKVRYIKNRFLKINFVLYNHQKICIFSHSLCSPQDGLPDCQRNLLHQNLNPNQEKHLLRKNLEQRLAEVLKGRRRKSRKLERKVLHHLKMVKLKLKRYFP

SEQ ID NO: 890118 - protein, 134 aa, Homo sapiens; identical to SEQ ID NO: 890115

SEQ ID NO: 890119 - protein, 130 aa, Homo sapiens
MPKRKSPENTEGKDGSKVTKQEPTRRSARLSAKPAPPKPEPKPRKTSAKKEPGAKISRGAKGKKEEKQEAGKEGTAPSENGETKAEEIHISRSTVNVSTSRGTPPSTLSVKGQIETVRVKGTVENSACLQ

SEQ ID NO: 890120 - protein, 98 aa, Homo sapiens
TGESLVLKQSFLHGITLLSEIAELEPTRRSARLSAKPAPPKPEPKPRKTSAKKEPGAKISRGAKGKKEEKQEAGKEGTAPSENGETKAEEVLSINTSH

SEQ ID NO: 890121 - protein, 77 aa, Homo sapiens; identical to SEQ ID NO: 890113

SEQ ID NO: 890122 - protein, 418 aa, Homo sapiens
MSIEIPAGLTELLQGFTVEVLRHQPADLLEFALQHFTRLQQENERKGTARFGHEGRTWGDLGAAAGGGTPSKGVNFAEEPMQSDSEDGEEEEAAPADAGAFNAPVINRFTRRASVCAEAYNPDEEEDDAESRIIHPKTDDQRNRLQEACKDILLFKNLDPEQMSQVLDAMFEKLVKDGEHVIDQGDDGDNFYVIDRGTFDIYVKCDGVGRCVGNYDNRGSFGELALMYNTPRAATITATSPGALWGLDRVTFRRIIVKNNAKKRKMYESFIESLPFLKSLEFSERLKVVDVIGTKVYNDGEQIIAQGDSADSFFIVESGEVKITMKRKGKSEVEENGAVEIARCSRGQYFGELALVTNKPRAASAHAIGTVKCLAMDVQAFERLLGPCMEIMKRNIATYEEQLVALFGTNMDIVEPTA

SEQ ID NO: 890123 - protein, 256 aa, Homo sapiens
MSQVLDAMFEKLVKDGEHVIDQGDDGDNFYVIDRGTFDIYVKCDGVGRCVGNYDNRGSFGELALMYNTPRAATITATSPGALWGLDRVTFRRIIVKNNAKKRKMYESFIESLPFLKSLEFSERLKVVDVIGTKVYNDGEQIIAQGDSADSFFIVESGEVKITMKRKGKSEVEENGAVEIARCSRGQYFGELALVTNKPRAASAHAIGTVKCLAMDVQAFERLLGPCMEIMKRNIATYEEQLVALFGTNMDIVEPTA

SEQ ID NO: 890124 - protein, 345 aa, Homo sapiens
MSIEIPAGLTELLQGFTVEVLRHQPADLLEFALQHFTRLQQENERKGTARFGHEGRTWGDLGAAAGGGTPSKGVNFAEEPMQSDSEDGEEEEAAPADAGAFNAPVINRFTRRASVCAEAYNPDEEEDDAESRIIHPKTDDQRNRLQEACKDILLFKNLDPEQMSQVLDAMFEKLVKDGEHVIDQGDDGDNFYVIDRGTFDIYVKCDGVGRCVGNYDNRGSFGELALMYNTPRAATITATSPGALWGLDRVTFRRIIVKNNAKKRKMYESFIESLPFLKSLEFSERLKVVDVIGTKVYNDGEQIIAQGDSADSFFIVESGEVKITMKRKQWMCKHLKGFWDLAWKL

SEQ ID NO: 890125 - protein, 418 aa, Homo sapiens; identical to SEQ ID NO: 890122

SEQ ID NO: 890126 - protein, 418 aa, Homo sapiens; identical to SEQ ID NO: 890122

SEQ ID NO: 890127 - protein, 390 aa, Homo sapiens
MSIEIPAGLTELLQGFTVEVLRHQPADLLEFALQHFTRLQQENERKGTARFGHEGRTWGDLGAAAGGGTPSKGVNFAEEPMQSDSEDGEEEEAAPADAGAFNAPVINRFTRRASVCAEAYNPDEEEDDAESREQMSQVLDAMFEKLVKDGEHVIDQGDDGDNFYVIDRGTFDIYVKCDGVGRCVGNYDNRGSFGELALMYNTPRAATITATSPGALWGLDRVTFRRIIVKNNAKKRKMYESFIESLPFLKSLEFSERLKVVDVIGTKVYNDGEQIIAQGDSADSFFIVESGEVKITMKRKGKSEVEENGAVEIARCSRGQYFGELALVTNKPRAASAHAIGTVKCLAMDVQAFERLLGPCMEIMKRNIATYEEQLVALFGTNMDIVEPTA

SEQ ID NO: 890128 - protein, 1118 aa, Homo sapiens
MSVEAYGPSSQTLTFLDTEEAELLGADTQGSEFEFTDFTLPSQTQTPPGGPGGPGGGGAGGPGGAGAGAAAGQLDAQVGPEGILQNGAVDDSVAKTSQLLAELNFEEDEEDTYYTKDLPIHACSYCGIHDPACVVYCNTSKKWFCNGRGNTSGSHIVNHLVRAKCKEVTLHKDGPLGETVLECYNCGCRNVFLLGFIPAKADSVVVLLCRQPCASQSSLKDINWDSSQWQPLIQDRCFLSWLVKIPSEQEQLRARQITAQQINKLEELWKENPSATLEDLEKPGVDEEPQHVLLRYEDAYQYQNIFGPLVKLEADYDKKLKESQTQDNITVRWDLGLNKKRIAYFTLPKTDSDMRLMQGDEICLRYKGDLAPLWKGIGHVIKVPDNYGDEIAIELRSSVGAPVEVTHNFQVDFVWKSTSFDRMQSALKTFAVDETSVSGYIYHKLLGHEVEDVIIKCQLPKRFTAQGLPDLNHSQVYAVKTVLQRPLSLIQGPPGTGKTVTSATIVYHLARQGNGPVLVCAPSNIAVDQLTEKIHQTGLKVVRLCAKSREAIDSPVSFLALHNQIRNMDSMPELQKLQQLKDETGELSSADEKRYRALKRTAERELLMNADVICCTCVGAGDPRLAKMQFRSILIDESTQATEPECMVPVVLGAKQLILVGDHCQLGPVVMCKKAAKAGLSQSLFERLVVLGIRPIRLQVQYRMHPALSAFPSNIFYEGSLQNGVTAADRVKKGFDFQWPQPDKPMFFYVTQGQEEIASSGTSYLNRTEAANVEKITTKLLKAGAKPDQIGIITPYEGQRSYLVQYMQFSGSLHTKLYQEVEIASVDAFQGREKDFIILSCVRANEHQGIGFLNDPRRLNVALTRARYGVIIVGNPKALSKQPLWNHLLNYYKEQKVLVEGPLNNLRESLMQFSKPRKLVNTINPGARFMTTAMYDAREAIIPGSVYDRSSQGRPSSMYFQTHDQIGMISAGPSHVAAMNIPIPFNLVMPPMPPPGYFGQANGPAAGRGTPKGKTGRGGRQKNRFGLPGPSQTNLPNSQASQDVASQPFSQGALTQGYISMSQPSQMSQPGLSQPELSQDSYLGDEFKSQIDVALSQDSTYQGERAYQHGGVTGLSQY

SEQ ID NO: 890129 - protein, 1118 aa, Homo sapiens; identical to SEQ ID NO: 890128

SEQ ID NO: 890130 - protein, 709 aa, Homo sapiens
MYECDQPVLFASRGSGLINVMSVGDSSVSGYIYHKLLGHEVEDVIIKCQLPKRFTAQGLPDLNHSQVYAVKTVLQRPLSLIQGPPGTGKTVTSATIVYHLARQGNGPVLVCAPSNIAVDQLTEKIHQTGLKVVRLCAKSREAIDSPVSFLALHNQIRNMDSMPELQKLQQLKDETGELSSADEKRYRALKRTAERELLMNADVICCTCVGAGDPRLAKMQFRSILIDESTQATEPECMVPVVLGAKQLILVGDHCQLGPVVMCKKAAKAGLSQSLFERLVVLGIRPIRLQVQYRMHPALSAFPSNIFYEGSLQNGVTAADRVKKGFDFQWPQPDKPMFFYVTQGQEEIASSGTSYLNRTEAANVEKITTKLLKAGAKPDQIGIITPYEGQRSYLVQYMQFSGSLHTKLYQEVEIASVDAFQGREKDFIILSCVRANEHQGIGFLNDPRRLNVALTRARYGVIIVGNPKALSKQPLWNHLLNYYKEQKVLVEGPLNNLRESLMQFSKPRKLVNTINPGARFMTTAMYDAREAIIPGSVYDRSSQGRPSSMYFQTHDQIGMISAGPSHVAAMNIPIPFNLVMPPMPPPGYFGQANGPAAGRGTPKGKTGRGGRQKNRFGLPGPSQTNLPNSQASQDVASQPFSQGALTQGYISMSQPSQMSQPGLSQPELSQDSYLGDEFKSQIDVALSQDSTYQGERAYQHGGVTGLSQY

SEQ ID NO: 890131 - protein, 1118 aa, Homo sapiens; identical to SEQ ID NO: 890128

SEQ ID NO: 890132 - protein, 1184 aa, Homo sapiens
MSVEAYGPSSQTLTFLDTEEAELLGADTQGSEFEFTDFTLPSQTQTPPGGPGGPGGGGAGGPGGAGAGAAAGQLDAQVGPEGILQNGAVDDSVAKTSQLLAELNFEEDEEDTYYTKDLPIHACSYCGIHDPACVVYCNTSKKWFCNGRGNTSGSHIVNHLVRAKCKEVTLHKDGPLGETVLECYNCGCRNVFLLGFIPAKADSVVVLLCRQPCASQSSLKDINWDSSQWQPLIQDRCFLSWLVKIPSEQEQLRARQITAQQINKLEELWKENPSATLEDLEKPGVDEEPQHVLLRYEDAYQYQNIFGPLVKLEADYDKKLKESQTQDNITVRWDLGLNKKRIAYFTLPKTDSDMRLMQGDEICLRYKGDLAPLWKGIGHVIKVPDNYGDEIAIELRSSVGAPVEVTHNFQVDFVWKSTSFDRMQSALKTFAVDETSVSGYIYHKLLGHEVEDVIIKCQLPKRFTAQGLPDLNHSQVYAVKTVLQRPLSLIQGPPGTGKTVTSATIVYHLARQGNGPVLVCAPSNIAVDQLTEKIHQTGLKVVRLCAKSREAIDSPVSFLALHNQIRNMDSMPELQKLQQLKDETGELSSADEKRYRALKRTAERELLMNADVICCTCVGAGDPRLAKMQFRSILIDESTQATEPECMVPVVLGAKQLILVGDHCQLGPVVMCKKAAKAGLSQSLFERLVVLGIRPIRLQVQYRMHPALSAFPSNIFYEGSLQNGVTAADRVKKGFDFQWPQPDKPMFFYVTQGQEEIASSGTSYLNRYLLIPHGSRFCPRDSPGEGWGSSAVQTPVMAAAFPQGVVSAPLTASSLRARDPTGGAQHCQPGFLRTEAANVEKITTKLLKAGAKPDQIGIITPYEGQRSYLVQYMQFSGSLHTKLYQEVEIASVDAFQGREKDFIILSCVRANEHQGIGFLNDPRRLNVALTRARYGVIIVGNPKALSKQPLWNHLLNYYKEQKVLVEGPLNNLRESLMQFSKPRKLVNTINPGARFMTTAMYDAREAIIPGSVYDRSSQGRPSSMYFQTHDQIGMISAGPSHVAAMNIPIPFNLVMPPMPPPGYFGQANGPAAGRGTPKGKTGRGGRQKNRFGLPGPSQTNLPNSQASQDVASQPFSQGALTQGYISMSQPSQMSQPGLSQPELSQDSYLGDEFKSQIDVALSQDSTYQGERAYQHGGVTGLSQY

SEQ ID NO: 890133 - protein, 491 aa, Homo sapiens
MQFRSILIDESTQATEPECMVPVVLGAKQLILVGDHCQLGPVVMCKKAAKAGLSQSLFERLVVLGIRPIRLQVQYRMHPALSAFPSNIFYEGSLQNGVTAADRVKKGFDFQWPQPDKPMFFYVTQGQEEIASSGTSYLNRTEAANVEKITTKLLKAGAKPDQIGIITPYEGQRSYLVQYMQFSGSLHTKLYQEVEIASVDAFQGREKDFIILSCVRANEHQGIGFLNDPRRLNVALTRARYGVIIVGNPKALSKQPLWNHLLNYYKEQKVLVEGPLNNLRESLMQFSKPRKLVNTINPGARFMTTAMYDAREAIIPGSVYDRSSQGRPSSMYFQTHDQIGMISAGPSHVAAMNIPIPFNLVMPPMPPPGYFGQANGPAAGRGTPKGKTGRGGRQKNRFGLPGPSQTNLPNSQASQDVASQPFSQGALTQGYISMSQPSQMSQPGLSQPELSQDSYLGDEFKSQIDVALSQDSTYQGERAYQHGGVTGLSQY

SEQ ID NO: 890134 - protein, 468 aa, Homo sapiens
MQFRSILIDESTQATEPECMVPVVLGAKQLILVGDHCQLGPVVMCKKAAKAGLSQSLFERLVVLGIRPIRLQVQYRMHPALSAFPSNIFYEGSLQNGVTAADRVKKGFDFQWPQPDKPMFFYVTQGQEEIASSGTSYLNRTEAANVEKITTKLLKYMQFSGSLHTKLYQEVEIASVDAFQGREKDFIILSCVRANEHQGIGFLNDPRRLNVALTRARYGVIIVGNPKALSKQPLWNHLLNYYKEQKVLVEGPLNNLRESLMQFSKPRKLVNTINPGARFMTTAMYDAREAIIPGSVYDRSSQGRPSSMYFQTHDQIGMISAGPSHVAAMNIPIPFNLVMPPMPPPGYFGQANGPAAGRGTPKGKTGRGGRQKNRFGLPGPSQTNLPNSQASQDVASQPFSQGALTQGYISMSQPSQMSQPGLSQPELSQDSYLGDEFKSQIDVALSQDSTYQGERAYQHGGVTGLSQY

SEQ ID NO: 890135 - protein, 1118 aa, Homo sapiens; identical to SEQ ID NO: 890128

SEQ ID NO: 890136 - protein, 1118 aa, Homo sapiens; identical to SEQ ID NO: 890128

SEQ ID NO: 890137 - protein, 1118 aa, Homo sapiens; identical to SEQ ID NO: 890128

SEQ ID NO: 890138 - protein, 793 aa, Homo sapiens
MSVEAYGPSSQTLTFLDTEEAELLGADTQGSEFEFTDFTLPSQTQTPPGGPGGPGGGGAGGPGGAGAGAAAGQLDAQVGPEGILQNGAVDDSVAKTSQLLAELNFEEDEEDTYYTKDLPIHACSYCGIHDPACVVYCNTSKKWFCNGRGNTSGSHIVNHLVRAKCKEVTLHKDGPLGETVLECYNCGCRNVFLLGFIPAKADSVVVLLCRQPCASQSSLKDINWDSSQWQPLIQDRCFLSWLVKIPSEQEQLRARQITAQQINKLEELWKENPSATLEDLEKPGVDEEPQHVLLRYEDAYQYQNIFGPLVKLEADYDKKLKESQTQDNITVRWDLGLNKKRIAYFTLPKTDSDMRLMQGDEICLRYKGDLAPLWKGIGHVIKVPDNYGDEIAIELRSSVGAPVEVTHNFQVDFVWKSTSFDRMQSALKTFAVDETSVSGYIYHKLLGHEVEDVIIKCQLPKRFTAQGLPDLNHSQVYAVKTVLQRPLSLIQGPPGTGKTVTSATIVYHLARQGNGPVLVCAPSNIAVDQLTEKIHQTGLKVVRLCAKSREAIDSPVSFLALHNQIRNMDSMPELQKLQQLKDETGELSSADEKRYRALKRTAERELLMNADVICCTCVGAGDPRLAKMQFRSILIDESTQATEPECMVPVVLGAKQLILVGDHCQLGPVVMCKKAAKAGLSQSLFERLVVLGIRPIRLQVQYRMHPALSAFPSNIFYEGSLQNGVTAADRVKKGFDFQWPQPDKPMFFYVTQGQEEIASSGTSYLNRTEAANVEKITTKLLKAGAKPDQIGTG

SEQ ID NO: 890139 - protein, 515 aa, Homo sapiens
MSVEAYGPSSQTLTFLDTEEAELLGADTQGSEFEFTDFTLPSQTQTPPGGPGGPGGGGAGGPGGAGAGAAAGQLDAQVGPEGILQNGAVDDSVAKTSQLLAELNFEEDEEDTYYTKDLPIHACSYCGIHDPACVVYCNTSKKWFCNGRGNTSGSHIVNHLVRAKCKEVTLHKDGPLGETVLECYNCGCRNVFLLGFIPAKADSVVVLLCRQPCASQSSLKDINWDSSQWQPLIQDRCFLSWLVKIPSEQEQLRARQITAQQINKLEELWKENPSATLEDLEKPGVDEEPQHVLLRYEDAYQYQNIFGPLVKLEADYDKKLKESQTQDNITVRWDLGLNKKRIAYFTLPKTDSDMRLMQGDEICLRYKGDLAPLWKGIGHVIKVPDNYGDEIAIELRSSVGAPVEVTHNFQVDFVWKSTSFDRMQSALKTFAVDETSVSGYIYHKLLGHEVEDVIIKCQLPKRFTAQGLPDLNHSQVYAVKTVLQRPLSLIQGPPGTGKTVTSATIVYHLARQGNG

SEQ ID NO: 890140 - protein, 69 aa, Homo sapiens
PGCGCSLLVSAAGFAAALCVSERGLDGWLGVARRNSRLAGGGTPAHGEVESFFKDAVLLVSGLVLAARF

SEQ ID NO: 890141 - protein, 1129 aa, Homo sapiens
MSVEAYGPSSQTLTFLDTEEAELLGADTQGSEFEFTDFTLPSQTQTPPGGPGGPGGGGAGGPGGAGAGAAAGQLDAQVGPEGILQNGAVDDSVAKTSQLLAELNFEEDEEDTYYTKDLPIHACSYCGIHDPACVVYCNTSKKWFCNGRGNTSGSHIVNHLVRAKCKEVTLHKDGPLGETVLECYNCGCRNVFLLGFIPAKADSVVVLLCRQPCASQSSLKDINWDSSQWQPLIQDRCFLSWLVKIPSEQEQLRARQITAQQINKLEELWKENPSATLEDLEKPGVDEEPQHVLLRYEDAYQYQNIFGPLVKLEADYDKKLKESQTQDNITVRWDLGLNKKRIAYFTLPKTDSGNEDLVIIWLRDMRLMQGDEICLRYKGDLAPLWKGIGHVIKVPDNYGDEIAIELRSSVGAPVEVTHNFQVDFVWKSTSFDRMQSALKTFAVDETSVSGYIYHKLLGHEVEDVIIKCQLPKRFTAQGLPDLNHSQVYAVKTVLQRPLSLIQGPPGTGKTVTSATIVYHLARQGNGPVLVCAPSNIAVDQLTEKIHQTGLKVVRLCAKSREAIDSPVSFLALHNQIRNMDSMPELQKLQQLKDETGELSSADEKRYRALKRTAERELLMNADVICCTCVGAGDPRLAKMQFRSILIDESTQATEPECMVPVVLGAKQLILVGDHCQLGPVVMCKKAAKAGLSQSLFERLVVLGIRPIRLQVQYRMHPALSAFPSNIFYEGSLQNGVTAADRVKKGFDFQWPQPDKPMFFYVTQGQEEIASSGTSYLNRTEAANVEKITTKLLKAGAKPDQIGIITPYEGQRSYLVQYMQFSGSLHTKLYQEVEIASVDAFQGREKDFIILSCVRANEHQGIGFLNDPRRLNVALTRARYGVIIVGNPKALSKQPLWNHLLNYYKEQKVLVEGPLNNLRESLMQFSKPRKLVNTINPGARFMTTAMYDAREAIIPGSVYDRSSQGRPSSMYFQTHDQIGMISAGPSHVAAMNIPIPFNLVMPPMPPPGYFGQANGPAAGRGTPKGKTGRGGRQKNRFGLPGPSQTNLPNSQASQDVASQPFSQGALTQGYISMSQPSQMSQPGLSQPELSQDSYLGDEFKSQIDVALSQDSTYQGERAYQHGGVTGLSQY

SEQ ID NO: 890142 - protein, 309 aa, Homo sapiens
RGVHLMPVGLSLEYPHRYKRHGREKDFIILSCVRANEHQGIGFLNDPRRLNVALTRARYGVIIVGNPKALSKQPLWNHLLNYYKEQKVLVEGPLNNLRESLMQFSKPRKLVNTINPGARFMTTAMYDAREAIIPGSVYDRSSQGRPSSMYFQTHDQIGMISAGPSHVAAMNIPIPFNLVMPPMPPPGYFGQANGPAAGRGTPKGKTGRGGRQKNRFGLPGPSQTNLPNSQASQDVASQPFSQGALTQGYISMSQPSQMSQPGLSQPELSQDSYLGDEFKSQIDVALSQDSTYQGERAYQHGGVTGLSQY

SEQ ID NO: 890143 - protein, 1118 aa, Homo sapiens; identical to SEQ ID NO: 890128

SEQ ID NO: 890144 - protein, 978 aa, Homo sapiens
MSVEAYGPSSQTLTFLDTEEAELLGADTQGSEFEFTDFTLPSQTQTPPGGPGGPGGGGAGGPGGAGAGAAAGQLDAQVGPEGILQNGAVDDSVAKTSQLLAELNFEEDEEDTYYTKDLPIHACSYCGIHDPACVVYCNTSKKWFCNGRGNTSGSHIVNHLVRAKCKEVTLHKDGPLGETVLECYNCGCRNVFLLGFIPAKADSVVVLLCRQPCASQSSLKDINWDSSQWQPLIQDRCFLSWLVKIPSEQEQLRARQITAQQINKLEELWKENPSATLEDLEKPGVDEEPQHVLLRYEDAYQYQNIFGPLVKLEADYDKKLKESQTQDNITVRWDLGLNKKRIAYFTLPKTDSDMRLMQGDEICLRYKGDLAPLWKGIGHVIKVPDNYGDEIAIELRSSVGAPVEVTHNFQVDFVWKSTSFDRMQSALKTFAVDETSVSGYIYHKLLGHEVEDVIIKCQLPKRFTAQGLPDLNHSQVYAVKTVLQRPLSLIQGPPGTGKTVTSATIVYHLARQGNGPVLVCAPSNIAVDQLTEKIHQTGLKVVRLCAKSREAIDSPVSFLALHNQIRNMDSMPELQKLQQLKDETGELSSADEKRYRALKRTAERELLMNADVICCTCVGAGDPRLAKMQFRSILIDESTQATEPECMVPVVLGAKQLILVGDHCQLGPVVMCKKAAKAGLSQSLFERLVVLGIRPIRLQVQYRMHPALSAFPSNIFYEGSLQNGVTAADRVKKGFDFQWPQPDKPMFFYVTQGQEEIASSGTSYLNRTEAANVEKITTKLLKAGAKPDQIGIITPYEGQRSYLVQYMQFSGSLHTKLYQEVEIASVDAFQGREKDFIILSCVRANEHQGIGFLNDPRRLNVALTRARYGVIIVGNPKALSKQPLWNHLLNYYKEQKVLVEGPLNNLRESLMQFSKPRKLVNTINPGARFMTTAMYDAREAIIPGSVYDRSSQARLFPQSGSRRIDNNRNSMTRRNSTA

SEQ ID NO: 890145 - protein, 108 aa, Homo sapiens
MAAAFPQGVVSAPLTASSLRARDPTGGAQHCQPGFLRTEAANVEKITTKLLKAGAKPDQIGIITPYEGQRSYLVQYMQFSGSLHTKLYQVRCALGHTWSPGPCKGIDP

SEQ ID NO: 890146 - protein, 70 aa, Homo sapiens
SRRLLSRQRLAVGPASWGLGHVEARPGPVLEANRGSCFSCAQTQDNITVRWDLGLNKKRIAYFTLPKTDS

SEQ ID NO: 890147 - protein, 116 aa, Homo sapiens
PKALSKQPLWNHLLNYYKEQKVLVEGPLNNLRESLMQFSKPRKLVNTINPVSACTGQQGSTEKPGPKTLLGTCQLGPCARELREGSPRGGWALLGEGGPAHFLSPEPCVAFLAWGR

SEQ ID NO: 890148 - protein, 639 aa, Homo sapiens
SLKLKTPAKNQYVSFCSYWEGACCGPVRKSRALVQLRAGREAVTMPACCSCSDVFQYETNKVTRIQSMNYGTIKWFFHVIIFSYVCFALVSDKLYQRKEPVISSVHTKVKGIAEVKEEIVENGVKKLVHSVFDTADYTFPLQGNSFFVMTNFLKTEGQEQRLCPEYPTRRTLCSSDRGCKKGWMDPQSKGIQTGRCVVHEGNQKTCEVSAWCPIEAVEEAPRPALLNSAENFTVLIKNNIDFPGHNYTTRNILPGLNITCTFHKTQNPQCPIFRLGDIFRETGDNFSDVAIQGGIMGIEIYWDCNLDRWFHHCHPKYSFRRLDDKTTNVSLYPGYNFRYAKYYKENNVEKRTLIKVFGIRFDILVFGTGGKFDIIQLVVYIGSTLSYFGLAAVFIDFLIDTYSSNCCRSHIYPWCKCCQPCVVNEYYYRKKCESIVEPKPTLKYVSFVDESHIRMVNQQLLGRSLQDVKGQEVPRPAMDFTDLSRLPLALHDTPPIPGQPEEIQLLRKEATPRSRDSPVWCQCGSCLPSQLPESHRCLEELCCRKKPGACITTSELFRKLVLSRHVLQFLLLYQEPLLALDVDSTNSRLRHCAYRCYATWRFGSQDMADFAILPSCCRWRIRKEFPKSEGQYSGFKSPY

SEQ ID NO: 890149 - protein, 639 aa, Homo sapiens; identical to SEQ ID NO: 890148

SEQ ID NO: 890150 - protein, 639 aa, Homo sapiens; identical to SEQ ID NO: 890148

SEQ ID NO: 890151 - protein, 425 aa, Homo sapiens [sequence omitted]

SEQ ID NO: 890152 - protein, 667 aa, Homo sapiens
SLKLKTPAKNQYVSFCSYWEGACCGPVRKSRALVQLRAGREAVTMPACCSCSDVFQYETNKVTRIQSMNYGTIKWFFHVIIFSYVCFALVSDKLYQRKEPVISSVHTKVKGIAEVKEEIVENGVKKLVHSVFDTADYTFPLQGNSFFVMTNFLKTEGQEQRLCPEYPTRRTLCSSDRGCKKGWMDPQSKGIQTGRCVVHEGNQKTCEVSAWCPIEAVEEAPRPALLNSAENFTVLIKNNIDFPGHNYTTRNILPGLNITCTFHKTQNPQCPIFRLGDIFRETGDNFSDVAIQGGIMGIEIYWDCNLDRWFHHCHPKYSFRRLDDKTTNVSLYPGYNFRYAKYYKENNVEKRTLIKVFGIRFDILVFGTGGKFDIIQLVVYIGSTLSYFGLVRDSLFHALGKWFGEGSDYRSACLHSPQAAVFIDFLIDTYSSNCCRSHIYPWCKCCQPCVVNEYYYRKKCESIVEPKPTLKYVSFVDESHIRMVNQQLLGRSLQDVKGQEVPRPAMDFTDLSRLPLALHDTPPIPGQPEEIQLLRKEATPRSRDSPVWCQCGSCLPSQLPESHRCLEELCCRKKPGACITTSELFRKLVLSRHVLQFLLLYQEPLLALDVDSTNSRLRHCAYRCYATWRFGSQDMADFAILPSCCRWRIRKEFPKSEGQYSGFKSPY

SEQ ID NO: 890153 - protein, 106 aa, Homo sapiens
SLKLKTPAKNQYVSFCSYWEGACCGPVRKSRALVQLRAGREAVTMPACCSCSDVFQYETNKVTRIQSMNYGTIKWFFHVIIFSYVCFALVSDKLYQRKEPVISSSA

SEQ ID NO: 890154 - protein, 64 aa, Homo sapiens
MPPVDAFPCLPFSFALVSDKLYQRKEPVISSVHTKVKGIAEVKEEIVENGVKKLVHSVFDTADY

SEQ ID NO: 890155 - protein, 996 aa, Homo sapiens
MQHLKSKKREERWMRASKRQSEKEMEELHHNIDDLLQEKKSLECEVEELHRTVQKRQQQKDFIDGNVESLMTELEIEKSLKHHEDIVDEIECIEKTLLKRRSELREADRLLAEAESELSCTKEKTKNAVEKFTDAKRSLLQTESDAEELERRAQETAVNLVKADQQLRSLQADAKDLEQHKIKQEEILKEINKIVAAKDSDFQCLSKKKEKLTEELQKLQKDIEMAERNEDHHLQVLKESEVLLQAKRAELEKLKSQVTSQQQEMAVLDRQLGHKKEELHLLQGSMVQAKADLQEALRLGETEVTEKCNHIREVKSLLEELSFQKGELNVQISERKTQLTLIKQEIEKEEENLQVVLRQMSKHKTELKNILDMLQLENHELQGLKLQHDQRVSELEKTQVAVLEEKLELENLQQISQQQKGEIEWQKQLLERDKREIERMTAESRALQSCVECLSKEKEDLQEKCDIWEKKLAQTKRVLAAAEENSKMEQSNLEKLELNVRKLQQELDQLNRDKLSLHNDISAMQQQLQGKEKREAVNSLQEELANVQDHLNLAKQDLLHTTKHQDVLLSEQTRLQKDISEWANRFEDCQKEEETKQQQLQVLQNEIEENKLKLVQQEMMFQRLQKERESEESKLETSKVTLKEQQHQLEKELTDQKSKLDQVLSKVLAAEERVRTLQEEERWCESLEKTLSQTKRQLSEREQQLVEKSGELLALQKEADSMRADFSLLRNQFLTERKKAEKQVASLKEALKIQRSQLEKNLLEQKQENSCIQKEMATIELVAQDNHERARRLMKELNQMQYEYTELKKQMANQKDLERRQMEISDAMRTLKSEVKDEIRTSLKNLNQFLPELPADLEAILERNENLEGELESLKENLPFTMNEGPFEEKLNFSQVHIMDEHWRGEALREKLRHREDRLKAQLRHCMSKQAEVLIKGKRQTEGTLHSLRRQVDALGELVTSTSADSASSPSLSQLESSLTEDSQLGQNQEKNASAR

SEQ ID NO: 890156 - protein, 126 aa, Homo sapiens
MAFVKLTLPFSLIQVTSQQQEMAVLDRQLGHKKEELHLLQGSMVQAKADLQEALRLGETEVTEKCNHIREVKSLLEELSFQKGELNVQISERKTQLTLIKQEIEKEEENLQVVLRQMSKHKTAFLQ

SEQ ID NO: 890157 - protein, 130 aa, Homo sapiens
FLFHENVISLEKREAVNSLQEELANVQDHLNLAKQDLLHTTKHQDVLLSEQTRLQKDISEWANRFEDCQKEEETKQQQLQVLQNEIEENKLKLVQQEMMFQRLQKERESKDPKRAKTPKEQRPQKSKDPK

SEQ ID NO: 890158 - protein, 1775 aa, Homo sapiens
MKAQKSGKEQQLDIMNKQYQQLESRLDEILSRIAKETEEIKDLEEQLTEGQIAANEALKKDLEGVISGLQEYLGTIKGQATQAQNECRKLRDEKETLLQRLTEVEQERDQLEIVAMDAENMRKELAELESALQEQHEVNASLQQTQGDLSAYEAELEARLNLRDAEANQLKEELEKVTRLTQLEQSALQAELEKERQALKNALGKAQFSEEKEQENSELHAKLKHLQDDNNLLKQQLKDFQNHLNHVVDGLVRPEEVAARVDELRRKLKLGTGEMNIHSPSDVLGKSLADLQKQFSEILARSKWERDEAQVRERKLQEEMALQQEKLATGQEEFRQACERALEARMNFDKRQHEARIQQMENEIHYLQENLKSMEEIQGLTDLQLQEADEEKERILAQLRELEKKKKLEDAKSQEQVFGLDKELKKLKKAVATSDKLATAELTIAKDQLKSLHGTVMKINQERAEELQEAERFSRKAAQAARDLTRAEAEIELLQNLLRQKGEQFRLEMEKTGVGTGANSQVLEIEKLNETMERQRTEIARLQNVLDLTGSDNKGGFENVLEEIAELRREVSYQNDYISSMADPFKRRGYWYFMPPPPSSKVSSHSSQATKDSGVGLKYSASTPVRKPRPGQQDGKEGSQPPPASGYWVYSPIRSGLHKLFPSRDADSGGDSQEESELDDQEEPPFVPPPGYMMYTVLPDGSPVPQGMALYAPPPPLPNNSRPLTPGTVVYGPPPAGAPMVYGPPPPNFSIPFIPMGVLHCNVPEHHNLENEVSRLEDIMQHLKSKKREERWMRASKRQSEKEMEELHHNIDDLLQEKKSLECEVEELHRTVQKRQQQKDFIDGNVESLMTELEIEKSLKHHEDIVDEIECIEKTLLKRRSELREADRLLAEAESELSCTKEKTKNAVEKFTDAKRSLLQTESDAEELERRAQETAVNLVKADQQLRSLQADAKDLEQHKIKQEEILKEINKIVAAKDSDFQCLSKKKEKLTEELQKLQKDIEMAERNEDHHLQVLKESEVLLQAKRAELEKLKSQVTSQQQEMAVLDRQLGHKKEELHLLQGSMVQAKADLQEALRLGETEVTEKCNHIREVKSLLEELSFQKGELNVQISERKTQLTLIKQEIEKEEENLQVVLRQMSKHKTELKNILDMLQLENHELQGLKLQHDQRVSELEKTQVAVLEEKLELENLQQISQQQKGEIEWQKQLLERDKREIERMTAESRALQSCVECLSKEKEDLQEKCDIWEKKLAQTKRVLAAAEENSKMEQSNLEKLELNVRKLQQELDQLNRDKLSLHNDISAMQQQLQGKEKREAVNSLQEELANVQDHLNLAKQDLLHTTKHQDVLLSEQTRLQKDISEWANRFEDCQKEEETKQQQLQVLQNEIEENKLKLVQQEMMFQRLQKERESEESKLETSKVTLKEQQHQLEKELTDQKSKLDQVLSKVLAAEERVRTLQEEERWCESLEKTLSQTKRQLSEREQQLVEKSGELLALQKEADSMRADFSLLRNQFLTERKKAEKQVASLKEALKIQRSQLEKNLLEQKQENSCIQKEMATIELVAQDNHERARRLMKELNQMQYEYTELKKQMANQKDLERRQMEISDAMRTLKSEVKDEIRTSLKNLNQFLPELPADLEAILERNENLEGELESLKENLPFTMNEGPFEEKLNFSQVHIMDEHWRGEALREKLRHREDRLKAQLRHCMSKQAEVLIKGKRQTEGTLHSLRRQVDALGELVTSTSADSASSPSLSQLESSLTEDSQLGQNQEKNASAR

SEQ ID NO: 890159 - protein, 1698 aa, Homo sapiens
MKAQKSGKEQQLDIMNKQYQQLESRLDEILSRIAKETEEIKDLEEQLTEGQIAANEALKKDLEGVISGLQEYLGTIKGQATQAQNECRKLRDEKETLLQRLTEVEQERDQLEIVAMDAENMRKELAELESALQEQHEVNASLQQTQGDLSAYEAELEARLNLRDAEANQLKEELEKVTRLTQLEQSALQAELEKERQALKNALGKAQFSEEKEQENSELHAKLKHLQDDNNLLKQQLKDFQNHLNHVVDGLVRPEEVAARVDELRRKLKLGTGEMNIHSPSDVLGKSLADLQKQFSEILARSKWERDEAQVRERKLQEEMALQQEKLATGQEEFRQACERALEARMNFDKRQHEARIQQMENEIHYLQENLKSMEEIQGLTDLQLQEADEEKERILAQLRELEKKKKLEDAKSQEQVFGLDKELKKLKKAVATSDKLATAELTIAKDQLKSLHGTVMKINQERAEELQEAERFSRKAAQAARDLTRAEAEIELLQNLLRQKGEQFRLEMEKTGVGTGANSQVLEIEKLNETMERQRTEIARLQNVLDLTGSDNKGGFENVLEEIAELRREVSYQNDYISSMADPFKRRGYWYFMPPPPSSKVSSHSSQATKDSGVGLKYSASTPVRKPRPGQQDGKEGSQPPPASGYWVYSPIRSGLHKLFPSRDADSGGDSQEESELDDQEEPPFVPPPGYMMYTVLPDGSPVPQGMALYAPPPPLPNNSRPLTPGTVVYGPPPAGAPMVYGPPPPNFSIPFIPMGVLHCNVPEHHNLENEVSRLEDIMQHLKSKKREERWMRASKRQSEKEMEELHHNIDDLLQEKKSLECEVEELHRTVQKRQQQKDFIDGNVESLMTELEIEKSLKHHEDIVDEIECIEKTLLKRRSELREADRLLAEAESELSCTKEKTKNAVEKFTDAKRSLLQTESDAEELERRAQETAVNLVKADQQLRSLQADAKDLEQHKIKQEEILKEINKIVAAKDSDFQCLSKKKEKLTEELQKLQKDIEMAERNEDHHLQVLKESEVLLQAKRAELEKLKSQVTSQQQEMAVLDRQLGHKKEELHLLQGSMVQAKADLQEALRLGETEVTEKCNHIREVKSLLEELSFQKGELNVQISERKTQLTLIKQEIEKEEENLQVVLRQMSKHKTELKNILDMLQLENHELQGLKLQHDQRVSELEKTQVAVLEEKLELENLQQISQQQKGEIEWQKQLLERDKREIERMTAESRALQSCVECLSKEKEDLQEKCDIWEKKLAQTKRVLAAAEENSKMEQSNLEKLELNVRKLQQELDQLNRDKLSLHNDISAMQQQLQGKEKREAVNSLQEELANVQDHLNLAKQDLLHTTKHQDVLLSEQTRLQKDISEWANRFEDCQKEEETKQQQLQVLQNEIEENKLKLVQQEMMFQRLQKERESEESKLETSKVTLKEQQHQLEKELTDQKSKLDQVLSKVLAAEERVRTLQEEERWCESLEKTLSQTKRQLSEREQQLVEKSGELLALQKEADSMRADFSLLRNQFLTERKKAEKQVASLKEALKIQRSQLEKNLLEQKQENSCIQKEMATIELVAQDNHERARRLMKELNQMQYEYTELKKQMANQKDLERRQMEISDAMRTLKSEVKDEIRTSLKNLNQFLPELPADLEAILERNENLEGELESLKENLPFTMNEGPFEEKLNFSQVHIMVRVYPAILWVRRIDHLPQLS

SEQ ID NO: 890160 - protein, 1309 aa, Homo sapiens
MKAQKSGKEQQLDIMNKQYQQLESRLDEILSRIAKETEEIKDLEEQLTEGQIAANEALKKDLEGVISGLQEYLGTIKGQATQAQNECRKLRDEKETLLQRLTEVEQERDQLEIVAMDAENMRKELAELESALQEQHEVNASLQQTQGDLSAYEAELEARLNLRDAEANQLKEELEKVTRLTQLEQSALQAELEKERQALKNALGKAQFSEEKEQENSELHAKLKHLQDDNNLLKQQLKDFQNHLNHVVDGLVRPEEVAARVDELRRKLKLGTGEMNIHSPSDVLGKSLADLQKQFSEILARSKWERDEAQVRERKLQEEMALQQEKLATGQEEFRQACERALEARMNFDKRQHEARIQQMENEIHYLQENLKSMEEIQGLTDLQLQEADEEKERILAQLRELEKKKKLEDAKSQEQVFGLDKELKKLKKAVATSDKLATAELTIAKDQLKSLHGTVMKINQERAEELQEAERFSRKAAQAARDLTRAEAEIELLQNLLRQKGEQFRLEMEKTGVGTGANSQVLEIEKLNETMERQRTEIARLQNVLDLTGSDNKGGFENVLEEIAELRREVSYQNDYISSMADPFKRRGYWYFMPPPPSSKVSSHSSQATKDSGVGLKYSASTPVRKPRPGQQDGKEGSQPPPASGYWVYSPIRSGLHKLFPSRDADSGGDSQEESELDDQEEPPFVPPPGYMMYTVLPDGSPVPQGMALYAPPPPLPNNSRPLTPGTVVYGPPPAGAPMVYGPPPPNFSIPFIPMGVLHCNVPEHHNLENEVSRLEDIMQHLKSKKREERWMRASKRQSEKEMEELHHNIDDLLQEKKSLECEVEELHRTVQKRQQQKDFIDGNVESLMTELEIEKSLKHHEDIVDEIECIEKTLLKRRSELREADRLLAEAESELSCTKEKTKNAVEKFTDAKRSLLQTESDAEELERRAQETAVNLVKADQQLRSLQADAKDLEQHKIKQEEILKEINKIVAAKDSDFQCLSKKKEKLTEELQKLQKDIEMAERNEDHHLQVLKESEVLLQAKRAELEKLKSQVTSQQQEMAVLDRQLGHKKEELHLLQGSMVQAKADLQEALRLGETEVTEKCNHIREVKSLLEELSFQKGELNVQISERKTQLTLIKQEIEKEEENLQVVLRQMSKHKTELKNILDMLQLENHELQGLKLQHDQRVSELEKTQVAVLEEKLELENLQQISQQQKGEIEWQKQLLERDKREIERMTAESRALQSCVECLSKEKEDLQEKCDIWEKKLAQTKRVLAAAEENSKMEQSNLEKLELNVRKLQQELDQLNRDKLSLHNDISAMQQQLQV

SEQ ID NO: 890161 - protein, 1148 aa, Homo sapiens
MKAQKSGKEQQLDIMNKQYQQLESRLDEILSRIAKETEEIKDLEEQLTEGQIAANEALKKDLEGVISGLQEYLGTIKGQATQAQNECRKLRDEKETLLQRLTEVEQERDQLEIVAMDAENMRKELAELESALQEQHEVNASLQQTQGDLSAYEAELEARLNLRDAEANQLKEELEKVTRLTQLEQSALQAELEKERQALKNALGKAQFSEEKEQENSELHAKLKHLQDDNNLLKQQLKDFQNHLNHVVDGLVRPEEVAARVDELRRKLKLGTGEMNIHSPSDVLGKSLADLQKQFSEILARSKWERDEAQVRERKLQEEMALQQEKLATGQEEFRQACERALEARMNFDKRQHEARIQQMENEIHYLQENLKSMEEIQGLTDLQLQEADEEKERILAQLRELEKKKKLEDAKSQEQVFGLDKELKKLKKAVATSDKLATAELTIAKDQLKSLHGTVMKINQERAEELQEAERFSRKAAQAARDLTRAEAEIELLQNLLRQKGEQFRLEMEKTGVGTGANSQVLEIEKLNETMERQRTEIARLQNVLDLTGSDNKGGFENVLEEIAELRREVSYQNDYISSMADPFKRRGYWYFMPPPPSSKVSSHSSQATKDSGVGLKYSASTPVRKPRPGQQDGKEGSQPPPASGYWVYSPIRSGLHKLFPSRDADSGGDSQEESELDDQEEPPFVPPPGYMMYTVLPDGSPVPQGMALYAPPPPLPNNSRPLTPGTVVYGPPPAGAPMVYGPPPPNFSIPFIPMGVLHCNVPEHHNLENEVSRLEDIMQHLKSKKREERWMRASKRQSEKEMEELHHNIDDLLQEKKSLECEVEELHRTVQKRQQQKDFIDGNVESLMTELEIEKSLKHHEDIVDEIECIEKTLLKRRSELREADRLLAEAESELSCTKEKTKNAVEKFTDAKRSLLQTESDAEELERRAQETAVNLVKADQQLRSLQADAKDLEQHKIKQEEILKEINKIVAAKDSDFQCLSKKKEKLTEELQKLQKDIEMAERNEDHHLQVLKESEVLLQAKRAELEKLKSQVTSQQQEMAVLDRQLGHKKEELHLLQGSMVQAKADLQEALRLGETEVTEKCNHIREVKSLLEELSFQKGELNVQISERKTQLTLIKQEIEKEEENLQVVLRQMSKHKTAFLQ

SEQ ID NO: 890162 - protein, 1809 aa, Homo sapiens
MKAQKSGKEQQLDIMNKQYQQLESRLDEILSRIAKETEEIKDLEEQLTEGQIAANEALKKDLEGVISGLQEYLGTIKGQATQAQNECRKLRDEKETLLQRLTEVEQERDQLEIVAMDAENMRKELAELESALQEQHEVNASLQQTQGDLSAYEAELEARLNLRDAEANQLKEELEKVTRLTQLEQSALQAELEKERQALKNALGKAQFSEEKEQENSELHAKLKHLQDDNNLLKQQLKDFQNHLNHVVDGLVRPEEVAARVDELRRKLKLGTGEMNIHSPSDVLGKSLADLQKQFSEILARSKWERDEAQVRERKLQEEMALQQEKLATGQEEFRQACERALEARMNFDKRQHEARIQQMENEIHYLQENLKSMEEIQGLTDLQLQEADEEKERILAQLRELEKKKKLEDAKSQEQVFGLDKELKKLKKAVATSDKLATAELTIAKDQLKSLHGTVMKINQERAEELQEAERFSRKAAQAARDLTRAEAEIELLQNLLRQKGEQFRLEMEKTGVGTGANSQVLEIEKLNETMERQRTEIARLQNVLDLTGSDNKGGFENVLEEIAELRREVSYQNDYISSMADPFKRRGYWYFMPPPPSSKVSSHSSQATKDSGVGLKYSASTPVRKPRPGQQDGKEGSQPPPASGYWVYSPIRSGLHKLFPSRDADSGGDSQEESELDDQEEPPFVPPPGYMMYTVLPDGSPVPQGMALYAPPPPLPNNSRPLTPGTVVYGPPPAGAPMVYGPPPPNFSIPFIPMGVLHCNVPEHHNLENEVSRLEDIMQHLKSKKREERWMRASKRQSEKEMEELHHNIDDLLQEKKSLECEVEELHRTVQKRQQQKDFIDGNVESLMTELEIEKSLKHHEDIVDEIECIEKTLLKRRSELREADRLLAEAESELSCTKEKTKNAVEKFTDAKRSLLQTESDAEELERRAQETAVNLVKADQQLRSLQADAKDLEQHKIKQEEILKEINKIVAAKDSDFQCLSKKKEKLTEEYSKASVGLQGFVLEDSSGVPSPLGSALVLLVLCRLQKLQKDIEMAERNEDHHLQVLKESEVLLQAKRAELEKLKSQVTSQQQEMAVLDRQLGHKKEELHLLQGSMVQAKADLQEALRLGETEVTEKCNHIREVKSLLEELSFQKGELNVQISERKTQLTLIKQEIEKEEENLQVVLRQMSKHKTELKNILDMLQLENHELQGLKLQHDQRVSELEKTQVAVLEEKLELENLQQISQQQKGEIEWQKQLLERDKREIERMTAESRALQSCVECLSKEKEDLQEKCDIWEKKLAQTKRVLAAAEENSKMEQSNLEKLELNVRKLQQELDQLNRDKLSLHNDISAMQQQLQGKEKREAVNSLQEELANVQDHLNLAKQDLLHTTKHQDVLLSEQTRLQKDISEWANRFEDCQKEEETKQQQLQVLQNEIEENKLKLVQQEMMFQRLQKERESEESKLETSKVTLKEQQHQLEKELTDQKSKLDQVLSKVLAAEERVRTLQEEERWCESLEKTLSQTKRQLSEREQQLVEKSGELLALQKEADSMRADFSLLRNQFLTERKKAEKQVASLKEALKIQRSQLEKNLLEQKQENSCIQKEMATIELVAQDNHERARRLMKELNQMQYEYTELKKQMANQKDLERRQMEISDAMRTLKSEVKDEIRTSLKNLNQFLPELPADLEAILERNENLEGELESLKENLPFTMNEGPFEEKLNFSQVHIMDEHWRGEALREKLRHREDRLKAQLRHCMSKQAEVLIKGKRQTEGTLHSLRRQVDALGELVTSTSADSASSPSLSQLESSLTEDSQLGQNQEKNASAR

SEQ ID NO: 890163 - protein, 1732 aa, Homo sapiens
MKAQKSGKEQQLDIMNKQYQQLESRLDEILSRIAKETEEIKDLEEQLTEGQIAANEALKKDLEGVISGLQEYLGTIKGQATQAQNECRKLRDEKETLLQRLTEVEQERDQLEIVAMDAENMRKELAELESALQEQHEVNASLQQTQGDLSAYEAELEARLNLRDAEANQLKEELEKVTRLTQLEQSALQAELEKERQALKNALGKAQFSEEKEQENSELHAKLKHLQDDNNLLKQQLKDFQNHLNHVVDGLVRPEEVAARVDELRRKLKLGTGEMNIHSPSDVLGKSLADLQKQFSEILARSKWERDEAQVRERKLQEEMALQQEKLATGQEEFRQACERALEARMNFDKRQHEARIQQMENEIHYLQENLKSMEEIQGLTDLQLQEADEEKERILAQLRELEKKKKLEDAKSQEQVFGLDKELKKLKKAVATSDKLATAELTIAKDQLKSLHGTVMKINQERAEELQEAERFSRKAAQAARDLTRAEAEIELLQNLLRQKGEQFRLEMEKTGVGTGANSQVLEIEKLNETMERQRTEIARLQNVLDLTGSDNKGGFENVLEEIAELRREVSYQNDYISSMADPFKRRGYWYFMPPPPSSKVSSHSSQATKDSGVGLKYSASTPVRKPRPGQQDGKEGSQPPPASGYWVYSPIRSGLHKLFPSRDADSGGDSQEESELDDQEEPPFVPPPGYMMYTVLPDGSPVPQGMALYAPPPPLPNNSRPLTPGTVVYGPPPAGAPMVYGPPPPNFSIPFIPMGVLHCNVPEHHNLENEVSRLEDIMQHLKSKKREERWMRASKRQSEKEMEELHHNIDDLLQEKKSLECEVEELHRTVQKRQQQKDFIDGNVESLMTELEIEKSLKHHEDIVDEIECIEKTLLKRRSELREADRLLAEAESELSCTKEKTKNAVEKFTDAKRSLLQTESDAEELERRAQETAVNLVKADQQLRSLQADAKDLEQHKIKQEEILKEINKIVAAKDSDFQCLSKKKEKLTEELQKLQKDIEMAERNEDHHLQVLKESEVLLQAKADLQEALRLGETEVTEKCNHIREVKSLLEELSFQKGELNVQISERKTQLTLIKQEIEKEEENLQVVLRQMSKHKTELKNILDMLQLENHELQGLKLQHDQRVSELEKTQVAVLEEKLELENLQQISQQQKGEIEWQKQLLERDKREIERMTAESRALQSCVECLSKEKEDLQEKCDIWEKKLAQTKRVLAAAEENSKMEQSNLEKLELNVRKLQQELDQLNRDKLSLHNDISAMQQQLQGKEKREAVNSLQEELANVQDHLNLAKQDLLHTTKHQDVLLSEQTRLQKDISEWANRFEDCQKEEETKQQQLQVLQNEIEENKLKLVQQEMMFQRLQKERESEESKLETSKVTLKEQQHQLEKELTDQKSKLDQVLSKVLAAEERVRTLQEEERWCESLEKTLSQTKRQLSEREQQLVEKSGELLALQKEADSMRADFSLLRNQFLTERKKAEKQVASLKEALKIQRSQLEKNLLEQKQENSCIQKEMATIELVAQDNHERARRLMKELNQMQYEYTELKKQMANQKDLERRQMEISDAMRTLKSEVKDEIRTSLKNLNQFLPELPADLEAILERNENLEGELESLKENLPFTMNEGPFEEKLNFSQVHIMDEHWRGEALREKLRHREDRLKAQLRHCMSKQAEVLIKGKRQTEGTLHSLRRQVDALGELVTSTSADSASSPSLSQLESSLTEDSQLGQNQEKNASAR

SEQ ID NO: 890164 - protein, 1706 aa, Homo sapiens
MKAQKSGKEQQLDIMNKQYQQLESRLDEILSRIAKETEEIKDLEEQLTEGQIAANEALKKDLEGVISGLQEYLGTIKGQATQAQNECRKLRDEKETLLQRLTEVEQERDQLEIVAMDAENMRKELAELESALQEQHEVNASLQQTQGDLSAYEAELEARLNLRDAEANQLKEELEKVTRLTQLEQSALQAELEKERQALKNALGKAQFSEEKEQENSELHAKLKHLQDDNNLLKQQLKDFQNHLNHVVDGLVRPEEVAARVDELRRKLKLGTGEDEMNFDKRQHEARIQQMENEIHYLQENLKSMEEIQGLTDLQLQEADEEKERILAQLRELEKKKKLEDAKSQEQVFGLDKELKKLKKAVATSDKLATAELTIAKDQLKSLHGTVMKINQERAEELQEAERFSRKAAQAARDLTRAEAEIELLQNLLRQKGEQFRLEMEKTGVGTGANSQVLEIEKLNETMERQRTEIARLQNVLDLTGSDNKGGFENVLEEIAELRREVSYQNDYISSMADPFKRRGYWYFMPPPPSSKVSSHSSQATKDSGVGLKYSASTPVRKPRPGQQDGKEGSQPPPASGYWVYSPIRSGLHKLFPSRDADSGGDSQEESELDDQEEPPFVPPPGYMMYTVLPDGSPVPQGMALYAPPPPLPNNSRPLTPGTVVYGPPPAGAPMVYGPPPPNFSIPFIPMGVLHCNVPEHHNLENEVSRLEDIMQHLKSKKREERWMRASKRQSEKEMEELHHNIDDLLQEKKSLECEVEELHRTVQKRQQQKDFIDGNVESLMTELEIEKSLKHHEDIVDEIECIEKTLLKRRSELREADRLLAEAESELSCTKEKTKNAVEKFTDAKRSLLQTESDAEELERRAQETAVNLVKADQQLRSLQADAKDLEQHKIKQEEILKEINKIVAAKDSDFQCLSKKKEKLTEELQKLQKDIEMAERNEDHHLQVLKESEVLLQAKRAELEKLKSQVTSQQQEMAVLDRQLGHKKEELHLLQGSMVQAKADLQEALRLGETEVTEKCNHIREVKSLLEELSFQKGELNVQISERKTQLTLIKQEIEKEEENLQVVLRQMSKHKTELKNILDMLQLENHELQGLKLQHDQRVSELEKTQVAVLEEKLELENLQQISQQQKGEIEWQKQLLERDKREIERMTAESRALQSCVECLSKEKEDLQEKCDIWEKKLAQTKRVLAAAEENSKMEQSNLEKLELNVRKLQQELDQLNRDKLSLHNDISAMQQQLQGKEKREAVNSLQEELANVQDHLNLAKQDLLHTTKHQDVLLSEQTRLQKDISEWANRFEDCQKEEETKQQQLQVLQNEIEENKLKLVQQEMMFQRLQKERESEESKLETSKVTLKEQQHQLEKELTDQKSKLDQVLSKVLAAEERVRTLQEEERWCESLEKTLSQTKRQLSEREQQLVEKSGELLALQKEADSMRADFSLLRNQFLTERKKAEKQVASLKEALKIQRSQLEKNLLEQKQENSCIQKEMATIELVAQDNHERARRLMKELNQMQYEYTELKKQMANQKDLERRQMEISDAMRTLKSEVKDEIRTSLKNLNQFLPELPADLEAILERNENLEGELESLKENLPFTMNEGPFEEKLNFSQVHIMDEHWRGEALREKLRHREDRLKAQLRHCMSKQAEVLIKGKRQTEGTLHSLRRQVDALGELVTSTSADSASSPSLSQLESSLTEDSQLGQNQEKNASAR

SEQ ID NO: 890165 - protein, 1430 aa, Homo sapiens
MNFDKRQHEARIQQMENEIHYLQENLKSMEEIQGLTDLQLQEADEEKERILAQLRELEKKKKLEDAKSQEQVFGLDKELKKLKKAVATSDKLATAELTIAKDQLKSLHGTVMKINQERAEELQEAERFSRKAAQAARDLTRAEAEIELLQNLLRQKGEQFRLEMEKTGVGTGANSQVLEIEKLNETMERQRTEIARLQNVLDLTGSDNKGGFENVLEEIAELRREVSYQNDYISSMADPFKRRGYWYFMPPPPSSKVSSHSSQATKDSGVGLKYSASTPVRKPRPGQQDGKEGSQPPPASGYWVYSPIRSGLHKLFPSRDADSGGDSQEESELDDQEEPPFVPPPGYMMYTVLPDGSPVPQGMALYAPPPPLPNNSRPLTPGTVVYGPPPAGAPMVYGPPPPNFSIPFIPMGVLHCNVPEHHNLENEVSRLEDIMQHLKSKKREERWMRASKRQSEKEMEELHHNIDDLLQEKKSLECEVEELHRTVQKRQQQKDFIDGNVESLMTELEIEKSLKHHEDIVDEIECIEKTLLKRRSELREADRLLAEAESELSCTKEKTKNAVEKFTDAKRSLLQTESDAEELERRAQETAVNLVKADQQLRSLQADAKDLEQHKIKQEEILKEINKIVAAKDSDFQCLSKKKEKLTEELQKLQKDIEMAERNEDHHLQVLKESEVLLQAKRAELEKLKSQVTSQQQEMAVLDRQLGHKKEELHLLQGSMVQAKADLQEALRLGETEVTEKCNHIREVKSLLEELSFQKGELNVQISERKTQLTLIKQEIEKEEENLQVVLRQMSKHKTELKNILDMLQLENHELQGLKLQHDQRVSELEKTQVAVLEEKLELENLQQISQQQKGEIEWQKQLLERDKREIERMTAESRALQSCVECLSKEKEDLQEKCDIWEKKLAQTKRVLAAAEENSKMEQSNLEKLELNVRKLQQELDQLNRDKLSLHNDISAMQQQLQGKEKREAVNSLQEELANVQDHLNLAKQDLLHTTKHQDVLLSEQTRLQKDISEWANRFEDCQKEEETKQQQLQVLQNEIEENKLKLVQQEMMFQRLQKERESEESKLETSKVTLKEQQHQLEKELTDQKSKLDQVLSKVLAAEERVRTLQEEERWCESLEKTLSQTKRQLSEREQQLVEKSGELLALQKEADSMRADFSLLRNQFLTERKKAEKQVASLKEALKIQRSQLEKNLLEQKQENSCIQKEMATIELVAQDNHERARRLMKELNQMQYEYTELKKQMANQKDLERRQMEISDAMRTLKSEVKDEIRTSLKNLNQFLPELPADLEAILERNENLEGELESLKENLPFTMNEGPFEEKLNFSQVHIMDEHWRGEALREKLRHREDRLKAQLRHCMSKQAEVLIKGKRQTEGTLHSLRRQVDALGELVTSTSADSASSPSLSQLESSLTEDSQLGQNQEKNASAR

SEQ ID NO: 890166 - protein, 845 aa, Homo sapiens
MHGKSTGPGGNKAMCFRSLQADAKDLEQHKIKQEEILKEINKIVAAKDSDFQCLSKKKEKLTEELQKLQKDIEMAERNEDHHLQVLKESEVLLQAKRAELEKLKSQVTSQQQEMAVLDRQLGHKKEELHLLQGSMVQAKADLQEALRLGETEVTEKCNHIREVKSLLEELSFQKGELNVQISERKTQLTLIKQEIEKEEENLQVVLRQMSKHKTELKNILDMLQLENHELQGLKLQHDQRVSELEKTQVAVLEEKLELENLQQISQQQKGEIEWQKQLLERDKREIERMTAESRALQSCVECLSKEKEDLQEKCDIWEKKLAQTKRVLAAAEENSKMEQSNLEKLELNVRKLQQELDQLNRDKLSLHNDISAMQQQLQGKEKREAVNSLQEELANVQDHLNLAKQDLLHTTKHQDVLLSEQTRLQKDISEWANRFEDCQKEEETKQQQLQVLQNEIEENKLKLVQQEMMFQRLQKERESEESKLETSKVTLKEQQHQLEKELTDQKSKLDQVLSKVLAAEERVRTLQEEERWCESLEKTLSQTKRQLSEREQQLVEKSGELLALQKEADSMRADFSLLRNQFLTERKKAEKQVASLKEALKIQRSQLEKNLLEQKQENSCIQKEMATIELVAQDNHERARRLMKELNQMQYEYTELKKQMANQKDLERRQMEISDAMRTLKSEVKDEIRTSLKNLNQFLPELPADLEAILERNENLEGELESLKENLPFTMNEGPFEEKLNFSQVHIMDEHWRGEALREKLRHREDRLKAQLRHCMSKQAEVLIKGKRQTEGTLHSLRRQVDALGELVTSTSADSASSPSLSQLESSLTEDSQLGQNQEKNASAR

SEQ ID NO: 890167 - protein, 753 aa, Homo sapiens
MAFVKLTLPFSLIQVTSQQQEMAVLDRQLGHKKEELHLLQGSMVQAKADLQEALRLGETEVTEKCNHIREVKSLLEELSFQKGELNVQISERKTQLTLIKQEIEKEEENLQVVLRQMSKHKTELKNILDMLQLENHELQGLKLQHDQRVSELEKTQVAVLEEKLELENLQQISQQQKGEIEWQKQLLERDKREIERMTAESRALQSCVECLSKEKEDLQEKCDIWEKKLAQTKRVLAAAEENSKMEQSNLEKLELNVRKLQQELDQLNRDKLSLHNDISAMQQQLQGKEKREAVNSLQEELANVQDHLNLAKQDLLHTTKHQDVLLSEQTRLQKDISEWANRFEDCQKEEETKQQQLQVLQNEIEENKLKLVQQEMMFQRLQKERESEESKLETSKVTLKEQQHQLEKELTDQKSKLDQVLSKVLAAEERVRTLQEEERWCESLEKTLSQTKRQLSEREQQLVEKSGELLALQKEADSMRADFSLLRNQFLTERKKAEKQVASLKEALKIQRSQLEKNLLEQKQENSCIQKEMATIELVAQDNHERARRLMKELNQMQYEYTELKKQMANQKDLERRQMEISDAMRTLKSEVKDEIRTSLKNLNQFLPELPADLEAILERNENLEGELESLKENLPFTMNEGPFEEKLNFSQVHIMDEHWRGEALREKLRHREDRLKAQLRHCMSKQAEVLIKGKRQTEGTLHSLRRQVDALGELVTSTSADSASSPSLSQLESSLTEDSQLGQNQEKNASAR

SEQ ID NO: 890168 - protein, 772 aa, Homo sapiens
MAERNEDHHLQVLKESEVLLQAKRAELEKLKSQVTSQQQEMAVLDRQLGHKKEELHLLQGSMVQAKADLQEALRLGETEVTEKCNHIREVKSLLEELSFQKGELNVQISERKTQLTLIKQEIEKEEENLQVVLRQMSKHKTELKNILDMLQLENHELQGLKLQHDQRVSELEKTQVAVLEEKLELENLQQISQQQKGEIEWQKQLLERDKREIERMTAESRALQSCVECLSKEKEDLQEKCDIWEKKLAQTKRVLAAAEENSKMEQSNLEKLELNVRKLQQELDQLNRDKLSLHNDISAMQQQLQGKEKREAVNSLQEELANVQDHLNLAKQDLLHTTKHQDVLLSEQTRLQKDISEWANRFEDCQKEEETKQQQLQVLQNEIEENKLKLVQQEMMFQRLQKERESEESKLETSKVTLKEQQHQLEKELTDQKSKLDQVLSKVLAAEERVRTLQEEERWCESLEKTLSQTKRQLSEREQQLVEKSGELLALQKEADSMRADFSLLRNQFLTERKKAEKQVASLKEALKIQRSQLEKNLLEQKQENSCIQKEMATIELVAQDNHERARRLMKELNQMQYEYTELKKQMANQKDLERRQMEISDAMRTLKSEVKDEIRTSLKNLNQFLPELPADLEAILERNENLEGELESLKENLPFTMNEGPFEEKLNFSQVHIMDEHWRGEALREKLRHREDRLKAQLRHCMSKQAEVLIKGKRQTEGTLHSLRRQVDALGELVTSTSADSASSPSLSQLESSLTEDSQLGQNQEKNASAR

SEQ ID NO: 890169 - protein, 732 aa, Homo sapiens
MAVLDRQLGHKKEELHLLQGSMVQAKADLQEALRLGETEVTEKCNHIREVKSLLEELSFQKGELNVQISERKTQLTLIKQEIEKEEENLQVVLRQMSKHKTELKNILDMLQLENHELQGLKLQHDQRVSELEKTQVAVLEEKLELENLQQISQQQKGEIEWQKQLLERDKREIERMTAESRALQSCVECLSKEKEDLQEKCDIWEKKLAQTKRVLAAAEENSKMEQSNLEKLELNVRKLQQELDQLNRDKLSLHNDISAMQQQLQGKEKREAVNSLQEELANVQDHLNLAKQDLLHTTKHQDVLLSEQTRLQKDISEWANRFEDCQKEEETKQQQLQVLQNEIEENKLKLVQQEMMFQRLQKERESEESKLETSKVTLKEQQHQLEKELTDQKSKLDQVLSKVLAAEERVRTLQEEERWCESLEKTLSQTKRQLSEREQQLVEKSGELLALQKEADSMRADFSLLRNQFLTERKKAEKQVASLKEALKIQRSQLEKNLLEQKQENSCIQKEMATIELVAQDNHERARRLMKELNQMQYEYTELKKQMANQKDLERRQMEISDAMRTLKSEVKDEIRTSLKNLNQFLPELPADLEAILERNENLEGELESLKENLPFTMNEGPFEEKLNFSQVHIMDEHWRGEALREKLRHREDRLKAQLRHCMSKQAEVLIKGKRQTEGTLHSLRRQVDALGELVTSTSADSASSPSLSQLESSLTEDSQLGQNQEKNASAR

SEQ ID NO: 890170 - protein, 750 aa, Homo sapiens
MKAQKSGKEQQLDIMNKQYQQLESRLDEILSRIAKETEEIKDLEEQLTEGQIAANEALKKDLEGVISGLQEYLGTIKGQATQAQNECRKLRDEKETLLQRLTEVEQERDQLEIVAMDAENMRKELAELESALQEQHEVNASLQQTQGDLSAYEAELEARLNLRDAEANQLKEELEKVTRLTQLEQSALQAELEKERQALKNALGKAQFSEEKEQENSELHAKLKHLQDDNNLLKQQLKDFQNHLNHVVDGLVRPEEVAARVDELRRKLKLGTGEMNIHSPSDVLGKSLADLQKQFSEILARSKWERDEAQVRERKLQEEMALQQEKLATGQEEFRQACERALEARMNFDKRQHEARIQQMENEIHYLQENLKSMEEIQGLTDLQLQEADEEKERILAQLRELEKKELTDQKSKLDQVLSKVLAAEERVRTLQEEERWCESLEKTLSQTKRQLSEREQQLVEKSGELLALQKEADSMRADFSLLRNQFLTERKKAEKQVASLKEALKIQRSQLEKNLLEQKQENSCIQKEMATIELVAQDNHERARRLMKELNQMQYEYTELKKQMANQKDLERRQMEISDAMRTLKSEVKDEIRTSLKNLNQFLPELPADLEAILERNENLEGELESLKENLPFTMNEGPFEEKLNFSQVHIMDEHWRGEALREKLRHREDRLKAQLRHCMSKQAEVLIKGKRQTEGTLHSLRRQVDALGELVTSTSADSASSPSLSQLESSLTEDSQLGQNQEKNASAR

SEQ ID NO: 890171 - protein, 557 aa, Homo sapiens
MTAESRALQSCVECLSKEKEDLQEKCDIWEKKLAQTKRVLAAAEENSKMEQSNLEKLELNVRKLQQELDQLNRDKLSLHNDISAMQQQLQGKEKREAVNSLQEELANVQDHLNLAKQDLLHTTKHQDVLLSEQTRLQKDISEWANRFEDCQKEEETKQQQLQVLQNEIEENKLKLVQQEMMFQRLQKERESEESKLETSKVTLKEQQHQLEKELTDQKSKLDQVLSKVLAAEERVRTLQEEERWCESLEKTLSQTKRQLSEREQQLVEKSGELLALQKEADSMRADFSLLRNQFLTERKKAEKQVASLKEALKIQRSQLEKNLLEQKQENSCIQKEMATIELVAQDNHERARRLMKELNQMQYEYTELKKQMANQKDLERRQMEISDAMRTLKSEVKDEIRTSLKNLNQFLPELPADLEAILERNENLEGELESLKENLPFTMNEGPFEEKLNFSQVHIMDEHWRGEALREKLRHREDRLKAQLRHCMSKQAEVLIKGKRQTEGTLHSLRRQVDALGELVTSTSADSASSPSLSQLESSLTEDSQLGQNQEKNASAR

SEQ ID NO: 890172 - protein, 794 aa, Homo sapiens
MKAQKSGKEQQLDIMNKQYQQLESRLDEILSRIAKETEEIKDLEEQLTEGQIAANEALKKDLEGVISGLQEYLGTIKGQATQAQNECRKLRDEKETLLQRLTEVEQERDQLEIVAMDAENMRKELAELESALQEQHEVNASLQQTQGDLSAYEAELEARLNLRDAEANQLKEELEKVTRLTQLEQSALQAELEKERQALKNALGKAQFSEEKEQENSELHAKLKHLQDDNNLLKQQLKDFQNHLNHVVDGLVRPEEVAARVDELRRKLKLGTGEMNIHSPSDVLGKSLADLQKQFSEILARSKWERDEAQVRERKLQEEMALQQEKLATGQEEFRQACERALEARMNFDKRQHEARIQQMENEIHYLQENLKSMEEIQGLTDLQLQEADEEKERILAQLRELEKKKKLEDAKSQEQVFGLDKELKKLKKAVATSDKLATAELTIAKDQLKSLHGTVMKINQERAEELQEAERFSRKAAQAARDLTRAEAEIELLQNLLRQKGEQFRLEMEKTGVGTGANSQVLEIEKLNETMERQRTEIARLQNVLDLTGSDNKGGFENVLEEIAELRREVSYQNDYISSMADPFKRRGYWYFMPPPPSSKVSSHSSQATKDSGVGLKYSASTPVRKPRPGQQDGKEGSQPPPASGYWVYSPIRSGLHKLFPSRDADSGGDSQEESELDDQEEPPFVPPPGYMMYTVLPDGSPVPQGMALYAPPPPLPNNSRPLTPGTVVYGPPPAGAPMVYGPPPPNFSIPFIPMGVLHCNVPEHHNLVSGKTYNSLSTLLPWVTDKVIYLMS

SEQ ID NO: 890173 - protein, 508 aa, Homo sapiens
MKAQKSGKEQQLDIMNKQYQQLESRLDEILSRIAKETEEIKDLEEQLTEGQIAANEALKKDLEGVISGLQEYLGTIKGQATQAQNECRKLRDEKETLLQRLTEVEQERDQLEIVAMDAENMRKELAELESALQEQHEVNASLQQTQGDLSAYEAELEARLNLRDAEANQLKEELEKVTRLTQLEQSALQAELEKERQALKNALGKAQFSEEKEQENSELHAKLKHLQDDNNLLKQQLKDFQNHLNHVVDGLVRPEEVAARVDELRRKLKLGTGEMNIHSPSDVLGKSLADLQKQFSEILARSKWERDEAQVRERKLQEEMALQQEKLATGQEEFRQACERALEARMNFDKRQHEARIQQMENEIHYLQENLKSMEEIQGLTDLQLQEADEEKERILAQLRELEKKKKLEDAKSQEQVFGLDKELKKLKKAVATSDKLATAELTIAKDQLKSLHGTVMKINQERAEVSSHVQNRFPSMMLLSKNMATCIIDLAIDIGYFINHCKVVCFS

SEQ ID NO: 890174 - protein, 409 aa, Homo sapiens
MKAQKSGKEQQLDIMNKQYQQLESRLDEILSRIAKETEEIKDLEEQLTEGQIAANEALKKDLEGVISGLQEYLGTIKGQATQAQNECRKLRDEKETLLQRLTEVEQERDQLEIVAMDAENMRKELAELESALQEQHEVNASLQQTQGDLSAYEAELEARLNLRDAEANQLKEELEKVTRLTQLEQSALQAELEKERQALKNALGKAQFSEEKEQENSELHAKLKHLQDDNNLLKQQLKDFQNHLNHVVDGLVRPEEVAARVDELRRKLKLGTGEMNIHSPSDVLGKSLADLQKQFSEILARSKWERDEAQVRERKLQEEMALQQEKLATGQEEFRQACERALEARMNFDKRQHEARIQQMENEIHYLQENLKSMEEIQGLTDLQLQEADEEKERILAQLRELEKKVGET

SEQ ID NO: 890175 - protein, 386 aa, Homo sapiens
MEELDALLEELERSTLQDSDEYSNPAPLPLDQHSRKETNLDETSEILSIQDNTSPLPAQLVYTTNIQELNVYSEAQEPKESPPPSKTSAAAQLDELMAHLTEMQAKVAVRADAGKKHLPDKQDHKASLDSMLGGLEQELQDLGIATVPKGHCASCQKPIAGKVIHALGQSWHPEHFVCTHCKEEIGSSPFFERSGLAYCPNDYHQLFSPRCAYCAAPILDKVLTAMNQTWHPEHFFCSHCGEVFGAEGFHEKDKKPYCRKDFLAMFSPKCGGCNRPVLENYLSAMDTVWHPECFVCGDCFTSFSTGSFFELDGRPFCELHYHHRRGTLCHGCGQPITGRCISAMGYKFHPEHFVCAFCLTQLSKGIFREQNDKTYCQPCFNKLFPL

SEQ ID NO: 890176 - protein, 391 aa, Homo sapiens
MSTLLISSSDALLEELERSTLQDSDEYSNPAPLPLDQHSRKETNLDETSEILSIQDNTSPLPAQLVYTTNIQELNVYSEAQEPKESPPPSKTSAAAQLDELMAHLTEMQAKVAVRADAGKKHLPDKQDHKASLDSMLGGLEQELQDLGIATVPKGHCASCQKPIAGKVIHALGQSWHPEHFVCTHCKEEIGSSPFFERSGLAYCPNDYHQLFSPRCAYCAAPILDKVLTAMNQTWHPEHFFCSHCGEVFGAEGFHEKDKKPYCRKDFLAMFSPKCGGCNRPVLENYLSAMDTVWHPECFVCGDCFTSFSTGSFFELDGRPFCELHYHHRRGTLCHGCGQPITGRCISAMGYKFHPEHFVCAFCLTQLSKGIFREQNDKTYCQPCFNKLFPL

SEQ ID NO: 890177 - protein, 152 aa, Homo sapiens
TRYRSICLSVLQAGNLVSICQEPEGNSCSWQVTVRNFKAENFTLLTFYLLTFAFFFSLFSLPQDCFTSFSTGSFFELDGRPFCELHYHHRRGTLCHGCGQPITGRCISAMGYKFHPEHFVCAFCLTQLSKGIFREQNDKTYCQPCFNKLFPL

SEQ ID NO: 890178 - protein, 366 aa, Homo sapiens
MPYWRNWNAPPFRTVMNIPTQLLFPWISIPERRLTLMRLRRSFLFRITQVPCREAQEPKESPPPSKTSAAAQLDELMAHLTEMQAKVAVRADAGKKHLPDKQDHKASLDSMLGGLEQELQDLGIATVPKGHCASCQKPIAGKVIHALGQSWHPEHFVCTHCKEEIGSSPFFERSGLAYCPNDYHQLFSPRCAYCAAPILDKVLTAMNQTWHPEHFFCSHCGEVFGAEGFHEKDKKPYCRKDFLAMFSPKCGGCNRPVLENYLSAMDTVWHPECFVCGDCFTSFSTGSFFELDGRPFCELHYHHRRGTLCHGCGQPITGRCISAMGYKFHPEHFVCAFCLTQLSKGIFREQNDKTYCQPCFNKLFPL

SEQ ID NO: 890179 - protein, 256 aa, Homo sapiens
MLGGLEQELQDLGIATVPKGHCASCQKPIAGKVIHALGQSWHPEHFVCTHCKEEIGSSPFFERSGLAYCPNDYHQLFSPRCAYCAAPILDKVLTAMNQTWHPEHFFCSHCGEVFGAEGFHEKDKKPYCRKDFLAMFSPKCGGCNRPVLENYLSAMDTVWHPECFVCGDCFTSFSTGSFFELDGRPFCELHYHHRRGTLCHGCGQPITGRCISAMGYKFHPEHFVCAFCLTQLSKGIFREQNDKTYCQPCFNKLFPL

SEQ ID NO: 890180 - protein, 858 aa, Homo sapiens
SPLPKPEPELEEAPRCQDLPGSAPAPAGTMDSEAFQSARDFLDMNFQSLAMKHMDLKQMELDTAAAKVDELTKQLESLWSDSPAPPGPQAGPPSRPPRYSSSSIPEPFGSRGSPPEGGHRRRRHPVRTIRECPNPTPLQPAVPQGTAVVAAHPALPAAGRLRQPGPRDLAPAPRLRWRRQLPRPCALPADPGQARCRQQGPPTPFDFLGRAGSPRGSPLAEGPQAFFPERGPSPRPPATAYDAPASAFGSSLLGSGGSAFAPPLRAQDDLTLRRRPPKAWNESDLDVAYEKKPSQTASYERLDVFARPASPSLQLLPWRESSLDGLGGTGKDNLTSATLPRNYKVSPLASDRRSDAGSYRRSLGSAGPSGTLPRSWQPVSRIPMPPSSPQPRGAPRQRPIPLSMIFKLQNAFWEHGASRAMLPGSPLFTRAPPPKLQPQPQPQPQPQSQPQPQLPPQPQTQPQTPTPAPQHPQQTWPPVNEGPPKPPTELEPEPEIEGLLTPVLEAGDVDEGPVARPLSPTRLQPALPPEAQSVPELEEVARVLAEIPRPLKRRGSMEQAPAVALPPTHKKQYQQIISRLFHRHGGPGPGGPEPELSPITEGSEARAGPPAPAPPAPIPPPAPSQSSPPEQPQSMEMRSVLRKAGSPRKARRARLNPLVLLLDAALTGELEVVQQAVKEMNDPSQPNEEGITALHNAICGANYSIVDFLITAGANVNSPDSHGWTPLHCAASCNDTVICMALVQHGAAIFATTLSDGATAFEKCDPYREGYADCATYLADVEQSMGLMNSGAVYALWDYSAEFGDELSFREGESVTVLRRDGPEETDWWWAALHGQEGYVPRNYFGLFPRVKPQRSKV

SEQ ID NO: 890181 - protein, 403 aa, Homo sapiens
MPWKLWRGSVGCLPGDLSSDGLLFRLGPPKPPTELEPEPEIEGLLTPVLEAGDVDEGPVARPLSPTRLQPALPPEAQSVPELEEVARVLAEIPRPLKRRGSMEQAPAVALPPTHKKQYQQIISRLFHRHGGPGPGGPEPELSPITEGSEARAGPPAPAPPAPIPPPAPSQSSPPEQPQSMEMRSVLRKAGSPRKARRARLNPLVLLLDAALTGELEVVQQAVKEMNDPSQPNEEGITALHNAICGANYSIVDFLITAGANVNSPDSHGWTPLHCAASCNDTVICMALVQHGAAIFATTLSDGATAFEKCDPYREGYADCATYLADVEQSMGLMNSGAVYALWDYSAEFGDELSFREGESVTVLRRDGPEETDWWWAALHGQEGYVPRNYFGLFPRVKPQRSKV

SEQ ID NO: 890182 - protein, 858 aa, Homo sapiens; identical to SEQ ID NO: 890180

SEQ ID NO: 890183 - protein, 189 aa, Homo sapiens
MDRHGQHEEGMNDPSQPNEEGITALHNAICGANYSIVDFLITAGANVNSPDSHGWTPLHCAASCNDTVICMALVQHGAAIFATTLSDGATAFEKCDPYREGYADCATYLADVEQSMGLMNSGAVYALWDYSAEFGDELSFREGESVTVLRRDGPEETDWWWAALHGQEGYVPRNYFGLFPRVKPQRSKV

SEQ ID NO: 890184 - protein, 57 aa, Homo sapiens
MDRARYLIFKNPEEFSHVDFTVNLNRSWKKDFKHSPVLWNKYTFFWTYTLSVSMYHN

SEQ ID NO: 890185 - protein, 92 aa, Homo sapiens
VGGNADLGECAAGLGLGQLPWEARCLLEGRWSVLLNHKGPAESWSLCGLASRVHLMLVDCSGWVPKVFKVVSSPTAQPVVSNVLPLQMCLDR

SEQ ID NO: 890186 - protein, 164 aa, Homo sapiens
RKEFVEAVRVRYVAFRYRTPRAVCLRLWSCRREVIMSGRGKQGGKVRAKAKSRSSRAGLQFPVGRVHRLLRKGNYAERVGAGAPVYLAAVLEYLTAEILELAGNAARDNKKTRIIPRHLQLAIRNDEELNKLLGKVTIAQGGVLPNIQAVLLPKKTESQKTKSK

SEQ ID NO: 890187 - protein, 164 aa, Homo sapiens; identical to SEQ ID NO: 890186

SEQ ID NO: 890188 - protein, 205 aa, Homo sapiens
RKEFVEAVRVRYVAFRYRTPRAVCLRLWSCRREVIMSGRGKQGGKVRAKAKSRSSRAGLQFPVGRVHRLLRKGNYAERVGAGAPVYLAAVLEYLTAEILELAGNAARDNKKTRIIPRHLQLAIRNDEELNKLLGKVTIAQGGVLPNIQAVLASLSCQFVSTQDQVLGRYRRIELSSGQEVSAAIFFKKWSNFPSWKGGSDGTMST

SEQ ID NO: 890189 - protein, 164 aa, Homo sapiens; identical to SEQ ID NO: 890186

SEQ ID NO: 890190 - protein, 164 aa, Homo sapiens; identical to SEQ ID NO: 890186

SEQ ID NO: 890191 - protein, 935 aa, Homo sapiens
NQFVSLGSMCFPEAVLLSDERNILSNVDDILAATAAACGVTPTDFSKSTSNETMQAVEDGDSKSHFQQSLDVRHVTSDFNSMTATVGKPQNINDTSLNGNQVTVNLSPVPALQSKMTLDQQHIETPGQNIPTKVTSAVVGPSHEVQEQSSGPFKKQSATNLESEEDSEAPVDSTLNNNRNQEFVSSSRSISGESATSESEFTLGGDDSGVSMNPARSALALLAMAQSGDAVSVKIEEENQDLMHFNLQKKRAKGKGQVKEEDNSNQKQLKRPAQGKRQNPRGTDIYLPYTPPSSESCHDGYQHQEKMRQKIKEVEEKQPEVKTGFIASFLDFLKSGPKQQFSTLAVRMPNRTRRPGTQMVRTFCPPPLPKPSSTTPTPLVSETGGNSPSDKVDNELKNLEHLSSFSSDEDDPGYSQDAYKSVSTPLTTLDATSDKKKKTEALQVATTSPTANTTGTATTSSTTVGAVKQEPLHSTSYAVNILENISSSESSKPIELDGLPSDQFAKGQDTVAIEGFTDEEDTESGGEGQYRERDEFVVKIEDIETFKEALKTGKEPPAIWKVQKALLQKFVPEIRDGQREFAATNSYLGYFGDAKSKYKRIYVKFIENANKKEYVRVCSKKPRNKPSQTIRTVQAKPSSSSKTSDPLASKTTTTKAPSVKPKVKQPKVKAEPPPKKRKKWKEEFSSSQSDSSPEIHTSSSDDEEFEPPAPFVTRFLNTRAMKETFKSYMELLVSIALDPDTMQALEKSNDELLLPHMKKIDGMLNDNRKRLLLNLHLDQSFKNALESFPELTIITRDSKAKSGGTAISKIKMNGKAYNKKTLRTSKTTTKSAQEFAVDPEKIQLYSLYHSLHHYKYHVYLICKDEVLSSHLLKKNVFQNVKETLAIVFWSVLKRVVKYMCVCILSMYSVNNDLIYCSESLCYVLCSDLPEPHHLL

SEQ ID NO: 890192 - protein, 911 aa, Homo sapiens
NQFVSLGSMCFPEAVLLSDERNILSNVDDILAATAAACGVTPTDFSKSTSNETMQAVEDGDSKSHFQQSLDVRHVTSDFNSMTATVGKPQNINDTSLNGNQVTVNLSPVPALQSKMTLDQQHIETPGQNIPTKVTSAVVGPSHEVQEQSSGPFKKQSATNLESEEDSEAPVDSTLNNNRNQEFVSSSRSISGESATSESEFTLGGDDSGVSMNPARSALALLAMAQSGDAVSVKIEEENQDLMHFNLQKKRAKGKGQVKEEDNSNQKQLKRPAQGKRQNPRGTDIYLPYTPPSSESCHDGYQHQEKMRQKIKEVEEKQPEVKTGFIASFLDFLKSGPKQQFSTLAVRMPNRTRRPGTQMVRTFCPPPLPKPSSTTPTPLVSETGGNSPSDKVDNELKNLEHLSSFSSDEDDPGYSQDAYKSVSTPLTTLDATSDKKKKTEALQVATTSPTANTTGTATTSSTTVGAVKQEPLHSTSYAVNILENISSSESSKPIELDGLPSDQFAKGQDTVAIEGFTDEEDTESGGEGQYRERDEFVVKIEDIETFKEALKTGKEPPAIWKVQKALLQKFVPEIRDGQREFAATNSYLGYFGDAKSKYKRIYVKFIENANKKEYVRVCSKKPRNKPSQTIRTVQAKPSSSSKTSDPLASKTTTTKAPSVKPKVKQPKVKAEPPPKKRKKWKEEFSSSQSDSSPEIHTSSSDDEEFEPPAPFVTRFLNTRAMKETFKSYMELLVSIALDPDTMQALEKSNDELLLPHMKKIDGMLNDNRKRLLLNLHLDQSFKNALESFPELTIITRDSKAKSGGTAISKIKMNGKAYNKKTLRTSKTTTKSAQEFAVDPEKIQLYSLYHSLHHYKYHVYLICKDEISSVQKKNEDLGQEEIVQLCMKNVKWVEDLFEKFGELLNHVQQKCS

SEQ ID NO: 890193 - protein, 633 aa, Homo sapiens
MPETSHLIDLPTCELNKLEEIADLVTSVLSSPIRREKLALALENEGYIKKLLQLFQACENLENTEGLHHLYEIIRGILFLNKATLFEVMFSDECIMDVVGCLEYDPALAQPKRHREFLTKTAKFKEVIPITDSELRQKIHQTYRVQYIQDIILPTPSVFEENFLSTLTSFIFFNKVEIVSMLQEDEKFLSEVFAQLTDEATDDDKRRELVNFFKEFCAFSQTLQPQNRDAFFKTLAKLGILPALEIVMGMDDLQVRSAATDIFSYLVEFSPSMVREFVMQEAQQSDDDILLINVVIEQMICDTDPELGGAVQLMGLLRTLIDPENMLATTNKTEKSEFLNFFYNHCMHVLTAPLLTNTSEDKCEKDNIVGSNKNNTICPGALRFMRRIIGLKDEFYNRYITKGNLFEPVINALLDNGTRYNLLNSAVIELFEFIRVEDIKSLTAHIVENFYKALESIEYVQTFKGLKTKYEQEKDRQNQKLNSNRFRRDAKALEEDEEMWFNEDEEEEGKAVVAPVEKPKPEDDFPDNYEKFMETKKAKESEDKENLPKRTSPGGFKFTFSHSASAANGTNSKSVVAQIPPATSNGSSSKTTNLPTSVTATKGSLVGLVDYPDDEEEDEEEESSPRKRPRLGS

SEQ ID NO: 890194 - protein, 963 aa, Homo sapiens
MKKRKAERVGLQDGGSVVVTAAAGEQASPGGQRDGRVGVCAGEVRGNGASGRRGLSGSCHPFSRLNLWSHGEFGPLRSRRRRHRHYCLYRLLRVRSADEVSEEAAARAVETAATMSDTRRRVKVYTLNEDRQWDDRGTGHVSSTYVEELKGMSLLVRAESDGSLLLESKINPNTAYQKQQDTLIVWSEAENYDLALSFQEKAGCDEIWEKICQVQGKDPSVEVTQDLIDESEEERFEEMPETSHLIDLPTCELNKLEEIADLVTSVLSSPIRREKLALALENEGYIKKLLQLFQACENLENTEGLHHLYEIIRGILFLNKATLFEVMFSDECIMDVVGCLEYDPALAQPKRHREFLTKTAKFKEVIPITDSELRQKIHQTYRVQYIQDIILPTPSVFEENFLSTLTSFIFFNKVEIVSMLQEDEKFLSEVFAQLTDEATDDDKRRELVNFFKEFCAFSQTLQPQNRDAFFKTLAKLGILPALEIVMGMDDLQVRSAATDIFSYLVEFSPSMVREFVMQEAQQSDDDILLINVVIEQMICDTDPELGGAVQLMGLLRTLIDPENMLATTNKTEKSEFLNFFYNHCMHVLTAPLLTNTSEDKCEKDFFLKHYRYSWSFVCTPSHSHSHSTPSSSISQDNIVGSNKNNTICPDNYQTAQLLALILELLTFCVEHHTYHIKNYIMNKDLLRRVLVLMNSKHTFLALCALRFMRRIIGLKDEFYNRYITKGNLFEPVINALLDNGTRYNLLNSAVIELFEFIRVEDIKSLTAHIVENFYKALESIEYVQTFKGLKTKYEQEKDRQNQKLNSVPSILRSNRFRRDAKALEEDEEMWFNEDEEEEGKAVVAPVEKPKPEDDFPDNYEKFMETKKAKESEDKENLPKRTSPGGFKFTFSHSASAANGTNSKSVVAQIPPATSNGSSSKTTNLPTSVTATKGSLVGLVDYPDDEEEDEEEESSPRKRPRLGS

SEQ ID NO: 890195 - protein, 956 aa, Homo sapiens
MKKRKAERVGLQDGGSVVVTAAAGEQASPGGQRDGRVGVCAGEVRGNGASGRRGLSGSCHPFSRLNLWSHGEFGPLRSRRRRHRHYCLYRLLRVRSADEVSEEAAARAVETAATMSDTRRRVKVYTLNEDRQWDDRGTGHVSSTYVEELKGMSLLVRAESDGSLLLESKINPNTAYQKQQDTLIVWSEAENYDLALSFQEKAGCDEIWEKICQVQGKDPSVEVTQDLIDESEEERFEEMPETSHLIDLPTCELNKLEEIADLVTSVLSSPIRREKLALALENEGYIKKLLQLFQACENLENTEGLHHLYEIIRGILFLNKATLFEVMFSDECIMDVVGCLEYDPALAQPKRHREFLTKTAKFKEVIPITDSELRQKIHQTYRVQYIQDIILPTPSVFEENFLSTLTSFIFFNKVEIVSMLQEDEKFLSEVFAQLTDEATDDDKRRELVNFFKEFCAFSQTLQPQNRDAFFKTLAKLGILPALEIVMGMDDLQVRSAATDIFSYLVEFSPSMVREFVMQEAQQSDDDILLINVVIEQMICDTDPELGGAVQLMGLLRTLIDPENMLATTNKTEKSEFLNFFYNHCMHVLTAPLLTNTSEDKCEKDFFLKHYRYSWSFVCTPSHSHSHSTPSSSISQDNIVGSNKNNTICPDNYQTAQLLALILELLTFCVEHHTYHIKNYIMNKDLLRRVLVLMNSKHTFLALCALRFMRRIIGLKDEFYNRYITKGNLFEPVINALLDNGTRYNLLNSAVIELFEFIRVEDIKSLTAHIVENFYKALESIEYVQTFKGLKTKYEQEKDRQNQKLNSNRFRRDAKALEEDEEMWFNEDEEEEGKAVVAPVEKPKPEDDFPDNYEKFMETKKAKESEDKENLPKRTSPGGFKFTFSHSASAANGTNSKSVVAQIPPATSNGSSSKTTNLPTSVTATKGSLVGLVDYPDDEEEDEEEESSPRKRPRLGS

SEQ ID NO: 890196 - protein, 931 aa, Homo sapiens
MKKRKAERVGLQDGGSVVVTAAAGEQASPGGQRDGRVGVCAGEVRGNGASGRRGLSGSCHPFSRLNLWSHGEFGPLRSRRRRHRHYCLYRLLRVRSADEVSEEAAARAVETAATMSDTRRRVKVYTLNEDRQWDDRGTGHVSSTYVEELKGMSLLVRAESDGSLLLESKINPNTAYQKQQDTLIVWSEAENYDLALSFQEKAGCDEIWEKICQVQGKDPSVEVTQDLIDESEEERFEEMPETSHLIDLPTCELNKLEEIADLVTSVLSSPIRREKLALALENEGYIKKLLQLFQACENLENTEGLHHLYEIIRGILFLNKATLFEVMFSDECIMDVVGCLEYDPALAQPKRHREFLTKTAKFKEVIPITDSELRQKIHQTYRVQYIQDIILPTPSVFEENFLSTLTSFIFFNKVEIVSMLQEDEKFLSEVFAQLTDEATDDDKRRELVNFFKEFCAFSQTLQPQNRDAFFKTLAKLGILPALEIVMGMDDLQVRSAATDIFSYLVEFSPSMVREFVMQEAQQSDDDILLINVVIEQMICDTDPELGGAVQLMGLLRTLIDPENMLATTNKTEKSEFLNFFYNHCMHVLTAPLLTNTSEDKCEKDNIVGSNKNNTICPDNYQTAQLLALILELLTFCVEHHTYHIKNYIMNKDLLRRVLVLMNSKHTFLALCALRFMRRIIGLKDEFYNRYITKGNLFEPVINALLDNGTRYNLLNSAVIELFEFIRVEDIKSLTAHIVENFYKALESIEYVQTFKGLKTKYEQEKDRQNQKLNSVPSILRSNRFRRDAKALEEDEEMWFNEDEEEEGKAVVAPVEKPKPEDDFPDNYEKFMETKKAKESEDKENLPKRTSPGGFKFTFSHSASAANGTNSKSVVAQIPPATSNGSSSKTTNLPTSVTATKGSLVGLVDYPDDEEEDEEEESSPRKRPRLGS

SEQ ID NO: 890197 - protein, 977 aa, Homo sapiens
MAVSVVLNVSEDRSIRCSCVGTYHDDRLGCVVTACMQVEKSDTGGRYTRTLDYVHIKIAHHWYDPRMRSTVTGESYAKHDRCNSRLSSLKTLTPRALRHYCLYRLLRVRSADEVSEEAAARAVETAATMSDTRRRVKVYTLNEDRQWDDRGTGHVSSTYVEELKGMSLLVRAESDGSLLLESKINPNTAYQKQQDTLIVWSEAENYDLALSFQEKAGCDEIWEKICQVQGKDPSVEVTQDLIDESEEERFEEMPETSHLIDLPTCELNKLEEIADLVTSVLSSPIRREKLALALENEGYIKKLLQLFQACENLENTEGLHHLYEIIRGILFLNKATLFEVMFSDECIMDVVGCLEYDPALAQPKRHREFLTKTAKFKEVIPITDSELRQKIHQTYRVQYIQDIILPTPSVFEENFLSTLTSFIFFNKVEIVSMLQEDEKFLSEVFAQLTDEATDDDKRRELVNFFKEFCAFSQTLQPQNRDAFFKTLAKLGILPALEIVMGMDDLQVRSAATDIFSYLVEFSPSMVREFVMQEAQQSDDDILLINVVIEQMICDTDPELGGAVQLMGLLRTLIDPENMLATTNKTEKSEFLNFFYNHCMHVLTAPLLTNTSEDKCEKDFFLKHYRYSWSFVCTPSHSHSHSTPSSSISQDNIVGSNKNNTICPDNYQTAQLLALILELLTFCVEHHTYHIKNYIMNKDLLRRVLVLMNSKHTFLALCALRFMRRIIGLKDEFYNRYITKGNLFEPVINALLDNGTRYNLLNSAVIELFEFIRVEDIKSLTAHIVENFYKALESIEYVQTFKGLKTKYEQEKDRQNQKLNSVPSILRSNRFRRDAKALEEDEEMWFNEDEEEEGKAVVAPVEKPKPEDDFPDNYEKFMETKKAKESEDKENLPKRTSPGGFKFTFSHSASAANGTNSKSVVAQIPPATSNGSSSKTTNLPTSVTATKGSLVGLVDYPDDEEEDEEEESSPRKRPRLGS

SEQ ID NO: 890198 - protein, 723 aa, Homo sapiens
MKKRKAERVGLQDGGSVVVTAAAGEQASPGGQRDGRVGVCAGEVRGNGASGRRGLSGSCHPFSRLNLWSHGEFGPLRSRRRRHRHYCLYRLLRVRSADEVSEEAAARAVETAATMSDTRRRVKVYTLNEDRQWDDRGTGHVSSTYVEELKGMSLLVRAESDGSLLLESKINPNTAYQKQQDTLIVWSEAENYDLALSFQEKAGCDEIWEKICQEDEKFLSEVFAQLTDEATDDDKRRELVNFFKEFCAFSQTLQPQNRDAFFKTLAKLGILPALEIVMGMDDLQVRSAATDIFSYLVEFSPSMVREFVMQEAQQSDDDILLINVVIEQMICDTDPELGGAVQLMGLLRTLIDPENMLATTNKTEKSEFLNFFYNHCMHVLTAPLLTNTSEDKCEKDNIVGSNKNNTICPDNYQTAQLLALILELLTFCVEHHTYHIKNYIMNKDLLRRVLVLMNSKHTFLALCALRFMRRIIGLKDEFYNRYITKGNLFEPVINALLDNGTRYNLLNSAVIELFEFIRVEDIKSLTAHIVENFYKALESIEYVQTFKGLKTKYEQEKDRQNQKLNSVPSILRSNRFRRDAKALEEDEEMWFNEDEEEEGKAVVAPVEKPKPEDDFPDNYEKFMETKKAKESEDKENLPKRTSPGGFKFTFSHSASAANGTNSKSVVAQIPPATSNGSSSKTTNLPTSVTATKGSLVGLVDYPDDEEEDEEEESSPRKRPRLGS

SEQ ID NO: 890199 - protein, 512 aa, Homo sapiens
MQEDEKFLSEVFAQLTDEATDDDKRRELVNFFKEFCAFSQTLQPQNRDAFFKTLAKLGILPALEIVMGMDDLQVRSAATDIFSYLVEFSPSMVREFVMQEAQQSDDDILLINVVIEQMICDTDPELGGAVQLMGLLRTLIDPENMLATTNKTEKSEFLNFFYNHCMHVLTAPLLTNTSEDKCEKDNIVGSNKNNTICPDNYQTAQLLALILELLTFCVEHHTYHIKNYIMNKDLLRRVLVLMNSKHTFLALCALRFMRRIIGLKDEFYNRYITKGNLFEPVINALLDNGTRYNLLNSAVIELFEFIRVEDIKSLTAHIVENFYKALESIEYVQTFKGLKTKYEQEKDRQNQKLNSVPSILRSNRFRRDAKALEEDEEMWFNEDEEEEGKAVVAPVEKPKPEDDFPDNYEKFMETKKAKESEDKENLPKRTSPGGFKFTFSHSASAANGTNSKSVVAQIPPATSNGSSSKTTNLPTSVTATKGSLVGLVDYPDDEEEDEEEESSPRKRPRLGS

SEQ ID NO: 890200 - protein, 878 aa, Homo sapiens
MKKRKAERVGLQDGGSVVVTAAAGEQASPGGQRDGRVGVCAGEVRGNGASGRRGLSGSCHPFSRLNLWSHGEFGPLRSRRRRHRHYCLYRLLRVRSADEVSEEAAARAVETAATMSDTRRRVKVYTLNEDRQWDDRGTGHVSSTYVEELKGMSLLVRAESDGSLLLESKINPNTAYQKQQDTLIVWSEAENYDLALSFQEKAGCDEIWEKICQVQGKDPSVEVTQDLIDESEEERFEEMPETSHLIDLPTCELNKLEEIADLVTSVLSSPIRREKLALALENEGYIKKLLQLFQACENLENTEGLHHLYEIIRGILFLNKATLFEVMFSDECIMDVVGCLEYDPALAQPKRHREFLTKTAKFKEVIPITDSELRQKIHQTYRVQYIQDIILPTPSVFEENFLSTLTSFIFFNKVEIVSMLQEDEKFLSEVFAQLTDEATDDDKRRELVNFFKEFCAFSQTLQPQNRDAFFKTLAKLGILPALEIVMGMDDLQVRSAATDIFSYLVEFSPSMVREFVMQEAQQSDDDILLINVVIEQMICDTDPELGGAVQLMGLLRTLIDPENMLATTNKTEKSEFLNFFYNHCMHVLTAPLLTNTSEDKCEKDNIVGSNKNNTICPGALRFMRRIIGLKDEFYNRYITKGNLFEPVINALLDNGTRYNLLNSAVIELFEFIRVEDIKSLTAHIVENFYKALESIEYVQTFKGLKTKYEQEKDRQNQKLNSVPSILRSNRFRRDAKALEEDEEMWFNEDEEEEGKAVVAPVEKPKPEDDFPDNYEKFMETKKAKESEDKENLPKRTSPGGFKFTFSHSASAANGTNSKSVVAQIPPATSNGSSSKTTNLPTSVTATKGSLVGLVDYPDDEEEDEEEESSPRKRPRLGS

SEQ ID NO: 890201 - protein, 956 aa, Homo sapiens; identical to SEQ ID NO: 890195

SEQ ID NO: 890202 - protein, 204 aa, Homo sapiens
YVQTSKDLSVFFLLIFSSNAFECLNIFKGLKTKYEQEKDRQNQKLNSVPSILRSNRFRRDAKALEEDEEMWFNEDEEEEGKAVVAPVEKPKPEDDFPDNYEKFMETKKAKESEDKENLPKRTSPGGFKFTFSHSASAANGTNSKSVVAQIPPATSNGSSSKTTNLPTSVTATKGSLVGLVDYPDDEEEDEEEESSPRKRPRLGS

SEQ ID NO: 890203 - protein, 956 aa, Homo sapiens; identical to SEQ ID NO: 890195

SEQ ID NO: 890204 - protein, 956 aa, Homo sapiens; identical to SEQ ID NO: 890195

SEQ ID NO: 890205 - protein, 931 aa, Homo sapiens; identical to SEQ ID NO: 890196

SEQ ID NO: 890206 - protein, 864 aa, Homo sapiens
MKKRKAERVGLQDGGSVVVTAAAGEQASPGGQRDGRVGVCAGEVRGNGASGRRGLSGSCHPFSRLNLWSHGEFGPLRSRRRRHRHYCLYRLLRVRSADEVSEEAAARAVETAATMSDTRRRVKVYTLNEDRQWDDRGTGHVSSTYVEELKGMSLLVRAESDGSLLLESKINPNTAYQKQQDTLIVWSEAENYDLALSFQEKAGCDEIWEKICQVQGKDPSVEVTQDLIDESEEERFEEMPETSHLIDLPTCELNKLEEIADLVTSVLSSPIRREKLALALENEGYIKKLLQLFQACENLENTEGLHHLYEIIRGILFLNKATLFEVMFSDECIMDVVGCLEYDPALAQPKRHREFLTKTAKFKEVIPITDSELRQKIHQTYRVQYIQDIILPTPSVFEENFLSTLTSFIFFNKVEIVSMLQEDEKFLSEVFAQLTDEATDDDKRRELVNFFKEFCAFSQTLQPQNRDAFFKTLAKLGILPALEIVMGMDDLQVRSAATDIFSYLVEFSPSMVREFVMQEAQQSDDDILLINVVIEQMICDTDPELGGAVQLMGLLRTLIDPENMLATTNKTEKSEFLNFFYNHCMHVLTAPLLTNTSEDKCEKDFFLKHYRYSWSFVCTPSHSHSHSTPSSSISQDNIVGSNKNNTICPDNYQTAQLLALILELLTFCVEHHTYHIKNYIMNKDLLRRVLVLMNSKHTFLALCALRFMRRIIGLKDEFYNRYITKGNLFEPVINALLDNGTRYNLLNSAVIELFEFIRVEDIKSLTAHIVENFYKALESIEYVQTFKGLKTKYEQEKDRQNQKLNSVPSILRSNRFRRDAKALEEDEEMWFNEDEEEEGKSIFWLRFFHWCHNCFSFPLPATTH

SEQ ID NO: 890207 - protein, 676 aa, Homo sapiens
MKKRKAERVGLQDGGSVVVTAAAGEQASPGGQRDGRVGVCAGEVRGNGASGRRGLSGSCHPFSRLNLWSHGEFGPLRSRRRRHRHYCLYRLLRVRSADEVSEEAAARAVETAATMSDTRRRVKVYTLNEDRQWDDRGTGHVSSTYVEELKGMSLLVRAESDGSLLLESKINPNTAYQKQQDTLIVWSEAENYDLALSFQEKAGCDEIWEKICQVQGKDPSVEVTQDLIDESEEERFEEMPETSHLIDLPTCELNKLEEIADLVTSVLSSPIRREKLALALENEGYIKKLLQLFQACENLENTEGLHHLYEIIRGILFLNKATLFEVMFSDECIMDVVGCLEYDPALAQPKRHREFLTKTAKFKEVIPITDSELRQKIHQTYRVQYIQDIILPTPSVFEENFLSTLTSFIFFNKVEIVSMLQEDEKFLSEVFAQLTDEATDDDKRRELVNFFKEFCAFSQTLQPQNRDAFFKTLAKLGILPALEIVMGMDDLQVRSAATDIFSYLVEFSPSMVREFVMQEAQQSDDDILLINVVIEQMICDTDPELGGAVQLMGLLRTLIDPENMLATTNKTEKSEFLNFFYNHCMHVLTAPLLTNTSEDKCEKDNIVGSNKNNTICPDNYQTAQLLALILELLTFCVEHHTYHIKNYIMNKDLLRRVLVLMNSKHTFLALCKYKMF

SEQ ID NO: 890208 - protein, 188 aa, Homo sapiens
MKKRKAERVGLQDGGSVVVTAAAGEQASPGGQRDGRVGVCAGEVRGNGASGRRGLSGSCHPFSRLNLWSHGEFGPLRSRRRRHRHYCLYRLLRVRSADEVSEEAAARAVETAATMSDTRRRVKVYTLNEDRQWDDRGTGHVSSTYVEELKGMSLLVRAESDGSLLLESKINPNTAYQKQQASSCLSLI

SEQ ID NO: 890209 - protein, 218 aa, Homo sapiens
MKKRKAERVGLQDGGSVVVTAAAGEQASPGGQRDGRVGVCAGEVRGNGASGRRGLSGSCHPFSRLNLWSHGEFGPLRSRRRRHRHYCLYRLLRVRSADEVSEEAAARAVETAATMSDTRRRVKVYTLNEDRQWDDRGTGHVSSTYVEELKGMSLLVRAESDGSLLLESKINPNTAYQKQQDTLIVWSEAENYDLALSFQEKAGCDEIWEKICQVSFFL

SEQ ID NO: 890210 - protein, 221 aa, Homo sapiens
GATQVSAQRAYPGSTGATAPRRERAKFLGRAPSLPGCPPPPGAWVPGAVAAAASSGQAAGGGGGTGLRKRGHGAQRVGEGRTGRPGGRPLPPEDPRAGLGRGGAARAEAPQMSQACREGLAGPPSLPALRRPTPGGWRRGADASVRCPRILPELPSVRWVDAGLGDPRVERCEGASCFPHHLRRFEEALLRLGVWIGRQWELQGGTLEGLTLPRSSLPRKG

SEQ ID NO: 890211 - protein, 309 aa, Homo sapiens
MATELQCPDSMPCHNQQVNSASTPSPEQLRPGDLILDHAGGNRASRAKVILLTGYAHSSLPAELDSGACGGSSLNSEGNSGSGDSSSYDAPAGNSFLEDCELSRQIGAQLKLLPMNDQIRELQTIIRDKTASRGDFMFSADRLIRLVVEEGLNQLPYKECMVTTPTGYKYEGVKFEKGNCGVSIMRSGEAMEQGLRDCCRSIRIGKILIQSDEETQRAKVYYAKFPPDIYRRKVLLMYPILSTGNTVIEAVKVLIEHGVQPSVIILLSLFSTPHGAKSIIQEFPEITILTTEVHPVAPTHFGQKYFGTD

SEQ ID NO: 890212 - protein, 328 aa, Homo sapiens
MATELQCPDSMPCHNQQVNSASTPSPEQLRPGDLILDHAGGNRASRAKVILLTGYAHSSLPAELDSGACGGSSLNSEGNSGSGDSSSYDAPAGNSFLEDCELSRQIGAQLKLLPMNDQIRELQTIIRDKTASRGDFMFSADRLVLPEDLFQKSIDNSCSVFIIRLVVEEGLNQLPYKECMVTTPTGYKYEGVKFEKGNCGVSIMRSGEAMEQGLRDCCRSIRIGKILIQSDEETQRAKVYYAKFPPDIYRRKVLLMYPILSTGNTVIEAVKVLIEHGVQPSVIILLSLFSTPHGAKSIIQEFPEITILTTEVHPVAPTHFGQKYFGTD

SEQ ID NO: 890213 - protein, 198 aa, Homo sapiens
VKGLRDSVLGLGKLWRLGTASRGDFMFSADRLIRLVVEEGLNQLPYKECMVTTPTGYKYEGVKFEKGNCGVSIMRSGEAMEQGLRDCCRSIRIGKILIQSDEETQRAKVYYAKFPPDIYRRKVLLMYPILSTGNTVIEAVKVLIEHGVQPSVIILLSLFSTPHGAKSIIQEFPEITILTTEVHPVAPTHFGQKYFGTD

SEQ ID NO: 890214 - protein, 281 aa, Homo sapiens
MATELQCPDSMPCHNQQVNSASTPSPEQLRPGDLILDHAGGNRASRAKVILLTGYAHSSLPAELDSGACGGSSLNSEGNSGSGDSSSYDAPAGNSFLEDCELSRQIGAQLKLLPMNDQIRELQTIIRDKTASRGDFMFSADRLIRLVVEEGLNQLPYKECMVTTPTGYKYEGVKFEKGNCGVSIMRSGEAMEQGLRDCCRSIRIGKILIQSDEETQRAKVYYAKFPPDIYRRKVLLMYPILSTGNTVIEAVKVLIEHGVQPSVIILLSLFSTPHGEFSMRQ

SEQ ID NO: 890215 - protein, 149 aa, Homo sapiens
MATELQCPDSMPCHNQQVNSASTPSPEQLRPGDLILDHAGGNRASRAKVILLTGYAHSSLPAELDSGACGGSSLNSEGNSGSGDSSSYDAPAGNSFLEDCELSRQIGAQLKLLPMNDQIRELQTIIRDKTASRGDFMFSADRLGTSMKE

SEQ ID NO: 890216 - protein, 557 aa, Homo sapiens
MESERSKRMGNACIPLKRIAYFLCLLSALLLTEGKKPAKPKCPAVCTCTKDNALCENARSIPRTVPPDVISLSFVRSGFTEISEGSFLFTPSLQLLLFTSNSFDVISDDAFIGLPHLEYLFIENNNIKSISRHTFRGLKSLIHLSLANNNLQTLPKDIFKGLDSLTNVDLRGNSFNCDCKLKWLVEWLGHTNATVEDIYCEGPPEYKKRKINSLSSKDFDCIITEFAKSQDLPYQSLSIDTFSYLNDEYVVIAQPFTGKCIFLEWDHVEKTFRNYDNITGTSTVVCKPIVIETQLYVIVAQLFGGSHIYKRDSFANKFIKIQDIEILKIRKPNDIETFKIENNWYFVVADSSKAGFTTIYKWNGNGFYSHQSLHAWYRDTDVEYLEIVRTPQTLRTPHLILSSSSQRPVIYQWNKATQLFTNQTDIPNMEDVYAVKHFSVKGDVYICLTRFIGDSKVMKWGGSSFQDIQRMPSRGSMVFQPLQINNYQYAILGSDYSFTQVYNWDAEKAKFVKFQELNVQAPRSFTHVSINKRNFLFASSFKGNTQIYKHVIVDLSA

SEQ ID NO: 890217 - protein, 195 aa, Homo sapiens
MESERSKRMGNACIPLKRIAYFLCLLSALLLTEGKKPAKPKCPAVCTCTKDNALCENARSIPRTVPPDVISLSFVRSGFTEISEGSFLFTPSLQLLLFTSNSFDVISDDAFIGLPHLEYLFIENNNIKSISRHTFRGLKSLIHFSALGPRMQQGTKETKMPVLGLSLISSVSTRLSLCLHQAPFSPVACFVAKRS

SEQ ID NO: 890218 - protein, 291 aa, Homo sapiens
MESERSKRMGNACIPLKRIAYFLCLLSALLLTEGKKPAKPKCPAVCTCTKDNALCENARSIPRTVPPDVISLSFVRSGFTEISEGSFLFTPSLQLLLFTSNSFDVISDDAFIGLPHLEYLFIENNNIKSISRHTFRGLKSLIHLSLANNNLQTLPKDIFKGLDSLTNVDLRGNSFNCDCKLKWLVEWLGHTNATVEDIYCEGPPEYKKRKINSLSSKDFDCIITEFAKSQDLPYQSLSIDTFSYLNDEYVVIAQPFTGKCIFLEWDHVEKTFRNYDNITVLREIHRFTNMS

SEQ ID NO: 890219 - protein, 487 aa, Homo sapiens
MALERLCSVLKVLLITVLVVEGIAVAQKTQDGQNIGIKHIPATQCGIWVRTSNGGHFASPNYPDSYPPNKECIYILEAAPRQRIELTFDEHYYIEPSFECRFDHLEVRDGPFGFSPLIDRYCGVKSPPLIRSTGRFMWIKFSSDEELEGLGFRAKYSFIPDPDFTYLGGILNPIPDCQFELSGADGIVRSSQVEQEEKTKPGQAVDCIWTIKATPKAKIYLRFLDYQMEHSNECKRNFVAVYDGSSSIENLKAKFCSTVANDVMLKTGIGVIRMWADEGSRLSRFRMLFTSFVEQKKKAGVFEQITKTHGTIIGITSGIVLVLLIISILVQVKQPRKKVMACKTAFNKTGFQEVFDPPHYELFSLRDKEISADLADLSEELDNYQKMRRSSTASRCIHDHHCGSQASSVKQSRTNLSSMELPFRNDFAQPQPMKTFNSTFKKSSYTFKQGHECPEQALEDRVMEEIPCEIYVRGREDSAQASISIDF

SEQ ID NO: 890220 - protein, 518 aa, Homo sapiens
MALERLCSVLKVLLITVLVVEGIAVAQKTQDGQNIGIKHIPATQCGIWVRTSNGGHFASPNYPDSYPPNKECIYILEAAPRQRIELTFDEHYYIEPSFECRFDHLEVRDGPFGFSPLIDRYCGVKSPPLIRSTGRFMWIKFSSDEELEGLGFRAKYSFIPDPDFTYLGDCQFELSGADGIVRSSQVEQEEKTKPGQAVDCIWTIKATPKAKIYLRFLDYQMEHSNECKRNFVAVYDGSSSIENLKAKFCSTVANDVMLKTGIGVIRMWADEGSRLSRFRMLFTSFVEPPCTSSTFFCHSNMCINNSLVCNGVQNCAYPWDENHCKEKKKAGVFEQITKTHGTIIGITSGIVLVLLIISILVQVKQPRKKVMACKTAFNKTGFQEVFDPPHYELFSLRDKEISADLADLSEELDNYQKMRRSSTASRCIHDHHCGSQASSVKQSRTNLSSMELPFRNDFAQPQPMKTFNSTFKKSSYTFKQGHECPEQALEDRVMEEIPCEIYVRGREDSAQASISIDF

SEQ ID NO: 890221 - protein, 525 aa, Homo sapiens
MALERLCSVLKVLLITVLVVEGIAVAQKTQDGQNIGIKHIPATQCGIWVRTSNGGHFASPNYPDSYPPNKECIYILEAAPRQRIELTFDEHYYIEPSFECRFDHLEVRDGPFGFSPLIDRYCGVKSPPLIRSTGRFMWIKFSSDEELEGLGFRAKYSFIPDPDFTYLGGILNPIPDCQFELSGADGIVRSSQVEQEEKTKPGQAVDCIWTIKATPKAKIYLRFLDYQMEHSNECKRNFVAVYDGSSSIENLKAKFCSTVANDVMLKTGIGVIRMWADEGSRLSRFRMLFTSFVEPPCTSSTFFCHSNMCINNSLVCNGVQNCAYPWDENHCKEKKKAGVFEQITKTHGTIIGITSGIVLVLLIISILVQVKQPRKKVMACKTAFNKTGFQEVFDPPHYELFSLRDKEISADLADLSEELDNYQKMRRSSTASRCIHDHHCGSQASSVKQSRTNLSSMELPFRNDFAQPQPMKTFNSTFKKSSYTFKQGHECPEQALEDRVMEEIPCEIYVRGREDSAQASISIDF

SEQ ID NO: 890222 - protein, 525 aa, Homo sapiens; identical to SEQ ID NO: 890221

SEQ ID NO: 890223 - protein, 525 aa, Homo sapiens; identical to SEQ ID NO: 890221

SEQ ID NO: 890224 - protein, 487 aa, Homo sapiens; identical to SEQ ID NO: 890219

SEQ ID NO: 890225 - protein, 525 aa, Homo sapiens; identical to SEQ ID NO: 890221

SEQ ID NO: 890226 - protein, 296 aa, Homo sapiens [sequence omitted]

SEQ ID NO: 890227 - protein, 1495 aa, Homo sapiens
PALLSAWPPTASAAPPEQREILHEIQRRKEEIKEEKKRKEMAKQERLEIASLSNQDHTSKKDPGGHRTAAILHGGSPDFVGNGKHRANSSGRSRRERQYSVCNSEDSPGSCEILYFNMGSPDQLMVHKGKCIGSDEQLGKLVYNALETATGGFVLLYEWVLQWQKKMGPFLTSQEKEKIDKCKKQIQGTETEFNSLVKLSHPNVVRYLAMNLKEQDDSIVVDILVEHISGVSLAAHLSHSGPIPVHQLRRYTAQLLSGLDYLHSNSVVHKVLSASNVLVDAEGTVKITDYSISKRLADICKEDVFEQTRVRFSDNALPYKTGKKGDVWRLGLLLLSLSQGQECGEYPVTIPSDLPADFQDFLKKCVCLDDKERWSPQQLLKHSFINPQPKMPLVEQSPEDSGGQDYVETVIPSNRLPSAAFFSETQRQFSRYFIEFEELQLLGKGAFGAVIKVQNKLDGCCYAVKRIPINPASRQFRRIKGEVTLLSRLHHENIVRYYNAWIERHERPAGPGTPPPDSGPLAKDDRAARGQPASDTDGLDSVEAAAPPPILSSSVEWSTSGERSASARFPATGPGSSDDEDDDEDEHGGVFSQSFLPASDSESDIIFDNEDENSKSQNQDEDCNEKNGCHESEPSVTTEAVHYLYIQMEYCEKSTLRDTIDQGLYRDTVRLWRLFREILDGLAYIHEKGMIHRDLKPVNIFLDSDDHVKIGDFGLATDHLAFSADSKQDDQTGDLIKSDPSGHLTGMVGTALYVSPEVQGSTKSAYNQKVDLFSLGIIFFEMSYHPMVTASERIFVLNQLRDPTSPKFPEDFDDGEHAKQKSVISWLLNHDPAKRPTATELLKSELLPPPQMEESELHEVLHHTLTNVDGKAYRTMMAQIFSQRISPAIDYTYDSDILKGNFSIRTAKMQQHVCETIIRIFKRHGAVQLCTPLLLPRNRQIYEHNEAALFMDHSGMLVMLPFDLRIPFARYVARNNILNLKRYCIERVFRPRKLDRFHPKELLECAFDIVTSTTNSFLPTAEIIYTIYEIIQEFPALQERNYSIYLNHTMLLKAILLHCGIPEDKLSQVYIILYDAVTEKLTRREVEAKFCNLSLSSNSLCRLYKFIEQKGDLQDLMPTINSLIKQKTGIAQLVKYGLKDLEEVVGLLKKLGIKLQVLINLGLVYKVQQHNGIIFQFVAFIKRRQRAVPEILAAGGRYDLLIPQFRGPQALGPVPTAIGVSIAIDKISAAVLNMEESVTISSCDLLVVSVGQMSMSRAINLTQKLWTAGITAEIMYDWSQSQEELQEYCRHHEITYVALVSDKEGSHVKVKSFEKERQTEKRVLETELVDHVLQKLRTKVTDERNGREASDNLAVQNLKGSFSNASGLFEIHGATVVPIVSVLAPEKLSASTRRRYETQVQTRLQTSLANLHQKSSEIEILAVDLPKETILQFLSLEWDADEQAFNTTVKQLLSRLPKQRYLKLVCDEIYNIKVEKKVSVLFLYSYRDDYYRILF

SEQ ID NO: 890228 - protein, 1632 aa, Homo sapiens
SYPQRQDHELQALEAIYGADFQDLRPDACGPVKEPPEINLVLYPQGLTGEEVYVKVDLRVKCPPTYPDVVPEIELKNAKGLSNESVNLLKSRLEELAKKHCGEVMIFELAYHVQSFLSEHNKPPPKSFHEEMLERRAQEEQQRLLEAKRKEEQEQREILHEIQRRKEEIKEEKKRKEMAKQERLEIASLSNQDHTSKKDPGGHRTAAILHGGSPDFVGNGKHRANSSGRSRRERQYSVCNSEDSPGSCEILYFNMGSPDQLMVHKGKCIGSDEQLGKLVYNALETATGGFVLLYEWVLQWQKKMGPFLTSQEKEKIDKCKKQIQGTETEFNSLVKLSHPNVVRYLAMNLKEQDDSIVVDILVEHISGVSLAAHLSHSGPIPVHQLRRYTAQLLSGLDYLHSNSVVHKVLSASNVLVDAEGTVKITDYSISKRLADICKEDVFEQTRVRFSDNALPYKTGKKGDVWRLGLLLLSLSQGQECGEYPVTIPSDLPADFQDFLKKCVCLDDKERWSPQQLLKHSFINPQPKMPLVEQSPEDSGGQDYVETVIPSNRLPSAAFFSETQRQFSRYFIEFEELQLLGKGAFGAVIKVQNKLDGCCYAVKRIPINPASRQFRRIKGEVTLLSRLHHENIVRYYNAWIERHERPAGPGTPPPDSGPLAKDDRAARGQPASDTDGLDSVEAAAPPPILSSSVEWSTSGERSASARFPATGPGSSDDEDDDEDEHGGVFSQSFLPASDSESDIIFDNEDENSKSQNQDEDCNEKNGCHESEPSVTTEAVHYLYIQMEYCEKSTLRDTIDQGLYRDTVRLWRLFREILDGLAYIHEKGMIHRDLKPVNIFLDSDDHVKIGDFGLATDHLAFSADSKQDDQTGDLIKSDPSGHLTGMVGTALYVSPEVQGSTKSAYNQKVDLFSLGIIFFEMSYHPMVTASERIFVLNQLRDPTSPKFPEDFDDGEHAKQKSVISWLLNHDPAKRPTATELLKSELLPPPQMEESELHEVLHHTLTNVDGKAYRTMMAQIFSQRISPAIDYTYDSDILKGNFSIRTAKMQQHVCETIIRIFKRHGAVQLCTPLLLPRNRQIYEHNEAALFMDHSGMLVMLPFDLRIPFARYVARNNILNLKRYCIERVFRPRKLDRFHPKELLECAFDIVTSTTNSFLPTAEIIYTIYEIIQEFPALQERNYSIYLNHTMLLKAILLHCGIPEDKLSQVYIILYDAVTEKLTRREVEAKFCNLSLSSNSLCRLYKFIEQKGDLQDLMPTINSLIKQKTGIAQLVKYGLKDLEEVVGLLKKLGIKLQVLINLGLVYKVQQHNGIIFQFVAFIKRRQRAVPEILAAGGRYDLLIPQFRGPQALGPVPTAIGVSIAIDKISAAVLNMEESVTISSCDLLVVSVGQMSMSRAINLTQKLWTAGITAEIMYDWSQSQEELQEYCRHHEITYVALVSDKEGSHVKVKSFEKERQTEKRVLETELVDHVLQKLRTKVTDERNGREASDNLAVQNLKGSFSNASGLFEIHGATVVPIVSVLAPEKLSASTRRRYETQVQTRLQTSLANLHQKSSEIEILAVDLPKETILQFLSLEWDADEQAFNTTVKQLLSRLPKQRYLKLVCDEIYNIKVEKKVSVLFLYSYRDDYYRILF

SEQ ID NO: 890229 - protein, 1061 aa, Homo sapiens
MPVCARLRAADLPLAVPQVQNKLDGCCYAVKRIPINPASRQFRRIKGEVTLLSRLHHENIVRYYNAWIERHERPAGPGTPPPDSGPLAKDDRAARGQPASDTDGLDSVEAAAPPPILSSSVEWSTSGERSASARFPATGPGSSDDEDDDEDEHGGVFSQSFLPASDSESDIIFDNEDENSKSQNQDEDCNEKNGCHESEPSVTTEAVHYLYIQMEYCEKSTLRDTIDQGLYRDTVRLWRLFREILDGLAYIHEKGMIHRDLKPVNIFLDSDDHVKIGDFGLATDHLAFSADSKQDDQTGDLIKSDPSGHLTGMVGTALYVSPEVQGSTKSAYNQKVDLFSLGIIFFEMSYHPMVTASERIFVLNQLRDPTSPKFPEDFDDGEHAKQKSVISWLLNHDPAKRPTATELLKSELLPPPQMEESELHEVLHHTLTNVDGKAYRTMMAQIFSQRISPAIDYTYDSDILKGNFSIRTAKMQQHVCETIIRIFKRHGAVQLCTPLLLPRNRQIYEHNEAALFMDHSGMLVMLPFDLRIPFARYVARNNILNLKRYCIERVFRPRKLDRFHPKELLECAFDIVTSTTNSFLPTAEIIYTIYEIIQEFPALQERNYSIYLNHTMLLKAILLHCGIPEDKLSQVYIILYDAVTEKLTRREVEAKFCNLSLSSNSLCRLYKFIEQKGDLQDLMPTINSLIKQKTGIAQLVKYGLKDLEEVVGLLKKLGIKLQVLINLGLVYKVQQHNGIIFQFVAFIKRRQRAVPEILAAGGRYDLLIPQFRGPQALGPVPTAIGVSIAIDKISAAVLNMEESVTISSCDLLVVSVGQMSMSRAINLTQKLWTAGITAEIMYDWSQSQEELQEYCRHHEITYVALVSDKEGSHVKVKSFEKERQTEKRVLETELVDHVLQKLRTKVTDERNGREASDNLAVQNLKGSFSNASGLFEIHGATVVPIVSVLAPEKLSASTRRRYETQVQTRLQTSLANLHQKSSEIEILAVDLPKETILQFLSLEWDADEQAFNTTVKQLLSRLPKQRYLKLVCDEIYNIKVEKKVSVLFLYSYRDDYYRILF

SEQ ID NO: 890230 - protein, 620 aa, Homo sapiens
YSLVEWHIVDPAPRLHRRHSDILKGNFSIRTAKMQQHVCETIIRIFKRHGAVQLCTPLLLPRNRQIYEHNEAALFMDHSGMLVMLPFDLRIPFARYVARNNILNLKRYCIERVFRPRKLDRFHPKELLECAFDIVTSTTNSFLPTAEIIYTIYEIIQEFPALQERNYSIYLNHTMLLKAILLHCGIPEDKLSQVYIILYDAVTEKLTRREVEAKFCNLSLSSNSLCRLYKFIEQKGDLQDLMPTINSLIKQKTGIAQLVKYGLKDLEEVVGLLKKLGIKLQVLINLGLVYKVQQHNGIIFQFVAFIKRRQRAVPEILAAGGRYDLLIPQFRGPQALGPVPTAIGVSIAIDKISAAVLNMEESVTISSCDLLVVSVGQMSMSRAINLTQKLWTAGITAEIMYDWSQSQEELQEYCRHHEITYVALVSDKEGSHVKVKSFEKERQTEKRVLETELVDHVLQKLRTKVTDERNGREASDNLAVQNLKGSFSNASGLFEIHGATVVPIVSVLAPEKLSASTRRRYETQVQTRLQTSLANLHQKSSEIEILAVDLPKETILQFLSLEWDADEQAFNTTVKQLLSRLPKQRYLKLVCDEIYNIKVEKKVSVLFLYSYRDDYYRILF

SEQ ID NO: 890231 - protein, 1575 aa, Homo sapiens
SYPQRQDHELQALEAIYGADFQDLRPDACGPVKEPPEINLVLYPQGLTGEEVYVKVDLRVKCPPTYPDVVPEIELKNAKGLSNESVNLLKSRLEELAKKHCGEVMIFELAYHVQSFLSEHNKPPPKSFHEEMLERRAQEEQQRLLEAKRKEEQEQREILHEIQRRKEEIKEEKKRKEMAKQERLEIASLSNQDHTSKKDPGGHRTAAILHGGSPDFVGNGKHRANSSGRSRRERQYSVCNSEDSPGSCEILYFNMGSPDQLMVHKGKCIGSDEQLGKLVYNALETATGGFVLLYEWVLQWQKKMGPFLTSQEKEKIDKCKKQIQGTETEFNSLVKLSHPNVVRYLAMNLKEQDDSIVVDILVEHISGVSLAAHLSHSGPIPVHQLRRYTAQLLSGLDYLHSNSVVHKVLSASNVLVDAEGTVKITDYSISKRLADICKEDVFEQTRVRFSDNALPYKTGKKGDVWRLGLLLLSLSQGQECGEYPVTIPSDLPADFQDFLKKCVCLDDKERWSPQQLLKHSFINPQPKMPLVEQSPEDSGGQDYVETVIPSNRLPSAAFFSETQRQFSRYFIEFEELQLLGKGAFGAVIKVQNKLDGCCYAVKRIPINPASRQFRRIKGEVTLLSRLHHENIVRYYNAWIERHERPAGPGTPPPDSGPLAKDDRAARGQPASDTDGLDSVEAAAPPPILSSSVEWSTSGERSASARFPATGPGSSDDEDDDEDEHGGVFSQSFLPASDSESDIIFDNEDENSKSQNQDEDCNEKNGCHESEPSVTTEAVHYLYIQMEYCEKSTLRDTIDQGLYRDTVRLWRLFREILDGLAYIHEKGMIHRDLKPVNIFLDSDDHVKIGDFGLATDHLAFSADSKQDDQTGDLIKSDPSGHLTGMVGTALYVSPEVQGSTKSAYNQKVDLFSLGIIFFEMSYHPMVTASERIFVLNQLRDPTSPKFPEDFDDGEHAKQKSVISWLLNHDPAKRPTATELLKSELLPPPQMEESELHEVLHHTLTNVDGKAYRTMMAQIFSQRISPAIDYTYDSDILKGNFSIRTAKMQQHVCETIIRIFKRHGAVQLCTPLLLPRNRQIYEHNEAALFMDHSGMLVMLPFDLRIPFARYVARNNILNLKRYCIERVFRPRKLDRFHPKELLECAFDIVTSTTNSFLPTAEIIYTIYEIIQEFPALQERNYSIYLNHTMLLKAILLHCGIPEDKLSQVYIILYDAVTEKLTRREVEAKFCNLSLSSNSVLINLGLVYKVQQHNGIIFQFVAFIKRRQRAVPEILAAGGRYDLLIPQFRGPQALGPVPTAIGVSIAIDKISAAVLNMEESVTISSCDLLVVSVGQMSMSRAINLTQKLWTAGITAEIMYDWSQSQEELQEYCRHHEITYVALVSDKEGSHVKVKSFEKERQTEKRVLETELVDHVLQKLRTKVTDERNGREASDNLAVQNLKGSFSNASGLFEIHGATVVPIVSVLAPEKLSASTRRRYETQVQTRLQTSLANLHQKSSEIEILAVDLPKETILQFLSLEWDADEQAFNTTVKQLLSRLPKQRYLKLVCDEIYNIKVEKKVSVLFLYSYRDDYYRILF

SEQ ID NO: 890232 - protein, 1450 aa, Homo sapiens
SYPQRQDHELQALEAIYGADFQDLRPDACGPVKEPPEINLVLYPQGLTGEEVYVKVDLRVKCPPTYPDVVPEIELKNAKGLSNESVNLLKSRLEELAKKHCGEVMIFELAYHVQSFLSEHNKPPPKSFHEEMLERRAQEEQQRLLEAKRKEEQEQREILHEIQRRKEEIKEEKKRKEMAKQERLEIASLSNQDHTSKKDPGGHRTAAILHGGSPDFVGNGKHRANSSGRSRRERQYSVCNSEDSPGSCEILYFNMGSPDQLMVHKGKCIGSDEQLGKLVYNALETATGGFVLLYEWVLQWQKKMGPFLTSQEKEKIDKCKKQIQGTETEFNSLVKLSHPNVVRYLAMNLKEQDDSIVVDILVEHISGVSLAAHLSHSGPIPVHQLRRYTAQLLSGLDYLHSNSVVHKVLSASNVLVDAEGTVKITDYSISKRLADICKEDVFEQTRVRFSDNALPYKTGKKGDVWRLGLLLLSLSQGQECGEYPVTIPSDLPADFQDFLKKCVCLDDKERWSPQQLLKHSFINPQPKMPLVEQSPEDSGGQDYVETVIPSNRLPSAAFFSETQRQFSRYFIEFEELQLLGKGAFGAVIKVQNKLDGCCYAVKRIPINPASRQFRRIKGEVTLLSRLHHENIVRYYNAWIERHERPAGPGTPPPDSGPLAKDDRAARGQPASDTDGLDSVEAAAPPPILSSSVEWSTSGERSASARFPATGPGSSDDEDDDEDEHGGVFSQSFLPASDSESDIIFDNEDENSKSQNQDEDCNEKNGCHESEPSVTTEAVHYLYIQMEYCEKSTLRDTIDQGLYRDTVRLWRLFREILDGLAYIHEKGMIHRDLKPVNIFLDSDDHVKIGDFGLATDHLAFSADSKQDDQTGDLIKSDPSGHLTGMVGTALYVSPEVQGSTKSAYNQKVDLFSLGIIFFEMSYHPMVTASERIFVLNQLRDPTSPKFPEDFDDGEHAKQKSVISWLLNHDPAKRPTATELLKSELLPPPQMEESELHEVLHHTLTNVDGKAYRTMMAQIFSQRISPAIDYTYDSDILKGNFSIRTAKMQQHVCETIIRIFKRHGAVQLCTPLLLPRNRQIYEHNEAALFMDHSGMLVMLPFDLRIPFARYVARNNILNLKRYCIERVFRPRKLDRFHPKELLECAFDIVTSTTNSFLPTAEIIYTIYEIIQEFPALQERNYSIYLNHTMLLKAILLHCGIPEDKLSQVYIILYDAVTEKLTRREVEAKFCNLSLSSNSLCRLYKFIEQKGDLQDLMPTINSLIKQKTGIAQLVKYGLKDLEEVVGLLKKLGIKLQVLINLGLVYKVQQHNGIIFQFVAFIKRRQRAVPEILAAGGRYDLLIPQFRGPQALGPVPTAIGVSIAIDKISAAVLNMEESVTISSCDLLVVSVGQMSMSRAINLTQKLWTAGITAEIMYDWSQSQEELQEYCRHHEITYVALVSDKEGSHVKRSFR

SEQ ID NO: 890233 - protein, 1594 aa, Homo sapiens
SYPQRQDHELQALEAIYGADFQDLRPDACGPVKEPPEINLVLYPQGLTGEEVYVKVDLRVKCPPTYPDVVPEIELKNAKGLSNESVNLLKSRLEELAKKHCGEVMIFELAYHVQSFLSEHNKPPPKSFHEEMLERRAQEEQQRLLEAKRKEEQEQREILHEIQRRKEEIKEEKKRKEMAKQERLEIASLSNQDHTSKKDPGGHRTAAILHGGSPDFVGNGKHRANSSGRSRRERQYSVCNSEDSPGSCEILYFNMGSPDQLMVHKGKCIGSDEQLGKLVYNALETATGGFVLLYEWVLQWQKKMGPFLTSQEKEKIDKCKKQIQGTETEFNSLVKLSHPNVVRYLAMNLKEQDDSIVVDILVEHISGVSLAAHLSHSGPIPVHQLRRYTAQLLSGLDYLHSNSVVHKVLSASNVLVDAEGTVKITDYSISKRLADICKEDVFEQTRVRFSDNALPYKTGKKGDVWRLGLLLLSLSQGQECGEYPVTIPSDLPADFQDFLKKCVCLDDKERWSPQQLLKHSFINPQPKMPLVEQSPEDSGGQDYVETVIPSNRLPSAAFFSETQRQFSRYFIEFEELQLLGKGAFGAVIKVQNKLDGCCYAVKRIPINPASRQFRRIKGEVTLLSRLHHENIVRYYNAWIERHERPAGPGTPPPDSGPLAKDDRAARGQPASDTDGLDSVEAAAPPPILSSSVEWSTSGERSASARFPATGPGSSDDEDDDEDEHGGVFSQSFLPASDSESDIIFDNEDENSKSQNQDEDCNEKNGCHESEPSVTTEAVHYLYIQMEYCEKSTLRDTIDQGLYRDTVRLWRLFREILDGLAYIHEKGMIHRDLKPVNIFLDSDDHVKIGDFGLATDHLAFSADSKQDDQTGDLIKSDPSGHLTGMVGTALYVSPEVQGSTKSAYNQKVDLFSLGIIFFEMSYHPMVTASERIFVLNQLRDPTSPKFPEDFDDGEHAKQKSVISWLLNHDPAKRPTATELLKSELLPPPQMEESELHEVLHHTLTNVDGKAYRTMMAQIFSQRISPAIDYTYDSDILKGNFSIRTAKMQQHVCETIIRIFKRHGAVQLCTPLLLPRNRQIYEHNEAALFMDHSGMLVMLPFDLRIPFARYVARNNILNLKRYCIERVFRPRKLDRFHPKELLECAFDIVTSTTNSFLPTAEIIYTIYEIIQEFPALQERNYSIYLNHTMLLKAILLHCGIPEDKLSQVYIILYDAVTEKLTRREVEAKFCNLSLSSNSLCRLYKFIEQKGDLQDLMPTINSLIKQKTGIAQLVKYGLKDLEEVVGLLKKLGIKLQVLINLGLVYKVQQHNGIIFQFVAFIKRRQRAVPEILAAGGRYDLLIPQFRGPQALGPVPTAIGVSIAIDKISAAVLNMEESVTISSCDLLVVSVGQMSMSRAINLTQKLWTAGITAEIMYDWSQSQEELQEYCRHHEITYVALVSDKEGSHVKVKSFEKERQTEKRVLETELVDHVLQKLRTKVTDERNGREASDNLAVQNLKGSFSNASGLFEIHGATVVPIVSVLAPEKLSASTRRRYETQWDADEQAFNTTVKQLLSRLPKQRYLKLVCDEIYNIKVEKKVSVLFLYSYRDDYYRILF

SEQ ID NO: 890234 - protein, 1632 aa, Homo sapiens; identical to SEQ ID NO: 890228

SEQ ID NO: 890235 - protein, 1632 aa, Homo sapiens; identical to SEQ ID NO: 890228

SEQ ID NO: 890236 - protein, 182 aa, Homo sapiens
MVMRQTEKRVLETELVDHVLQKLRTKVTDERNGREASDNLAVQNLKGSFSNASGLFEIHGATVVPIVSVLAPEKLSASTRRRYETQVQTRLQTSLANLHQKSSEIEILAVDLPKETILQFLSLEWDADEQAFNTTVKQLLSRLPKQRYLKLVCDEIYNIKVEKKVSVLFLYSYRDDYYRILF

SEQ ID NO: 890237 - protein, 1052 aa, Homo sapiens
SYPQRQDHELQALEAIYGADFQDLRPDACGPVKEPPEINLVLYPQGLTGEEVYVKVDLRVKCPPTYPDVVPEIELKNAKGLSNESVNLLKSRLEELAKKHCGEVMIFELAYHVQSFLSEHNKPPPKSFHEEMLERRAQEEQQRLLEAKRKEEQEQREILHEIQRRKEEIKEEKKRKEMAKQERLEIASLSNQDHTSKKDPGGHRTAAILHGGSPDFVGNGKHRANSSGRSRRERQYSVCNSEDSPGSCEILYFNMGSPDQLMVHKGKCIGSDEQLGKLVYNALETATGGFVLLYEWVLQWQKKMGPFLTSQEKEKIDKCKKQIQGTETEFNSLVKLSHPNVVRYLAMNLKEQDDSIVVDILVEHISGVSLAAHLSHSGPIPVHQLRRYTAQLLSGLDYLHSNSVVHKVLSASNVLVDAEGTVKITDYSISKRLADICKEDVFEQTRVRFSDNALPYKTGKKGDVWRLGLLLLSLSQGQECGEYPVTIPSDLPADFQDFLKKCVCLDDKERWSPQQLLKHSFINPQPKMPLVEQSPEDSGGQDYVETVIPSNRLPSAAFFSETQRQFSRYFIEFEELQLLGKGAFGAVIKVQNKLDGCCYAVKRIPINPASRQFRRIKGEVTLLSRLHHENIVRYYNAWIERHERPAGPGTPPPDSGPLAKDDRAARGQPASDTDGLDSVEAAAPPPILSSSVEWSTSGERSASARFPATGPGSSDDEDDDEDEHGGVFSQSFLPASDSESDIIFDNEDENSKSQNQDEDCNEKNGCHESEPSVTTEAVHYLYIQMEYCEKSTLRDTIDQGLYRDTVRLWRLFREILDGLAYIHEKGMIHRDLKPVNIFLDSDDHVKIGDFGLATDHLAFSADSKQDDQTGDLIKSDPSGHLTGMVGTALYVSPEVQGSTKSAYNQKVDLFSLGIIFFEMSYHPMVTASERIFVLNQLRDPTSPKFPEDFDDGEHAKQKSVISWLLNHDPAKRPTATELLKSELLPPPQMEESELHEVLHHTLTNVDGKAYRTMMAQIFSQRISFYNKGKSNGRDILNGRFVNPYSQDAMRMR

SEQ ID NO: 890238 - protein, 114 aa, Homo sapiens
SSLAKSKGVVLMALCALTRALRSLNLAPPTVAAPAPSLFPAAQMMNNGLLQQPSALMLLPCRPVLTSVALNANFVSWKSRTKYTITPVKMRKSGGRDHTGAGNVRSNSRPSIQR

SEQ ID NO: 890239 - protein, 107 aa, Homo sapiens
SSLAKSKGVVLMALCALTRALRSLNLAPPTVAAPAPSLFPAAQMMNNGLLQQPSALMLLPCRPVLTSVALNANFVSWKSRTKYTITPVKMRKSGGRDHTGGNKDRGI

SEQ ID NO: 890240 - protein, 149 aa, Homo sapiens
MQAGDTILNSNHIGRMAVAAREGDAHPLGALPVGTLINNVESEPGRGAQYIRAAGTCGVLLRKVNGTAIIQLPSKRQMQVLETCVATVGRVSNVDHNKRVIGKAGRNRWLGKRPNSGRWHRKGGWAGRKIRPLPPMKSYVKLPSASAQS

SEQ ID NO: 890241 - protein, 236 aa, Homo sapiens
SSLAKSKGVVLMALCALTRALRSLNLAPPTVAAPAPSLFPAAQMMNNGLLQQPSALMLLPCRPVLTSVALNANFVSWKSRTKYTITPVKMRKSGGRDHTGRIRVHGIGGGHKQRYRMIDFLRFRPEETKSGPFEEKVIQVRYDPCRSADIALVAGGSRKRWIIATENMQAGDTILNSNHIGRMAVAAREGDAHPLGALPVGTLINNVESEPGRGAQYIRAAGAGNVRSNSRPSIQR

SEQ ID NO: 890242 - protein, 107 aa, Homo sapiens; identical to SEQ ID NO: 890239

SEQ ID NO: 890243 - protein, 316 aa, Homo sapiens
SSLAKSKGVVLMALCALTRALRSLNLAPPTVAAPAPSLFPAAQMMNNGLLQQPSALMLLPCRPVLTSVALNANFVSWKSRTKYTITPVKMRKSGGRDHTGRIRVHGIGGGHKQRYRMIDFLRFRPEETKSGPFEEKVIQVRYDPCRSADIALVAGGSRKRWIIATENMQAGDTILNSNHIGRMAVAAREGDAHPLGALPVGTLINNVESEPGRGAQYIRAAGTCGVLLRKVNGTAIIQLPSKRQMQVLETCVATVGRVSNVDHNKRVIGKAGRNRWLGKRPNSGRWHRKGGWAGRKIRPLPPMKSYVKLPSASAQS

SEQ ID NO: 890244 - protein, 127 aa, Homo sapiens
RAKQGQHVGYVPCVSPSAPPCFVEGGKSAFSPGTCGVLLRKVNGTAIIQLPSKRQMQVLETCVATVGRVSNVDHNKRVIGKAGRNRWLGKRPNSGRWHRKGGWAGRKIRPLPPMKSYVKLPSASAQS

SEQ ID NO: 890245 - protein, 380 aa, Homo sapiens [sequence omitted]

SEQ ID NO: 890246 - protein, 308 aa, Homo sapiens
MPFCAPKYSVDPKEKIDIGLPPPKVSRTQQLLERKQAIQELRANVEEERAARLRTASVPLDAVRAEWERTCGPYHKQRLAEYYGLYRDLFHGATFVPRVPLHVAYAVGEDDLMPVYCGNEVTPTEAAQAPEVTYEAEEGSLWTLLLTSLDGHLLEPDAEYLHWLLTNIPGNRVAEGQVTCPYLPPFPARGSGIHRLAFLLFKQDQPIDFSEDARPSPCYQLAQRTFRTFDFYKKHQETMTPAGLSFFQCRWDDSVTYIFHQLLDMREPVFEFVRPPPYHPKQKRFPHRQPLRYLDRYRDSHEPTYGIY

SEQ ID NO: 890247 - protein, 380 aa, Homo sapiens [sequence omitted]

SEQ ID NO: 890248 - protein, 380 aa, Homo sapiens [sequence omitted]

SEQ ID NO: 890249 - protein, 290 aa, Homo sapiens
MAAPWWRAALCECRRWRGFSTSAVLGRRTPPLGPMPNSDIDLSNLERLEKYRSFDRYRRRAEQEAQAPHWWRTYREYFGEKTDPKEKIDIGLPPPKVSRTQQLLERKQAIQELRANVEEERAARLRTASVPLDAVRAEWERTCGPYHKQRLAEYYGLYRDLFHGATFVPRVPLHVAYAVGEDDLMPVYCGNEVTPTEAAQAPEVTYEAEEGSLWTLLLTSLDGHLLEPDAEYLHWLLTNIPGNRVAEGQVTCPYLPPFPARGSGIHRLAFLLFKQDQPIDFSEDARPSPW

SEQ ID NO: 890250 - protein, 337 aa, Homo sapiens
MAAPWWRAALCECRRWRGFSTSAVLGRRTPPLGPMPNSDIDLSNLERLEKYRSFDRYRRRAEQEAQAPHWWRTYREYFGEKTDPKEKIDIGLPPPKVSRTQQLLERKQAIQELRANVEEERAARLRTASVPLDAVRAEWERTCGPYHKQRLAEYYGLYRDLFHGATFVPRVPLHVAYAVGEDDLMPVYCGNEVTPTEAAQAPEVTYEAEEGSLWTLLLTSLDGHLLEPDAEYLHWLLTNIPGNRVAEGQVTCPYLPPFPARGSGIHRLAFLLFKQDQPIDFSEDARPSPWYSAWPKGLSDFDFYRTQNMIPAGVFSWRGCPYYFHVWIRTCDWGPYQ

SEQ ID NO: 890251 - protein, 372 aa, Homo sapiens
PWNNRLRPTRPGRAPVLGRRTPPLGPMPNSDIDLSNLERLEKYRSFDRYRRRAEQEAQAPHWWRTYREYFGEKTDPKEKIDIGLPPPKVSRTQQLLERKQAIQELRANVEEERAARLRTASVPLDAVRAEWERTCGPYHKQRLAEYYGLYRDLFHGATFVPRVPLHVAYAVGEDDLMPVYCGNEVTPTEAAQAPEVTYEAEEGSLWTLLLTSLDGHLLEPDAEYLHWLLTNIPGNRVAEGQVTCPYLPPFPARGSGIHRLAFLLFKQDQPIDFSEDARPSPCYQLAQRTFRTFDFYKKHQETMTPAGLSFFQCRWDDSVTYIFHQLLDMREPVFEFVRPPPYHPKQKRFPHRQPLRYLDRYRDSHEPTYGIY

SEQ ID NO: 890252 - protein, 527 aa, Homo sapiens
MAAPWWRAALCECRRWRGFSTSAVLGRRTPPLGPMPNSDIDLSNLERLEKYRSFDRYRRRAEQEAQAPHWWRTYREYFGEKTDPKEKIDIGLPPPKVSRTQQLLERKQAIQELRANVEEERAARLRTASVPLDAVRAEWERTCGPYHKQRLAEYYGLYRDLFHGATFVPRVPLHVAYAVGEDDLMPVYCGNEVTPTEVTTHLCPSSLPCANTDTSHLSVTDTPGFGILLFSVIFDFLEDDTMTISKKIEQNEGKRGSVLAHSCDQPAVCGVALLARPWHMFVFVVVAWTGNSARAASLRIPLPACLCQGLSRAFGSEWAPLSPRLPATAGLSLVGLTASFSPCQAAQAPEVTYEAEEGSLWTLLLTSLDGHLLEPDAEYLHWLLTNIPGNRVAEGQVTCPYLPPFPARGSGIHRLAFLLFKQDQPIDFSEDARPSPCYQLAQRTFRTFDFYKKHQETMTPAGLSFFQCRWDDSVTYIFHQLLDMREPVFEFVRPPPYHPKQKRFPHRQPLRYLDRYRDSHEPTYGIY

SEQ ID NO: 890253 - protein, 237 aa, Homo sapiens
MAAPWWRAALCECRRWRGFSTSAVLGRRTPPLGPMPNSDIDLSNLERLEKYRSFDRYRRRAEQEAQAPHWWRTYREYFGEKTDPKEKIDIGLPPPKVSRTQQLLERKQAIQELRANVEEERAARLRTASVPLDAVRAEWERTCGPYHKQRLAEYYGLYRDLFHGATFVPRVPLHVAYAVGEDDLMPVYCGNEVTPTEAAQAPEVTYEAEEGSLWTLLLTSLDGHLLEPDAEYLHWLL

SEQ ID NO: 890254 - protein, 237 aa, Homo sapiens; identical to SEQ ID NO: 890253

SEQ ID NO: 890255 - protein, 467 aa, Homo sapiens
MAAPWWRAALCECRRWRGFSTSDPKEKIDIGLPPPKVSRTQQLLERKQAIQELRANVEEERAARLRTASVPLDAVRAEWERTCGPYHKQRLAEYYGLYRDLFHGATFVPRVPLHVAYAVGEDDLMPVYCGNEVTPTEVTTHLCPSSLPCANTDTSHLSVTDTPGFGILLFSVIFDFLEDDTMTISKKIEQNEGKRGSVLAHSCDQPAVCGVALLARPWHMFVFVVVAWTGNSARAASLRIPLPACLCQGLSRAFGSEWAPLSPRLPATAGLSLVGLTASFSPCQAAQAPEVTYEAEEGSLWTLLLTSLDGHLLEPDAEYLHWLLTNIPGNRVAEGQVTCPYLPPFPARGSGIHRLAFLLFKQDQPIDFSEDARPSPCYQLAQRTFRTFDFYKKHQETMTPAGLSFFQCRWDDSVTYIFHQLLDMREPVFEFVRPPPYHPKQKRFPHRQPLRYLDRYRDSHEPTYGIY

SEQ ID NO: 890256 - protein, 243 aa, Homo sapiens
MAAPWWRAALCECRRWRGFSTSAVLGRRTPPLGPMPNSDIDLSNLERLEKYRSFDRYRRRAEQEAQAPHWWRTYREYFGEKTDPKEKIDIGLPPPKVSRTQQLLERKQAIQELRANVEEERAARLRTASVPLDAVRAEWERTCGPYHKQRLAEYYGLYRDLFHGATFVPRVPLHVAYAVGEDDLMPVYCGNEVTPTEAAQAPEVTYEAEEGSLWTLLLTSLDGHLLEPDAEYLTGGNQSGYGW

SEQ ID NO: 890257 - protein, 199 aa, Homo sapiens
MSRRSQSLAASSVPGERCLELSSQGVMSASRVCMELRGHSCCLPGVVINRDFPPPRTNIPGNRVAEGQVTCPYLPPFPARGSGIHRLAFLLFKQDQPIDFSEDARPSPCYQLAQRTFRTFDFYKKHQETMTPAGLSFFQCRWDDSVTYIFHQLLDMREPVFEFVRPPPYHPKQKRFPHRQPLRYLDRYRDSHEPTYGIY

SEQ ID NO: 890258 - protein, 131 aa, Homo sapiens
MAAPWWRAALCECRRWRGFSTSAVLGRRTPPLGPMPNSDIDLSNLERLEKYRSFDRYRRRAEQEAQAPHWWRTYREYFGEKTDPKEKIDIGLPPPKVSRTQQLLERKQAIQELRANVEEERAARLRTVKDR

SEQ ID NO: 890259 - protein, 135 aa, Homo sapiens
MAAPWWRAALCECRRWRGFSTSAVLGRRTPPLGPMPNSDIDLSNLERLEKYRSFDRYRRRAEQEAQAPHWWRTYREYFGEKTDPKEKIDIGLPPPKVSRTQQLLERKQAIQELRANVEEERAARLRTELRRRRYG

SEQ ID NO: 890260 - protein, 113 aa, Homo sapiens
MTLFFPHIFPLQIPKRRLILGCLHPKSPGPNSYWNGNRPSRSFGPMWKRSGLPASAQPVSRWMPCGPSGRGPVAPTTSSVWLSITASTETCSTVPPLCPESPCTWPTLWVRMT

SEQ ID NO: 890261 - protein, 380 aa, Homo sapiens [sequence omitted]

SEQ ID NO: 890262 - protein, 361 aa, Homo sapiens
MAAPWWRAALCECRRWRGFSTSAVLGRRTPPLGPMPNSDIDLSNLERLEKYRSFDRYRRRAEQEAQAPHWWRTYREYFGEKTDPKEKIDIGLPPPKVSRTQQLLERKQAIQELRANVEEERAARLRTASVPLDAVRAEWERTCGPYHKQRLAEYYGLYRDLFHGATFVPRVPLHVAYAVGEDDLMPVYCGNEVTPTEAAQAPEVTYEAEEGSLWTLLLTSLDGHLLEPDAEYLHWLLTNIPGNRVAEGQVTCPYLPPFPARGSGIHRLAFLLFKQDQPIDFSEDARPSPCYQLAQRTFRTFDFYKKHQETMTPAGLSFFQCRWDDSVTYIFHQLLGKGHGAGALGGPELPGLACPAREKLC

SEQ ID NO: 890263 - protein, 366 aa, Homo sapiens
MAAPWWRAALCECRRWRGFSTSAVLGRRTPPLGPMPNSDIDLSNLERLEKYRSFDRYRRRAEQEAQAPHWWRTYREYFGEKTDPKEKIDIGLPPPKVSRTQQLLERKQAIQELRANVEEERAARLRTASVPLDAVRAEWERTCGPYHKQRLAEYYGLYRDLFHGATFVPRVPLHVAYAVGEDDLMPVYCGNEVTPTEAAQAPEVTYEAEEGSLWTLLLTSLDGHLLEPDAEYLHWLLTNIPGNRVAEGQVTCPYLPPFPARGSGIHRLAFLLFKQDQPIDFSEDARPSPCISGQRTSTLDSTENQKQIQRLSSPLPGMTRYYISTDSEAGARRVVGAINTERLQGTANERRDKTTDKKQGEHAHAQ

SEQ ID NO: 890264 - protein, 237 aa, Homo sapiens; identical to SEQ ID NO: 890253

SEQ ID NO: 890265 - protein, 237 aa, Homo sapiens; identical to SEQ ID NO: 890253

SEQ ID NO: 890266 - protein, 237 aa, Homo sapiens; identical to SEQ ID NO: 890253

SEQ ID NO: 890267 - protein, 191 aa, Homo sapiens
HEVYCGNEAAQAPEVTYEAEEGSLWTLLLTSLDGHLLEPDAEYLHWLLTNIPGNRVAEGQVTCPYLPPFPARGSGIHRLAFLLFKQDQPIDFSEDARPSPCYQLAQRTFRTFDFYKKHQETMTPAGLSFFQCRWDDSVTYIFHQLLDMREPVFEFVRPPPYHPKQKRFPHRQPLRYLDRYRDSHEPTYGIY

SEQ ID NO: 890268 - protein, 197 aa, Homo sapiens
PGGLMTVPVPVQVAQGLPEGEALLLGVVRGRPHELKHSCCLPGVVINRDFPPPRTNIPGNRVAEGQVTCPYLPPFPARGSGIHRLAFLLFKQDQPIDFSEDARPSPCYQLAQRTFRTFDFYKKHQETMTPAGLSFFQCRWDDSVTYIFHQLLDMREPVFEFVRPPPYHPKQKRFPHRQPLRYLDRYRDSHEPTYGIY

SEQ ID NO: 890269 - protein, 95 aa, Homo sapiens
GLTRPPAPLTSYEPGPWGAGGGARWRSPALAPNKGGGGRAVVGWAVVSRCVFVQMGTCWSQMLSTSTGCCEYWSTGGRGCCPGGKRSWEPGLSCS

SEQ ID NO: 890270 - protein, 220 aa, Homo sapiens
MGIIRFLLLYCPTNILTVCVLERQIFDFLGYQWAPILANFVHIIIVILGLFGTIQYRPRYITGYAVWLVLWVTWNVFVICFYLEAGDLSKETDLILTFNISMHRSWWMENGPGCTVTSVTPAPDWAPEDHRYITVSGCLLEYQYIEVAHSSLQIVLALAGFIYACYVVKCITEEEDSFDFHQVALTLMANHGPQKTSHLQLTAYVHVKISPDDFGMSGPW

SEQ ID NO: 890271 - protein, 221 aa, Homo sapiens
MGYCSGRCTLIFICGMQLVCVLERQIFDFLGYQWAPILANFVHIIIVILGLFGTIQYRPRYITGYAVWLVLWVTWNVFVICFYLEAGDLSKETDLILTFNISMHRSWWMENGPGCTVTSVTPAPDWAPEDHRYITVSGCLLEYQYIEVAHSSLQIVLALAGFIYACYVVKCITEEEDSFDFHQVALTLMANHGPQKTSHLQLTAYVHVKISPDDFGMSGPW

SEQ ID NO: 890272 - protein, 134 aa, Homo sapiens
MGIIRFLLLYCPTNILTVCVLERQIFDFLGYQWAPILANFVHIIIVILGLFGTIQYRPRYITGYAVWLVLWVTWNVFVICFYLEAGDLSKHPSVNWWKEPCLSNREWKKAPELQIQNFSLQSKEGTRLALHLFL

SEQ ID NO: 890273 - protein, 85 aa, Homo sapiens
QCSARRAARGQGGGSGVDGEYFFKKKEDKQKRKKMTYILMKSVHSSGRIFMSQIKSVIDWSSLNPKTSEELEDPEELFSSKYKVL

SEQ ID NO: 890274 - protein, 70 aa, Homo sapiens
YTSSSYRSAEVVALLGPYRTARYRLVPSSKYDCEELHVGIIRLWTVSSKEENLQVLQRWETCVSPFPMLD

SEQ ID NO: 890275 - protein, 129 aa, Homo sapiens
RACAETLGTGGGNCSKSRLALESTRIFEAGAGKRPLDTTLQSSAHFLAEQREAAAASRVPPWPRICPGFFCPCSLARLVLGVRAEADSEVLLPYWDLLVRLSAAPPCIPSSLLYLGALKLAHYESWTRP

SEQ ID NO: 890276 - protein, 400 aa, Homo sapiens
MAANYSSTSTRREHVKVKTSSQPGFLERLSETSGGMFVGLMAFLLSFYLIFTNEGRALKTATSLAEGLSLVVSPDSIHSVAPENEGRLVHIIGALRTSKLLSDPNYGVHLPAVKLRRHVEMYQWVETEESREYTEDGQVKKETRYSYNTEWRSEIINSKNFDREIGHKNPSAMAVESFMATAPFVQIGRFFLSSGLIDKVDNFKSLSLSKLEDPHVDIIRRGDFFYHSENPKYPEVGDLRVSFSYAGLSGDDPDLGPAHVVTVIARQRGDQLVPFSTKSGDTLLLLHHGDFSAEEVFHRELRSNSMKTWGLRAAGWMAMFMGLNLMTRILYTLVDWFPVFRDLVNIGLKAFAFCVATSLTLLTVAAGWLFYRPLWALLIAGLALVPILVARTRVPAKKLE

SEQ ID NO: 890277 - protein, 400 aa, Homo sapiens; identical to SEQ ID NO: 890276

SEQ ID NO: 890278 - protein, 400 aa, Homo sapiens; identical to SEQ ID NO: 890276

SEQ ID NO: 890279 - protein, 400 aa, Homo sapiens; identical to SEQ ID NO: 890276

SEQ ID NO: 890280 - protein, 89 aa, Homo sapiens
RACAETLGTGGGNCSKSRLALESTRIFEAGAGKRPLDTTLQSSAHFLAEQREAAAASRVPPWPRIIPVPVPGENMSKLKPAPSQASWNG

SEQ ID NO: 890281 - protein, 125 aa, Homo sapiens
TGDRVRVLSPGEGAQGPWGWTGQDVCCAWANLDLQEPPGGDPAQHKQPKGTRAAPTPVPISDSFLSPTVPWQWSHSWQQPPLSKLAGFSSRQVSLRPLQRSSCQKHKAPLGPELPVLSLQRAKGT

SEQ ID NO: 890282 - protein, 400 aa, Homo sapiens; identical to SEQ ID NO: 890276

SEQ ID NO: 890283 - protein, 86 aa, Homo sapiens
SPGFLTTLVPSGLIDKVDNFKSLSLSKLEDPHVDIIRRGDFFYHSENPKYPEVGDLRVSFSYAGLSGDDPDLGPAHVVTWLPRGRH

SEQ ID NO: 890284 - protein, 400 aa, Homo sapiens; identical to SEQ ID NO: 890276

SEQ ID NO: 890285 - protein, 400 aa, Homo sapiens; identical to SEQ ID NO: 890276

SEQ ID NO: 890286 - protein, 400 aa, Homo sapiens; identical to SEQ ID NO: 890276

SEQ ID NO: 890287 - protein, 400 aa, Homo sapiens; identical to SEQ ID NO: 890276

SEQ ID NO: 890288 - protein, 75 aa, Homo sapiens
HSLGTGVEVGEEPEGRSRGILDLGLGQLLRSSLSLLLFHPQVGDLRVSFSYAGLSGDDPDLGPAHVVTWLPRGRH

SEQ ID NO: 890289 - protein, 401 aa, Homo sapiens
PGPHADPGPGGGSATSAPPQAPSEPPGPIKAPGRLPGGPPAGVWASLRAATARRRRPGEEVQLGPAGLRRRRPGEEVQLGPAGLQRRRAGAASRRVLPKPAPGPALVRPCPRLAPPGPRALAGSGSCDRSGGVSGRGGGLAGLGGVSAAAGGAAAEREAGQGARLGVEARPTAAALMAGGGAGDPGLGAAAAPAPETREHLFKVLVIGELGVGKTSIIKRYVHQLFSQHYRATIGVDFALKVLNWDSRTLVRLQLWDIAGQERFGNMTRVYYKEAVGAFVVFDISRSSTFEAVLKWKSDLDSKVHLPNGSPIPAVLLANKCDQNKDSSQSPSQVDQFCKEHGFAGWFETSAKDNINIEEAARFLVEKILVNHQSFPNEENDVDKIKLDQETLRAENKSQCC

SEQ ID NO: 890290 - protein, 352 aa, Homo sapiens
PGPHADPGPGGGSATSAPPQAPSEPPGPIKAPGRLPGGPPAGVWASLRAATARRRRPGEEVQLGPAGLRRRRPGEEVQLGPAGLQRRRAGAASRRVLPKPAPGPALVRPCPRLAPPGPRALAGSGSCDRSGGVSGRGGGLAGLGGVSAAAGGAAAEREAGQGARLGVEARPTAAALMAGGGAGDPGLGAAAAPAPETREHLFKVLVIGELGVGKTSIIKRYVHQLFSQHYRATIGVDFALKVLNWDSRTLVRLQLWDIAGKRGREFPTPEPRRAAWLLSASFLFLFCLNSSAWVPLGEERGPIQGRDAMDAVGWTRWGPEDGMGSRSWSRSCTPELALLKGGEEARGPFPEV

SEQ ID NO: 890291 - protein, 281 aa, Homo sapiens
PGPHADPGPGGGSATSAPPQAPSEPPGPIKAPGRLPGGPPAGVWASLRAATARRRRPGEEVQLGPAGLRRRRPGEEVQLGPAGLQRRRAGAASRRVLPKPAPGPALVRPCPRLAPPGPRALAGSGSCDRSGGVSGRGGGLAGLGGVSAAAGGAAAEREAGQGARLGVEARPTAAALMAGGGAGDPGLGAAAAPAPETREHLFKVLVIGELGVGKTSIIKRYVHQLFSQHYRATIGVDFALKSSWLTNVTRTRTVARVLPRWTNSAKNMALPDGLKPLQRIT

SEQ ID NO: 890292 - protein, 286 aa, Homo sapiens
PGPHADPGPGGGSATSAPPQAPSEPPGPIKAPGRLPGGPPAGVWASLRAATARRRRPGEEVQLGPAGLRRRRPGEEVQLGPAGLQRRRAGAASRRVLPKPAPGPALVRPCPRLAPPGPRALAGSGSCDRSGGVSGRGGGLAGLGGVSAAAGGAAAEREAGQGARLGVEARPTAAALMAGGGAGDPGLGAAAAPAPETREHLFKVLVIGELGVGKTSIIKRYVHQLFSQHYRATIGVDFALKVLNWDSRTLVRLQLWDIAGQERFGNMTRVYYMALPDGLKPLQRIT

SEQ ID NO: 890293 - protein, 355 aa, Homo sapiens
PGPHADPGPGGGSATSAPPQAPSEPPGPIKAPGRLPGGPPAGVWASLRAATARRRRPGEEVQLGPAGLRRRRPGEEVQLGPAGLQRRRAGAASRRVLPKPAPGPALVRPCPRLAPPGPRALAGSGSCDRSGGVSGRGGGLAGLGGVSAAAGGAAAEREAGQGARLGVEARPTAAALMAGGGAGDPGLGAAAAPAPETREHLFKVLVIGELGVGKTSIIKRYVHQLFSQHYRATIGVDFALKVLNWDSRTLVRLQLWDIAGQERFGNMTRVYYKEAVGAFVVFDISRSSTFEAVLKWKSDLDSKVHLPNGSPIPAALVCASALKKFLRMGYRCHVSWESSHMWHFKRQHHWAPALI

SEQ ID NO: 890294 - protein, 726 aa, Homo sapiens
APKMASIMEGPLSKWTNVMKGWQYRWFVLDYNAGLLSYYTSKDKMMRGSRRGCVRLRGAVIGIDDEDDSTFTITVDQKTFHFQARDADEREKWIHALEETILRHTLQLQGLDSGFVPSVQDFDKKLTEADAYLQILIEQLKLFDDKLQNCKEDEQRKKIETLKETTNSMVESIKHCIVLLQIAKSTINPVDAIYQPSPLEPVISTMPSQTVLPPEPVQLCKSEQRPSSLPVGPVLATLGHHQTPTPNSTGSGHSPPSSSLTSPSHVNLSPNTVPEFSYSSSEDEFYDADEFHQSGSSPKRLIDSSGSASVLTHSSSGNSLKRPDTTESLNSSLSNGTSDADLFDSHDDRDDDAEAGSVEEHKSVIMHLLSQVRLGMDLTKVVLPTFILERRSLLEMYADFFAHPDLFVSISDQKDPKDRMVQVVKWYLSAFHAGRKGSVAKKPYNPILGEIFQCHWTLPNDTEENTELVSEGPVPWVSKNSVTFVAEQVSHHPPISAFYAECFNKKIQFNAHIWTKSKFLGMSIGVHNIGQGCVSCLDYDEHYILTFPNGYGRSILTVPWVELGGECNINCSKTGYSANIIFHTKPFYGGKKHRITAEIFSPNDKKSFCSIEGEWNGVMYAKYATGENTVFVDTKKLPIIKKKVRKLEDQNEYESRSLWKDVTFNLKIRDIDAATEAKHRLEERQRAEARERKEKEIQWETRLFHEDGECWVYDEPLLKRLGAAKH

SEQ ID NO: 890295 - protein, 626 aa, Homo sapiens
MAFLLATCGGLDSGFVPSVQDFDKKLTEADAYLQILIEQLKLFDDKLQNCKEDEQRKKIETLKETTNSMVESIKHCIVLLQIAKSTINPVDAIYQPSPLEPVISTMPSQTVLPPEPVQLCKSEQRPSSLPVGPVLATLGHHQTPTPNSTGSGHSPPSSSLTSPSHVNLSPNTVPEFSYSSSEDEFYDADEFHQSGSSPKRLIDSSGSASVLTHSSSGNSLKRPDTTESLNSSLSNGTSDADLFDSHDDRDDDAEAGSVEEHKSVIMHLLSQVRLGMDLTKVVLPTFILERRSLLEMYADFFAHPDLFVSISDQKDPKDRMVQVVKWYLSAFHAGRKGSVAKKPYNPILGEIFQCHWTLPNDTEENTELVSEGPVPWVSKNSVTFVAEQVSHHPPISAFYAECFNKKIQFNAHIWTKSKFLGMSIGVHNIGQGCVSCLDYDEHYILTFPNGYGRSILTVPWVELGGECNINCSKTGYSANIIFHTKPFYGGKKHRITAEIFSPNDKKSFCSIEGEWNGVMYAKYATGENTVFVDTKKLPIIKKKVRKLEDQNEYESRSLWKDVTFNLKIRDIDAATEAKHRLEERQRAEARERKEKEIQWETRLFHEDGECWVYDEPLLKRLGAAKH

SEQ ID NO: 890296 - protein, 558 aa, Homo sapiens
MVESIKHCIVLLQIAKSTINPVDAIYQPSPLEPVISTMPSQTVLPPEPVQLCKSEQRPSSLPVGPVLATLGHHQTPTPNSTGSGHSPPSSSLTSPSHVNLSPNTVPEFSYSSSEDEFYDADEFHQSGSSPKRLIDSSGSASVLTHSSSGNSLKRPDTTESLNSSLSNGTSDADLFDSHDDRDDDAEAGSVEEHKSVIMHLLSQVRLGMDLTKVVLPTFILERRSLLEMYADFFAHPDLFVSISDQKDPKDRMVQVVKWYLSAFHAGRKGSVAKKPYNPILGEIFQCHWTLPNDTEENTELVSEGPVPWVSKNSVTFVAEQVSHHPPISAFYAECFNKKIQFNAHIWTKSKFLGMSIGVHNIGQGCVSCLDYDEHYILTFPNGYGRSILTVPWVELGGECNINCSKTGYSANIIFHTKPFYGGKKHRITAEIFSPNDKKSFCSIEGEWNGVMYAKYATGENTVFVDTKKLPIIKKKVRKLEDQNEYESRSLWKDVTFNLKIRDIDAATEAKHRLEERQRAEARERKEKEIQWETRLFHEDGECWVYDEPLLKRLGAAKH

SEQ ID NO: 890297 - protein, 571 aa, Homo sapiens
MVESIKHCIVLLQIAKDQSNAEKHADGMISTINPVDAIYQPSPLEPVISTMPSQTVLPPEPVQLCKSEQRPSSLPVGPVLATLGHHQTPTPNSTGSGHSPPSSSLTSPSHVNLSPNTVPEFSYSSSEDEFYDADEFHQSGSSPKRLIDSSGSASVLTHSSSGNSLKRPDTTESLNSSLSNGTSDADLFDSHDDRDDDAEAGSVEEHKSVIMHLLSQVRLGMDLTKVVLPTFILERRSLLEMYADFFAHPDLFVSISDQKDPKDRMVQVVKWYLSAFHAGRKGSVAKKPYNPILGEIFQCHWTLPNDTEENTELVSEGPVPWVSKNSVTFVAEQVSHHPPISAFYAECFNKKIQFNAHIWTKSKFLGMSIGVHNIGQGCVSCLDYDEHYILTFPNGYGRSILTVPWVELGGECNINCSKTGYSANIIFHTKPFYGGKKHRITAEIFSPNDKKSFCSIEGEWNGVMYAKYATGENTVFVDTKKLPIIKKKVRKLEDQNEYESRSLWKDVTFNLKIRDIDAATEAKHRLEERQRAEARERKEKEIQWETRLFHEDGECWVYDEPLLKRLGAAKH

SEQ ID NO: 890298 - protein, 558 aa, Homo sapiens; identical to SEQ ID NO: 890296

SEQ ID NO: 890299 - protein, 739 aa, Homo sapiens
APKMASIMEGPLSKWTNVMKGWQYRWFVLDYNAGLLSYYTSKDKMMRGSRRGCVRLRGAVIGIDDEDDSTFTITVDQKTFHFQARDADEREKWIHALEETILRHTLQLQGLDSGFVPSVQDFDKKLTEADAYLQILIEQLKLFDDKLQNCKEDEQRKKIETLKETTNSMVESIKHCIVLLQIAKDQSNAEKHADGMISTINPVDAIYQPSPLEPVISTMPSQTVLPPEPVQLCKSEQRPSSLPVGPVLATLGHHQTPTPNSTGSGHSPPSSSLTSPSHVNLSPNTVPEFSYSSSEDEFYDADEFHQSGSSPKRLIDSSGSASVLTHSSSGNSLKRPDTTESLNSSLSNGTSDADLFDSHDDRDDDAEAGSVEEHKSVIMHLLSQVRLGMDLTKVVLPTFILERRSLLEMYADFFAHPDLFVSISDQKDPKDRMVQVVKWYLSAFHAGRKGSVAKKPYNPILGEIFQCHWTLPNDTEENTELVSEGPVPWVSKNSVTFVAEQVSHHPPISAFYAECFNKKIQFNAHIWTKSKFLGMSIGVHNIGQGCVSCLDYDEHYILTFPNGYGRSILTVPWVELGGECNINCSKTGYSANIIFHTKPFYGGKKHRITAEIFSPNDKKSFCSIEGEWNGVMYAKYATGENTVFVDTKKLPIIKKKVRKLEDQNEYESRSLWKDVTFNLKIRDIDAATEAKHRLEERQRAEARERKEKEIQWETRLFHEDGECWVYDEPLLKRLGAAKH

SEQ ID NO: 890300 - protein, 571 aa, Homo sapiens; identical to SEQ ID NO: 890297

SEQ ID NO: 890301 - protein, 725 aa, Homo sapiens
VRARCILMDALSKWTNVMKGWQYRWFVLDYNAGLLSYYTSKDKMMRGSRRGCVRLRGAVIGIDDEDDSTFTITVDQKTFHFQARDADEREKWIHALEETILRHTLQLQGLDSGFVPSVQDFDKKLTEADAYLQILIEQLKLFDDKLQNCKEDEQRKKIETLKETTNSMVESIKHCIVLLQIAKSTINPVDAIYQPSPLEPVISTMPSQTVLPPEPVQLCKSEQRPSSLPVGPVLATLGHHQTPTPNSTGSGHSPPSSSLTSPSHVNLSPNTVPEFSYSSSEDEFYDADEFHQSGSSPKRLIDSSGSASVLTHSSSGNSLKRPDTTESLNSSLSNGTSDADLFDSHDDRDDDAEAGSVEEHKSVIMHLLSQVRLGMDLTKVVLPTFILERRSLLEMYADFFAHPDLFVSISDQKDPKDRMVQVVKWYLSAFHAGRKGSVAKKPYNPILGEIFQCHWTLPNDTEENTELVSEGPVPWVSKNSVTFVAEQVSHHPPISAFYAECFNKKIQFNAHIWTKSKFLGMSIGVHNIGQGCVSCLDYDEHYILTFPNGYGRSILTVPWVELGGECNINCSKTGYSANIIFHTKPFYGGKKHRITAEIFSPNDKKSFCSIEGEWNGVMYAKYATGENTVFVDTKKLPIIKKKVRKLEDQNEYESRSLWKDVTFNLKIRDIDAATEAKHRLEERQRAEARERKEKEIQWETRLFHEDGECWVYDEPLLKRLGAAKH

SEQ ID NO: 890302 - protein, 640 aa, Homo sapiens
PRDRRPTRSQGLDSGFVPSVQDFDKKLTEADAYLQILIEQLKLFDDKLQNCKEDEQRKKIETLKETTNSMVESIKHCIVLLQIAKDQSNAEKHADGMISTINPVDAIYQPSPLEPVISTMPSQTVLPPEPVQLCKSEQRPSSLPVGPVLATLGHHQTPTPNSTGSGHSPPSSSLTSPSHVNLSPNTVPEFSYSSSEDEFYDADEFHQSGSSPKRLIDSSGSASVLTHSSSGNSLKRPDTTESLNSSLSNGTSDADLFDSHDDRDDDAEAGSVEEHKSVIMHLLSQVRLGMDLTKVVLPTFILERRSLLEMYADFFAHPDLFVSISDQKDPKDRMVQVVKWYLSAFHAGRKGSVAKKPYNPILGEIFQCHWTLPNDTEENTELVSEGPVPWVSKNSVTFVAEQVSHHPPISAFYAECFNKKIQFNAHIWTKSKFLGMSIGVHNIGQGCVSCLDYDEHYILTFPNGYGRSILTVPWVELGGECNINCSKTGYSANIIFHTKPFYGGKKHRITAEIFSPNDKKSFCSIEGEWNGVMYAKYATGENTVFVDTKKLPIIKKKVRKLEDQNEYESRSLWKDVTFNLKIRDIDAATEAKHRLEERQRAEARERKEKEIQWETRLFHEDGECWVYDEPLLKRLGAAKH

SEQ ID NO: 890303 - protein, 361 aa, Homo sapiens
MHLLSQVRLGMDLTKVVLPTFILERRSLLEMYADFFAHPDLFVSISDQKDPKDRMVQVVKWYLSAFHAGRKGSVAKKPYNPILGEIFQCHWTLPNDTEENTELVSEGPVPWVSKNSVTFVAEQVSHHPPISAFYAECFNKKIQFNAHIWTKSKFLGMSIGVHNIGQGCVSCLDYDEHYILTFPNGYGRSILTVPWVELGGECNINCSKTGYSANIIFHTKPFYGGKKHRITAEIFSPNDKKSFCSIEGEWNGVMYAKYATGENTVFVDTKKLPIIKKKVRKLEDQNEYESRSLWKDVTFNLKIRDIDAATEAKHRLEERQRAEARERKEKEIQWETRLFHEDGECWVYDEPLLKRLGAAKH

SEQ ID NO: 890304 - protein, 571 aa, Homo sapiens; identical to SEQ ID NO: 890297

SEQ ID NO: 890305 - protein, 571 aa, Homo sapiens; identical to SEQ ID NO: 890297

SEQ ID NO: 890306 - protein, 571 aa, Homo sapiens; identical to SEQ ID NO: 890297

SEQ ID NO: 890307 - protein, 214 aa, Homo sapiens
ESLVATWHYSSEILSLLSTGCVSCLDYDEHYILTFPNGYGRSILTVPWVELGGECNINCSKTGYSANIIFHTKPFYGGKKHRITAEIFSPNDKKSFCSIEGEWNGVMYAKYATGENTVFVDTKKLPIIKKKVRKLEDQNEYESRSLWKDVTFNLKIRDIDAATEAKHRLEERQRAEARERKEKEIQWETRLFHEDGECWVYDEPLLKRLGAAKH

SEQ ID NO: 890308 - protein, 348 aa, Homo sapiens
MVESIKHCIVLLQIAKDQSNAEKHADGMISTINPVDAIYQPSPLEPVISTMPSQTVLPPEPVQLCKSEQRPSSLPVGPVLATLGHHQTPTPNSTGSGHSPPSSSLTSPSHVNLSPNTVPEFSYSSSEDEFYDADEFHQSGSSPKRLIDSSGSASVLTHSSSGNSLKRPDTTESLNSSLSNGTSDADLFDSHDDRDDDAEAGSVEEHKSVIMHLLSQVRLGMDLTKVVLPTFILERRSLLEMYADFFAHPDLFVSISDQKDPKDRMVQVVKWYLSAFHAGRKGSVAKKPYNPILGEIFQCHWTLPNDTEENTELVSEGPVPWVSKNSVTFGPDMSIELYLLVKTLSIKG

SEQ ID NO: 890309 - protein, 200 aa, Homo sapiens
VRARCILMDALSKWTNVMKGWQYRWFVLDYNAGLLSYYTSKDKMMRGSRRGCVRLRGAVIGIDDEDDSTFTITVDQKTFHFQARDADEREKWIHALEETILRHTLQLQGLDSGFVPSVQDFDKKLTEADAYLQILIEQLKLFDDKLQNCKEDEQRKKIETLKETTNSMVESIKHCIVLLQIAKDQSNAEKHADGMIVSLM

SEQ ID NO: 890310 - protein, 284 aa, Homo sapiens
GLGGARAPAPAQLRRPQVPKRVRAAAARAPRTAAPGPGPPPTSALLPRLGQAPKARTKQLSGNLRRSRIYVQLPATTGSKMVCGGFACSKNCLCALNLLYTLVSLLLIGIAAWGIGFGLISSLRVVGVVIAVGIFLFLIALVGLIGAVKHHQVLLFFYMIILLLVFIVQFSVSCACLALNQEQQGQLLEVGWNNTASARNDIQRNLNCCGFRSVNPNDTCLASCVKSDHSCSPCAPIIGEYAGEVLRFVGGIGLFFSFTEILGVWLTYRYRNQKDPRANPSAFL

SEQ ID NO: 890311 - protein, 284 aa, Homo sapiens; identical to SEQ ID NO: 890310

SEQ ID NO: 890312 - protein, 284 aa, Homo sapiens; identical to SEQ ID NO: 890310

SEQ ID NO: 890313 - protein, 262 aa, Homo sapiens
RRFKRVERGARGMARAASTTSALLPRLGQAPKARTKQLSGNLRRSRIYVQLPATTGSKMVCGGFACSKNCLCALNLLYTLVSLLLIGIAAWGIGFGLISSLRVVGVVIAVGIFLFLIALVGLIGAVKHHQVLLFFYMIILLLVFIVQFSVSCACLALNQEQQGQLLEVGWNNTASARNDIQRNLNCCGFRSVNPNDTCLASCVKSDHSCSPCAPIIGEYAGEVLRFVGGIGLFFSFTEILGVWLTYRYRNQKDPRANPSAFL

SEQ ID NO: 890314 - protein, 299 aa, Homo sapiens
ISSEPRPPSSPAPGETTPRPPLWPGAPSHTALALSPSPRDRSAPPGSRSAERIYLHISTFVPRLGQAPKARTKQLSGNLRRSRIYVQLPATTGSKMVCGGFACSKNCLCALNLLYTLVSLLLIGIAAWGIGFGLISSLRVVGVVIAVGIFLFLIALVGLIGAVKHHQVLLFFYMIILLLVFIVQFSVSCACLALNQEQQGQLLEVGWNNTASARNDIQRNLNCCGFRSVNPNDTCLASCVKSDHSCSPCAPIIGEYAGEVLRFVGGIGLFFSFTEILGVWLTYRYRNQKDPRANPSAFL

SEQ ID NO: 890315 - protein, 506 aa, Homo sapiens
MALIPDLAMETWLLLAVSLVLLYLYGTHSHGLFKKLGIPGPTPLPFLGNILSYHKGFCMFDMECHKKYGKVWGFYDGQQPVLAITDPDMIKTVLVKECYSVFTNRRPFGPVGFMKSAISIAEDEEWKRLRSLLSPTFTSGKLKEMVPIIAQYGDVLVRNLRREAETGKPVTLKDVFGAYSMDVITSTSFGVNIDSLNNPQDPFVENTKKLLRFDFLDPFFLSITVFPFLIPILEVLNICVFPREVTNFLRKSVKRMKESRLEDTQKHRVDFLQLMIDSQNSKETESHKALSDLELVAQSIIFIFAGYETTSSVLSFIMYELATHPDVQQKLQEEIDAVLPNKAPPTYDTVLQMEYLDMVVNETLRLFPIAMRLERVCKKDVEINGMFIPKGVGGDDSNPSYALHRDPKYWTEPEKFLPERFSKKNKDNIDPYIYTPFGSGPRNCIGMRFALMNMKLALIRVLQNFSFKPCKETQIPLKLRLRQGLLQPEKPVVLKVESRDGTVSGA

SEQ ID NO: 890316 - protein, 102 aa, Homo sapiens
MYELATHPDVQQKLQEEIDAVLPNKAPPTYDTVLQMEYLDMVVNETLRLFPIAMRLERVCKNPSYALHRDPKYWTEPEKFLPERYKAPGKGALPEPAWFKHI

SEQ ID NO: 890317 - protein, 165 aa, Homo sapiens
MDVITGTSFGVNIDSLNNPQDPFVESTKKFLKFGFLDPLFLSIILFPFLTPVFEALNVSLFPKDTINFLSKSVNRMKKSRLNDKQKHRLDFLQLMIDSQNSKETESHKALSDLELAAQSIIFIFAGYETTSSVLSFTLYELATHPDVQQKLQKEIDAVLPNKVRG

SEQ ID NO: 890318 - protein, 165 aa, Homo sapiens; identical to SEQ ID NO: 890317

SEQ ID NO: 890319 - protein, 506 aa, Homo sapiens; identical to SEQ ID NO: 890315

SEQ ID NO: 890320 - protein, 506 aa, Homo sapiens; identical to SEQ ID NO: 890315

SEQ ID NO: 890321 - protein, 506 aa, Homo sapiens; identical to SEQ ID NO: 890315

SEQ ID NO: 890322 - protein, 506 aa, Homo sapiens; identical to SEQ ID NO: 890315

SEQ ID NO: 890323 - protein, 506 aa, Homo sapiens; identical to SEQ ID NO: 890315

SEQ ID NO: 890324 - protein, 506 aa, Homo sapiens; identical to SEQ ID NO: 890315

SEQ ID NO: 890325 - protein, 506 aa, Homo sapiens; identical to SEQ ID NO: 890315

SEQ ID NO: 890326 - protein, 506 aa, Homo sapiens; identical to SEQ ID NO: 890315

SEQ ID NO: 890327 - protein, 506 aa, Homo sapiens; identical to SEQ ID NO: 890315

SEQ ID NO: 890328 - protein, 493 aa, Homo sapiens
MALIPDLAMETWLLLAVSLVLLYLYGTHSHGLFKKLGIPGPTPLPFLGNILSYHKGFCMFDMECHKKYGKVWGFYDGQQPVLAITDPDMIKTVLVKECYSVFTNRRPFGPVGFMKSAISIAEDEEWKRLRSLLSPTFTSGKLKERNLRREAETGKPVTLKDVFGAYSMDVITSTSFGVNIDSLNNPQDPFVENTKKLLRFDFLDPFFLSITVFPFLIPILEVLNICVFPREVTNFLRKSVKRMKESRLEDTQKHRVDFLQLMIDSQNSKETESHKALSDLELVAQSIIFIFAGYETTSSVLSFIMYELATHPDVQQKLQEEIDAVLPNKAPPTYDTVLQMEYLDMVVNETLRLFPIAMRLERVCKKDVEINGMFIPKGVGGDDSNPSYALHRDPKYWTEPEKFLPERFSKKNKDNIDPYIYTPFGSGPRNCIGMRFALMNMKLALIRVLQNFSFKPCKETQIPLKLRLRQGLLQPEKPVVLKVESRDGTVSGA

SEQ ID NO: 890329 - protein, 488 aa, Homo sapiens
MALIPDLAMETWLLLAVSLVLLYLYGTHSHGLFKKLGIPGPTPLPFLGNILSYHKGFCMFDMECHKKYGKVWGFYDGQQPVLAITDPDMIKTVLVKECYSVFTNRRPFGPVGFMKSAISIAEDEEWKRLRSLLSPTFTSGKLKEMVPIIAQYGDVLVRNLRREAETGKPVTLKDVFGAYSMDVITSTSFGVNIDSLNNPQDPFVETVFPFLIPILEVLNICVFPREVTNFLRKSVKRMKESRLEDTQKHRVDFLQLMIDSQNSKETESHKALSDLELVAQSIIFIFAGYETTSSVLSFIMYELATHPDVQQKLQEEIDAVLPNKAPPTYDTVLQMEYLDMVVNETLRLFPIAMRLERVCKKDVEINGMFIPKGVGGDDSNPSYALHRDPKYWTEPEKFLPERFSKKNKDNIDPYIYTPFGSGPRNCIGMRFALMNMKLALIRVLQNFSFKPCKETQIPLKLRLRQGLLQPEKPVVLKVESRDGTVSGA

SEQ ID NO: 890330 - protein, 307 aa, Homo sapiens
SVNVSNDVDKRGLSLHRLSYLPPLPVFPFLIPILEVLNICVFPREVTNFLRKSVKRMKESRLEDTQKHRVDFLQLMIDSQNSKETESHKALSDLELVAQSIIFIFAGYETTSSVLSFIMYELATHPDVQQKLQEEIDAVLPNKAPPTYDTVLQMEYLDMVVNETLRLFPIAMRLERVCKKDVEINGMFIPKGVGGDDSNPSYALHRDPKYWTEPEKFLPERFSKKNKDNIDPYIYTPFGSGPRNCIGMRFALMNMKLALIRVLQNFSFKPCKETQIPLKLRLRQGLLQPEKPVVLKVESRDGTVSGA

SEQ ID NO: 890331 - protein, 506 aa, Homo sapiens; identical to SEQ ID NO: 890315

SEQ ID NO: 890332 - protein, 491 aa, Homo sapiens
MALIPDLAMETWLLLAVSLVLLYLYGTHSHGLFKKLGIPGPTPLPFLGNILSYHKGFCMFDMECHKKYGKVWGFYDGQQPVLAITDPDMIKTVLVKECYSVFTNRRPFGPVGFMKSAISIAEDEEWKRLRSLLSPTFTSGKLKERNLRREAETGKPVTLKDVFGAYSMDVITSTSFGVNIDSLNNPQDPFVENTKKLLRFDFLDPFFLSITVFPFLIPILEVLNICVFPREVTNFLRKSVKRMKESRLEDTQKHRVDFLQLMIDSQNSKETESHKALSDLELVAQSIIFIFAGYETTSSVLSFIMYELATHPDVQQKLQEEIDAVLPNKAPPTYDTVLQMEYLDMVVNETLRLFPIAMRLERVCKKDVEINGMFIPKGVGGDDSNPSYALHRDPKYWTEPEKFLPERFSKKNKDNIDPYIYTPFGSGPRNCIGMRFALMNMKLALIRVLQNFSFKPCKETQIPLKLRLRQGLLQPEIIPKDFCFALQEICA

SEQ ID NO: 890333 - protein, 474 aa, Homo sapiens
MALIPDLAMETWLLLAVSLVLLYLYGTHSHGLFKKLGIPGPTPLPFLGNILSYHKGFCMFDMECHKKYGKVWGFYDGQQPVLAITDPDMIKTVLVKECYSVFTNRRPFGPVGFMKSAISIAEDEEWKRLRSLLSPTFTSGKLKERNLRREAETGKPVTLKDVFGAYSMDVITSTSFGVNIDSLNNPQDPFVENTKKLLRFDFLDPFFLSITVFPFLIPILEVLNICVFPREVTNFLRKSVKRMKESRLEDTQKHRVDFLQLMIDSQNSKETESHKALSDLELVAQSIIFIFAGYETTSSVLSFIMYELATHPDVQQKLQEEIDAVLPNKAPPTYDTVLQMEYLDMVVNETLRLFPIAMRLERVCKNPSYALHRDPKYWTEPEKFLPERFSKKNKDNIDPYIYTPFGSGPRNCIGMRFALMNMKLALIRVLQNFSFKPCKETQIPLKLRLRQGLLQPEKPVVLKVESRDGTVSGA

SEQ ID NO: 890334 - protein, 475 aa, Homo sapiens
MALIPDLAMETWLLLAVSLVLLYLYGTHSHGLFKKLGIPGPTPLPFLGNILSYHKGFCMFDMECHKKYGKVWGFYDGQQPVLAITDPDMIKTVLVKECYSVFTNRRPFGPVGFMKSAISIAEDEEWKRLRSLLSPTFTSGKLKERNLRREAETGKPVTLKDVFGAYSMDVITSTSFGVNIDSLNNPQDPFVENTKKLLRFDFLDPFFLSITVFPFLIPILEVLNICVFPREVTNFLRKSVKRMKESRLEDTQKHRVDFLQLMIDSQNSIIFIFAGYETTSSVLSFIMYELATHPDVQQKLQEEIDAVLPNKAPPTYDTVLQMEYLDMVVNETLRLFPIAMRLERVCKKDVEINGMFIPKGVGGDDSNPSYALHRDPKYWTEPEKFLPERFSKKNKDNIDPYIYTPFGSGPRNCIGMRFALMNMKLALIRVLQNFSFKPCKETQIPLKLRLRQGLLQPEKPVVLKVESRDGTVSGA

SEQ ID NO: 890335 - protein, 491 aa, Homo sapiens; identical to SEQ ID NO: 890332

SEQ ID NO: 890336 - protein, 463 aa, Homo sapiens
MALIPDLAMETWLLLAVSLVLLYLYGTHSHGLFKKLGIPGPTPLPFLGNILSYHKGFCMFDMECHKKYGKVWGFYDGQQPVLAITDPDMIKTVLVKECYSVFTNRRPFGPVGFMKSAISIAEDEEWKRLRSLLSPTFTSGKLKERNLRREAETGKPVTLKDVFGAYSMDVITSTSFGVNIDSLNNPQDPFVENTKKLLRFDFLDPFFLSITVFPFLIPILEVLNICVFPREVTNFLRKSVKRMKESRLEDTQKHRVDFLQLMIDSQNSKETESHKALSDLELVAQSIIFIFAGYETTSSVLSFIMYELATHPDVQQKLQEEIDAVLPNKAPPTYDTVLQMEYLDMVVNETLRLFPIAMRLERVCKKDVEINGMFIPKGVGGDDSNPSYALHRDPKYWTEPEKFLPERFSKKNKDNIDPYIYTPFGSGPRNCIGMRFALMNMKLALIRVLQNFSFKPCKETQSS

SEQ ID NO: 890337 - protein, 337 aa, Homo sapiens
MALIPDLAMETWLLLAVSLVLLYLYGTHSHGLFKKLGIPGPTPLPFLGNILSYHKGFCMFDMECHKKYGKVWGFYDGQQPVLAITDPDMIKTVLVKECYSVFTNRRPFGPVGFMKSAISIAEDEEWKRLRSLLSPTFTSGKLKERNLRREAETGKPVTLKDVFGAYSMDVITSTSFGVNIDSLNNPQDPFVENTKKLLRFDFLDPFFLSITVFPFLIPILEVLNICVFPREVTNFLRKSVKRMKESRLEDTQKHRVDFLQLMIDSQNSKETESHKALSDLELVAQSIIFIFAGYETTSSVLSFIMYELATHPDVQQKLQEEIDAVLPNKIIPNCYET

SEQ ID NO: 890338 - protein, 397 aa, Homo sapiens
MALIPDLAMETWLLLAVSLVLLYLYGTHSHGLFKKLGIPGPTPLPFLGNILSYHKGFCMFDMECHKKYGKVWGFYDGQQPVLAITDPDMIKTVLVKECYSVFTNRRPFGPVGFMKSAISIAEDEEWKRLRSLLSPTFTSGKLKERNLRREAETGKPVTLKDVFGAYSMDVITSTSFGVNIDSLNNPQDPFVENTKKLLRFDFLDPFFLSITVFPFLIPILEVLNICVFPREVTNFLRKSVKRMKESRLEDTQKHRVDFLQLMIDSQNSKETESHKALSDLELVAQSIIFIFAGYETTSSVLSFIMYELATHPDVQQKLQEEIDAVLPNKAPPTYDTVLQMDLPTWNQIQQEEQGQHRSLHIHTLWKWTQKLHWHEVCSHEHETCSNQSPSELLLQTL

SEQ ID NO: 890339 - protein, 489 aa, Homo sapiens
MALIPDLAMETWLLLAVSLVLLYLYGTHSHGLFKKLGIPGPTPLPFLGNILSYHKGFCMFDMECHKKYGKVWGFYDGQQPVLAITDPDMIKTVLVKECYSVFTNRRPFGPVGFMKSAISIAEDEEWKRLRSLLSPTFTSGKLKERNLRREAETGKPVTLKDVFGAYSMDVITSTSFGVNIDSLNNPQDPFVENTKKLLRFDFLDPFFLSITVFPFLIPILEVLNICVFPREVTNFLRKSVKRMKESRLEDTQKHRVDFLQLMIDSQNSKETESHKALSDLELVAQSIIFIFAGYETTSSVLSFIMYELATHPDVQQKLQEEIDAVLPNKAPPTYDAVVQMEYLDMVVNETLRLFPVAIRLERTCKKDVEINGVFIPKGSMVVIPTYALHHDPKYWTEPEEFRPERFSKKKDSIDPYIYTPFGTGPRNCIGMRFALMNMKLALIRVLQNFSFKPCKETQIPLKLDTQGLLQPEKPIVLKVDSRDGTLSGE

SEQ ID NO: 890340 - protein, 489 aa, Homo sapiens; identical to SEQ ID NO: 890339

SEQ ID NO: 890341 - protein, 393 aa, Homo sapiens
MALIPDLAMETWLLLAVSLVLLYLYGTHSHGLFKKLGIPGPTPLPFLGNILSYHKGFCMFDMECHKKYGKVWGFYDGQQPVLAITDPDMIKTVLVKECYSVFTNRRPFGPVGFMKSAISIAEDEEWKRLRSLLSPTFTSGKLKERNLRREAETGKPVTLKDVFGAYSMDVITSTSFGVNIDSLNNPQDPFVENTKKLLRFDFLDPFFLSITVFPFLIPILEVLNICVFPREVTNFLRKSVKRMKESRLEDTQKHRVDFLQLMIDSQNSKETESHKALSDLELVAQSIIFIFAGYETTSSVLSFIMYELATHPDVQQKLQEEIDAVLPNKAPPTYDTVLQMEYLDMVVNETLRLFPIAMRLERVCKKDVEINGMFIPKGVGGDDSNFALQEICA

SEQ ID NO: 890342 - protein, 207 aa, Homo sapiens
SVNVSNDVDKRGLSLHRLSYLPPLPVFPFLIPILEVLNICVFPREVTNFLRKSVKRMKESRLEDTQKHRVDFLQLMIDSQNSKETESHKALSDLELVAQSIIFIFAGYETTSSVLSFIMYELATHPDVQQKLQEEIDAVLPNKAPPTYDTVLQMEYLDMVVNETLRLFPIAMRLERVCKKDVEINGMFIPKGVGGDDSNFALQEICA

SEQ ID NO: 890343 - protein, 471 aa, Homo sapiens
MALIPDLAMETWLLLAVSLVLLYLYGTHSHGLFKKLGIPGPTPLPFLGNILSYHKGFCMFDMECHKKYGKVWGFYDGQQPVLAITDPDMIKTVLVKECYSVFTNRRPFGPVGFMKSAISIAEDEEWKRLRSLLSPTFTSGKLKERNLRREAETGKPVTLKDVFGAYSMDVITSTSFGVNIDSLNNPQDPFVENTKKLLRFDFLDPFFLSITVFPFLIPILEVLNICVFPREVTNFLRKSVKRMKESRLEDTQKHRVDFLQLMIDSQNSIIFIFAGYETTSSVLSFIMYELATHPDVQQKLQEEIDAVLPNKAPPTYDAVVQMEYLDMVVNETLRLFPVAIRLERTCKKDVEINGVFIPKGSMVVIPTYALHHDPKYWTEPEEFRPERFSKKKDSIDPYIYTPFGTGPRNCIGMRFALMNMKLALIRVLQNFSFKPCKETQIPLKLDTQGLLQPEKPIVLKVDSRDGTLSGE

SEQ ID NO: 890344 - protein, 443 aa, Homo sapiens
GTAKAPARPGSEARGCMEWPARLCGLWALLLCAGGGGGGGGAAPTETQPPVTNLSVSVENLCTVIWTWNPPEGASSNCSLWYFSHFGDKQDKKIAPETRRSIEVPLNERICLQVGSQCSTNESEKPSILVEKCISPPEGDPESAVTELQCIWHNLSYMKCSWLPGRNTSPDTNYTLYYWHRSLEKIHQCENIFREGQYFGCSFDLTKVKDSSFEQHSVQIMVKDNAGKIKPSFNIVPLTSRVKPDPPHIKNLSFHNDDLYVQWENPQNFISRCLFYEVEVNNSQTETHNVFYVQEAKCENPEFERNVENTSCFMVPGVLPDTLNTVRIRVKTNKLCYEDDKLWSNWSQEMSIGKKRNSTLYITMLLIVPVIVAGAIIVLLLYLKRLKIIIFPPIPDPGKIFKEMFGDQNDDTLHWKKYDIYEKQTKEETDSVVLIENLKKASQ

SEQ ID NO: 890345 - protein, 443 aa, Homo sapiens; identical to SEQ ID NO: 890344

SEQ ID NO: 890346 - protein, 295 aa, Homo sapiens
GTAKAPARPGSEARGCMEWPARLCGLWALLLCAGGGGGGGGAAPTETQPPVTNLSVSVENLCTVIWTWNPPEGASSNCSLWYFSHFGDKQDKKIAPETRRSIEVPLNERICLQVGSQCSTNESEKPSILVEKCISPPEGDPESAVTELQCIWHNLSYMKCSWLPGRNTSPDTNYTLYYWHRSLEKIHQCENIFREGQYFGCSFDLTKVKDSSFEQHSVQIMVKDNAGKIKPSFNIVPLTSRVKPDPPHIKNLSFHNDDLYVQWENPQNFISRCLFYEVEVNNSQTETHNVFYVRF

SEQ ID NO: 890347 - protein, 70 aa, Homo sapiens
LITGSVATSAKYFDAGGDSDDYGSGECLETRMMISGNKPSGLPESIRDLKITKSPHPDSEKPDPSPFLIG

SEQ ID NO: 890348 - protein, 443 aa, Homo sapiens; identical to SEQ ID NO: 890344

SEQ ID NO: 890349 - protein, 443 aa, Homo sapiens; identical to SEQ ID NO: 890344

SEQ ID NO: 890350 - protein, 443 aa, Homo sapiens; identical to SEQ ID NO: 890344

SEQ ID NO: 890351 - protein, 443 aa, Homo sapiens; identical to SEQ ID NO: 890344

SEQ ID NO: 890352 - protein, 256 aa, Homo sapiens
GTAKAPARPGSEARGCMEWPARLCGLWALLLCAGGGGGGGGAAPTETQPPVTNLSVSVENLCTVIWTWNPPEGASSNCSLWYFSHFGDKQDKKIAPETRRSIEVPLNERICLQVGSQCSTNESEKPSILVEKCISPPEGDPESAVTELQCIWHNLSYMKCSWLPGRNTSPDTNYTLYYWHRSLEKIHQCENIFREGQYFGCSFDLTKVKDSSFEQHSVQIMVKDNAGKIKPSFNIVPLTSRGPTSPYCHIGDEVST

SEQ ID NO: 890353 - protein, 443 aa, Homo sapiens; identical to SEQ ID NO: 890344

SEQ ID NO: 890354 - protein, 443 aa, Homo sapiens; identical to SEQ ID NO: 890344

SEQ ID NO: 890355 - protein, 426 aa, Homo sapiens
GTAKAPARPGSEARGCMEWPARLCGLWALLLCAGGGGGGGGAAPTETQPPVTNLSVSVENLCTVIWTWNPPEGASSNCSLWYFSHFGDKQDKKIAPETRRSIEVPLNERICLQVGSQCSTNESEKPSILVEKCISPPEGDPESAVTELQCIWHNLSYMKCSWLPGRNTSPDTNYTLYYWHRSLEKIHQCENIFREGQYFGCSFDLTKVKDSSFEQHSVQIMVKDNAGKIKPSFNIVPLTSRVKPDPPHIKNLSFHNDDLYVQWENPQNFISRCLFYEVEVNNSQTETHNVFYVQEAKCENPEFERNVENTSCFMVPGVLPDTLNTVRIRVKTNKLCYEDDKLWSNWSQEMSIGKKRNSTLYITMLLIVPVIVAGAIIVLLLYLKRLKIIIFPPIPDPGKIFKEMFGDQNDDTLETNHQASQKVSGI

SEQ ID NO: 890356 - protein, 444 aa, Homo sapiens
GTAKAPARPGSEARGCMEWPARLCGLWALLLCAGGGGGGGGAAPTETQPPVTNLSVSVENLCTVIWTWNPPEGASSNCSLWYFSHFGDKQDKKIAPETRRSIEVPLNERICLQVGSQCSTNESEKPSILVEKCISPPEGDPESAVTELQCIWHNLSYMKCSWLPGRNTSPDTNYTLYYWHRSLEKIHQCENIFREGQYFGCSFDLTKVKDSSFEQHSVQIMVKDNAGKIKPSFNIVPLTSRVKPDPPHIKNLSFHNDDLYVQWENPQNFISRCLFYEVEVNNSQTETHNVFYVQEAKCENPEFERNVENTSCFMVPGVLPDTLNTVRIRVKTNKLCYEDDKLWSNWSQEMSIGKKRNSTLYITMLLIVPVIVAGAIIVLLLYLKRLKIIIFPPIPDPGKIFKEMFGDQNDDTLPWKKISLIRLREVKLLVQGHTIHSFFSLILP

SEQ ID NO: 890357 - protein, 369 aa, Homo sapiens
GTAKAPARPGSEARGCMEWPARLCGLWALLLCAGGGGGGGGAAPTETQPPVTNLSVSVENLCTVIWTWNPPEGASSNCSLWYFSHFGDKQDKKIAPETRRSIEVPLNERICLQVGSQCSTNESEKPSILVEKCISPPEGDPESAVTELQCIWHNLSYMKCSWLPGRNTSPDTNYTLYYWHRSLEKIHQCENIFREGQYFGCSFDLTKVKDSSFEQHSVQIMVKDNAGKIKPSFNIVPLTSRVKPDPPHIKNLSFHNDDLYVQWENPQNFISRCLFYEVEVNNSQTETHNVFYVQEAKCENPEFERNVENTSCFMVPGVLPDTLNTVRIRVKTNKLCYEDDKLWSNWSQEMSIGKRTEFLLKFKTLMYKN

SEQ ID NO: 890358 - protein, 549 aa, Homo sapiens [sequence omitted]

SEQ ID NO: 890359 - protein, 549 aa, Homo sapiens [sequence omitted]

SEQ ID NO: 890360 - protein, 549 aa, Homo sapiens [sequence omitted]

SEQ ID NO: 890361 - protein, 397 aa, Homo sapiens
MMVKDEYVHDFEGQPSLSTEGHSIQTIQHPPSNRASTETYSTPALLAPSESNATSTANFPNIPVASTSQPASILGGSHSEGLLQIASGPQPGQQQNGFTGQPATYHHNSTTTWTGSRTAPYTPNLPHHQNGHLQHHPPMPPHPGHYWPVHNELAFQPPISNHPAPEYWCSIAYFEMDVQVGETFKVPSSCPIVTVDGYVDPSGGDRFCLGQLSNVHRTEAIERARLHIGKGVQLECKGEGDVWVRCLSDHAVFVQSYYLDREAGRAPGDAVHKIYPSAYIKVFDLRQCHRQMQQQAATAQAAAAAQAAAVAGNIPGPGSVGGIAPAISLSAAAGIGVDDLRRLCILRMSFVKGWGPDYPRQSIKETPCWIEIHLHRALQLLDEVLHTMPIADPQPLD

SEQ ID NO: 890362 - protein, 397 aa, Homo sapiens; identical to SEQ ID NO: 890361

SEQ ID NO: 890363 - protein, 397 aa, Homo sapiens; identical to SEQ ID NO: 890361

SEQ ID NO: 890364 - protein, 549 aa, Homo sapiens [sequence omitted]

SEQ ID NO: 890365 - protein, 439 aa, Homo sapiens
MSITNTPTSNDACLSIVHSLMCHRQGGESETFAKRAIESLVKKLKEKKDELDSLITAITTNGAHPSKCVTIQRTLDGRLQVAGRKGFPHVIYARLWRWPDLHKNELKHVKYCQYAFDLKCDSVCVNPYHYERVVSPGIDLSGLTLQSNAPSSMMVKDEYVHDFEGQPSLSTEGHSIQTIQHPPSNRASTETYSTPALLAPSESNATSTANFPNIPVASTSQPASILGGSHSEGLLQIASGPQPGQQQNGFTGQPATYHHNSTTTWTGSRTAPYTPNLPHHQNGHLQHHPPMPPHPGHYWPVHNELAFQPPISNHPAPEYWCSIAYFEMDVQVGETFKVPSSCPIVTVDGYVDPSGGDRFCLGQLSNVHRTEAIERARLHIGKGVQLECKGEGDVWVRCLSDHAVFVQSYYLDREAGRAPGDAVHKIYPSAYIKVSYNFI

SEQ ID NO: 890366 - protein, 330 aa, Homo sapiens
MSITNTPTSNDACLSIVHSLMCHRQGGESETFAKRAIESLVKKLKEKKDELDSLITAITTNGAHPSKCVTIQRTLDGRLQVAGRKGFPHVIYARLWRWPDLHKNELKHVKYCQYAFDLKCDSVCVNPYHYERVVSPGIDLSGLTLQSNAPSSMMVKDEYVHDFEGQPSLSTEGHSIQTIQHPPSNRASTETYSTPALLAPSESNATSTANFPNIPVASTSQPASILGGSHSEGLLQIASGPQPGQQQNGFTGQPATYHHNSTTTWTGSRTAPYTPNLPQMGLTELGCCPRVRLNVLLCYYLLHANFTYISMNIQHSLNTVPPALVIAFQK

SEQ ID NO: 890367 - protein, 253 aa, Homo sapiens
MSITNTPTSNDACLSIVHSLMCHRQGGESETFAKRAIESLVKKLKEKKDELDSLITAITTNGAHPSKCVTIQRTLDGRLQVAGRKGFPHVIYARLWRWPDLHKNELKHVKYCQYAFDLKCDSVCVNPYHYERVVSPGIDLSGLTLQSNAPSSMMVKDEYVHDFEGQPSLSTEGHSIQTIQHPPSNRASTETYSTPALLAPSESNATSTANFPNIPVASTSQPASILGGSHSEGLLQIASGPQPGQHPSSVSPI

SEQ ID NO: 890368 - protein, 107 aa, Homo sapiens
MSITNTPTSNDACLSIVHSLMCHRQGGESETFAKRAIESLVKKLKEKKDELDSLITAITTNGAHPSKCVTIQRTLDGRLQVSLIRVFPSSLPASLPYFSLGHSETLS

SEQ ID NO: 890369 - protein, 549 aa, Homo sapiens [sequence omitted]

SEQ ID NO: 890370 - protein, 531 aa, Homo sapiens
MSITNTPTSNDACLSIVHSLMCHRQGGESETFAKRAIESLVKKLKEKKDELDSLITAITTNGAHPSKCVTIQRTLDGRLQVAGRKGFPHVIYARLWRWPDLHKNELKHVKYCQYAFDLKCDLSGLTLQSNAPSSMMVKDEYVHDFEGQPSLSTEGHSIQTIQHPPSNRASTETYSTPALLAPSESNATSTANFPNIPVASTSQPASILGGSHSEGLLQIASGPQPGQQQNGFTGQPATYHHNSTTTWTGSRTAPYTPNLPHHQNGHLQHHPPMPPHPGHYWPVHNELAFQPPISNHPAPEYWCSIAYFEMDVQVGETFKVPSSCPIVTVDGYVDPSGGDRFCLGQLSNVHRTEAIERARLHIGKGVQLECKGEGDVWVRCLSDHAVFVQSYYLDREAGRAPGDAVHKIYPSAYIKVFDLRQCHRQMQQQAATAQAAAAAQAAAVAGNIPGPGSVGGIAPAISLSAAAGIGVDDLRRLCILRMSFVKGWGPDYPRQSIKETPCWIEIHLHRALQLLDEVLHTMPIADPQPLD

SEQ ID NO: 890371 - protein, 397 aa, Homo sapiens; identical to SEQ ID NO: 890361

SEQ ID NO: 890372 - protein, 322 aa, Homo sapiens
TYPVQRRKISQRAQPGQQQNGINQSTTTTYHHNSTTTWTGSRTAPYTPNLPHHQNGHLQHHPPMPPHPGHYWPVHNELAFQPPISNHPAPEYWCSIAYFEMDVQVGETFKVPSSCPIVTVDGYVDPSGGDRFCLGQLSNVHRTEAIERARLHIGKGVQLECKGEGDVWVRCLSDHAVFVQSYYLDREAGRAPGDAVHKIYPSAYIKVFDLRQCHRQMQQQAATAQAAAAAQAAAVAGNIPGPGSVGGIAPAISLSAAAGIGVDDLRRLCILRMSFVKGWGPDYPRQSIKETPCWIEIHLHRALQLLDEVLHTMPIADPQPLD

SEQ ID NO: 890373 - protein, 549 aa, Homo sapiens [sequence omitted]

SEQ ID NO: 890374 - protein, 310 aa, Homo sapiens
MSITNTPTSNDACLSIVHSLMCHRQGGESETFAKRAIESLVKKLKEKKDELDSLITAITTNGAHPSKCVTIQRTLDGRLQVAGRKGFPHVIYARLWRWPDLHKNELKHVKYCQYAFDLKCDSVCVNPYHYERVVSPGIDLSGLTLQSNAPSSMMVKDEYVHDFEGQPSLSTEGHSIQTIQHPPSNRASTETYSTPALLAPSESNATSTANFPNIPVASTSQPASILGGSHSEGLLQIASGPQPGQQQNGFTGQPATYHHNSTTTWTGSRTAPYTPNLPHHQNGHLQHHPSFARTRDRARNPNHPKAVPGG

SEQ ID NO: 890375 - protein, 140 aa, Homo sapiens
MSITNTPTSNDACLSIVHSLMCHRQGGESETFAKRAIESLVKKLKEKKDELDSLITAITTNGAHPSKCVTIQRTLDGRLQVAGRKGFPHVIYARLWRWPDLHKNELKHVKYCQYAFDLKCDSVCVNPYHYERVVSPGIGK

SEQ ID NO: 890376 - protein, 121 aa, Homo sapiens
ATTPSNRPSPPPALRPRPRSRFRAARRLALPCRRLRRATLPVTRSGRRGQPGERKAAGEKGQTLKLPGCGPRARMLSGFSTSWQQQHGPGRRRRCGNGAVWVAEPAFAPSRSPREALPALP

SEQ ID NO: 890377 - protein, 934 aa, Homo sapiens
MSAVGEPLFSFEQERLGPLSSRTFSMADPGSAERTAQKRKFPSPPHSSNGHSPQDTSTSPIKKKKKPGLLNSNNKEQDGRNDFYCWVCHREGQVLCCELCPRVYHAKCLRLTSEPEGDWFCPECEKITVAECIETQSKAMTMLTIEQLSYLLKFAIQKMKQPGTDAFQKPVPLEQHPDYAEYIFHPMDLCTLEKNAKKKMYGCTEAFLADAKWILHNCIIYNGGNHKLTQIAKVVIKICEHEMNEIEVCPECYLAACQKRDNWFCEPCSNPHPLVWAKLKGFPFWPAKALRDKDGQVDARFFGQHDRAWVPINNCYLMSKEIPFSVKKTKSIFNSAMQEMEVYVENIRRKFGVFNYSPFRTPYTPNSQYQMLLDPTNPSAGTAKIDKQEKVKLNFDMTASPKILMSKPVLSGGTGRRISLSDMPRSPMSTNSSVHTGSDVEQDAEKKATSSHFSASEESMDFLDKSTASPASTKTGQAGSLSGSPKPFSPQLSAPITTKTDKTSTTGSILNLNLDRSKAEMDLKELSESVQQQSTPVPLISPKRQIRSRFQLNLDKTIESCKAQLGINEISEDVYTAVEHSDSEDSEKSDSSDSEYISDDEQKSKNEPEDTEDKEGCQMDKEPSAVKKKPKPTNPVEIKEELKSTSPASEKADPGAVKDKASPEPEKDFSEKAKPSPHPIKDKLKGKDETDSPTVHLGLDSDSESELVIDLGEDHSGREGRKNKKEPKEPSPKQDVVGKTPPSTTVGSHSPPETPVLTRSSAQTSAAGATATTSTSSTVTVTAPAPAATGSPVKKQRPLLPKETAPAVQRVVWNSSSKFQTSSQKWHMQKMQRQQQQQQQQNQQQQPQSSQGTRYQTRQAVKGTEPPLLFSVAPAPILPHRQEKVIALLFFFFSSRLFPGHCILKALHIPFGIIFKNCFATCFFTFKKFFLFIL

SEQ ID NO: 890378 - protein, 1135 aa, Homo sapiens
MHPQSLAEEEIKTEQEVVEGMDISTRSKDPGSAERTAQKRKFPSPPHSSNGHSPQDTSTSPIKKKKKPGLLNSNNKEQDGRNDFYCWVCHREGQVLCCELCPRVYHAKCLRLTSEPEGDWFCPECEKITVAECIETQSKAMTMLTIEQLSYLLKFAIQKMKQPGTDAFQKPVPLEQHPDYAEYIFHPMDLCTLEKNAKKKMYGCTEAFLADAKWILHNCIIYNGGNHKLTQIAKVVIKICEHEMNEIEVCPECYLAACQKRDNWFCEPCSNPHPLVWAKLKGFPFWPAKALRDKDGQVDARFFGQHDRAWVPINNCYLMSKEIPFSVKKTKSIFNSAMQEMEVYVENIRRKFGVFNYSPFRTPYTPNSQYQMLLDPTNPSAGTAKIDKQEKVKLNFDMTASPKILMSKPVLSGGTGRRISLSDMPRSPMSTNSSVHTGSDVEQDAEKKATSSHFSASEESMDFLDKSTASPASTKTGQAGSLSGSPKPFSPQLSAPITTKTDKTSTTGSILNLNLDRSKAEMDLKELSESVQQQSTPVPLISPKRQIRSRFQLNLDKTIESCKAQLGINEISEDVYTAVEHSDSEDSEKSDSSDSEYISDDEQKSKNEPEDTEDKEGCQMDKEPSAVKKKPKPTNPVEIKEELKSTSPASEKADPGAVKDKASPEPEKDFSEKAKPSPHPIKDKLKGKDETDSPTVHLGLDSDSESELVIDLGEDHSGREGRKNKKEPKEPSPKQDVVGKTPPSTTVGSHSPPETPVLTRSSAQTSAAGATATTSTSSTVTVTAPAPAATGSPVKKQRPLLPKETAPAVQRVVWNSSTVQQKEITQSPSTSTITLVTSTQSSPLVTSSGSMSTLVSSVNADLPIATASADVAADIAKYTSKMMDAIKGTMTEIYNDLSKNTTGSTIAEIRRLRIEIEKLQWLHQQELSEMKHNLELTMAEMRQSLEQERDRLIAEVKKQLELEKQQAVDETKKKQWCANCKKEAIFYCCWNTSYCDYPCQQAHWPEHMKSCTQSATAPQQEADAEVNTETLNKSSQGSSSSTQSAPSETASASKEKETSAEKSKESGSTLDLSGSRETPSSILLGSNQGSDHSRSNKSSWSSSDEKRGSTRSDHNTSTSTKSLLPKESRLDTFWD

SEQ ID NO: 890379 - protein, 1072 aa, Homo sapiens
MKQPLTTDPVDVVPQDGRNDFYCWVCHREGQVLCCELCPRVYHAKCLRLTSEPEGDWFCPECEKITVAECIETQSKAMTMLTIEQLSYLLKFAIQKMKQPGTDAFQKPVPLEQHPDYAEYIFHPMDLCTLEKNAKKKMYGCTEAFLADAKWILHNCIIYNGGNHKLTQIAKVVIKICEHEMNEIEVCPECYLAACQKRDNWFCEPCSNPHPLVWAKLKGFPFWPAKALRDKDGQVDARFFGQHDRAWVPINNCYLMSKEIPFSVKKTKSIFNSAMQEMEVYVENIRRKFGVFNYSPFRTPYTPNSQYQMLLDPTNPSAGTAKIDKQEKVKLNFDMTASPKILMSKPVLSGGTGRRISLSDMPRSPMSTNSSVHTGSDVEQDAEKKATSSHFSASEESMDFLDKSTASPASTKTGQAGSLSGSPKPFSPQLSAPITTKTDKTSTTGSILNLNLDRSKAEMDLKELSESVQQQSTPVPLISPKRQIRSRFQLNLDKTIESCKAQLGINEISEDVYTAVEHSDSEDSEKSDSSDSEYISDDEQKSKNEPEDTEDKEGCQMDKEPSAVKKKPKPTNPVEIKEELKSTSPASEKADPGAVKDKASPEPEKDFSEKAKPSPHPIKDKLKGKDETDSPTVHLGLDSDSESELVIDLGEDHSGREGRKNKKEPKEPSPKQDVVGKTPPSTTVGSHSPPETPVLTRSSAQTSAAGATATTSTSSTVTVTAPAPAATGSPVKKQRPLLPKETAPAVQRVVWNSSTVQQKEITQSPSTSTITLVTSTQSSPLVTSSGSMSTLVSSVNADLPIATASADVAADIAKYTSKMMDAIKGTMTEIYNDLSKNTTGSTIAEIRRLRIEIEKLQWLHQQELSEMKHNLELTMAEMRQSLEQERDRLIAEVKKQLELEKQQAVDETKKKQWCANCKKEAIFYCCWNTSYCDYPCQQAHWPEHMKSCTQSATAPQQEADAEVNTETLNKSSQGSSSSTQSAPSETASASKEKETSAEKSKESGSTLDLSGSRETPSSILLGSNQGSDHSRSNKSSWSSSDEKRGSTRSDHNTSTSTKSLLPKESRLDTFWD

SEQ ID NO: 890380 - protein, 1196 aa, Homo sapiens
RIVTVRTRIAVLSLLEIHCALKIRCGFPPPALDKDEGMSLSLAEEEIKTEQEVVEGMDISTRSKDPGSAERTAQKRKFPSPPHSSNGHSPQDTSTSPIKKKKKPGLLNSNNKEQSELRHGPFYYMKQPLTTDPVDVVPQDGRNDFYCWVCHREGQVLCCELCPRVYHAKCLRLTSEPEGDWFCPECEKITVAECIETQSKAMTMLTIEQLSYLLKFAIQKMKQPGTDAFQKPVPLEQHPDYAEYIFHPMDLCTLEKNAKKKMYGCTEAFLADAKWILHNCIIYNGGNHKLTQIAKVVIKICEHEMNEIEVCPECYLAACQKRDNWFCEPCSNPHPLVWAKLKGFPFWPAKALRDKDGQVDARFFGQHDRAWVPINNCYLMSKEIPFSVKKTKSIFNSAMQEMEVYVENIRRKFGVFNYSPFRTPYTPNSQYQMLLDPTNPSAGTAKIDKQEKVKLNFDMTASPKILMSKPVLSGGTGRRISLSDMPRSPMSTNSSVHTGSDVEQDAEKKATSSHFSASEESMDFLDKSTASPASTKTGQAGSLSGSPKPFSPQLSAPITTKTDKTSTTGSILNLNLDRSKAEMDLKELSESVQQQSTPVPLISPKRQIRSRFQLNLDKTIESCKAQLGINEISEDVYTAVEHSDSEDSEKSDSSDSEYISDDEQKSKNEPEDTEDKEGCQMDKEPSAVKKKPKPTNPVEIKEELKSTSPASEKADPGAVKDKASPEPEKDFSEKAKPSPHPIKDKLKGKDETDSPTVHLGLDSDSESELVIDLGEDHSGREGRKNKKEPKEPSPKQDVVGKTPPSTTVGSHSPPETPVLTRSSAQTSAAGATATTSTSSTVTVTAPAPAATGSPVKKQRPLLPKETAPAVQRVVWNSSTVQQKEITQSPSTSTITLVTSTQSSPLVTSSGSMSTLVSSVNADLPIATASADVAADIAKYTSKMMDAIKGTMTEIYNDLSKNTTGSTIAEIRRLRIEIEKLQWLHQQELSEMKHNLELTMAEMRQSLEQERDRLIAEVKKQLELEKQQAVDETKKKQWCANCKKEAIFYCCWNTSYCDYPCQQAHWPEHMKSCTQSATAPQQEADAEVNTETLNKSSQGSSSSTQSAPSETASASKEKETSAEKSKESGSTLDLSGSRETPSSILLGSNQGSDHSRSNKSSWSSSDEKRGSTRSDHNTSTSTKSLLPKESRLDTFWD

SEQ ID NO: 890381 - protein, 1159 aa, Homo sapiens
MSAVGEPLFSFEQERLGPLSSRTFSMADPGSAERTAQKRKFPSPPHSSNGHSPQDTSTSPIKKKKKPGLLNSNNKEQSELRHGPFYYMKQPLTTDPVDVVPQDGRNDFYCWVCHREGQVLCCELCPRVYHAKCLRLTSEPEGDWFCPECEKITVAECIETQSKAMTMLTIEQLSYLLKFAIQKMKQPGTDAFQKPVPLEQHPDYAEYIFHPMDLCTLEKNAKKKMYGCTEAFLADAKWILHNCIIYNGGNHKLTQIAKVVIKICEHEMNEIEVCPECYLAACQKRDNWFCEPCSNPHPLVWAKLKGFPFWPAKALRDKDGQVDARFFGQHDRAWVPINNCYLMSKEIPFSVKKTKSIFNSAMQEMEVYVENIRRKFGVFNYSPFRTPYTPNSQYQMLLDPTNPSAGTAKIDKQEKVKLNFDMTASPKILMSKPVLSGGTGRRISLSDMPRSPMSTNSSVHTGSDVEQDAEKKATSSHFSASEESMDFLDKSTASPASTKTGQAGSLSGSPKPFSPQLSAPITTKTDKTSTTGSILNLNLDRSKAEMDLKELSESVQQQSTPVPLISPKRQIRSRFQLNLDKTIESCKAQLGINEISEDVYTAVEHSDSEDSEKSDSSDSEYISDDEQKSKNEPEDTEDKEGCQMDKEPSAVKKKPKPTNPVEIKEELKSTSPASEKADPGAVKDKASPEPEKDFSEKAKPSPHPIKDKLKGKDETDSPTVHLGLDSDSESELVIDLGEDHSGREGRKNKKEPKEPSPKQDVVGKTPPSTTVGSHSPPETPVLTRSSAQTSAAGATATTSTSSTVTVTAPAPAATGSPVKKQRPLLPKETAPAVQRVVWNSSTVQQKEITQSPSTSTITLVTSTQSSPLVTSSGSMSTLVSSVNADLPIATASADVAADIAKYTSKMMDAIKGTMTEIYNDLSKNTTGSTIAEIRRLRIEIEKLQWLHQQELSEMKHNLELTMAEMRQSLEQERDRLIAEVKKQLELEKQQAVDETKKKQWCANCKKEAIFYCCWNTSYCDYPCQQAHWPEHMKSCTQSATAPQQEADAEVNTETLNKSSQGSSSSTQSAPSETASASKEKETSAEKSKESGSTLDLSGSRETPSSILLGSNQGSDHSRSNKSSWSSSDEKRGSTRSDHNTSTSTKSLLPKESRLDTFWD

SEQ ID NO: 890382 - protein, 1140 aa, Homo sapiens
MDISTRSKDPGSAERTAQKRKFPSPPHSSNGHSPQDTSTSPIKKKKKPGLLNSNNKEQSELRHGPFYYMKQPLTTDPVDVVPQDGRNDFYCWVCHREGQVLCCELCPRVYHAKCLRLTSEPEGDWFCPECEKITVAECIETQSKAMTMLTIEQLSYLLKFAIQKMKQPGTDAFQKPVPLEQHPDYAEYIFHPMDLCTLEKNAKKKMYGCTEAFLADAKWILHNCIIYNGGNHKLTQIAKVVIKICEHEMNEIEVCPECYLAACQKRDNWFCEPCSNPHPLVWAKLKGFPFWPAKALRDKDGQVDARFFGQHDRAWVPINNCYLMSKEIPFSVKKTKSIFNSAMQEMEVYVENIRRKFGVFNYSPFRTPYTPNSQYQMLLDPTNPSAGTAKIDKQEKVKLNFDMTASPKILMSKPVLSGGTGRRISLSDMPRSPMSTNSSVHTGSDVEQDAEKKATSSHFSASEESMDFLDKSTASPASTKTGQAGSLSGSPKPFSPQLSAPITTKTDKTSTTGSILNLNLDRSKAEMDLKELSESVQQQSTPVPLISPKRQIRSRFQLNLDKTIESCKAQLGINEISEDVYTAVEHSDSEDSEKSDSSDSEYISDDEQKSKNEPEDTEDKEGCQMDKEPSAVKKKPKPTNPVEIKEELKSTSPASEKADPGAVKDKASPEPEKDFSEKAKPSPHPIKDKLKGKDETDSPTVHLGLDSDSESELVIDLGEDHSGREGRKNKKEPKEPSPKQDVVGKTPPSTTVGSHSPPETPVLTRSSAQTSAAGATATTSTSSTVTVTAPAPAATGSPVKKQRPLLPKETAPAVQRVVWNSSTVQQKEITQSPSTSTITLVTSTQSSPLVTSSGSMSTLVSSVNADLPIATASADVAADIAKYTSKMMDAIKGTMTEIYNDLSKNTTGSTIAEIRRLRIEIEKLQWLHQQELSEMKHNLELTMAEMRQSLEQERDRLIAEVKKQLELEKQQAVDETKKKQWCANCKKEAIFYCCWNTSYCDYPCQQAHWPEHMKSCTQSATAPQQEADAEVNTETLNKSSQGSSSSTQSAPSETASASKEKETSAEKSKESGSTLDLSGSRETPSSILLGSNQGSDHSRSNKSSWSSSDEKRGSTRSDHNTSTSTKSLLPKESRLDTFWD

SEQ ID NO: 890383 - protein, 647 aa, Homo sapiens
IDLGEDHSGREGRKNKKEPKEPSPKQDDRSKAEMDLKELSESVQQQSTPVPLISPKRQIRSRFQLNLDKTIESCKAQLGINEISEDVYTAVEHSDSEDSEKSDSSDSEYISDDEQKSKNEPEDTEDKEGCQMDKEPSAVKKKPKPTNPVEIKEELKSTSPASEKADPGAVKDKASPEPEKDFSEKAKPSPHPIKDKLKGKDETDSPTVHLGLDSDSESELVIDLGEDHSGREGRKNKKEPKEPSPKQDVVGKTPPSTTVGSHSPPETPVLTRSSAQTSAAGATATTSTSSTVTVTAPAPAATGSPVKKQRPLLPKETAPAVQRVVWNSSTVQQKEITQSPSTSTITLVTSTQSSPLVTSSGSMSTLVSSVNADLPIATASADVAADIAKYTSKMMDAIKGTMTEIYNDLSKNTTGSTIAEIRRLRIEIEKLQWLHQQELSEMKHNLELTMAEMRQSLEQERDRLIAEVKKQLELEKQQAVDETKKKQWCANCKKEAIFYCCWNTSYCDYPCQQAHWPEHMKSCTQSATAPQQEADAEVNTETLNKSSQGSSSSTQSAPSETASASKEKETSAEKSKESGSTLDLSGSRETPSSILLGSNQGSDHSRSNKSSWSSSDEKRGSTRSDHNTSTSTKSLLPKESRLDTFWD

SEQ ID NO: 890384 - protein, 1186 aa, Homo sapiens
MDISTRSKDPGSAERTAQKRKFPSPPHSSNGHSPQDTSTSPIKKKKKPGLLNSNNKEQSELRHGPFYYMKQPLTTDPVDVVPQDGRNDFYCWVCHREGQVLCCELCPRVYHAKCLRLTSEPEGDWFCPECEKITVAECIETQSKAMTMLTIEQLSYLLKFAIQKMKQPGTDAFQKPVPLEQHPDYAEYIFHPMDLCTLEKNAKKKMYGCTEAFLADAKWILHNCIIYNGGNHKLTQIAKVVIKICEHEMNEIEVCPECYLAACQKRDNWFCEPCSNPHPLVWAKLKGFPFWPAKALRDKDGQVDARFFGQHDRAWVPINNCYLMSKEIPFSVKKTKSIFNSAMQEMEVYVENIRRKFGVFNYSPFRTPYTPNSQYQMLLDPTNPSAGTAKIDKQEKVKLNFDMTASPKILMSKPVLSGGTGRRISLSDMPRSPMSTNSSVHTGSDVEQDAEKKATSSHFSASEESMDFLDKSTASPASTKTGQAGSLSGSPKPFSPQLSAPITTKTDKTSTTGSILNLNLDRSKAEMDLKELSESVQQQSTPVPLISPKRQIRSRFQLNLDKTIESCKAQLGINEISEDVYTAVEHSDSEDSEKSDSSDSEYISDDEQKSKNEPEDTEDKEGCQMDKEPSAVKKKPKPTNPVEIKEELKSTSPASEKADPGAVKDKASPEPEKDFSEKAKPSPHPIKDKLKGKDETDSPTVHLGLDSDSESELVIDLGEDHSGREGRKNKKEPKEPSPKQDVVGKTPPSTTVGSHSPPETPVLTRSSAQTSAAGATATTSTSSTVTVTAPAPAATGSPVKKQRPLLPKETAPAVQRVVWNSSSKFQTSSQKWHMQKMQRQQQQQQQQNQQQQPQSSQGTRYQTRQAVKAVQQKEITQSPSTSTITLVTSTQSSPLVTSSGSMSTLVSSVNADLPIATASADVAADIAKYTSKMMDAIKGTMTEIYNDLSKNTTGSTIAEIRRLRIEIEKLQWLHQQELSEMKHNLELTMAEMRQSLEQERDRLIAEVKKQLELEKQQAVDETKKKQWCANCKKEAIFYCCWNTSYCDYPCQQAHWPEHMKSCTQSATAPQQEADAEVNTETLNKSSQGSSSSTQSAPSETASASKEKETSAEKSKESGSTLDLSGSRETPSSILLGSNQGSDHSRSNKSSWSSSDEKRGSTRSDHNTSTSTKSLLPKESRLDTFWD

SEQ ID NO: 890385 - protein, 960 aa, Homo sapiens
MHPQSLAEEEIKTEQEVVEGMDISTRSKDPGSAERTAQKRKFPSPPHSSNGHSPQDTSTSPIKKKKKPGLLNSNNKEQSELRHGPFYYMKQPLTTDPVDVVPQDGRNDFYCWVCHREGQVLCCELCPRVYHAKCLRLTSEPEGDWFCPECEKITVAECIETQSKAMTMLTIEQLSYLLKFAIQKMKQPGTDAFQKPVPLEQHPDYAEYIFHPMDLCTLEKNAKKKMYGCTEAFLADAKWILHNCIIYNGGNHKLTQIAKVVIKICEHEMNEIEVCPECYLAACQKRDNWFCEPCSNPHPLVWAKLKGFPFWPAKALRDKDGQVDARFFGQHDRAWVPINNCYLMSKEIPFSVKKTKSIFNSAMQEMEVYVENIRRKFGVFNYSPFRTPYTPNSQYQMLLDPTNPSAGTAKIDKQEKVKLNFDMTASPKILMSKPVLSGGTGRRISLSDMPRSPMSTNSSVHTGSDVEQDAEKKATSSHFSASEESMDFLDKSTASPASTKTGQAGSLSGSPKPFSPQLSAPITTKTDKTSTTGSILNLNLDRSKAEMDLKELSESVQQQSTPVPLISPKRQIRSRFQLNLDKTIESCKAQLGINEISEDVYTAVEHSDSEDSEKSDSSDSEYISDDEQKSKNEPEDTEDKEGCQMDKEPSAVKKKPKPTNPVEIKEELKSTSPASEKADPGAVKDKASPEPEKDFSEKAKPSPHPIKDKLKGKDETDSPTVHLGLDSDSESELVIDLGEDHSGREGRKNKKEPKEPSPKQDVVGKTPPSTTVGSHSPPETPVLTRSSAQTSAAGATATTSTSSTVTVTAPAPAATGSPVKKQRPLLPKETAPAVQRVVWNSSSKFQTSSQKWHMQKMQRQQQQQQQQNQQQQPQSSQGTRYQTRQAVKGTEPPLLFSVAPAPILPHRQEKVIALLFFFFSSRLFPGHCILKALHIPFGIIFKNCFATCFFTFKKFFLFIL

SEQ ID NO: 890386 - protein, 1142 aa, Homo sapiens
MHPQSLAEEEIKTEQEVVEGMDISTRSKDPGSAERTAQKRKFPSPPHSSNGHSPQDTSTSPIKKKKKPGLLNSNNKEQSELRHGPFYYMKQPLTTDPVDVVPQDGRNDFYCWVCHREGQVLCCELCPRVYHAKCLRLTSEPEGDWFCPECEKITVAECIETQSKAMTMLTIEQLSYLLKFAIQKMKQPGTDAFQKPVPLEQHPDYAEYIFHPMDLCTLEKNAKKKMYGCTEAFLADAKWILHNCIIYNGGNHKLTQIAKVVIKICEHEMNEIEVCPECYLAACQKRDNWFCEPCSNPHPLVWAKLKGFPFWPAKALRDKDGQVDARFFGQHDRAWVPINNCYLMSKEIPFSVKKTKSIFNSAMQEMEVYVENIRRKFGVFNYSPFRTPYTPNSQYQMLLDPTNPSAGTAKIDKQEKVKLNFDMTASPKILMSKPVLSGGTGRRISLSDMPRSPMSTNSSVHTGSDVEQDAEKKATSSHFSASEESMDFLDKSTASPASTKTGQAGSLSGSPKPFSPQLSAPITTKTDKTSTTGSILNLNLDRSKAEMDLKELSESVQQQSTPVPLISPKRQIRSRFQLNLDKTIESCKAQLGINEISEDVYTAVEHSDSEDSEKSDSSDSEYISDDEQKSKNEPEDTEDKEGCQMDKEPSAVKKKPKPTNPVEIKEELKSTSPASEKADPGAVKDKASPEPEKDFSEKAKPSPHPIKDKLKGKDETDSPTVHLGLDSDSESELVIDLGEDHSGREGRKNKKEPKEPSPKQDVVGKTPPSTTVGSHSPPETPVLTRSSAQTSAAGATATTSTSSTVTVTAPAPAATGSPVKKQRPLLPKETAPAVQRVVWNSSTVQQKEITQSPSTSTITLVTSTQSSPLVTSSGSMSTLVSSVNADLPIATASADVAADIAKYTSKMMDAIKGTMTEIYNDLSKNTTGSTIAEIRRLRIEIEKLQWLHQQELSEMKHNLELTMAEMRQSLEQERDRLIAEVKKQLELEKQQAVDETKKKQWCANCKKEAIFYCCWNTSYCDYPCQQAHWPEHMKSCTQSATAPQQEADAEVNTETLNKSSQGSSSSTQSAPSETASASKEKETSAESSILLGSNQGSDHSRSNKSSWSSSDEKRGSTRSDHNTSTSTKSLLPKESRLDTFWD

SEQ ID NO: 890387 - protein, 313 aa, Homo sapiens [sequence omitted]

SEQ ID NO: 890388 - protein, 313 aa, Homo sapiens [sequence omitted]

SEQ ID NO: 890389 - protein, 244 aa, Homo sapiens
MGTQPGLLPARSCIHVCLNLGAGITPHPRLGSGDERCSSPPPPELTMAEMRQSLEQERDRLIAEVKKQLELEKQQAVDETKKKQWCANCKKEAIFYCCWNTSYCDYPCQQAHWPEHMKSCTQSATAPQQEADAEVNTETLNKSSQGSSSSTQSAPSETASASKEKETSAEKSKESGSTLDLSGSRETPSSILLGSNQGSDHSRSNKSSWSSSDEKRGSTRSDHNTSTSTKSLLPKESRLDTFWD

SEQ ID NO: 890390 - protein, 1143 aa, Homo sapiens
MHPQSLAEEEIKTEQEVVEGMDISTRSKDPGSAERTAQKRKFPSPPHSSNGHSPQDTSTSPIKKKKKPGLLNSNNKEQSELRHGPFYYMKQPLTTDPVDVVPQDGRNDFYCWVCHREGQVLCCELCPRVYHAKCLRLTSEPEGDWFCPECEKITVAECIETQSKAMTMLTIEQLSYLLKFAIQKMKQPGTDAFQKPVPLEQHPDYAEYIFHPMDLCTLEKNAKKKMYGCTEAFLADAKWILHNCIIYNGGNHKLTQIAKVVIKICEHEMNEIEVCPECYLAACQKRDNWFCEPCSNPHPLVWAKLKGFPFWPAKALRDKDGQVDARFFGQHDRAWVPINNCYLMSKEIPFSVKKTKSIFNSAMQEMEVYVENIRRKFGVFNYSPFRTPYTPNSQYQMLLDPTNPSAGTAKIDKQEKVKLNFDMTASPKILMSKPVLSGGTGRRISLSDMPRSPMSTNSSVHTGSDVEQDAEKKATSSHFSASEESMDFLDKSTASPASTKTGQAGSLSGSPKPFSPQLSAPITTKTDKTSTTGSILNLNLDRSKAEMDLKELSESVQQQSTPVPLISPKRQIRSRFQLNLDKTIESCKAQLGINEISEDVYTAVEHSDSEDSEKSDSSDSEYISDDEQKSKNEPEDTEDKEGCQMDKEPSAVKKKPKPTNPVEIKEELKSTSPASEKADPGAVKDKASPEPEKDFSEKAKPSPHPIKDKLKGKDETDSPTVHLGLDSDSESELVIDLGEDHSGREGRKNKKEPKEPSPKQDVVGKTPPSTTVGSHSPPETPVLTRSSAQTSAAGATATTSTSSTVTVTAPAPAATGSPVKKQRPLLPKETAPAVQRVVWNSSTVQQKEITQSPSTSTITLVTSTQSSPLVTSSGSMSTLVSSVNADLPIATASADVAADIAKYTSKMMDAIKGTMTEIYNDLSKNTTGSTIAEIRRLRIEIEKLQWLHQQELSEMKHNLELTMAEMRQSLEQERDRLIAEVKKQLELEKQQAVDETKKKQWCANCKKEAIFYCCWNTSYCDYPCQQAHWPEHMKSCTQSATAPQQEADAEVNTETLNKSSQGSSSSTQSAPSETASASKEKETSAEKSKESGSTLDLSGSRETPSSILLGSNQGSVSNRCARHWVWPTTGHRGAIKPAEYLRV

SEQ ID NO: 890391 - protein, 763 aa, Homo sapiens [sequence omitted]

SEQ ID NO: 890392 - protein, 1135 aa, Homo sapiens; identical to SEQ ID NO: 890378

SEQ ID NO: 890393 - protein, 1160 aa, Homo sapiens
MHPQSLAEEEIKTEQEVVEGMDISTRSKDPGSAERTAQKRKFPSPPHSSNGHSPQDTSTSPIKKKKKPGLLNSNNKEQSELRHGPFYYMKQPLTTDPVDVVPQDGRNDFYCWVCHREGQVLCCELCPRVYHAKCLRLTSEPEGDWFCPECEKITVAECIETQSKAMTMLTIEQLSYLLKFAIQKMKQPGTDAFQKPVPLEQHPDYAEYIFHPMDLCTLEKNAKKKMYGCTEAFLADAKWILHNCIIYNGGNHKLTQIAKVVIKICEHEMNEIEVCPECYLAACQKRDNWFCEPCSNPHPLVWAKLKGFPFWPAKALRDKDGQVDARFFGQHDRAWVPINNCYLMSKEIPFSVKKTKSIFNSAMQEMEVYVENIRRKFGVFNYSPFRTPYTPNSQYQMLLDPTNPSAGTAKIDKQEKVKLNFDMTASPKILMSKPVLSGGTGRRISLSDMPRSPMSTNSSVHTGSDVEQDAEKKATSSHFSASEESMDFLDKSTASPASTKTGQAGSLSGSPKPFSPQLSAPITTKTDKTSTTGSILNLNLDRSKAEMDLKELSESVQQQSTPVPLISPKRQIRSRFQLNLDKTIESCKAQLGINEISEDVYTAVEHSDSEDSEKSDSSDSEYISDDEQKSKNEPEDTEDKEGCQMDKEPSAVKKKPKPTNPVEIKEELKSTSPASEKADPGAVKDKASPEPEKDFSEKAKPSPHPIKDKLKGKDETDSPTVHLGLDSDSESELVIDLGEDHSGREGRKNKKEPKEPSPKQDVVGKTPPSTTVGSHSPPETPVLTRSSAQTSAAGATATTSTSSTVTVTAPAPAATGSPVKKQRPLLPKETAPAVQRVVWNSSTVQQKEITQSPSTSTITLVTSTQSSPLVTSSGSMSTLVSSVNADLPIATASADVAADIAKYTSKMMDAIKGTMTEIYNDLSKNTTGSTIAEIRRLRIEIEKLQWLHQQELSEMKHNLELTMAEMRQSLEQERDRLIAEVKKQLELEKQQAVDETKKKQWCANCKKEAIFYCCWNTSYCDYPCQQAHWPEHMKSCTQSATAPQQEADAEVNTETLNKSSQGSSSSTQSAPSETASASKEKETSAEKSKESGSTLDLSGSRETPSSILLGSNQGSDHSRSNKSSWSSSDEKRGSTRSDHNTSTSTKSLLPKESRLDTFWD

SEQ ID NO: 890394 - protein, 1140 aa, Homo sapiens; identical to SEQ ID NO: 890382

SEQ ID NO: 890395 - protein, 1072 aa, Homo sapiens; identical to SEQ ID NO: 890379

SEQ ID NO: 890396 - protein, 1115 aa, Homo sapiens
MDISTRSKDPGSAERTAQKRKFPSPPHSSNGHSPQDTSTSPIKKKKKPGLLNSNNKEQDGRNDFYCWVCHREGQVLCCELCPRVYHAKCLRLTSEPEGDWFCPECEKITVAECIETQSKAMTMLTIEQLSYLLKFAIQKMKQPGTDAFQKPVPLEQHPDYAEYIFHPMDLCTLEKNAKKKMYGCTEAFLADAKWILHNCIIYNGGNHKLTQIAKVVIKICEHEMNEIEVCPECYLAACQKRDNWFCEPCSNPHPLVWAKLKGFPFWPAKALRDKDGQVDARFFGQHDRAWVPINNCYLMSKEIPFSVKKTKSIFNSAMQEMEVYVENIRRKFGVFNYSPFRTPYTPNSQYQMLLDPTNPSAGTAKIDKQEKVKLNFDMTASPKILMSKPVLSGGTGRRISLSDMPRSPMSTNSSVHTGSDVEQDAEKKATSSHFSASEESMDFLDKSTASPASTKTGQAGSLSGSPKPFSPQLSAPITTKTDKTSTTGSILNLNLDRSKAEMDLKELSESVQQQSTPVPLISPKRQIRSRFQLNLDKTIESCKAQLGINEISEDVYTAVEHSDSEDSEKSDSSDSEYISDDEQKSKNEPEDTEDKEGCQMDKEPSAVKKKPKPTNPVEIKEELKSTSPASEKADPGAVKDKASPEPEKDFSEKAKPSPHPIKDKLKGKDETDSPTVHLGLDSDSESELVIDLGEDHSGREGRKNKKEPKEPSPKQDVVGKTPPSTTVGSHSPPETPVLTRSSAQTSAAGATATTSTSSTVTVTAPAPAATGSPVKKQRPLLPKETAPAVQRVVWNSSTVQQKEITQSPSTSTITLVTSTQSSPLVTSSGSMSTLVSSVNADLPIATASADVAADIAKYTSKMMDAIKGTMTEIYNDLSKNTTGSTIAEIRRLRIEIEKLQWLHQQELSEMKHNLELTMAEMRQSLEQERDRLIAEVKKQLELEKQQAVDETKKKQWCANCKKEAIFYCCWNTSYCDYPCQQAHWPEHMKSCTQSATAPQQEADAEVNTETLNKSSQGSSSSTQSAPSETASASKEKETSAEKSKESGSTLDLSGSRETPSSILLGSNQGSDHSRSNKSSWSSSDEKRGSTRSDHNTSTSTKSLLPKESRLDTFWD

SEQ ID NO: 890397 - protein, 1188 aa, Homo sapiens
MHPQSLAEEEIKTEQEVVEGMDISTRSKDPGSAERTAQKRKFPSPPHSSNGHSPQDTSTSPIKKKKKPGLLNSNNKEQSELRHGPFYYMKQPLTTDPVDVVPQDGRNDFYCWVCHREGQVLCCELCPRVYHAKCLRLTSEPEGDWFCPECEKITVAECIETQSKAMTMLTIEQLSYLLKFAIQKMKQPGTDAFQKPVPLEQHPDYAEYIFHPMDLCTLEKNAKKKMYGCTEAFLADAKWILHNCIIYNGGNHKLTQIAKVVIKICEHEMNEIEVCPECYLAACQKRDNWFCEPCSNPHPLVWAKLKGFPFWPAKALRDKDGQVDARFFGQHDRAWVPINNCYLMSKEIPFSVKKTKSIFNSAMQEMEVYVENIRRKFGVFNYSPFRTPYTPNSQYQMLLDPTNPSAGTAKIDKQEKVKLNFDMTASPKILMSKPVLSGGTGRRISLSDMPRSPMSTNSSVHTGSDVEQDAEKKATSSHFSASEESMDFLDKSTASPASTKTGQAGSLSGSPKPFSPQLSAPITTKTDKTSTTGSILNLNLDRSKAEMDLKELSESVQQQSTPVPLISPKRQIRSRFQLNLDKTIESCKAQLGINEISEDVYTAVEHSDSEDSEKSDSSDSEYISDDEQKSKNEPEDTEDKEGCQMDKEPSAVKKKPKPTNPVEIKEELKSTSPASEKADPGAVKDKASPEPEKDFSEKAKPSPHPIKDKLKGKDETDSPTVHLGLDSDSESELVIDLGEDHSGREGRKNKKEPKEPSPKQDVVGKTPPSTTVGSHSPPETPVLTRSSAQTSAAGATATTSTSSTVTVTAPAPAATGSPVKKQRPLLPKETAPAVQRVVWNSSTVQQKEITQSPSTSTITLVTSTQSSPLVTSSGSMSTLVSSVNADLPIATASADVAADIAKYTSKMMDAIKGTMTEIYNDLSKNTTGSTIAEIRRLRIEIEKLQWLHQQELSEMKHNLELTMAEMRQSLEQERDRLIAEVKKQLELEKQQAVDETKKKQWCANCKKEAIFYCCWNTSYCDYPCQQAHWPEHMKSCTQSATAPQQEADAEVNTETLNKSSQGSSSSTQSAPSETASASKEKETSAEKSKESGSTLDLSGSRETPSSILLGSNQGSVSKRCDKQPAYAPTTTDHQPHPNYPAQKYHSRSNKSSWSSSDEKRGSTRSDHNTSTSTKSLLPKESRLDTFWD

SEQ ID NO: 890398 - protein, 1170 aa, Homo sapiens
MHPQSLAEEEIKTEQEVVEGMDISTRSKDPGSAERTAQKRKFPSPPHSSNGHSPQDTSTSPIKKKKKPGLLNSNNKEQSELRHGPFYYMKQPLTTDPVDVVPQDGRNDFYCWVCHREGQVLCCELCPRVYHAKCLRLTSEPEGDWFCPECEKITVAECIETQSKAMTMLTIEQLSYLLKFAIQKMKQPGTDAFQKPVPLEQHPDYAEYIFHPMDLCTLEKNAKKKMYGCTEAFLADAKWILHNCIIYNGGNHKLTQIAKVVIKICEHEMNEIEVCPECYLAACQKRDNWFCEPCSNPHPLVWAKLKGFPFWPAKALRDKDGQVDARFFGQHDRAWVPINNCYLMSKEIPFSVKKTKSIFNSAMQEMEVYVENIRRKFGVFNYSPFRTPYTPNSQYQMLLDPTNPSAGTAKIDKQEKVKLNFDMTASPKILMSKPVLSGGTGRRISLSDMPRSPMSTNSSVHTGSDVEQDAEKKATSSHFSASEESMDFLDKSTASPASTKTGQAGSLSGSPKPFSPQLSAPITTKTDKTSTTGSILNLNLDRSKAEMDLKELSESVQQQSTPVPLISPKRQIRSRFQLNLDKTIESCKAQLGINEISEDVYTAVEHSDSEDSEKSDSSDSEYISDDEQKSKNEPEDTEDKEGCQMDKEPSAVKKKPKPTNPVEIKEELKSTSPASEKADPGAVKDKASPEPEKDFSEKAKPSPHPIKDKLKGKDETDSPTVHLGLDSDSESELVIDLGEDHSGREGRKNKKEPKEPSPKQDVVGKTPPSTTVGSHSPPETPVLTRSSAQTSAAGATATTSTSSTVTVTAPAPAATGSPVKKQRPLLPKETAPAVQRVVWNSSSKFQTSSQKWHMQKMQRQQQQQQQQNQQQQPQSSQGTRYQTRQAVKMMDAIKGTMTEIYNDLSKNTTGSTIAEIRRLRIEIEKLQWLHQQELSEMKHNLELTMAEMRQSLEQERDRLIAEVKKQLELEKQQAVDETKKKQWCANCKKEAIFYCCWNTSYCDYPCQQAHWPEHMKSCTQSATAPQQEADAEVNTETLNKSSQGSSSSTQSAPSETASASKEKETSAEKSKESGSTLDLSGSRETPSSILLGSNQGSVSKRCDKQPAYAPTTTDHQPHPNYPAQKYHSRSNKSSWSSSDEKRGSTRSDHNTSTSTKSLLPKESRLDTFWD

SEQ ID NO: 890399 - protein, 1107 aa, Homo sapiens
MHPQSLAEEEIKTEQEVVEGMDISTRSKDPGSAERTAQKRKFPSPPHSSNGHSPQDTSTSPIKKKKKPGLLNSNNKEQSELRHGPFYYMKQPLTTDPVDVVPQDGRNDFYCWVCHREGQVLCCELCPRVYHAKCLRLTSEPEGDWFCPECEKITVAECIETQSKAMTMLTIEQLSYLLKFAIQKMKQPGTDAFQKPVPLEQHPDYAEYIFHPMDLCTLEKNAKKKMYGCTEAFLADAKWILHNCIIYNGGNHKLTQIAKVVIKICEHEMNEIEVCPECYLAACQKRDNWFCEPCSNPHPLVWAKLKGFPFWPAKALRDKDGQVDARFFGQHDRAWVPINNCYLMSKEIPFSVKKTKSIFNSAMQEMEVYVENIRRKFGVFNYSPFRTPYTPNSQYQMLLDPTNPSAGTAKIDKQEKVKLNFDMTASPKILMSKPVLSGGTGRRISLSDMPRSPMSTNSSVHTGSDVEQDAEKKATSSHFSASEESMDFLDKSTASPASTKTGQAGSLSGSPKPFSPQLSAPITTKTDKTSTTGSILNLNLDRSKAEMDLKELSESVQQQSTPVPLISPKRQIRSRFQLNLDKTIESCKAQLGINEISEDVYTAVEHSDSEDSEKSDSSDSEYISDDEQKSKNEPEDTEDKEGCQMDKEPSAVKKKPKPTNPVEIKEELKSTSPASEKADPGAVKDKASPEPEKDFSEKAKPSPHPIKDKLKGKDETDSPTVHLGLDSDSESELVIDLGEDHSGREGRKNKKEPKEPSPKQDAVQQKEITQSPSTSTITLVTSTQSSPLVTSSGSMSTLVSSVNADLPIATASADVAADIAKYTSKMMDAIKGTMTEIYNDLSKNTTGSTIAEIRRLRIEIEKLQWLHQQELSEMKHNLELTMAEMRQSLEQERDRLIAEVKKQLELEKQQAVDETKKKQWCANCKKEAIFYCCWNTSYCDYPCQQAHWPEHMKSCTQSATAPQQEADAEVNTETLNKSSQGSSSSTQSAPSETASASKEKETSAEKSKESGSTLDLSGSRETPSSILLGSNQGSVSKRCDKQPAYAPTTTDHQPHPNYPAQKYHSRSNKSSWSSSDEKRGSTRSDHNTSTSTKSLLPKESRLDTFWD

SEQ ID NO: 890400 - protein, 226 aa, Homo sapiens
MAEMRQSLEQERDRLIAEVKKQLELEKQQAVDETKKKQWCANCKKEAIFYCCWNTSYCDYPCQQAHWPEHMKSCTQSATAPQQEADAEVNTETLNKSSQGSSSSTQSAPSETASASKEKETSAEKSKESGSTLDLSGSRETPSSILLGSNQGSVSKRCDKQPAYAPTTTDHQPHPNYPAQKYHSRSNKSSWSSSDEKRGSTRSDHNTSTSTKSLLPKESRLDTFWD

SEQ ID NO: 890401 - protein, 133 aa, Homo sapiens [sequence omitted]

SEQ ID NO: 890402 - protein, 1125 aa, Homo sapiens
MHPQSLAEEEIKTEQEVVEGMDISTRSKDPGSAERTAQKRKFPSPPHSSNGHSPQDTSTSPIKKKKKPGLLNSNNKEQSELRHGPFYYMKQPLTTDPVDVVPQDGRNDFYCWVCHREGQVLCCELCPRVYHAKCLRLTSEPEGDWFCPECEKITVAECIETQSKAMTMLTIEQLSYLLKFAIQKMKQPGTDAFQKPVPLEQHPDYAEYIFHPMDLCTLEKNAKKKMYGCTEAFLADAKWILHNCIIYNGGNHKLTQIAKVVIKICEHEMNEIEVCPECYLAACQKRDNWFCEPCSNPHPLVWAKLKGFPFWPAKALRDKDGQVDARFFGQHDRAWVPINNCYLMSKEIPFSVKKTKSIFNSAMQEMEVYVENIRRKFGVFNYSPFRTPYTPNSQYQMLLDPTNPSAGTAKIDKQEKVKLNFDMTASPKILMSKPVLSGGTGRRISLSDMPRSPMSTNSSVHTGSDVEQDAEKKATSSHFSASEESMDFLDKSTASPASTKTGQAGSLSGSPKPFSPQLSAPITTKTDKTSTTGSILNLNLDRSKAEMDLKELSESVQQQSTPVPLISPKRQIRSRFQLNLDKTIESCKAQLGINEISEDVYTAVEHSDSEDSEKSDSSDSEYISDDEQKSKNEPEDTEDKEGCQMDKEPSAVKKKPKPTNPVEIKEELKSTSPASEKADPGAVKDKASPEPEKDFSEKAKPSPHPIKDKLKGKDETDSPTVHLGLDSDSESELVIDLGEDHSGREGRKNKKEPKEPSPKQDVVGKTPPSTTVGSHSPPETPVLTRSSAQTSAAGATATTSTSSTVTVTAPAPAATGSPVKKQRPLLPKETAPAVQRVVWNSSTVQQKEITQSPSTSTITLVTSTQSSPLVTSSGSMSTLVSSVNADLPIATASADVAADIAKYTSKMMDAIKGTMTEIYNDLSKNTTGSTIAEIRRLRIEIEKLQWLHQQELSEMKHNLELTMAEMRQSLEQERDRLIAEVKKQLELEKQQAVDETKKKQWCANCKKEAIFYCCWNTSYCDYPCQQAHWPEHMKSCTQSATAPQQEADAEVNTETLNKSSQGSSSSTQSAPSETASASKEKETSAEKSKESGSTLDLSGSRETPSSILLGSNQGSVSTRCDRATC

SEQ ID NO: 890403 - protein, 441 aa, Homo sapiens
MLPHNTTEAPGPHSAKQDSYEQGDSSQQSLKGHLRNNFQKQLLSNKELILDKVYTHPKWNTQTKARSYSYPHCTGISQQDPESDSQGQGNGLFYSSGPQSWYPKANNQDFIPFTKKRVGVDRAFPLKPMVHRKSCSTGEAGTDGDHNVYPRPPEPREFSSRNFGVRNQGNFSVVGTVLAATQAEKAVANFDRTEWVQIRRLEAAGESLEEEIRRKQILLRGKLKKTEEELRRIQTQKEQAKENENGELQKIILPRSRVKGNKSNTMYKPIFSPEFEFEEEFSRDRREDETWGRSQQNSVPFQFSDYRIQRLKRERLVASNNKIRDPVSEPSVEKFSPPSETPVGALQGSARNSSLSMAPDSSGSSGSIEEPQLGECSHCGRKFLSFRLERHSNICSRMRGSKRKVFDSSRARAKGTELEQYLNWKGPASAKAEPPQKSNWR

SEQ ID NO: 890404 - protein, 275 aa, Homo sapiens
MLPHNTTEAPGPHSAKQDSYEQGDSSQQSLKGHLRNNFQKQLLSNKELILDKVYTHPKWNTQTKARSYSYPHCTGISQQDPESDSQGQGNGLFYSSGPQSWYPKANNQDFIPFTKKRVGVDRAFPLKPMVHRKSCSTGEAGTDGDHNVYPRPPEPREFSSRNFGVRNQGNFSVVGTVLAATQAEKAVANFDRTEWVQIRRLEAAGESLEEEIRRKQILLRGKLKKTEEELRRIQTQKEQAKENENGELQKIILPRSRVKVLCLWKLSGCTFLSFL

SEQ ID NO: 890405 - protein, 275 aa, Homo sapiens; identical to SEQ ID NO: 890404

SEQ ID NO: 890406 - protein, 260 aa, Homo sapiens
MLPHNTTEAPGPHSAKQDSYEQGDSSQQSLKGHLRNNFQKQLLSNKELILDKVYTHPKWNTQTKARSYSYPHCTGISQQDPESDSQGQGNGLFYSSGPQSWYPKANNQDFIPFTKKRVGVDRAFPLKPMVHRKSCSTGEAGTDGDHNVYPRPPEPREFSSRNFGVRNQGNFSVVGTVLAATQAEKAVANFDRTEWVQIRRLEAAGESLEEEIRRKQILLRGKLKKTEEELRRIQTQKEQAKENENGELQKIILPRSRVKG

SEQ ID NO: 890407 - protein, 487 aa, Homo sapiens
EKGFTNLCGMLEQASWRKQDSVTKIFQKKKILVTYSFRQSFPLVEMHMQLFQNSYYQFGIKLLSAVPGGERKVLIIFNAPSLQDRLRFTSDLRESIAEVQEMEKYRVESELEKQKGMMRPNASQPGGAKDSVNGTMARSSLEDTYGAGDGLKRGALTVPCETSLMQGSVISSPRPHQRMPPPPPPPPPEEYKSQRPVSNSSSFLGSLFGSKRGKGPFQMPPPPTGQASASSSSASSTHHHHHHHHHGHSHGGLGVLPDGQSKLQALHAQYCQGPGPAPPPYLPPQQPSLPPPPQQPPPLPQLGSIPPPPASAPPVGPHRHFHAHGPVPGPQHYTLGRPGRAPRRGAGGHPQFAPHGRHPLHQPTSPLPLYSPAPQHPPAHKQGPKHFIFSHHPQMMPAAGAAGGPGSRPPGGSYSHPHHPQSPLSPHSPIPPHPSYPPLPPPSPHTPHSPLPPTSPHGPLHASGPPGTANPPSANPKAKPSRISTVV

SEQ ID NO: 890408 - protein, 1161 aa, Homo sapiens
RQPQLLLPVPPAPALSPGPPRAPGPSSPVRALASRRPPPPAGPGGGWRRERAGTGLSCPFPCPWAARMEAGSGPPGGPGSESPNRAVEYLLELNNIIESQQQLLETQRRRIEELEGQLDQLTQENRDLREESQLHRGELHRDPHGARDSPGRESQYQNLRETQFHHRELRESQFHQAARDVGYPNREGAYQNREAVYRDKERDASYPLQDTTGYTARERDVAQCHLHHENPALGRERGGREAGPAHPGREKEAGYSAAVGVGPRPPRERGQLSRGASRSSSPGAGGGHSTSTSTSPATTLQRKSDGENSRTVSVEGDAPGSDLSTAVDSPGSQPPYRLSQLPPSSSHMGGPPAGVGLPWAQRARLQPASVALRKQEEEEIKRSKALSDSYELSTDLQDKKVEMLERKYGGSFLSRRAARTIQTAFRQYRMNKNFERLRSSASESRMSRRIILSNMRMQFSFEEYEKAQNPAYFEGKPASLDEGAMAGARSHRLERGLPYGGSCGGGIDGGGSSVTTSGEFSNDITELEDSFSKQVKSLAESIDEALNCHPSGPMSEEPGSAQLEKRESKEQQEDSSATSFSDLPLYLDDTVPQQSPERLPSTEPPPQGRPEFWAPAPLPPVPPPVPSGTREDGSREEGTRRGPGCLECRDFRLRAAHLPLLTIEPPSDSSVDLSDRSDRGSVHRQLVYEADGCSPHGTLKHKGPPGRAPIPHRHYPAPEGPAPAPPGPLPPAPNSGTGPSGVAGGRRLGKCEAAGENSDGGDNESLESSSNSNETINCSSGSSSRDSLREPPATGLCKQTYQRETRHSWDSPAFNNDVVQRRHYRIGLNLFNKKPEKGIQYLIERGFLSDTPVGVAHFILERKGLSRQMIGEFLGNRQKQFNRDVLDCVVDEMDFSSMDLDDALRKFQSHIRVQGEAQKVERLIEAFSQRYCVCNPALVRQFRNPDTIFILAFAIILLNTDMYSPSVKAERKMKLDDFIKNLRGVDNGEDIPRDLLVGIYQRIQGRELRTNDDHVSQVQAVERMIVGKKPVLSLPHRRLVCCCQLYEVPDPNRPQRLGLHQREVFLFNDLLVVTKIFQKKKILVTYSFRQSFPLVEMHMQLFQNSYYQFGIKLLSAVPGGERKVLIIFNAPSLQDRLRFTSDLRESIAEVQEMEKYRVECE

SEQ ID NO: 890409 - protein, 1555 aa, Homo sapiens
RQPQLLLPVPPAPALSPGPPRAPGPSSPVRALASRRPPPPAGPGGGWRRERAGTGLSCPFPCPWAARMEAGSGPPGGPGSESPNRAVEYLLELNNIIESQQQLLETQRRRIEELEGQLDQLTQENRDLREESQLHRGELHRDPHGARDSPGRESQYQNLRETQFHHRELRESQFHQAARDVGYPNREGAYQNREAVYRDKERDASYPLQDTTGYTARERDVAQCHLHHENPALGRERGGREAGPAHPGREKEAGYSAAVGVGPRPPRERGQLSRGASRSSSPGAGGGHSTSTSTSPATTLQRKSDGENSRTVSVEGDAPGSDLSTAVDSPGSQPPYRLSQLPPSSSHMGGPPAGVGLPWAQRARLQPASVALRKQEEEEIKRSKALSDSYELSTDLQDKKVEMLERKYGGSFLSRRAARTIQTAFRQYRMNKNFERLRSSASESRMSRRIILSNMRMQFSFEEYEKAQNPAYFEGKPASLDEGAMAGARSHRLERGLPYGGSCGGGIDGGGSSVTTSGEFSNDITELEDSFSKQVKSLAESIDEALNCHPSGPMSEEPGSAQLEKRESKEQQEDSSATSFSDLPLYLDDTVPQQSPERLPSTEPPPQGRPEFWAPAPLPPVPPPVPSGTREDGSREEGTRRGPGCLECRDFRLRAAHLPLLTIEPPSDSSVDLSDRSDRGSVHRQLVYEADGCSPHGTLKHKGPPGRAPIPHRHYPAPEGPAPAPPGPLPPAPNSGTGPSGVAGGRRLGKCEAAGENSDGGDNESLESSSNSNETINCSSGSSSRDSLREPPATGLCKQTYQRETRHSWDSPAFNNDVVQRRHYRIGLNLFNKKPEKGIQYLIERGFLSDTPVGVAHFILERKGLSRQMIGEFLGNRQKQFNRDVLDCVVDEMDFSSMDLDDALRKFQSHIRVQGEAQKVERLIEAFSQRYCVCNPALVRQFRNPDTIFILAFAIILLNTDMYSPSVKAERKMKLDDFIKNLRGVDNGEDIPRDLLVGIYQRIQGRELRTNDDHVSQVQAVERMIVGKKPVLSLPHRRLVCCCQLYEVPDPNRPQRLGLHQREVFLFNDLLVVTKIFQKKKILVTYSFRQSFPLVEMHMQLFQNSYYQFGIKLLSAVPGGERKVLIIFNAPSLQDRLRFTSDLRESIAEVQEMEKYRVESELEKQKGMMRPNASQPGGAKDSVNGTMARSSLEDTYGAGDGLKRGALSSSLRDLSDAGKRGRRNSVGSLDSTIEGSVISSPRPHQRMPPPPPPPPPEEYKSQRPVSNSSSFLGSLFGSKRGKGPFQMPPPPTGQASASSSSASSTHHHHHHHHHGHSHGGLGVLPDGQSKLQALHAQYCQGPGPAPPPYLPPQQPSLPPPPQQPPPLPQLGSIPPPPASAPPVGPHRHFHAHGPVPGPQHYTLGRPGRAPRRGAGGHPQFAPHGRHPLHQPTSPLPLYSPAPQHPPAHKQGPKHFIFSHHPQMMPAAGAAGGPGSRPPGGSYSHPHHPQSPLSPHSPIPPHPSYPPLPPPSPHTPHSPLPPTSPHGPLHASGPPGTANPPSANPKAKPSRISTVV

SEQ ID NO: 890410 - protein, 388 aa, Homo sapiens
MMRPNASQPGGAKDSVNGTMARSSLEDTYGAGDGLKRGALSSSLRDLSDAGKRGRRNSVGSLDSTIEGSVISSPRPHQRMPPPPPPPPPEEYKSQRPVSNSSSFLGSLFGSKRGKGPFQMPPPPTGQASASSSSASSTHHHHHHHHHGHSHGGLGVLPDGQSKLQALHAQYCQGPGPAPPPYLPPQQPSLPPPPQQPPPLPQLGSIPPPPASAPPVGPHRHFHAHGPVPGPQHYTLGRPGRAPRRGAGGHPQFAPHGRHPLHQPTSPLPLYSPAPQHPPAHKQGPKHFIFSHHPQMMPAAGAAGGPGSRPPGGSYSHPHHPQSPLSPHSPIPPHPSYPPLPPPSPHTPHSPLPPTSPHGPLHASGPPGTANPPSANPKAKPSRISTVV

SEQ ID NO: 890411 - protein, 1118 aa, Homo sapiens
RQPQLLLPVPPAPALSPGPPRAPGPSSPVRALASRRPPPPAGPGGGWRRERAGTGLSCPFPCPWAARMEAGSGPPGGPGSESPNRAVEYLLELNNIIESQQQLLETQRRRIEELEGQLDQLTQENRDLREESQLHRGELHRDPHGARDSPGRESQYQNLRETQFHHRELRESQFHQAARDVGYPNREGAYQNREAVYRDKERDASYPLQDTTGYTARERDVAQCHLHHENPALGRERGGREAGPAHPGREKEAGYSAAVGVGPRPPRERGQLSRGASRSSSPGAGGGHSTSTSTSPATTLQRKSDGENSRTVSVEGDAPGSDLSTAVDSPGSQPPYRLSQLPPSSSHMGGPPAGVGLPWAQRARLQPASVALRKQEEEEIKRSKALSDSYELSTDLQDKKVEMLERKYGGSFLSRRAARTIQTAFRQYRMNKNFERLRSSASESRMSRRIILSNMRMQFSFEEYEKAQNPAYFEGKPASLDEGAMAGARSHRLERGLPYGGSCGGGIDGGGSSVTTSGEFSNDITELEDSFSKQVKSLAESIDEALNCHPSGPMSEEPGSAQLEKRESKEQQEDSSATSFSDLPLYLDDTVPQQSPERLPSTEPPPQGRPEFWAPAPLPPVPPPVPSGTREDGSREEGTRRGPGCLECRDFRLRAAHLPLLTIEPPSDSSVDLSDRSDRGSVHRQLVYEADGCSPHGTLKHKGPPGRAPIPHRHYPAPEGPAPAPPGPLPPAPNSGTGPSGVAGGRRLGKCEAAGENSDGGDNESLESSSNSNETINCSSGSSSRDSLREPPATGLCKQTYQRETRHSWDSPAFNNDVVQRRHYRIGLNLFNKKPEKGIQYLIERGFLSDTPVGVAHFILERKGLSRQMIGEFLGNRQKQFNRDVLDCVVDEMDFSSMDLDDALRKFQSHIRVQGEAQKVERLIEAFSQRYCVCNPALVRQFRNPDTIFILAFAIILLNTDMYSPSVKAERKMKLDDFIKNLRGVDNGEDIPRDLLVGIYQRIQGRELRTNDDHVSQVQAVERMIVGKKPVLSLPHRRLVCCCQLYEVPDPNRPQRLGLHQREVFLFNDLLVVTKIFQKKKILVTYSFRQSFPLVEMHIVQRLTSDAELCDFVTAQDS

SEQ ID NO: 890412 - protein, 228 aa, Homo sapiens
MSVSEIFVELQGFLAAEQDIREEIRKVVQSLEQTAREILTLLQGVHQGAGFQDIPKRCLKAREHFGTVKTHLTSLKTKFPAEQYYRFHEHWRFVLQRLVFLAAFVVYLETETLVTREAVTEILGIEPDREKGFHLDVEDYLSGVLILASELSRLSVNSVTAGDYSRPLHISTFINELDSGFRLLNLKNDSLRKRYDGLKYDVKKVEEVVYDLSIRGFNKETAAACVEK

SEQ ID NO: 890413 - protein, 228 aa, Homo sapiens; identical to SEQ ID NO: 890412

SEQ ID NO: 890414 - protein, 148 aa, Homo sapiens
MSVSEIFVELQGFLAAEQDIREEIRKVVQSLEQTAREILTLLQGVHQGAGFQDIPKRCLKAREHFGTVKTHLTSLKTKFPAEQYYRFHEHWRFVLQRLVFLAAFVVYLETETLVTREAVTEILGIEAVCQQRDCWRLLPTPPHLHLHQ

SEQ ID NO: 890415 - protein, 228 aa, Homo sapiens; identical to SEQ ID NO: 890412

SEQ ID NO: 890416 - protein, 174 aa, Homo sapiens
YNSSYNSSSYNSYVKTHLTSLKTKFPAEQYYRFHEHWRFVLQRLVFLAAFVVYLETETLVTREAVTEILGIEPDREKGFHLDVEDYLSGVLILASELSRLSVNSVTAGDYSRPLHISTFINELDSGFRLLNLKNDSLRKRYDGLKYDVKKVEEVVYDLSIRGFNKETAAACVEK

SEQ ID NO: 890417 - protein, 120 aa, Homo sapiens
SLLNTVYQEAFEKILGIEPDREKGFHLDVEDYLSGVLILASELSRLSVNSVTAGDYSRPLHISTFINELDSGFRLLNLKNDSLRKRYDGLKYDVKKVEEVVYDLSIRGFNKETAAACVEK

SEQ ID NO: 890418 - protein, 433 aa, Homo sapiens
MRQSHQLPLVGLLLFSFIPSQLCEICEVSEENYIRLKPLLNTMIQSNYNRGTSAVNVVLSLKLVGIQIQTLMQKMIQQIKYNVKSRLSDVSSGELALIILALGVCRNAEENLIYDYHLIDKLENKFQAEIENMEAHNGTPLTNYYQLSLDVLALCLFNGNYSTAEVVNHFTPENKNYYFGSQFSVDTGAMAVLALTCVKKSLINGQIKADEGSLKNISIYTKSLVEKILSEKKENGLIGNTFSTGEAMQALFVSSDYYNENDWNCQQTLNTVLTEISQGAFSNPNAAAQVLPALMGKTFLDINKDSSCVSASGNFNISADEPITVTPPDSQSYISVNYSVRINETYFTNVTVLNGSVFLSVMEKAQKMNDTIFGFTMEERSWGPYITCIQGLCANNNDRTYWELLSGGEPLSQGAGSYVVRNGENLEVRWSKY

SEQ ID NO: 890419 - protein, 306 aa, Homo sapiens
MRQSHQLPLVGLLLFSFIPSQLCEICEVSEENYIRLKPLLNTMIQSNYNRGTSAVNVVLSLKLVGIQIQTLMQKMIQQIKYNVKSRLSDVSSGELALIILALGVCRNAEENLIYDYHLIDKLENKFQAEIENMEAHNGTPLTNYYQLSLDVLALCLFNGNYSTAEVVNHFTPENKNYYFGSQFSVGNFNISADEPITVTPPDSQSYISVNYSVRINETYFTNVTVLNGSVFLSVMEKAQKMNDTIFGFTMEERSWGPYITCIQGLCANNNDRTYWELLSGGEPLSQGAGSYVVRNGENLEVRWSKY

SEQ ID NO: 890420 - protein, 373 aa, Homo sapiens
MRQSHQLPLVGLLLFSFIPSQLCEICVSDVSSGELALIILALGVCRNAEENLIYDYHLIDKLENKFQAEIENMEAHNGTPLTNYYQLSLDVLALCLFNGNYSTAEVVNHFTPENKNYYFGSQFSVDTGAMAVLALTCVKKSLINGQIKADEGSLKNISIYTKSLVEKILSEKKENGLIGNTFSTGEAMQALFVSSDYYNENDWNCQQTLNTVLTEISQGAFSNPNAAAQVLPALMGKTFLDINKDSSCVSASGNFNISADEPITVTPPDSQSYISVNYSVRINETYFTNVTVLNGSVFLSVMEKAQKMNDTIFGFTMEERSWGPYITCIQGLCANNNDRTYWELLSGGEPLSQGAGSYVVRNGENLEVRWSKY

SEQ ID NO: 890421 - protein, 362 aa, Homo sapiens
KYRHFFEACRLLQQMIDIAIDGFLLTPVQKICKYPLQLAELLKYTTQEHGDYSNIKAAYEAMKNVACLINERKRKLESIDKIARWQVSIVGWEGLDILDRSSELIHSGELTKITKQGKSQQRTFFLFDHQLVSCKKDLLRRDMLYYKGRLDMDEMELVDLGDGRDKDCNLSVKNAFKLVSRTTDEVYLFCAKKQEDKARWLQACADERRRVQEDKEMGMEISENQKKLAMLNAQKAGHGKSKVRLQQVPCGPTAPGPAPHPPAPHHYAHKRPPAAGLWPGGTQEEVLALLAHLQQAHPLPEMKTGGCASMELGVKRRTVFVSCVLQSRESFLDPVISLETQLPLWKGGDGHDTKLYPTQKHP

SEQ ID NO: 890422 - protein, 362 aa, Homo sapiens; identical to SEQ ID NO: 890421

SEQ ID NO: 890423 - protein, 270 aa, Homo sapiens
KYRHFFEACRLLQQMIDIAIDGFLLTPVQKICKYPLQLAELLKYTTQEHGDYSNIKAAYEAMKNVACLINERKRKLESIDKIARWQVSIVGWEGLDILDRSSELIHSGELTKITKQGKSQQRTFFLFDHQLVSCKKDLLRRDMLYYKGRLDMDEMELVDLGDGRDKDCNLSVKNAFKLVSRTTDEVYLFCAKKQEDKARWLQACADERRRVQEDKEMGMEISENQKKLAMLNAQKAGHGKSKGKLWRRLCPLNAYQYSPENGSIPQVVSL

SEQ ID NO: 890424 - protein, 71 aa, Homo sapiens
LPVLICQGACYVIKINLPSCSDYSNIKAAYEAMKNVACLINERKRKLESIDKIARWQVSIVGWEVSGKHPT

SEQ ID NO: 890425 - protein, 340 aa, Homo sapiens
KYRHFFEACRLLQQMIDIAIDGFLLTPVQKICKYPLQLAELLKYTTQEHGDYSNIKAAYEAMKNVACLINERKRKLESIDKIARWQVSIVGWEGLDILDRSSELIHSGELTKITKQGKSQQRTFFLFDHQLVSCKKDLLRRDMLYYKGRLDMDEMELVDLGDGRDKDCNLSVKNAFKLVSRTTDEVYLFCAKKQEDKARWLQACADERRRVQEDKEMGMEISENQKKLAMLNAQKAGHGKSKVRLQQVPCGPTAPGPAPHPPAPHHYAHKRPPAAGLWPGGTQEEVLALLAHLQQAHPLPEMKTGGCASMELGVKRRTVFVSCVLQSRESFLDPVIKTSF

SEQ ID NO: 890426 - protein, 362 aa, Homo sapiens; identical to SEQ ID NO: 890421

SEQ ID NO: 890427 - protein, 160 aa, Homo sapiens
LDMDEMELVDLGDGRDKDCNLSVKNAFKLVSRTTDEVYLFCAKKQEDKARWLQACADERRRVQEDKEMGEQPLALQAPVPLLAVIASFSTPMGLLCPAFSLRAESHHGERTRDLQTLNTSECTYKTDHVRCSYYRQHLFSIYLVPDILWPIYRDCLIESL

SEQ ID NO: 890428 - protein, 246 aa, Homo sapiens
ITRIRYRQIHIDIPRTNPLIPLFQQPLVQEIFERILFIWAIRHPASGYVQGINDLVTPFFVVFLSEYVEEDVENFDVTNLSQDMLRSIEADSFWCMSKLLDGIQDNYTFAQPGIQKKVKALEELVSRIDEQVHNHFRRYEVEYLQFAFRWMNNLLMRELPLRCTIRLWDTYQSEPEGFSHFHLYVCAAFLIKWRKEILDEEDFQGLLMLLQNLPTIHWGNEEIGLLLAEAYRLKYMFADAPNHYRR

SEQ ID NO: 890429 - protein, 246 aa, Homo sapiens; identical to SEQ ID NO: 890428

SEQ ID NO: 890430 - protein, 53 aa, Homo sapiens
MLRSIEADSFWCMSKLLDGIQVSCFCPCGNKRLGPEAPSRALVSFLLFCIRQD

SEQ ID NO: 890431 - protein, 246 aa, Homo sapiens; identical to SEQ ID NO: 890428

SEQ ID NO: 890432 - protein, 228 aa, Homo sapiens
ITRIRYRQIHIDIPRTNPLIPLFQQPLVQEIFERILFIWAIRHPASGYVQGINDLVTPFFVVFLSEYVEEDVENFDVTNLSQDMLRSIEADSFWCMSKLLDGIQDNYTFAQPGIQKKVKALEELVSRIDEQVHNHFRRYEVEYLQFAFRWMNNLLMRELPLRCTIRLWDTYQSEPEGFSHFHLYVCAAFLIKWRKEILDEEDFQCFSGILPNPLPFPLRCASVVSFIE

SEQ ID NO: 890433 - protein, 373 aa, Homo sapiens
PVCSEIPVSLLPSPGGCPWVLPSLPDTQTDLDRPPGRSRTGRPDAAMAELPGPFLCGALLGFLCLSGLAVEVKVPTEPLSTPLGKTAELTCTYSTSVGDSFALEWSFVQPGKPISESHPILYFTNGHLYPTGSKSKRVSLLQNPPTVGVATLKLTDVHPSDTGTYLCQVNNPPDFYTNGLGLINLTVLVPPSNPLCSQSGQTSVGGSTALRCSSSEGAPKPVYNWVRLGTFPTPSPGSMVQDEVSGQLILTNLSLTSSGTYRCVATNQMGSASCELTLSVTEPSQGRVAGALIGVLLGVLLLSVAAFCLVRFQKERGKKPKETYGGSDLREDAIAPGISEHTCMRADSSKGFLERPSSASTVTTTKSKLPMVV

SEQ ID NO: 890434 - protein, 135 aa, Homo sapiens
MVQDEVSGQLILTNLSLTSSGTYRCVATNQMGSASCELTLSVTEPSQGRVAGALIGVLLGVLLLSVAAFCLVRFQKERGKKPKETYGGSDLREDAIAPGISEHTCMRADSSKGFLERPSSASTVTTTKSKLPMVV

SEQ ID NO: 890435 - protein, 58 aa, Homo sapiens
MSRGTLPLHPLDEVSGQLILTNLSLTSSGTYRCVATNQMGSASCELTLSVTGRDAGWR

SEQ ID NO: 890436 - protein, 331 aa, Homo sapiens
MPGGGPDLQITGIWVPTSLWSPAPGLAVEVKVPTEPLSTPLGKTAELTCTYSTSVGDSFALEWSFVQPGKPISESHPILYFTNGHLYPTGSKSKRVSLLQNPPTVGVATLKLTDVHPSDTGTYLCQVNNPPDFYTNGLGLINLTVLVPPSNPLCSQSGQTSVGGSTALRCSSSEGAPKPVYNWVRLGTFPTPSPGSMVQDEVSGQLILTNLSLTSSGTYRCVATNQMGSASCELTLSVTEPSQGRVAGALIGVLLGVLLLSVAAFCLVRFQKERGKKPKETYGGSDLREDAIAPGISEHTCMRADSSKGFLERPSSASTVTTTKSKLPMVV

SEQ ID NO: 890437 - protein, 390 aa, Homo sapiens
PVCSEIPVSLLPSPGGCPWVLPSLPDTQTDLDRPPGRSRTGRPDAAMAELPGPFLCGALLGFLCLSGLAVEVKVPTEPLSTPLGKTAELTCTYSTSVGDSFALEWSFVQPGKPISESHPILYFTNGHLYPTGSKSKRVSLLQNPPTVGVATLKLTDVHPSDTGTYLCQVNNPPDFYTNGLGLINLTVLVPPSNPLCSQSGQTSVGGSTALRCSSSEGAPKPVYNWVRLGTFPTPSPGSMVQELLTELNESGTLPLHPLDEVSGQLILTNLSLTSSGTYRCVATNQMGSASCELTLSVTEPSQGRVAGALIGVLLGVLLLSVAAFCLVRFQKERGKKPKETYGGSDLREDAIAPGISEHTCMRADSSKGFLERPSSASTVTTTKSKLPMVV

SEQ ID NO: 890438 - protein, 135 aa, Homo sapiens; identical to SEQ ID NO: 890434

SEQ ID NO: 890439 - protein, 74 aa, Homo sapiens
YPQTLIIDIPPHRPQEMGKKPKETYGGSDLREDAIAPGISEHTCMRADSSKGFLERPSSASTVTTTKSKLPMVV

SEQ ID NO: 890440 - protein, 330 aa, Homo sapiens
PVCSEIPVSLLPSPGGCPWVLPSLPDTQTDLDRPPGRSRTGRPDAAMAELPGPFLCGALLGFLCLSGLAVEVKVPTEPLSTPLGKTAELTCTYSTSVGDSFALEWSFVQPGKPISESHPILYFTNGHLYPTGSKSKRVSLLQNPPTVGVATLKLTDVHPSDTGTYLCQVNNPPDFYTNGLGLINLTVLVPPSNPLCSQSGQTSVGGSTALRCSSSEGAPKPVYNWVRLGTFPTPSPGSMVQDEVSGQLILTNLSLTSSGTYRCVATNQMGSASCELTLSVTEPSQGRVAGALIGVLLGVLLLSVAAFCLVRFQKERGKKPKETYGGSDLR

SEQ ID NO: 890441 - protein, 373 aa, Homo sapiens; identical to SEQ ID NO: 890433

SEQ ID NO: 890442 - protein, 135 aa, Homo sapiens; identical to SEQ ID NO: 890434

SEQ ID NO: 890443 - protein, 218 aa, Homo sapiens
MPGGGPDLQITGIWVPTSLWSPAPGLAVEVKVPTEPLSTPLGKTAELTCTYSTSVGDSFALEWSFVQPGKPISESHPILYFTNGHLYPTGSKSKRVSLLQNPPTVGVATLKLTDVHPSDTGTYLCQVNNPPDFYTNGLGLINLTVLVPPSNPLCSQSGQTSVGGSTALRCSSSEGAPKPVYNWVRLGTFPTPSPGSMVQGKGPGHQEEGTGDLGKSGL

SEQ ID NO: 890444 - protein, 126 aa, Homo sapiens [sequence omitted]

SEQ ID NO: 890445 - protein, 126 aa, Homo sapiens [sequence omitted]

SEQ ID NO: 890446 - protein, 847 aa, Homo sapiens
AALLGSPRRPGRRPLLRALFRTCCPRPARSAAAMRLALLWALGLLGAGSPLPSWPLPNIGGTEEQQAESEKAPREPLEPQVLQDDLPISLKKVLQTSLPEPLRIKLELDGDSHILELLQNRELVPGRPTLVWYQPDGTRVVSEGHTLENCCYQGRVRGYAGSWVSICTCSGLRGLVVLTPERSYTLEQGPGDLQGPPIISRIQDLHLPGHTCALSWRESVHTQTPPEHPLGQRHIRRRRDVVTETKTVELVIVADHSEAQKYRDFQHLLNRTLEVALLLDTFFRPLNVRVALVGLEAWTQRDLVEISPNPAVTLENFLHWRRAHLLPRLPHDSAQLVTGTSFSGPTVGMAIQNSICSPDFSGGVNMDHSTSILGVASSIAHELGHSLGLDHDLPGNSCPCPGPAPAKTCIMEASTDFLPGLNFSNCSRRALEKALLDGMGSCLFERLPSLPPMAAFCGNMFVEPGEQCDCGFLDDCVDPCCDSLTCQLRPGAQCASDGPCCQNCQLRPSGWQCRPTRGDCDLPEFCPGDSSQCPPDVSLGDGEPCAGGQAVCMHGRCASYAQQCQSLWGPGAQPAAPLCLQTANTRGNAFGSCGRNPSGSYVSCTPRDAICGQLQCQTGRTQPLLGSIRDLLWETIDVNGTELNCSWVHLDLGSDVAQPLLTLPGTACGPGLVCIDHRCQRVDLLGAQECRSKCHGHGVCDSNRHCYCEEGWAPPDCTTQLKATSSLTTGLLLSLLVLLVLVMLGASYWYRARLHQRLCQLKGPTCQYRAAQSGPSERPGPPQRALLARGTKSQGPAKPPPPRKPLPADPQGRCPSGDLPGPGAGIPPLVVPSRPAPPPPTVSSLYL

SEQ ID NO: 890447 - protein, 398 aa, Homo sapiens
AALLGSPRRPGRRPLLRALFRTCCPRPARSAAAMRLALLWALGLLGAGSPLPSWPLPNIGGTEEQQAESEKAPREPLEPQVLQDDLPISLKKVLQTSLPEPLRIKLELDGDSHILELLQNRELVPGRPTLVWYQPDGTRVVSEGHTLENCCYQGRVRGYAGSWVSICTCSGLRGLVVLTPERSYTLEQGPGDLQGPPIISRIQDLHLPGHTCALSWRESVHTQTPPEHPLGQRHIRRRRDVVTETKTVELVIVADHSEAQKYRDFQHLLNRTLEVALLLDTFFRPLNVRVALVGLEAWTQRDLVEISPNPAVTLENFLHWRRAHLLPRLPHDSAQLVTGTSFSGPTVGMAIQNSICSPDFSGGVNMDHSTSILGVASSIAHELGHSLGLDHDLLESRP

SEQ ID NO: 890448 - protein, 83 aa, Homo sapiens
RHPLADILHRGCPLLRRWLCRRCVVCQAPETPESYVCRTLDCEAVYCWSCWDDMRQRCPVCTPREELSSSAFSDSNDDTAYAG

SEQ ID NO: 890449 - protein, 805 aa, Homo sapiens
AALLGSPRRPGRRPLLRALFRTCCPRPARSAAAMRLALLWALGLLGAGSPLPSWPLPNIGGTEEQQAESEKAPREPLEPQVLQDDLPISLKKVLQTSLPEPLRIKLELDGDSHILELLQNRELVPGRPTLVWYQPDGTRVVSEGHTLENCCYQGRVRGYAGSWVSICTCSGLRGLVVLTPERSYTLEQGPGDLQGPPIISRIQDLHLPGHTCALSWRESVHTQTPPEHPLGQRHIRRRRDVVTETKTVELVIVADHSEAQKYRDFQHLLNRTLEVALLLDTFFRPLNVRVALVGLEAWTQRDLVEISPNPAVTLENFLHWRRAHLLPRLPHDSAQLVTGTSFSGPTVGMAIQNSICSPDFSGGVNMDHSTSILGVASSIAHELGHSLGLDHDLPGNSCPCPGPAPAKTCIMEASTDFLPGLNFSNCSRRALEKALLDGMGSCLFERLPSLPPMAAFCGNMFVEPGEQCDCGFLDDCVDPCCDSLTCQLRPGAQCASDGPCCQNCQLRPSGWQCRPTRGDCDLPEFCPGDSSQCPPDVSLGDGEPCAGGQAVCMHGRCASYAQQCQSLWGPGAQPAAPLCLQTANTRGNAFGSCGRNPSGSYVSCTPRDAICGQLQCQTGRTQPLLGSIRDLLWETIDVNGTELNCSWVHLDLGSDVAQPLLTLPGTACGPGLVCIDHRCQRVDLLGAQECRSKCHGHGVCDSNRHCYCEEGWAPPDCTTQLKATSSLTTGLLLSLLVLLVLVMLGASYWYRARLHQRLCQLKGPTCQYSLRGQPSPHPQGSHCLPTPRAGAHRVTCPAQGLESRP

SEQ ID NO: 890450 - protein, 895 aa, Homo sapiens
AALLGSPRRPGRRPLLRALFRTCCPRPARSAAAMRLALLWALGLLGAGSPLPSWPLPNIGGTEEQQAESEKAPREPLEPQVLQDDLPISLKKVLQTSLPEPLRIKLELDGDSHILELLQNRELVPGRPTLVWYQPDGTRVVSEGHTLENCCYQGRVRGYAGSWVSICTCSGLRGLVVLTPERSYTLEQGPGDLQGPPIISRIQDLHLPGHTCALSWRESVHTQTPPEHPLGQRHIRRRRDVVTETKTVELVIVADHSEAQKYRDFQHLLNRTLEVALLLDTFFRPLNVRVALVGLEAWTQRDLVEISPNPAVTLENFLHWRRAHLLPRLPHDSAQLVTGTSFSGPTVGMAIQNSICSPDFSGGVNMDHSTSILGVASSIAHELGHSLGLDHDLPGNSCPCPGPAPAKTCIMEASTDFLPGLNFSNCSRRALEKALLDGMGSCLFERLPSLPPMAAFCGNMFVEPGEQCDCGFLDDCVDPCCDSLTCQLRPGAQCASDGPCCQNCQLRPSGWQCRPTRGDCDLPEFCPGDSSQCPPDVSLGDGEPCAGGQAVCMHGRCASYAQQCQSLWGPGAQPAAPLCLQTANTRGNAFGSCGRNPSGSYVSCTPRDAICGQLQCQTGRTQPLLGSIRDLLWETIDVNGTELNCSWVHLDLGSDVAQPLLTLPGTACGPGLVCIDHRCQRVDLLGAQECRSKCHGHGVCDSNRHCYCEEGWAPPDCTTQLKATSSLTTGLLLSLLVLLVLVMLGASYWYRARLHQRLCQLKGPTCQYRAAQSGPSERPGPPQRALLARGTKASALSFPAPPSRPLPPDPVSKRLQAELADRPNPPTRPLPADPVVRSPKSQGPAKPPPPRKPLPADPQGRCPSGDLPGPGAGIPPLVVPSRPAPPPPTVSSLYL

SEQ ID NO: 890451 - protein, 790 aa, Homo sapiens
MPCGTEEQQAESEKAPREPLEPQVLQDDLPISLKKVLQTSLPEPLRIKLELDGDSHILELLQNRELVPGRPTLVWYQPDGTRVVSEGHTLENCCYQGRVRGYAGSWVSICTCSGLRGLVVLTPERSYTLEQGPGDLQGPPIISRIQDLHLPGHTCALSWRESVHTQTPPEHPLGQRHIRRRRDVVTETKTVELVIVADHSEAQKYRDFQHLLNRTLEVALLLDTFFRPLNVRVALVGLEAWTQRDLVEISPNPAVTLENFLHWRRAHLLPRLPHDSAQLVTGTSFSGPTVGMAIQNSICSPDFSGGVNMDHSTSILGVASSIAHELGHSLGLDHDLPGNSCPCPGPAPAKTCIMEASTDFLPGLNFSNCSRRALEKALLDGMGSCLFERLPSLPPMAAFCGNMFVEPGEQCDCGFLDDCVDPCCDSLTCQLRPGAQCASDGPCCQNCQLRPSGWQCRPTRGDCDLPEFCPGDSSQCPPDVSLGDGEPCAGGQAVCMHGRCASYAQQCQSLWGPGAQPAAPLCLQTANTRGNAFGSCGRNPSGSYVSCTPRDAICGQLQCQTGRTQPLLGSIRDLLWETIDVNGTELNCSWVHLDLGSDVAQPLLTLPGTACGPGLVCIDHRCQRVDLLGAQECRSKCHGHGVCDSNRHCYCEEGWAPPDCTTQLKATSSLTTGLLLSLLVLLVLVMLGASYWYRARLHQRLCQLKGPTCQYRAAQSGPSERPGPPQRALLARGTKSQGPAKPPPPRKPLPADPQGRCPSGDLPGPGAGIPPLVVPSRPAPPPPTVSSLYL

SEQ ID NO: 890452 - protein, 826 aa, Homo sapiens
AALLGSPRRPGRRPLLRALFRTCCPRPARSAAAMRLALLWALGLLGAGSPLPSWPLPNIGGTEEQQAESEKAPREPLEPQVLQDDLPISLKKVLQTSLPEPLRIKLELDGDSHILELLQNRELVPGRPTLVWYQPDGTRVVSEGHTLENCCYQGRVRGYAGSWVSICTCSGLRGLVVLTPERSYTLEQGPGDLQGPPIISRIQDLHLPGHTCALSWRESVHTQTPPEHPLGQRHIRRAQKYRDFQHLLNRTLEVALLLDTFFRPLNVRVALVGLEAWTQRDLVEISPNPAVTLENFLHWRRAHLLPRLPHDSAQLVTGTSFSGPTVGMAIQNSICSPDFSGGVNMDHSTSILGVASSIAHELGHSLGLDHDLPGNSCPCPGPAPAKTCIMEASTDFLPGLNFSNCSRRALEKALLDGMGSCLFERLPSLPPMAAFCGNMFVEPGEQCDCGFLDDCVDPCCDSLTCQLRPGAQCASDGPCCQNCQLRPSGWQCRPTRGDCDLPEFCPGDSSQCPPDVSLGDGEPCAGGQAVCMHGRCASYAQQCQSLWGPGAQPAAPLCLQTANTRGNAFGSCGRNPSGSYVSCTPRDAICGQLQCQTGRTQPLLGSIRDLLWETIDVNGTELNCSWVHLDLGSDVAQPLLTLPGTACGPGLVCIDHRCQRVDLLGAQECRSKCHGHGVCDSNRHCYCEEGWAPPDCTTQLKATSSLTTGLLLSLLVLLVLVMLGASYWYRARLHQRLCQLKGPTCQYRAAQSGPSERPGPPQRALLARGTKSQGPAKPPPPRKPLPADPQGRCPSGDLPGPGAGIPPLVVPSRPAPPPPTVSSLYL

SEQ ID NO: 890453 - protein, 820 aa, Homo sapiens
MPCGTEEQQAESEKAPREPLEPQVLQDDLPISLKKVLQTSLPEPLRIKLELDGDSHILELLQNRELVPGRPTLVWYQPDGTRVVSEGHTLENCCYQGRVRGYAGSWVSICTCSGLRGLVVLTPERSYTLEQGPGDLQGPPIISRIQDLHLPGHTCALSWRESVHTQTPPEHPLGQRHIRRSRSGCLLVSPAQLLAASGRFAWIILLVHSERRDVVTETKTVELVIVADHSEAQKYRDFQHLLNRTLEVALLLDTFFRPLNVRVALVGLEAWTQRDLVEISPNPAVTLENFLHWRRAHLLPRLPHDSAQLVTGTSFSGPTVGMAIQNSICSPDFSGGVNMDHSTSILGVASSIAHELGHSLGLDHDLPGNSCPCPGPAPAKTCIMEASTDFLPGLNFSNCSRRALEKALLDGMGSCLFERLPSLPPMAAFCGNMFVEPGEQCDCGFLDDCVDPCCDSLTCQLRPGAQCASDGPCCQNCQLRPSGWQCRPTRGDCDLPEFCPGDSSQCPPDVSLGDGEPCAGGQAVCMHGRCASYAQQCQSLWGPGAQPAAPLCLQTANTRGNAFGSCGRNPSGSYVSCTPRDAICGQLQCQTGRTQPLLGSIRDLLWETIDVNGTELNCSWVHLDLGSDVAQPLLTLPGTACGPGLVCIDHRCQRVDLLGAQECRSKCHGHGVCDSNRHCYCEEGWAPPDCTTQLKATSSLTTGLLLSLLVLLVLVMLGASYWYRARLHQRLCQLKGPTCQYRAAQSGPSERPGPPQRALLARGTKSQGPAKPPPPRKPLPADPQGRCPSGDLPGPGAGIPPLVVPSRPAPPPPTVSSLYL

SEQ ID NO: 890454 - protein, 250 aa, Homo sapiens
AALLGSPRRPGRRPLLRALFRTCCPRPARSAAAMRLALLWALGLLGAGSPLPSWPLPNIGGTEEQQAESEKAPREPLEPQVLQDDLPISLKKVLQTSLPEPLRIKLELDGDSHILELLQNRELVPGRPTLVWYQPDGTRVVSEGHTLENCCYQGRVRGYAGSWVSICTCSGLRGLVVLTPERSYTLEQGPGDLQGPPIISRIQDLHLPGHTCALSWRESVHTQTPPEHPLGQRHIRRVRMNGRGGGLWLS

SEQ ID NO: 890455 - protein, 847 aa, Homo sapiens; identical to SEQ ID NO: 890446

SEQ ID NO: 890456 - protein, 188 aa, Homo sapiens
MRPPKQPRTISNATSRQHANHKHNATATHDDPRNPKNQRTSRHTRSPTTDKKKISGKTHADKKTHDTTNTHSEGKQMHTFRQRHCVPKTPERKADNSWKNHNRPRLSRDQVDTPPPQLSYSPQGRLLTPSHCTKTQSYAKTAARTDKQNPRHLINTGQEIEKTPDNSTAASRINKDTHKNTKTTPLCS

SEQ ID NO: 890457 - protein, 912 aa, Homo sapiens
AALLGSPRRPGRRPLLRALFRTCCPRPARSAAAMRLALLWALGLLGAGSPLPSWPLPNIGGTEEQQAESEKAPREPLEPQVLQDDLPISLKKVLQTSLPEPLRIKLELDGDSHILELLQNRELVPGRPTLVWYQPDGTRVVSEGHTLENCCYQGRVRGYAGSWVSICTCSGLRGLVVLTPERSYTLEQGPGDLQGPPIISRIQDLHLPGHTCALSWRESVHTQTPPEHPLGQRHIRRRRDVVTETKTVELVIVADHSEAQKYRDFQHLLNRTLEVALLLDTFFRPLNVRVALVGLEAWTQRDLVEISPNPAVTLENFLHWRRAHLLPRLPHDSAQLVTGTSFSGPTVGMAIQNSICSPDFSGGVNMDHSTSILGVASSIAHELGHSLGLDHDLPGNSCPCPGPAPAKTCIMEASTDFLPGLNFSNCSRRALEKALLDGMGSCLFERLPSLPPMAAFCGNMFVEPGEQCDCGFLDDCVDPCCDSLTCQLRPGAQCASDGPCCQNCQLRPSGWQCRPTRGDCDLPEFCPGDSSQCPPDVSLGDGEPCAGGQAVCMHGRCASYAQQCQSLWGPGAQPAAPLCLQTANTRGNAFGSCGRNPSGSYVSCTPRDAICGQLQCQTGRTQPLLGSIRDLLWETIDVNGTELNCSWVHLDLGSDVAQPLLTLPGTACGPGLVCIDHRCQRVDLLGAQECRSKCHGHGVCDSNRHCYCEEGWAPPDCTTQLKATSSLTTGLLLSLLVLLVLVMLGASYWYRARLHQRLCQLKGPTCQYRAAQSGPSERPGPPQRALLARGTKASALSFPAPPSRPLPPDPVSKRLQAELADRPNPPTRPLPADPVVRSPKVTVGGEKGTASPPTQGCGAGSHDGGGRGEMPPQCMRAHIPVVPLMVTVSGASQAPTPKEATACRPPGPVPIG

SEQ ID NO: 890458 - protein, 812 aa, Homo sapiens
AALLGSPRRPGRRPLLRALFRTCCPRPARSAAAMRLALLWALGLLGAGSPLPSWPLPNIGGTEEQQAESEKAPREPLEPQVLQDDLPISLKKVLQTSLPEPLRIKLELDGDSHILELLQNRELVPGRPTLVWYQPDGTRVVSEGHTLENCCYQGRVRGYAGSWVSICTCSGLRGLVVLTPERSYTLEQGPGDLQGPPIISRIQDLHLPGHTCALSWRESVHTQTPPEHPLGQRHIRRRRDVVTETKTVELVIVADHSEAQKYRDFQHLLNRTLEVALLLDTFFRPLNVRVALVGLEAWTQRDLVEISPNPAVTLENFLHWRRAHLLPRLPHDSAQLVTGTSFSGPTVGMAIQNSICSPDFSGGVNMDHSTSILGVASSIAHELGHSLGLDHDLPGNSCPCPGPAPAKTCIMEASTDFLPGLNFSNCSRRALEKALLDGMGSCLFERLPSLPPMAAFCGNMFVEPGEQCDCGFLDDCVDPCCDSLTCQLRPGAQCASDGPCCQNCQLRPSGWQCRPTRGDCDLPEFCPGDSSQCPPDVSLGDGEPCAGGQAVCMHGRCASYAQQCQSLWGPGAQPAAPLCLQTANTRGNAFGSCGRNPSGSYVSCTPRDAICGQLQCQTGRTQPLLGSIRDLLWETIDVNGTELNCSWVHLDLGSDVAQPLLTLPGTACGPGLVCIDHRCQRVDLLGAQECRSKCHGHGVCDSNRHCYCEEGWAPPDCTTQLKATSSLTTGLLLSLLVLLVLVMLGASYWYRARLHQRLCQLKGPTCQYRAAQSGPSERPGPPQRALLARGTKRLSWLTDPIPLPALCPLTRW

SEQ ID NO: 890459 - protein, 873 aa, Homo sapiens
AALLGSPRRPGRRPLLRALFRTCCPRPARSAAAMRLALLWALGLLGAGSPLPSWPLPNIGGTEEQQAESEKAPREPLEPQVLQDDLPISLKKVLQTSLPEPLRIKLELDGDSHILELLQNRELVPGRPTLVWYQPDGTRVVSEGHTLENCCYQGRVRGYAGSWVSICTCSGLRGLVVLTPERSYTLEQGPGDLQGPPIISRIQDLHLPGHTCALSWRESVHTQTPPEHPLGQRHIRRRRDVVTETKTVELVIVADHSEAQKYRDFQHLLNRTLEVALLLDTVSAGQGNPHPRPLTMATPLLSPSCLQFFRPLNVRVALVGLEAWTQRDLVEISPNPAVTLENFLHWRRAHLLPRLPHDSAQLVTGTSFSGPTVGMAIQNSICSPDFSGGVNMDHSTSILGVASSIAHELGHSLGLDHDLPGNSCPCPGPAPAKTCIMEASTDFLPGLNFSNCSRRALEKALLDGMGSCLFERLPSLPPMAAFCGNMFVEPGEQCDCGFLDDCVDPCCDSLTCQLRPGAQCASDGPCCQNCQLRPSGWQCRPTRGDCDLPEFCPGDSSQCPPDVSLGDGEPCAGGQAVCMHGRCASYAQQCQSLWGPGAQPAAPLCLQTANTRGNAFGSCGRNPSGSYVSCTPRDAICGQLQCQTGRTQPLLGSIRDLLWETIDVNGTELNCSWVHLDLGSDVAQPLLTLPGTACGPGLVCIDHRCQRVDLLGAQECRSKCHGHGVCDSNRHCYCEEGWAPPDCTTQLKATSSLTTGLLLSLLVLLVLVMLGASYWYRARLHQRLCQLKGPTCQYRAAQSGPSERPGPPQRALLARGTKSQGPAKPPPPRKPLPADPQGRCPSGDLPGPGAGIPPLVVPSRPAPPPPTVSSLYL

SEQ ID NO: 890460 - protein, 327 aa, Homo sapiens
AALLGSPRRPGRRPLLRALFRTCCPRPARSAAAMRLALLWALGLLGAGSPLPSWPLPNIGGTEEQQAESEKAPREPLEPQVLQDDLPISLKKVLQTSLPEPLRIKLELDGDSHILELLQNRELVPGRPTLVWYQPDGTRVVSEGHTLENCCYQGRVRGYAGSWVSICTCSGLRGLVVLTPERSYTLEQGPGDLQGPPIISRIQDLHLPGHTCALSWRESVHTQTPPEHPLGQRHIRRRRDVVTETKTVELVIVADHSEAQKYRDFQHLLNRTLEVALLLDTVSAGQGNPHPRPLTMATPLLSPSCLSVLPAPECTSGTSGPGGLDPA

SEQ ID NO: 890461 - protein, 212 aa, Homo sapiens
AALLGSPRRPGRRPLLRALFRTCCPRPARSAAAMRLALLWALGLLGAGSPLPSWPLPNIGGTEEQQAESEKAPREPLEPQVLQDDLPISLKKVLQTSLPEPLRIKLELDGDSHILELLQNRELVPGRPTLVWYQPDGTRVVSEGHTLENCCYQGRVRGYAGSWVSICTCSGLRGLVVLTPERSYTRGGGGRQITRPQEFETSLGNTVRSRLC

SEQ ID NO: 890462 - protein, 333 aa, Homo sapiens
TKARYEAGLCGPADMAAAVAAALARLLAAFLLLAAQVACEYGMVHVVSQAGGPEGKDYCILYNPQWAHLPHDLSKASFLQLRNWTASLLCSAADLPARGFSNQIPLVARGNCTFYEKVRLAQGSGARGLLIVSRERLVPPGGNKTQYDEIGIPVALLSYKDMLDIFTRFGRTVRAALYAPKEPVLDYNMVIIFIMAVGTVAIGGYWAGSRDVKKRYMKHKRDDGPEKQEDEAVDVTPVMTCVFVVMCCSMLVLLYYFYDLLVYVVIGIFCLASATGLYSCLAPCVRRLPFGKCRIPNNSLPYFHKRPQARMLLLALFCVAVSVVWGVFRNEDQ

SEQ ID NO: 890463 - protein, 392 aa, Homo sapiens
RGGSLRFSPPRVPSCSRVFCPVPPGGCGLPSPVSASRPQGPTTPWCLPRRYMKHKRDDGPEKQEDEAVDVTPVMTCVFVVMCCSMLVLLYYFYDLLVYVVIGIFCLASATGLYSCLAPCVRRLPFGKCSARRPVCCSWRSSAWPSAWCGASSATRTSKCCFPRAPAGSGVLGRTRAPGALTPCPPWRPPQPGAASAPRDEEPWPRAALTGLRGRFTWGLSGCHGNPDWNPGGEAGAPVARSHVLQPGWDSFVGHRCPGPQSVPRCPFPGTHVHAAGSRPRVWAPGHPVLLVMTAAASEQWWRWGRHCSPHAHLPRGLDLWLPPAGRASPMRPSAWCRVGRTELARPRPVPTAVADTIWHFLPAFLRQPSTLGFGVYWSHGTFNWQKEDVKIF

SEQ ID NO: 890464 - protein, 112 aa, Homo sapiens [sequence omitted]

SEQ ID NO: 890465 - protein, 226 aa, Homo sapiens
MAAAVAAALARLLAAFLLLAAQVACEYGMVHVVSQAGGPEGKDYCILYNPQWAHLPHDLSKAYFPCKLAQSGTGPPLARATASATYPAPCASSNQDPCCVAAAGTCTVLLRTVMAWPMEHAVRHAGLAQSYSMWMMCLVSPWGWYIQTHVVTDDLDLSLLRRCSGYQKTLAGPSFLLFRAGTVEVLAADIAAIMDAVCLELTSIGPSYFSQWSVRHPVANRQATWA

SEQ ID NO: 890466 - protein, 592 aa, Homo sapiens
MAAAVAAALARLLAAFLLLAAQVACEYGMVHVVSQAGGPEGKDYCILYNPQWAHLPHDLSKASFLQLRNWTASLLCSAADLPARGFSNQIPLVARGNCTFYEKVRLAQGSGARGLLIVSRERLVPPGGNKTQYDEIGIPVALLSYKDMLDIFTRFGRTVRAALYAPKEPVLDYNMVIIFIMAVGTVAIGGYWAGSRDVKKRYMKHKRDDGPEKQEDEAVDVTPVMTCVFVVMCCSMLVLLYYFYDLLVYVVIGIFCLASATGLYSCLAPCVRRLPFGKCRIPNNSLPYFHKRPQARMLLLALFCVAVSVVWGVFRNEDQWAWVLQDALGIAFCLYMLKTIRLPTFKACTLLLLVLFLYDIFFVFITPFLTKSGSSIMVEVATGPSDSATREKLPMVLKVPRLNSSPLALCDRPFSLLGFGDILVPGLLVAYCHRFDIQVQSSRVYFVACTIAYGVGLLVTFVALALMQRGQPALLYLVPCTLVTSCAVALWRRELGVFWTGSGFAKVLPPSPWAPAPADGPQPPKDSATPLSPQPPSEEPATSPWPAEQSPKSRTSEEMGAGAPMREPGSPAESEGRDQAQPSPVTQPGASA

SEQ ID NO: 890467 - protein, 592 aa, Homo sapiens; identical to SEQ ID NO: 890466

SEQ ID NO: 890468 - protein, 605 aa, Homo sapiens
MARYEAGLCGPADMAAAVAAALARLLAAFLLLAAQVACEYGMVHVVSQAGGPEGKDYCILYNPQWAHLPHDLSKASFLQLRNWTASLLCSAADLPARGFSNQIPLVARGNCTFYEKVRLAQGSGARGLLIVSRERLVPPGGNKTQYDEIGIPVALLSYKDMLDIFTRFGRTVRAALYAPKEPVLDYNMVIIFIMAVGTVAIGGYWAGSRDVKKRYMKHKRDDGPEKQEDEAVDVTPVMTCVFVVMCCSMLVLLYYFYDLLVYVVIGIFCLASATGLYSCLAPCVRRLPFGKCRIPNNSLPYFHKRPQARMLLLALFCVAVSVVWGVFRNEDQWAWVLQDALGIAFCLYMLKTIRLPTFKACTLLLLVLFLYDIFFVFITPFLTKSGSSIMVEVATGPSDSATREKLPMVLKVPRLNSSPLALCDRPFSLLGFGDILVPGLLVAYCHRFDIQVQSSRVYFVACTIAYGVGLLVTFVALALMQRGQPALLYLVPCTLVTSCAVALWRRELGVFWTGSGFAKVLPPSPWAPAPADGPQPPKDSATPLSPQPPSEEPATSPWPAEQSPKSRTSEEMGAGAPMREPGSPAESEGRDQAQPSPVTQPGASA

SEQ ID NO: 890469 - protein, 511 aa, Homo sapiens
MAAAVAAALARLLAAFLLLAAQVACEYGMVHVVSQAGGPEGKDYCILYNPQWAHLPHDLSKASFLQLRNWTASLLCSAADLPARGFSNQIPLVARGNCTFYEKVRLAQGSGARGLLIVSRERLVPPGGNKTQYDEIGIPVALLSYKDMLDIFTRFGRTVRAALYAPKEPVLDYNMVIIFIMAVGTVAIGGYWAGSRDVKKRYMKHKRDDGPEKQEDEAVDVTPVMTCVFVVMCCSMLVLLYYFYDLLVYVVIGIFCLASATGLYSCLAPCVRRLPFGKCRIPNNSLPYFHKRPQARMLLLALFCVAVSVVWGVFRNEDQWAWVLQDALGIAFCLYMLKTIRLPTFKACTLLLLVLFLYDIFFVFITPFLTKSGSSIMVEVATGPSDSATREKLPMVLKVPRLNSSPLALCDRPFSLLGFGDILVPGLLVAYCHRFDIQVQSSRVYFVACTIAYGVGLLVTFVALALMQRGQPALLYLVPCTLVTSCAVALWRRELGVFWTGSGFAVNTSLL

SEQ ID NO: 890470 - protein, 445 aa, Homo sapiens
MLDIFTRFGRTVRAALYAPKEPVLDYNMVIIFIMAVGTVAIGGYWAGSRDVKKRYMKHKRDDGPEKQEDEAVDVTPVMTCVFVVMCCSMLVLLYYFYDLLVYVVIGIFCLASATGLYSCLAPCVRRLPFGKCRIPNNSLPYFHKRPQARMLLLALFCVAVSVVWGVFRNEDQWAWVLQDALGIAFCLYMLKTIRLPTFKACTLLLLVLFLYDIFFVFITPFLTKSGSSIMVEVATGPSDSATREKLPMVLKVPRLNSSPLALCDRPFSLLGFGDILVPGLLVAYCHRFDIQVQSSRVYFVACTIAYGVGLLVTFVALALMQRGQPALLYLVPCTLVTSCAVALWRRELGVFWTGSGFAKVLPPSPWAPAPADGPQPPKDSATPLSPQPPSEEPATSPWPAEQSPKSRTSEEMGAGAPMREPGSPAESEGRDQAQPSPVTQPGASA

SEQ ID NO: 890471 - protein, 445 aa, Homo sapiens; identical to SEQ ID NO: 890470

SEQ ID NO: 890472 - protein, 592 aa, Homo sapiens; identical to SEQ ID NO: 890466

SEQ ID NO: 890473 - protein, 441 aa, Homo sapiens
RGGSLRFSPPRVPSCSRVFCPVPPGGCGLPSPVSASRPQGPTTPWCLPRRYMKHKRDDGPEKQEDEAVDVTPVMTCVFVVMCCSMLVLLYYFYDLLVYVVIGIFCLASATGLYSCLAPCVRRLPFGKCRIPNNSLPYFHKRPQARMLLLALFCVAVSVVWGVFRNEDQWAWVLQDALGIAFCLYMLKTIRLPTFKACTLLLLVLFLYDIFFVFITPFLTKSGSSIMVEVATGPSDSATREKLPMVLKVPRLNSSPLALCDRPFSLLGFGDILVPGLLVAYCHRFDIQVQSSRVYFVACTIAYGVGLLVTFVALALMQRGQPALLYLVPCTLVTSCAVALWRRELGVFWTGSGFAKVLPPSPWAPAPADGPQPPKDSATPLSPQPPSEEPATSPWPAEQSPKSRTSEEMGAGAPMREPGSPAESEGRDQAQPSPVTQPGASA

SEQ ID NO: 890474 - protein, 232 aa, Homo sapiens
EEVKNLAEKLARFIADGGPEVETIALQNNREKLPMVLKVPRLNSSPLALCDRPFSLLGFGDILVPGLLVAYCHRFDIQVQSSRVYFVACTIAYGVGLLVTFVALALMQRGQPALLYLVPCTLVTSCAVALWRRELGVFWTGSGFAKVLPPSPWAPAPADGPQPPKDSATPLSPQPPSEEPATSPWPAEQSPKSRTSEEMGAGAPMREPGSPAESEGRDQAQPSPVTQPGASA

SEQ ID NO: 890475 - protein, 511 aa, Homo sapiens; identical to SEQ ID NO: 890469

SEQ ID NO: 890476 - protein, 592 aa, Homo sapiens; identical to SEQ ID NO: 890466

SEQ ID NO: 890477 - protein, 573 aa, Homo sapiens
MAAAVAAALARLLAAFLLLAAQVACEYGMVHVVSQAGGPEGKDYCILYNPQWAHLPHDLSKASFLQLRNWTASLLCSAADLPARGFSNQIPLVARGNCTFYEKVRLAQGSGARGLLIVSRERLVPPGGNKTQYDEIGIPVALLSYKDMLDIFTRFGRTVRAALYAPKEPVLDYNMVIIFIMAVGTVAIGGYWAGSRDVKKRYMKHKRDDGPEKQEDEAVDVTPVMTCVFVVMCCSMLVLLYYFYDLLVYVVIGIFCLASATGLYSCLAPCVRRLPFGKCRIPNNSLPYFHKRPQARMLLLALFCVAVSVVWGVFRNEDQWAWVLQDALGIAFCLYMLKTIRLPTFKACTLLLLVLFLYDIFFVFITPFLTKSGSSIMVEVATGPSDSATREKLPMVLKVPRLNSSPLALCDRPFSLLGFGDILVPGLLVAYCHRFDIQVQSSRVYFVACTIAYGVGLLVTFVALALMQRGQPALLYLVPCTLVTSCAVALWRRELGVFWTGSGFAKVLPPSPWAPAPADGPQPPAETEPAPWLSVVPGPQLPPATRPVECGLQTRVQNLFLSSQSSPAAHGDC

SEQ ID NO: 890478 - protein, 38 aa, Homo sapiens
AYCHRFDIQVQSSRVYFVACTIGKCLGWARAGLSGSSP

SEQ ID NO: 890479 - protein, 408 aa, Homo sapiens
YKSWAGAGRAIRDPEVRGRGRAGSPGGRRRRPAQAGGRRGSPCRENSNSPMESADFYEAEPRPPMSSHLQSPPHAPSSAAFGFPRGAGPAQPPAPPAAPEPLGGICEHETSIDISAYIDPAAFNDEFLADLFQHSRQQEKAKAAVGPTGGGGGGDFDYPGAPAGPGGAVMPGGAHGPPPGYGCAAAGYLDGRLEPLYERVGAPALRPLVIKQEPREEDEAKQLALAGLFPYQPPPPPPPSHPHPHPPPAHLAAPHLQFQIAHCGQTTMHLQPGHPTPPPTPVPSPHPAPALGAAGLPGPGSALKGLGAAHPDLRASGGSGAGKAKKSVDKNSNEYRVRRERNNIAVRKSRDKAKQRNVETQQKVLELTSDNDRLRKRVEQLSRELDTLRGIFRQLPESSLVKAMGNCA

SEQ ID NO: 890480 - protein, 379 aa, Homo sapiens
LQVAAHRGPRLRLVEVGRLHGGVRVLPAWRALAPPACAGRRRRPPGDPARPRPRTSGSPPAQPPAPPAAPEPLGGICEHETSIDISAYIDPAAFNDEFLADLFQHSRQQEKAKAAVGPTGGGGGGDFDYPGAPAGPGGAVMPGGAHGPPPGYGCAAAGYLDGRLEPLYERVGAPALRPLVIKQEPREEDEAKQLALAGLFPYQPPPPPPPSHPHPHPPPAHLAAPHLQFQIAHCGQTTMHLQPGHPTPPPTPVPSPHPAPALGAAGLPGPGSALKGLGAAHPDLRASGGSGAGKAKKSVDKNSNEYRVRRERNNIAVRKSRDKAKQRNVETQQKVLELTSDNDRLRKRVEQLSRELDTLRGIFRQLPESSLVKAMGNCA

SEQ ID NO: 890481 - protein, 348 aa, Homo sapiens
YKSWAGAGRAIRDPEVRGRGRAGSPGGRRRRPAQAGGRRGSPCRENSNSPMESADFYEAEPRPPMSSHLQSPPHAPSSAAFGFPRGAGPAQPPAPPAAPEPLGGICEHETSIDISAYIDPAAFNDEFLADLFQHSRQQEKAKAAVGPTGGGGGGDFDYPGAPAGPGGAVMPGGAHGPPPGYGCAAAGYLDGRLEPLYERVGAPALRPLVIKQEPREEDEAKQLALAGLFPYQPPPPPPPSHPHPHPPPAHPDLRASGGSGAGKAKKSVDKNSNEYRVRRERNNIAVRKSRDKAKQRNVETQQKVLELTSDNDRLRKRVEQLSRELDTLRGIFRQLPESSLVKAMGNCA

SEQ ID NO: 890482 - protein, 69 aa, Homo sapiens
AAVIKDPLHMADKAKQRNVETQQKVLELTSDNDRLRKRVEQLSRELDTLRGIFRQLPESSLVKAMGNCA

SEQ ID NO: 890483 - protein, 80 aa, Homo sapiens
SIYRIPSYANVAWPFHMQLHMADKAKQRNVETQQKVLELTSDNDRLRKRVEQLSRELDTLRGIFRQLPESSLVKAMGNCA

SEQ ID NO: 890484 - protein, 408 aa, Homo sapiens; identical to SEQ ID NO: 890479

SEQ ID NO: 890485 - protein, 408 aa, Homo sapiens; identical to SEQ ID NO: 890479

SEQ ID NO: 890486 - protein, 408 aa, Homo sapiens; identical to SEQ ID NO: 890479

SEQ ID NO: 890487 - protein, 68 aa, Homo sapiens
YRIQRGPFILHVKQLLEVDDIKMVLELTSDNDRLRKRVEQLSRELDTLRGIFRQLPESSLVKAMGNCA

SEQ ID NO: 890488 - protein, 408 aa, Homo sapiens; identical to SEQ ID NO: 890479

SEQ ID NO: 890489 - protein, 161 aa, Homo sapiens
SCLSLLSRWGNRYVPPHPAKFLKIFCRHRVLICCLSWSGTPGFKQSSCLSLVCTVCLQHCLGTRSTISPSQRDRSYDKLSKYFALSADINTCIWPLCPSSALCNVNVRVSAKPPFYLVFVLFWFCSDTCQNETLRRQLGEGSETPFPFGFGITFDPGGPMR

SEQ ID NO: 890490 - protein, 1025 aa, Homo sapiens
GDGGSAMEPGEVKDRILENISLSVKKLQSYFAACEDEIPAIRNHDKVLQRLCEHLDHALLYGLQDLSSGYWVLVVHFTRREAIKQIEVLQHVATNLGRSRAWLYLALNENSLESYLRLFQENLGLLHKYYVKNALVCSHDHLTLFLTLVSGLEFIRFELDLDAPYLDLAPYMPDYYKPQYLLDFEDRLPSSVHGSDSLSLNSFNSVTSTNLEWDDSAIAPSSEDYDFGDVFPAVPSVPSTDWEDGDLTDTVSGPRSTASDLTSSKASTRSPTQRQNPFNEEPAETVSSSDTTPVHTTSQEKEEAQALDPPDACTELEVIRVTKKKKIGKKKKSRSDEEASPLHPACSQKKCAKQGDGDSRNGSPSLGRDSPDTMLASPQEEGEGPSSTTESSERSEPGLLIPEMKDTSMERLGQPLSKVIDQLNGQLDPSTWCSRAEPPDQSFRTGSPGDAPERPPLCDFSEGLSAPMDFYRFTVESPSTVTSGGGHHDPAGLGQPLHVPSSPEAAGQEEEGGGGEGQTPRPLEDTTREAQELEAQLSLVREGPVSEPEPGTQEVLCQLKRDQPSPCLSSAEDSGVDEGQGSPSEMVHSSEFRVDNNHLLLLMIHVFRENEEQLFKMIRMSTGHMEGNLQLLYVLLTDCYVYLLRKGATEKPYLVEEAVSYNELDYVSVGLDQQTVKLVCTNRRKQFLLDTADVALAEFFLASLKSAMIKGCREPPYPSILTDATMEKLALAKFVAQESKCEASAVTVRFYGLVHWEDPTDESLGPTPCHCSPPEGTITKEGMLHYKAGTSYLGKEHWKTCFVVLSNGILYQYPDRTDVIPLLSVNMGGEQCGGCRRANTTDRPHAFQVILSDRPCLELSAESEAEMAEWMQHLCQAVSKGVIPQGVAPSPCIPCCLVLTDDRLFTCHEDCQTSFFRSLGTAKLGDISAVSTEPGKEYCVLEFSQDSQQLLPPWVIYLSCTSELDRLLSALNSGWKTIYQVDLPHTAIQEASNKKKFEDALSLIHSAWQRSDSLCRGRASRDPWC

SEQ ID NO: 890491 - protein, 911 aa, Homo sapiens
SSSVPVSGELGCCISTIKNALVCSHDHLTLFLTLVSGLEFIRFELDLDAPYLDLAPYMPDYYKPQYLLDFEDRLPSSVHGSDSLSLNSFNSVTSTNLEWDDSAIAPSSEDYDFGDVFPAVPSVPSTDWEDGDLTDTVSGPRSTASDLTSSKASTRSPTQRQNPFNEEPAETVSSSDTTPVHTTSQEKEEAQALDPPDACTELEVIRVTKKKKIGKKKKSRSDEEASPLHPACSQKKCAKQGDGDSRNGSPSLGRDSPDTMLASPQEEGEGPSSTTESSERSEPGLLIPEMKDTSMERLGQPLSKVIDQLNGQLDPSTWCSRAEPPDQSFRTGSPGDAPERPPLCDFSEGLSAPMDFYRFTVESPSTVTSGGGHHDPAGLGQPLHVPSSPEAAGQEEEGGGGEGQTPRPLEDTTREAQELEAQLSLVREGPVSEPEPGTQEVLCQLKRDQPSPCLSSAEDSGVDEGQGSPSEMVHSSEFRVDNNHLLLLMIHVFRENEEQLFKMIRMSTGHMEGNLQLLYVLLTDCYVYLLRKGATEKPYLVEEAVSYNELDYVSVGLDQQTVKLVCTNRRKQFLLDTADVALAEFFLASLKSAMIKGCREPPYPSILTDATMEKLALAKFVAQESKCEASAVTVRFYGLVHWEDPTDESLGPTPCHCSPPEGTITKEGMLHYKAGTSYLGKEHWKTCFVVLSNGILYQYPDRTDVIPLLSVNMGGEQCGGCRRANTTDRPHAFQVILSDRPCLELSAESEAEMAEWMQHLCQAVSKGVIPQGVAPSPCIPCCLVLTDDRLFTCHEDCQTSFFRSLGTAKLGDISAVSTEPGKEYCVLEFSQDSQQLLPPWVIYLSCTSELDRLLSALNSGWKTIYQVDLPHTAIQEASNKKKFEDALSLIHSAWQRSDSLCRGRASRDPWC

SEQ ID NO: 890492 - protein, 867 aa, Homo sapiens
GDGGSAMEPGEVKDRILENISLSVKKLQSYFAACEDEIPAIRNHDKVLQRLCEHLDHALLYGLQDLSSGYWVLVVHFTRREAIKQIEVLQHVATNLGRSRAWLYLALNENSLESYLRLFQENLGLLHKYYVKNALVCSHDHLTLFLTLVSGLEFIRFELDLDAPYLDLAPYMPDTTNLSTCWTLKTACSQKKCAKQGDGDSRNGSPSLGRDSPDTMLASPQEEGEGPSSTTESSERSEPGLLIPEMKDTSMERLGQPLSKVIDQLNGQLDPSTWCSRAEPPDQSFRTGSPGDAPERPPLCDFSEGLSAPMDFYRFTVESPSTVTSGGGHHDPAGLGQPLHVPSSPEAAGQEEEGGGGEGQTPRPLEDTTREAQELEAQLSLVREGPVSEPEPGTQEVLCQLKRDQPSPCLSSAEDSGVDEGQGSPSEMVHSSEFRVDNNHLLLLMIHVFRENEEQLFKMIRMSTGHMEGNLQLLYVLLTDCYVYLLRKGATEKPYLVEEAVSYNELDYVSVGLDQQTVKLVCTNRRKQFLLDTADVALAEFFLASLKSAMIKGCREPPYPSILTDATMEKLALAKFVAQESKCEASAVTVRFYGLVHWEDPTDESLGPTPCHCSPPEGTITKEGMLHYKAGTSYLGKEHWKTCFVVLSNGILYQYPDRTDVIPLLSVNMGGEQCGGCRRANTTDRPHAFQVILSDRPCLELSAESEAEMAEWMQHLCQAVSKGVIPQGVAPSPCIPCCLVLTDDRLFTCHEDCQTSFFRSLGTAKLGDISAVSTEPGKEYCVLEFSQDSQQLLPPWVIYLSCTSELDRLLSALNSGWKTIYQVDLPHTAIQEASNKKKFEDALSLIHSAWQRSDSLCRGRASRDPWC

SEQ ID NO: 890493 - protein, 1035 aa, Homo sapiens
GDGGSAMEPGEVKDRILENISLSVKKLQSYFAACEDEIPAIRNHDKVLQRLCEHLDHALLYGLQDLSSGYWVLVVHFTRREAIKQIEVLQHVATNLGRSRAWLYLALNENSLESYLRLFQENLGLLHKYYVKNALVCSHDHLTLFLTLVSGLEFIRFELDLDAPYLDLAPYMPDYYKPQYLLDFEDRLPSSVHGSDSLSLNSFNSVTSTNLEWDDSAIAPSSEDYDFGDVFPAVPSVPSTDWEDGDLTDTVSGPRSTASDLTSSKASTRSPTQRQNPFNEEPAETVSSSDTTPVHTTSQEKEEAQALDPPDACTELEVIRVTKKKKIGKKKKSRSDEEASPLHPACSQKKCAKQGDGDSRNGSPSLGRDSPDTMLASPQEEGEGPSSTTESSERSEPGLLIPEMKDTSMERLGQPLSKVIDQLNGQLDPSTWCSRAEPPDQSFRTGSPGDAPERPPLCDFSEGLSAPMDFYRFTVESPSTVTSGGGHHDPAGLGQPLHVPSSPEAAGQEEEGGGGEGQTPRPLEDTTREAQELEAQLSLVREGPVSEPEPGTQEVLCQLKRDQPSPCLSSAEDSGVDEGQGSPSEMVHSSEFRVDNNHLLLLMIHVFRENEEQLFKVILDEDRAMEGKQQLLFVLLIRLLCLPAPDRGHMRIHNLSEKRPVSLATETVDYVDTAWNLHTWIRRKLDVQPNSRKRFHDMDTADVALELRFFLASLKSAMIKGCREPPYPSILTDATMEKLALAKFVAQESKCEASAVTVRFYGLVHWEDPTDESLGPTPCHCSPPEGTITKEGMLHYKAGTSYLGKEHWKTCFVVLSNGILYQYPDRTDVIPLLSVNMGGEQCGGCRRANTTDRPHAFQVILSDRPCLELSAESEAEMAEWMQHLCQAVSKGVIPQGVAPSPCIPCCLVLTDDRLFTCHEDCQTSFFRSLGTAKLGDISAVSTEPGKEYCVLEFSQDSQQLLPPWVIYLSCTSELDRLLSALNSGWKTIYQVDLPHTAIQEASNKKKFEDALSLIHSAWQRSDSLCRGRASRDPWC

SEQ ID NO: 890494 - protein, 919 aa, Homo sapiens
GDGGSAMEPGEVKDRILENISLSVKKLQSYFAACEDEIPAIRNHDKVLQRLCEHLDHALLYGLQDLSSGYWVLVVHFTRREAIKQIEVLQHVATNLGRSRAWLYLALNENSLESYLRLFQENLGLLHKYYVKNALVCSHDHLTLFLTLVSGLEFIRFELDLDAPYLDLAPYMPDYYKPQYLLDFEDRLPSSVHGSDSLSLNSFNSVTSTNLEWDDSAIAPSSEDYDFGDVFPAVPSVPSTDWEDGDLTDTVSGPRSTASDLTSSKASTRSPTQRQNPFNEEPAETVSSSDTTPVHTTSQEKEEAQALDPPDACTELEVIRVTKKKKIGKKKKSRSDEEASPLHPACSQKKCAKQGDGDSRNGSPSLGRDSPDTMLASPQEEGEGPSSTTESSERSEPGLLIPEMKDTSMERLGQPLSKVIDQLNGQLDPSTWCSRAEPPDQSFRTGSPGDAPERPPLCDFSEGLSAPMDFYRFTVESPSTVTSGGGHHDPAGLGQPLHVPSSPEAAGQEEEGGGGEGQTPRPLEDTTREAQELEAQLSLVREGPVSEPEPGTQEVLCQLKRDQPSPCLSSAEDSGVDEGQGSPSEMVHSSEFRKQDSAASAMIKGCREPPYPSILTDATMEKLALAKFVAQESKCEASAVTVRFYGLVHWEDPTDESLGPTPCHCSPPEGTITKEGMLHYKAGTSYLGKEHWKTCFVVLSNGILYQYPDRTDVIPLLSVNMGGEQCGGCRRANTTDRPHAFQVILSDRPCLELSAESEAEMAEWMQHLCQAVSKGVIPQGVAPSPCIPCCLVLTDDRLFTCHEDCQTSFFRSLGTAKLGDISAVSTEPGKEYCVLEFSQDSQQLLPPWVIYLSCTSELDRLLSALNSGWKTIYQVDLPHTAIQEASNKKKFEDALSLIHSAWQRSDSLCRGRASRDPWC

SEQ ID NO: 890495 - protein, 833 aa, Homo sapiens
GDGGSAMEPGEVKDRILENISLSVKKLQSYFAACEDEIPAIRNHDKVLQRLCEHLDHALLYGLQDLSSGYWVLVVHFTRREAIKQIEVLQHVATNLGRSRAWLYLALNENSLESYLRLFQENLGLLHKYYVKNALVCSHDHLTLFLTLVSGLEFIRFELDLDAPYLDLAPYMPDYYKPQYLLDFEDRLPSSVHGSDSLSLNSFNSVTSTNLEWDDSAIAPSSEDYDFGDVFPAVPSVPSTDWEDGDLTDTVSGPRSTASDLTSSKASTRSPTQRQNPFNEEPAETVSSSDTTPVHTTSQEKEEAQALDPPDACTELEVIRVTKKKKIGKKKKSRSDEEASPLHPACSQKKCAKQGDGDSRNGSPSLGRDSPDTMLASPQEEGEGPSSTTESSERSEPGLLIPEMKDTSMERLGQPLSKVIDQLNGQLDPSTWCSRAEPPDQSFRTGSPGDAPERPPLCDFSEGLSAPMDFYRFTVESPSTVTSGGGHHDPAGLGQPLHVPSSPEAAGQEEEGGGGEGQTPRPLEDTTREAQELEAQLSLVREGPVSEPEPGTQEVLCQLKRDQPSPCLSSAEDSGVDEGQGSPSEMVHSSEFRVDNNHLLLLMIHVFRENEEQLFKMIRMSTGHMEGNLQLLYVLLTDCYVYLLRKGATEKPYLVEEAVSYNELDYVSVGLDQQTVKLVCTNRRKQFLLDTADVALAEFFLASLKSAMIKGCREPPYPSILTDATMEKLALAKFVAQESKCEASAVTVRFYGLVHWEDPTDESLGPTPCHCSPPEGTITKEGMLHYKAGTSYLGKEHWKTCFVVLSNGILYQYPDRTDVIPLLSVNMGSSPRA

SEQ ID NO: 890496 - protein, 1025 aa, Homo sapiens; identical to SEQ ID NO: 890490

SEQ ID NO: 890497 - protein, 1025 aa, Homo sapiens; identical to SEQ ID NO: 890490

SEQ ID NO: 890498 - protein, 1025 aa, Homo sapiens; identical to SEQ ID NO: 890490

SEQ ID NO: 890499 - protein, 203 aa, Homo sapiens
NKKLYTNPENQNEANRFSTDRPHAFQVILSDRPCLELSAESEAEMAEWMQHLCQAVSKGVIPQGVAPSPCIPCCLVLTDDRLFTCHEDCQTSFFRSLGTAKLGDISAVSTEPGKEYCVLEFSQDSQQLLPPWVIYLSCTSELDRLLSALNSGWKTIYQVDLPHTAIQEASNKKKFEDALSLIHSAWQRSDSLCRGRASRDPWC

SEQ ID NO: 890500 - protein, 937 aa, Homo sapiens
GDGGSAMEPGEVKDRILENISLSVKKLQSYFAACEDEIPAIRNHDKVLQRLCEHLDHALLYGLQDLSSGYWVLVVHFTRREAIKQIEVLQHVATNLGRSRAWLYLALNENSLESYLRLFQENLGLLHKYYVKNALVCSHDHLTLFLTLVSGLEFIRFELDLDAPYLDLAPYMPDYYKPQYLLDFEDRLPSSVHGSDSLSLNSFNSVTSTNLEWDDSAIAPSSEDYDFGDVFPAVPSVPSTDWEDGDLTDTVSGPRSTASDLTSSKASTRSPTQRQNPFNEEPAETVSSSDTTPVHTTSQEKEEAQALDPPDACTELEVIRVTKKKKIGKKKKSRSDEEASPLHPACSQKKCAKQGDGDSRNGSPSLGRDSPDTMLASPQEEGEGPSSTTESSERSEPGLLIPEMKDTSMERLGQPLSKVIDQLNGQLDPSTWCSRAEPPDQSFRTGSPGDAPERPPLCDFSEGLSAPMDFYRFTVESPSTVTSGGGHHDPAGLGQPLHVPSSPEAAGQEEEGGGGEGQTPRPLEDTTREAQELEAQLSLVREGPVSEPEPGTQEVLCQLKRDQPSPCLSSAEDSGVDEGQGSPSEMVHSSEFRVDNNHLLLLMIHVFRENEEQLFKMIRMSTGHMEGNLQLLYVLLTDCYVYLLRKGATEKPYLVEEAVSYNELDYVSVGLDQQTVKLVCTNRRKQFLLDTADVALAEFFLASLKSAMIKGCREPPYPSILTDATMEKLALAKFVAQESKCEASAVTVRFYGLVHWEDPTDESLGPTPCHCSPPEGTITKEGMLHYKAGTSYLGKEHWKTCFVVLSNGILYQYPDRTDVIPLLSVNMGGEQCGGCRRANTTDRPHAFQVILSDRPCLELSAESEAEMAEWMQHLCQAVSKGVIPQGVAPSPCIPCCLVLTDDRLFTCHEDCQTSFFRSLGTAKLGDISAMGILLESD

SEQ ID NO: 890501 - protein, 160 aa, Homo sapiens
FPGRDGEGLTGAPWPRQRQAWCPQALKTPVALSGPHLFSARPNTGGPPPHGDPGSLQQEEIRGCLEPHPQRLAAERQSLPRPSLPRPLVLRQSWLASLVGRKGRHASRQAHCHGCCHAVGSLQSTPALGGRTTECGLRQGPSTPGIQIRCPAPLGILPDR

SEQ ID NO: 890502 - protein, 631 aa, Homo sapiens
GDGGSAMEPGEVKDRILENISLSVKKLQSYFAACEDEIPAIRNHDKVLQRLCEHLDHALLYGLQDLSSGYWVLVVHFTRREAIKQIEVLQHVATNLGRSRAWLYLALNENSLESYLRLFQENLGLLHKYYVKNALVCSHDHLTLFLTLVSGLEFIRFELDLDAPYLDLAPYMPDYYKPQYLLDFEDRLPSSVHGSDSLSLNSFNSVTSTNLEWDDSAIAPSSEDYDFGDVFPAVPSVPSTDWEDGDLTDTVSGPRSTASDLTSSKASTRSPTQRQNPFNEEPAETVSSSDTTPVHTTSQEKEEAQALDPPDACTELEVIRVTKKKKIGKKKKSRSDEEASPLHPACSQKKCAKQGDGDSRNGSPSLGRDSPDTMLASPQEEGEGPSSTTESSERSEPGLLIPEMKDTSMERLGQPLSKVIDQLNGQLDPSTWCSRAEPPDQSFRTGSPGDAPERPPLCDFSEGLSAPMDFYRFTVESPSTVTSGGGHHDPAGLGQPLHVPSSPEAAGQEEEGGGGEGQTPRHPCSCLNTLLATWGSGNTGCLRMFPPPSSITAHTAACLARCRGAGSPPWLPGGSACPQSCPACPLNPAVPVAPRSKGGGWGAWRRAEPTSLASMLTSSDCPLLGWSQALP

SEQ ID NO: 890503 - protein, 832 aa, Homo sapiens
GDGGSAMEPGEVKDRILENISLSVKKLQSYFAACEDEIPAIRNHDKVLQRLCEHLDHALLYGLQDLSSGYWVLVVHFTRREAIKQIEVLQHVATNLGRSRAWLYLALNENSLESYLRLFQENLGLLHKYYVKNALVCSHDHLTLFLTLVSGLEFIRFELDLDAPYLDLAPYMPDYYKPQYLLDFEDRLPSSVHGSDSLSLNSFNSVTSTNLEWDDSAIAPSSEDYDFGDVFPAVPSVPSTDWEDGDLTDTVSGPRSTASDLTSSKASTRSPTQRQNPFNEEPAETVSSSDTTPVHTTSQEKEEAQALDPPDACTELEVIRVTKKKKIGKKKKSRSDEEASPLHPACSQKKCAKQGDGDSRNGSPSLGRDSPDTMLASPQEEGEGPSSTTESSERSEPGLLIPEMKDTSMERLGQPLSKVIDQLNGQLDPSTWCSRAEPPDQSFRTGSPGDAPERPPLCDFSEGLSAPMDFYRFTVESPSTVTSGGGHHDPAGLGQPLHVPSSPEAAGQEEEGGGGEGQTPRPLEDTTREAQELEAQLSLVREGPVSEPEPGTQEVLCQLKRDQPSPCLSSAEDSGVDEGQGSPSEMVHSSEFRVDNNHLLLLMIHVFRENEEQLFKMIRMSTGHMEGNLQLLYVLLTDCYVYLLRKGATEKPYLVEEAVSYNELDYVSVGLDQQTVKLVCTNRRKQFLLDTADVALAEFFLASLKSAMIKGCREPPYPSILTDATMEKLALAKFVAQESKCEASAVTVRFYGLVHWEDPTDESLGPTPCHCSPPEGTITKEGMLHYKAGTTNKIGGAASAEPQSKNLDSGHCVPEPSSSGQRLYPEVFYGSA

SEQ ID NO: 890504 - protein, 616 aa, Homo sapiens
GDGGSAMEPGEVKDRILENISLSVKKLQSYFAACEDEIPAIRNHDKVLQRLCEHLDHALLYGLQDLSSGYWVLVVHFTRREAIKQIEVLQHVATNLGRSRAWLYLALNENSLESYLRLFQENLGLLHKYYVKNALVCSHDHLTLFLTLVSGLEFIRFELDLDAPYLDLAPYMPDYYKPQYLLDFEDRLPSSVHGSDSLSLNSFNSVTSTNLEWDDSAIAPSSEDYDFGDVFPAVPSVPSTDWEDGDLTDTVSGPRSTASDLTSSKASTRSPTQRQNPFNEEPAETVSSSDTTPVHTTSQEKEEAQALDPPDACTELEVIRVTKKKKIGKKKKSRSDEEASPLHPACSQKKCAKQGDGDSRNGSPSLGRDSPDTMLASPQEEGEGPSSTTESSERSEPGLLIPEMKDTSMERLGQPLSKVIDQLNGQLDPSTWCSRAEPPDQSFRTGSPGDAPERPPLCDFSEGLSAPMDFYRFTVESPSTVTSGGGHHDPAGLGQPLHVPSSPEAAGQEEEGGGGEGQTPRPLEDTTREAQELEAQLSLVREGPVSEPEPGTQEVLCQLKRDQPSPCLSSAEDSGVDEGQGSPSEMVHSSEFRVDNNHLLLLMIHVFRENEEQLFK

SEQ ID NO: 890505 - protein, 118 aa, Homo sapiens
QIVVSSGGPRGGGDGVPSKLLLKYKTPCPVRLWLLLEMGPPLSGFPGRNWPACLPPGLTHALGVGDPGGCLTGCLLLPCPPRWRPHRHGQWSPLHSLRPDQQQGLHQEPHPAPEPLQR

SEQ ID NO: 890506 - protein, 94 aa, Homo sapiens
CLVLTDDRLFTCHEDCQTSFFRSLGTAKLGDISAVSTEPGKEYCVLVSFEWGRGCKACRRKALAAHPGAWLSLGVLPGQPAAPPALGHLPELHF

SEQ ID NO: 890507 - protein, 633 aa, Homo sapiens
GDGGSAMEPGEVKDRILENISLSVKKLQSYFAACEDEIPAIRNHDKVLQRLCEHLDHALLYGLQDLSSGYWVLVVHFTRREAIKQIEVLQHVATNLGRSRAWLYLALNENSLESYLRLFQENLGLLHKYYVKNALVCSHDHLTLFLTLVSGLEFIRFELDLDAPYLDLAPYMPDYYKPQYLLDFEDRLPSSVHGSDSLSLNSFNSVTSTNLEWDDSAIAPSSEDYDFGDVFPAVPSVPSTDWEDGDLTDTVSGPRSTASDLTSSKASTRSPTQRQNPFNEEPAETVSSSDTTPVHTTSQEKEEAQALDPPDACTELEVIRVTKKKKIGKKKKSRSDEEASPLHPACSQKKCAKQGDGDSRNGSPSLGRDSPDTMLASPQEEGEGPSSTTESSERSEPGLLIPEMKDTSMERLGQPLSKVIDQLNGQLDPSTWCSRAEPPDQSFRTGSPGDAPERPPLCDFSEGLSAPMDFYRFTVESPSTVTSGGGHHDPAGLGQPLHVPSSPEAAGQEEEGGGGEGQTPRPLEDTTREAQELEAQLSLVREGPVSEPEPGTQEVLCQLKRDQPSPCLSSAEDSGVDEGQGSPSEMVHSSEFRVDNNHLLLLMIHVFRENEEQLFKSGGRGWGTWCAVPRYTA

SEQ ID NO: 890508 - protein, 351 aa, Homo sapiens
GDGGSAMEPGEVKDRILENISLSVKKLQSYFAACEDEIPAIRNHDKVLQRLCEHLDHALLYGLQDLSSGYWVLVVHFTRREAIKQIEVLQHVATNLGRSRAWLYLALNENSLESYLRLFQENLGLLHKYYVKNALVCSHDHLTLFLTLVSGLEFIRFELDLDAPYLDLAPYMPDYYKPQYLLDFEDRLPSSVHGSDSLSLNSFNSVTSTNLEWDDSAIAPSSEDGDLTDTVSGPRSTASDLTSSKASTRSPTQRQNPFNEEPAETVSSSDTTPVHTTSQEKEEAQALDPPDACTELEVIRVTKKKKEDALNETRESETKLKELPGVCNETMMALWEECKPCLKQTCMKFYA

SEQ ID NO: 890509 - protein, 461 aa, Homo sapiens
MHQRYFWTDQGQVALGGHYMAEGEGYFAMSEDELACSPYIPLGGDFGGGDFGGGDFGGGDFGGGGSFGGHCLDYCESPTAHCNVLNWEQVQRLDGILSETIPIHGRGNFPTLELQPSLIVKVVRRRLAEKRIGVRDVRLNGSAASHVLHQDSGLGYKDLDLIFCADLRGEGEFQTVKDVVLDCLLDFLPEGVNKEKITPLTLKEAYVQKMVKVCNDSDRWSLISLSNNSGKNVELKFVDSLRRQFEFSVDSFQIKLDSLLLFYECSENPMTETFHPTIIGESVYGDFQEAFDHLCNKIIATRNPEEIRGGGLLKYCNLLVRGFRPASDEIKTLQRYMCSRFFIDFSDIGEQQRKLESYLQNHFVGLEDRKYEYLMTLHGVVNESTVCLMGHERRQTLNLITMLAIRVLADQNVIPNVANVTCYYQPAPYVADANFSNYYIAQVQPVFTCQQQTYSTWLPCN

SEQ ID NO: 890510 - protein, 461 aa, Homo sapiens; identical to SEQ ID NO: 890509

SEQ ID NO: 890511 - protein, 252 aa, Homo sapiens [sequence omitted]

SEQ ID NO: 890512 - protein, 495 aa, Homo sapiens
IFPAQLLKLQRHERVWQQEPPVRDHRSWGGSGAGGVAGREWTDQGQVALGGHYMAEGEGYFAMSEDELACSPYIPLGGDFGGGDFGGGDFGGGDFGGGGSFGGHCLDYCESPTAHCNVLNWEQVQRLDGILSETIPIHGRGNFPTLELQPSLIVKVVRRRLAEKRIGVRDVRLNGSAASHVLHQDSGLGYKDLDLIFCADLRGEGEFQTVKDVVLDCLLDFLPEGVNKEKITPLTLKEAYVQKMVKVCNDSDRWSLISLSNNSGKNVELKFVDSLRRQFEFSVDSFQIKLDSLLLFYECSENPMTETFHPTIIGESVYGDFQEAFDHLCNKIIATRNPEEIRGGGLLKYCNLLVRGFRPASDEIKTLQRYMCSRFFIDFSDIGEQQRKLESYLQNHFVGLEDRKYEYLMTLHGVVNESTVCLMGHERRQTLNLITMLAIRVLADQNVIPNVANVTCYYQPAPYVADANFSNYYIAQVQPVFTCQQQTYSTWLPCN

SEQ ID NO: 890513 - protein, 109 aa, Homo sapiens
HVLHQDSGLGYKDLDLIFCADLRGEGEFQTVKDVVLDCLLDFLPEGVNKEKITPLTLKVTPPEMHLGPDPVWAGCDGERAEGHRLNAMNLWPSRVWARVISLIFDFLNQ

SEQ ID NO: 890514 - protein, 159 aa, Homo sapiens
MSGARSKLALFLCGCYVVALGAHTGEESVADHHEAEYYVAAVYEHPSILSLNPLALISRQEALELMNQNLDIYEQQVMTAAQKDVQIIVFPEDGIHGFNFTRTSIYPFLDFMPSPQVVRWNPCLEPHRFNDTEVIPAFFLSRLRVHRGDLSQGPEAVTC

SEQ ID NO: 890515 - protein, 159 aa, Homo sapiens; identical to SEQ ID NO: 890514

SEQ ID NO: 890516 - protein, 586 aa, Homo sapiens
MPEGAGLAGDCCLCKAGKKPNSEASRHCLRVGQLERFRGCKGRMAHAHIQGGRRAKSRFVVCIMSGARSKLALFLCGCYVVALGAHTGEESVADHHEAEYYVAAVYEHPSILSLNPLALISRQEALELMNQNLDIYEQQVMTAAQKDVQIIVFPEDGIHGFNFTRTSIYPFLDFMPSPQVVRWNPCLEPHRFNDTEVLQRLSCMAIRGDMFLVANLGTKEPCHSSDPRCPKDGRYQFNTNVVFSNNGTLVDRYRKHNLYFEAAFDVPLKVDLITFDTPFAGRFGIFTCFDILFFDPAIRVLRDYKVKHVVYPTAWMNQLPLLAAIEIQKAFAVAFGINVLAANVHHPVLGMTGSGIHTPLESFWYHDMENPKSHLIIAQVAKNPVGLIGAENATGETDPSHSKFLKILSGDPYCEKDAQEVHCDEATKWNVNAPPTFHSEMMYDNFTLVPVWGKEGYLHVCSNGLCCYLLYERPTLSKELYALGVFDGLHTVHGTYYIQVCALVRCGGLGFDTCGQEITEATGIFEFHLWGNFSTSYIFPLFLTSGMTLEVPDQLGWENDHYFLRKSRLSSGLVTAALYGRLYERD

SEQ ID NO: 890517 - protein, 523 aa, Homo sapiens
MSGARSKLALFLCGCYVVALGAHTGEESVADHHEAEYYVAAVYEHPSILSLNPLALISRQEALELMNQNLDIYEQQVMTAAQKDVQIIVFPEDGIHGFNFTRTSIYPFLDFMPSPQVVRWNPCLEPHRFNDTEVLQRLSCMAIRGDMFLVANLGTKEPCHSSDPRCPKDGRYQFNTNVVFSNNGTLVDRYRKHNLYFEAAFDVPLKVDLITFDTPFAGRFGIFTCFDILFFDPAIRVLRDYKVKHVVYPTAWMNQLPLLAAIEIQKAFAVAFGINVLAANVHHPVLGMTGSGIHTPLESFWYHDMENPKSHLIIAQVAKNPVGLIGAENATGETDPSHSKFLKILSGDPYCEKDAQEVHCDEATKWNVNAPPTFHSEMMYDNFTLVPVWGKEGYLHVCSNGLCCYLLYERPTLSKELYALGVFDGLHTVHGTYYIQVCALVRCGGLGFDTCGQEITEATGIFEFHLWGNFSTSYIFPLFLTSGMTLEVPDQLGWENDHYFLRKSRLSSGLVTAALYGRLYERD

SEQ ID NO: 890518 - protein, 545 aa, Homo sapiens
MPEGGGTSRRLLPMQSRFVVCIMSGARSKLALFLCGCYVVALGAHTGEESVADHHEAEYYVAAVYEHPSILSLNPLALISRQEALELMNQNLDIYEQQVMTAAQKDVQIIVFPEDGIHGFNFTRTSIYPFLDFMPSPQVVRWNPCLEPHRFNDTEVLQRLSCMAIRGDMFLVANLGTKEPCHSSDPRCPKDGRYQFNTNVVFSNNGTLVDRYRKHNLYFEAAFDVPLKVDLITFDTPFAGRFGIFTCFDILFFDPAIRVLRDYKVKHVVYPTAWMNQLPLLAAIEIQKAFAVAFGINVLAANVHHPVLGMTGSGIHTPLESFWYHDMENPKSHLIIAQVAKNPVGLIGAENATGETDPSHSKFLKILSGDPYCEKDAQEVHCDEATKWNVNAPPTFHSEMMYDNFTLVPVWGKEGYLHVCSNGLCCYLLYERPTLSKELYALGVFDGLHTVHGTYYIQVCALVRCGGLGFDTCGQEITEATGIFEFHLWGNFSTSYIFPLFLTSGMTLEVPDQLGWENDHYFLRKSRLSSGLVTAALYGRLYERD

SEQ ID NO: 890519 - protein, 401 aa, Homo sapiens
MPEGAGLAGDCCLCKAGKKPNSEASRHCLRVGQLERFRGCKGRMAHAHIQGGRRAKSRFVVCIMSGARSKLALFLCGCYVVALGAHTGEESVADHHEAEYYVAAVYEHPSILSLNPLALISRQEALELMNQNLDIYEQQVMTAAQKDVQIIVFPEDGIHGFNFTRTSIYPFLDFMPSPQVVRWNPCLEPHRFNDTEVLQRLSCMAIRGDMFLVANLGTKEPCHSSDPRCPKDGRYQFNTNVVFSNNGTLVDRYRKHNLYFEAAFDVPLKVDLITFDTPFAGRFGIFTCFDILFFDPAIRVLRDYKVKHVVYPTAWMNQLPLLAAIEIQKAFAVAFGINVLAANVHHPVLGMTGSGIHTPLESFWYHDMENPKSHLIIAQVAKNPVGLIGAENATGETDGDI

SEQ ID NO: 890520 - protein, 222 aa, Homo sapiens
MPEGAGLAGDCCLCKAGKKPNSEASRHCLRVGQLERFRGCKGRMAHAHIQGGRRAKSRFVVCIMSGARSKLALFLCGCYVVALGAHTGEESVADHHEAEYYVAAVYEHPSILSLNPLALISRQEALELMNQNLDIYEQQVMTAAQKDVQIIVFPEDGIHGFNFTRTSIYPFLDFMPSPQVVRWNPCLEPHRFNDTEVIPAFFLSRLRVHRGDLSQGPEAVTC

SEQ ID NO: 890521 - protein, 316 aa, Homo sapiens
ESAPCPRRERGAGGRRPAGCMARCERLRGAALRDVLGRAQGVLFDCDGVLWNGERAVPGAPELLERLARAGKAALFVSNNSRRARPELALRFARLGFGGLRAEQLFSSALCAARLLRQRLPGPPDAPGAVFVLGGEGLRAELRAAGLRLAGDPSAGDGAAPRVRAVLVGYDEHFSFAKLREACAHLRDPECLLVATDRDPWHPLSDGSRTPGTGSLAAAVETASGRQALVVGKPSPYMFECITENFSIDPARTLMVGDRLETDILFGHRCGMTTVLTLTGVSRLEEAQAYLAAGQHDLVPHYYVESIADLTEGLED

SEQ ID NO: 890522 - protein, 316 aa, Homo sapiens; identical to SEQ ID NO: 890521

SEQ ID NO: 890523 - protein, 316 aa, Homo sapiens; identical to SEQ ID NO: 890521

SEQ ID NO: 890524 - protein, 115 aa, Homo sapiens
RAVRSPCDPAHSWRLRGRCVRAMAAANPWDPASAPNGAGLVLGHFIASGMVNQKNLEIELLKLEKDTADVVHPFFLEMKSCYVAQAGLELMASILPFQSPKTLRLQLRSVILCKA

SEQ ID NO: 890525 - protein, 146 aa, Homo sapiens
RAVRSPCDPAHSWRLRGRCVRAMAAANPWDPASAPNGAGLVLGHFIASGMVNQEMLNMSKKTVSCFVNFTRLQQITNIQAEIYQKNLEIELLKLEKDTADVVHPFFLEMKSCYVAQAGLELMASILPFQSPKTLRLQLRSVILCKA

SEQ ID NO: 890526 - protein, 257 aa, Homo sapiens
RAVRSPCDPAHSWRLRGRCVRAMAAANPWDPASAPNGAGLVLGHFIASGMVNQEMLNMSKKTVSCFVNFTRLQQITNIQAEIYQKNLEIELLKLEKDTADVVHPFFLAQKCHTLQSMNNHLEAVLKEKRSLRQRLLKPMCQENLPIEAVYHRYMVHLLELAVTFIERLETHLETIRNIPHLAANLKKMNQALAKMDILVTETEELAENILKWRKQQNEVSSCIPKILAEESYLYKHDIIMPPLPFTSKVHVQTINAK

SEQ ID NO: 890527 - protein, 257 aa, Homo sapiens; identical to SEQ ID NO: 890526

SEQ ID NO: 890528 - protein, 257 aa, Homo sapiens; identical to SEQ ID NO: 890526

SEQ ID NO: 890529 - protein, 141 aa, Homo sapiens
MNNHLEAVLKEKRSLRQRLLKPMCQENLPIEAVYHRYMVHLLELAVTFIERLETHLETIRNIPHLAANLKKMNQALAKMDILVTETEELAENILKWRKQQNEVSSCIPKILAEESYLYKHDIIMPPLPFTSKVHVQTINAK

SEQ ID NO: 890530 - protein, 257 aa, Homo sapiens; identical to SEQ ID NO: 890526

SEQ ID NO: 890531 - protein, 257 aa, Homo sapiens; identical to SEQ ID NO: 890526

SEQ ID NO: 890532 - protein, 154 aa, Homo sapiens
RAVRSPCDPAHSWRLRGRCVRAMAAANPWDPASAPNGAGLVLGHFIASGMVNQEMLNMSKKTVSCFVNFTRLQQITNIQAEIYQKNLEIELLKLEKDTADVVHPFFLAQKCHTLQSMNNHLEAVLKEKRSLRQRLLKPMCQENLPIEAVYHRLD

SEQ ID NO: 890533 - protein, 132 aa, Homo sapiens
RAVRSPCDPAHSWRLRGRCVRAMAAANPWDPASAPNGAGLVLGHFIASGMVNQEMLNMSKKTVSCFVNFTRLQQITNIQAEIYQKNLEIELLKLEKDTADVVHPFFLGGSDSVILLYAGISNTQRGHCSAGC

SEQ ID NO: 890534 - protein, 770 aa, Homo sapiens
MSNEVETSATNGQPDQQAAPKAPSKKEKKKGPEKTDEYLLARFKGDGVKYKAKLIGIDDVPDARGDKMSQDSMMKLKGMAAAGRSQGQHKQRIWVNISLSGIKIIDEKTGVIEHEHPVNKISFIARDVTDNRAFGYVCGGEGQHQFFAIKTGQQAEPLVVDLKDLFQVIYNVKKKEEEKKKIEEASKAVENGSEALMILDDQTNKLKSGVDQMDLFGDMSTPPDLNSPTESKDILLVDLNSEIDTNQNSLRENPFLTNGITSCSLPRPTPQASFLPENAFSANLNFFPTPNPDPFRDDPFTQPDQSTPSSFDSLKSPDQKKENSSSSSTPLSNGPLNGDVDYFGQQFDQISNRTGKQEAQAGPWPFSSSQTQPAVRTQNGVSEREQNGFSVKSSPNPFVGSPPKGLSIQNGVKQDLESSVQSSPHDSIAIIPPPQSTKPGRGRRTAKSSANDLLASDIFAPPVSEPSGQASPTGQPTALQPNPLDLFKTSAPAPVGPLVGLGGVTVTLPQAGPWNTASLVFNQSPSMAPGAMMGGQPSGFSQPVIFGTSPAVSGWNQPSPFAASTPPPVPVVWGPSASVAPNAWSTTSPLGNPFQSNIFPAPAVSTQPPSMHSSLLVTPPQPPPRAGPPKDISSDAFTALDPLGDKEIKDVKEMFKDFQLRQPPAVPARKGEQTSSGTLSAFASYFNSKVGIPQENADHDDFDANQLLNKINEPPKPAPRQVSLPVTKSTDNAFENPFFKDSFGSSQASVASSQPVSSEMYRDPFGNPFA

SEQ ID NO: 890535 - protein, 770 aa, Homo sapiens; identical to SEQ ID NO: 890534

SEQ ID NO: 890536 - protein, 770 aa, Homo sapiens; identical to SEQ ID NO: 890534

SEQ ID NO: 890537 - protein, 749 aa, Homo sapiens
MSNEVETSATNGQPDQQAAPKAPSKKEKKKGPEKTDEYLLARFKGDGVKYKAKLIGIDDVPDARGDKMSQDSMMKLKGMAAAGRSQGQHKQRIWVNISLSGIKIIDEKTGVIEHEHPVNKISFIARDVTDNRAFGYVCGGEGQHQFFAIKTGQQAEPLVVDLKDLFQVIYNVKKKEEEKKKIEEASKAVENGSEALMILDDQTNKLKSESKDILLVDLNSEIDTNQNSLRENPFLTNGITSCSLPRPTPQASFLPENAFSANLNFFPTPNPDPFRDDPFTQPDQSTPSSFDSLKSPDQKKENSSSSSTPLSNGPLNGDVDYFGQQFDQISNRTGKQEAQAGPWPFSSSQTQPAVRTQNGVSEREQNGFSVKSSPNPFVGSPPKGLSIQNGVKQDLESSVQSSPHDSIAIIPPPQSTKPGRGRRTAKSSANDLLASDIFAPPVSEPSGQASPTGQPTALQPNPLDLFKTSAPAPVGPLVGLGGVTVTLPQAGPWNTASLVFNQSPSMAPGAMMGGQPSGFSQPVIFGTSPAVSGWNQPSPFAASTPPPVPVVWGPSASVAPNAWSTTSPLGNPFQSNIFPAPAVSTQPPSMHSSLLVTPPQPPPRAGPPKDISSDAFTALDPLGDKEIKDVKEMFKDFQLRQPPAVPARKGEQTSSGTLSAFASYFNSKVGIPQENADHDDFDANQLLNKINEPPKPAPRQVSLPVTKSTDNAFENPFFKDSFGSSQASVASSQPVSSEMYRDPFGNPFA

SEQ ID NO: 890538 - protein, 574 aa, Homo sapiens [sequence omitted]

SEQ ID NO: 890539 - protein, 585 aa, Homo sapiens
WLDEAGVIGRGDDLDDQTNKLKSGVDQMDLFGDMSTPPDLNSPTESKDILLVDLNSEIDTNQNSLRENPFLTNGITSCSLPRPTPQASFLPENAFSANLNFFPTPNPDPFRDDPFTQPDQSTPSSFDSLKSPDQKKENSSSSSTPLSNGPLNGDVDYFGQQFDQISNRTGKQEAQAGPWPFSSSQTQPAVRTQNGVSEREQNGFSVKSSPNPFVGSPPKGLSIQNGVKQDLESSVQSSPHDSIAIIPPPQSTKPGRGRRTAKSSANDLLASDIFAPPVSEPSGQASPTGQPTALQPNPLDLFKTSAPAPVGPLVGLGGVTVTLPQAGPWNTASLVFNQSPSMAPGAMMGGQPSGFSQPVIFGTSPAVSGWNQPSPFAASTPPPVPVVWGPSASVAPNAWSTTSPLGNPFQSNIFPAPAVSTQPPSMHSSLLVTPPQPPPRAGPPKDISSDAFTALDPLGDKEIKDVKEMFKDFQLRQPPAVPARKGEQTSSGTLSAFASYFNSKVGIPQENADHDDFDANQLLNKINEPPKPAPRQVSLPVTKSTDNAFENPFFKDSFGSSQASVASSQPVSSEMYRDPFGNPFA

SEQ ID NO: 890540 - protein, 594 aa, Homo sapiens
MRNVTPLRKSQPIMVSHFTRDKNNHFNLPYIPYLIWPLASHSTPPELNSPTEEESKDILLVDLNSEIDTNQNSLRENPFLTNGITSCSLPRPTPQASFLPENAFSANLNFFPTPNPDPFRDDPFTQPDQSTPSSFDSLKSPDQKKENSSSSSTPLSNGPLNGDVDYFGQQFDQISNRTGKQEAQAGPWPFSSSQTQPAVRTQNGVSEREQNGFSVKSSPNPFVGSPPKGLSIQNGVKQDLESSVQSSPHDSIAIIPPPQSTKPGRGRRTAKSSANDLLASDIFAPPVSEPSGQASPTGQPTALQPNPLDLFKTSAPAPVGPLVGLGGVTVTLPQAGPWNTASLVFNQSPSMAPGAMMGGQPSGFSQPVIFGTSPAVSGWNQPSPFAASTPPPVPVVWGPSASVAPNAWSTTSPLGNPFQSNIFPAPAVSTQPPSMHSSLLVTPPQPPPRAGPPKDISSDAFTALDPLGDKEIKDVKEMFKDFQLRQPPAVPARKGEQTSSGTLSAFASYFNSKVGIPQENADHDDFDANQLLNKINEPPKPAPRQVSLPVTKSTDNAFENPFFKDSFGSSQASVASSQPVSSEMYRDPFGNPFA

SEQ ID NO: 890541 - protein, 649 aa, Homo sapiens
MSNEVETSATNGQPDQQAAPKAPSKKEKKKGPEKTDEYLLARFKGDGVKYKAKLIGIDDVPDARGDKMSQDSMMKLKGMAAAGRSQGQHKQRIWVNISLSGIKIIDEKTGVIEHEHPVNKISFIARDVTDNRAFGYVCGGEGQHQFFAIKTGQQAEPLVVDLKDLFQVIYNVKKKEEEKKKIEEASKAVENGSEALMILDDQTNKLKSGVDQMDLFGDMSTPPDLNSPTESKDILLVDLNSEIDTNQNSLRENPFLTNGITSCSLPRPTPQASFLPENAFSANLNFFPTPNPDPFRDDPFTQPDQSTPSSFDSLKSPDQKKENSSSSSTPLSNGPLNGDVDYFGQQFDQISNRTGKQEAQAGPWPFSSSQTQPAVRTQNGVSEREQNGFSVKSSPNPFVGSPPKGLSIQNGVKQDLESSVQSSPHDSIAIIPPPQSTKPGRGRRTAKVNCLLHISISRVHVRYQRVVDASSLSCCSRSFLCCCEIEGGISTLVLQEYFPQPPPRAGPPKDISSDAFTALDPLGDKEIKDVKEMFKDFQLRQPPAVPARKGEQTSSGTLSAFASYFNSKVGIPQENADHDDFDANQLLNKINEPPKPAPRQVSLPVTKSTDNAFENPFFKDSFGSSQASVASSQPVSSEMYRDPFGNPFA

SEQ ID NO: 890542 - protein, 239 aa, Homo sapiens
MMGGQPSGFSQPVIFGTSPAVSGWNQPSPFAASTPPPVPVVWGPSASVAPNAWSTTSPLGNPFQSNIFPAPAVSTQPPSMHSSLLVTPPQPPPRAGPPKDISSDAFTALDPLGDKEIKDVKEMFKDFQLRQPPAVPARKGEQTSSGTLSAFASYFNSKVGIPQENADHDDFDANQLLNKINEPPKPAPRQVSLPVTKSTDNAFENPFFKDSFGSSQASVASSQPVSSEMYRDPFGNPFA

SEQ ID NO: 890543 - protein, 239 aa, Homo sapiens; identical to SEQ ID NO: 890542

SEQ ID NO: 890544 - protein, 770 aa, Homo sapiens; identical to SEQ ID NO: 890534

SEQ ID NO: 890545 - protein, 770 aa, Homo sapiens; identical to SEQ ID NO: 890534

SEQ ID NO: 890546 - protein, 770 aa, Homo sapiens; identical to SEQ ID NO: 890534

SEQ ID NO: 890547 - protein, 235 aa, Homo sapiens
MSNEVETSATNGQPDQQAAPKAPSKKEKKKGPEKTDEYLLARFKGDGVKYKAKLIGIDDVPDARGDKMSQDSMMKLKGMAAAGRSQGQHKQRIWVNISLSGIKIIDEKTGVIEHEHPVNKISFIARDVTDNRAFGYVCGGEGQHQFFAIKTGQQAEPLVVDLKDLFQVIYNVKKKEEEKKKIEEASKAVENGSEALMILDDQTNKLKSGVDQMDLFGDMSTPPDLNSPTGDYSEV

SEQ ID NO: 890548 - protein, 72 aa, Homo sapiens
GFRCPTPRLQALLQGNQGSACQDAAGAQARAVGQLRPGVQLRFLWELISHIQRYLEGEEEGDAQKLNKTGAT

SEQ ID NO: 890549 - protein, 770 aa, Homo sapiens; identical to SEQ ID NO: 890534

SEQ ID NO: 890550 - protein, 770 aa, Homo sapiens; identical to SEQ ID NO: 890534

SEQ ID NO: 890551 - protein, 770 aa, Homo sapiens; identical to SEQ ID NO: 890534

SEQ ID NO: 890552 - protein, 752 aa, Homo sapiens
MSNEVETSATNGQPDQQAAPKAPSKKEKKKGPEKTDEYLLARFKGDGVKYKAKLIGIDDVPDARGDKMSQDSMMKLKGMAAAGRSQGQHKQRIWVNISLSGIKIIDEKTGVIEHEHPVNKISFIARDVTDNRAFGYVCGGEGQHQFFAIKTGQQAEPLVVDLKDLFQVIYNVKKKEEEKKKIEEASKAVENGSEALMILDDQTNKLKSGVDQMDLFGDMSTPPDLNSPTESKDILLVDLNSEIDTNQNSLRENPFLTNGITSCSLPRPTPQASFLPENAFSANLNFFPTPNPDPFRDDPFTQPDQSTPSSFDSLKSPDQKKENSSSSSTPLSNGPLNGDVDYFGQQFDQISNRTGKQEAQAGPWPFSSSQTQPAVRTQPFVGSPPKGLSIQNGVKQDLESSVQSSPHDSIAIIPPPQSTKPGRGRRTAKSSANDLLASDIFAPPVSEPSGQASPTGQPTALQPNPLDLFKTSAPAPVGPLVGLGGVTVTLPQAGPWNTASLVFNQSPSMAPGAMMGGQPSGFSQPVIFGTSPAVSGWNQPSPFAASTPPPVPVVWGPSASVAPNAWSTTSPLGNPFQSNIFPAPAVSTQPPSMHSSLLVTPPQPPPRAGPPKDISSDAFTALDPLGDKEIKDVKEMFKDFQLRQPPAVPARKGEQTSSGTLSAFASYFNSKVGIPQENADHDDFDANQLLNKINEPPKPAPRQVSLPVTKSTDNAFENPFFKDSFGSSQASVASSQPVSSEMYRDPFGNPFA

SEQ ID NO: 890553 - protein, 554 aa, Homo sapiens
MSTPPELNSPTEEESKDILLVDLNSEIDTNQNSLRENPFLTNGITSCSLPRPTPQASFLPENAFSANLNFFPTPNPDPFRDDPFTQPDQSTPSSFDSLKSPDQKKENSSSSSTPLSNGPLNGDVDYFGQQFDQISNRTGKQEAQAGPWPFSSSQTQPAVRTQNGVSEREQNGFSVKSSPNPFVGSPPKGLSIQNGVKQDLESSVQSSPHDSIAIIPPPQSTKPGRGRRTAKSSANDLLASDIFAPPVSEPSGQASPTGQPTALQPNPLDLFKTSAPAPVGPLVGLGGVTVTLPQAGPWNTASLVFNQSPSMAPGAMMGGQPSGFSQPVIFGTSPAVSGWNQPSPFAASTPPPVPVVWGPSASVAPNAWSTTSPLGNPFQSNIFPAPAVSTQPPSMHSSLLVTPPQPPPRAGPPKDISSDAFTALDPLGDKEIKDVKEMFKDFQLRQPPAVPARKGEQTSSGTLSAFASYFNSKVGIPQENADHDDFDANQLLNKINEPPKPAPRQVSLPVTKSTDNAFENPFFKDSFGSSQASVASSQPVSSEMYRDPFGNPFA

SEQ ID NO: 890554 - protein, 552 aa, Homo sapiens
MSNEVETSATNGQPDQQAAPKAPSKKEKKKGPEKTDEYLLARFKGDGVKYKAKLIGIDDVPDARGDKMSQDSMMKLKGMAAAGRSQGQHKQRIWVNISLSGIKIIDEKTGVIEHEHPVNKISFIARDVTDNRAFGYVCGGEGQHQFFAIKTGQQAEPLVVDLKDLFQVIYNVKKKEEEKKKIEEASKAVENGSEALMILDDQTNKLKSGVDQMDLFGDMSTPPDLNSPTSSANDLLASDIFAPPVSEPSGQASPTGQPTALQPNPLDLFKTSAPAPVGPLVGLGGVTVTLPQAGPWNTASLVFNQSPSMAPGAMMGGQPSGFSQPVIFGTSPAVSGWNQPSPFAASTPPPVPVVWGPSASVAPNAWSTTSPLGNPFQSNIFPAPAVSTQPPSMHSSLLVTPPQPPPRAGPPKDISSDAFTALDPLGDKEIKDVKEMFKDFQLRQPPAVPARKGEQTSSGTLSAFASYFNSKVGIPQENADHDDFDANQLLNKINEPPKPAPRQVSLPVTKSTDNAFENPFFKDSFGSSQASVASSQPVSSEMYRDPFGNPFA

SEQ ID NO: 890555 - protein, 382 aa, Homo sapiens
ARYPCSLTTTVFSGEDCGPPVSRAPRSGEDSVQSSPHDSIAIIPPPQSTKPGRGRRTAKSSANDLLASDIFAPPVSEPSGQASPTGQPTALQPNPLDLFKTSAPAPVGPLVGLGGVTVTLPQAGPWNTASLVFNQSPSMAPGAMMGGQPSGFSQPVIFGTSPAVSGWNQPSPFAASTPPPVPVVWGPSASVAPNAWSTTSPLGNPFQSNIFPAPAVSTQPPSMHSSLLVTPPQPPPRAGPPKDISSDAFTALDPLGDKEIKDVKEMFKDFQLRQPPAVPARKGEQTSSGTLSAFASYFNSKVGIPQENADHDDFDANQLLNKINEPPKPAPRQVSLPVTKSTDNAFENPFFKDSFGSSQASVASSQPVSSEMYRDPFGNPFA

SEQ ID NO: 890556 - protein, 239 aa, Homo sapiens; identical to SEQ ID NO: 890542

SEQ ID NO: 890557 - protein, 749 aa, Homo sapiens; identical to SEQ ID NO: 890537

SEQ ID NO: 890558 - protein, 234 aa, Homo sapiens
MSNEVETSATNGQPDQQAAPKAPSKKEKKKGPEKTDEYLLARFKGDGVKYKAKLIGIDDVPDARGDKMSQDSMMKLKGMAAAGRSQGQHKQRIWVNISLSGIKIIDEKTGVIEHEHPVNKISFIARDVTDNRAFGYVCGGEGQHQFFAIKTGQQAEPLVVDLKDLFQVIYNVKKKEEEKKKIEEASKAVENGSEALMILDDQTNKLKSGVDQMDLFGDMSTPPDLNSPTVSVCF

SEQ ID NO: 890559 - protein, 234 aa, Homo sapiens; identical to SEQ ID NO: 890558

SEQ ID NO: 890560 - protein, 108 aa, Homo sapiens
MSNEVETSATNGQPDQQAAPKAPSKKEKKKGPEKTDEYLLARFKGDGVKYKAKLIGIDDVPDARGDKMSHLPTSFTLKSFKSRGNCQTQGDSILDSCPRRAEHLHTEG

SEQ ID NO: 890561 - protein, 230 aa, Homo sapiens
MPPSLEGKVASSSLPVSAEKSHLVPLMDARINAYIEEEVQRRLQDLHRVISEGCSTSADTMKDNEKLHNGTIQRKLKYERMVSRSLGANPDDLKDPIKISIPRYVLCGQGKDAHFEFEVKITVLDETWTVFRRYSRFREMHKTLKLKYAELAALEFPPKKLFGNKDERVIAERRSHLEKYLRDFFSVMLQSATSPLHINKVGLTLSKHTICEFSPFFKKGVFDYSSHGTG

SEQ ID NO: 890562 - protein, 131 aa, Homo sapiens
TTYFRSQEMVFKTLGTDVVKSAFEGYNACVFAYGQTGSGKSYTMMGNSGDSGLIPRICEGLFSRINETTRWDEASFRTEVSYLEIYNERVRDLLRRKSSKTFNLRVREHPKEGPYVEDLSKHLGLHTSGLP

SEQ ID NO: 890563 - protein, 149 aa, Homo sapiens
MASVKVAVRVRPMNRREKDLEAKFIIQMEKSKTTITNLKIPEGGTGDSGRERTKTFTYDFSFYSADTKSPDYVSQEMVFKTLGTDVVKSAFEGYNACVFAYGQTGSGKSYTMMGNSGNLLNTPICRPSLRINETPMNSFQLNSLLKNFY

SEQ ID NO: 890564 - protein, 1392 aa, Homo sapiens
MASVKVAVRVRPMNRREKDLEAKFIIQMEKSKTTITNLKIPEGGTGDSGRERTKTFTYDFSFYSADTKSPDYVSQEMVFKTLGTDVVKSAFEGYNACVFAYGQTGSGKSYTMMGNSGDSGLIPRICEGLFSRINETTRWDEASFRTEVSYLEIYNERVRDLLRRKSSKTFNLRVREHPKEGPYVEDLSKHLVQNYGDVEELMDAGNINRTTAATGMNDVSSRSHAIFTIKFTQAKFDSEMPCETVSKIHLVDLAGSERADATGATGVRLKEGGNINKSLVTLGNVISALADLSQDAANTLAKKKQVFVPYRDSVLTWLLKDSLGGNSKTIMIATISPADVNYGETLSTLRYANRAKNIINKPTINEDANVKLIRELRAEIARLKTLLAQGNQIALLDSPTALSMEEKLQQNEARVQELTKEWTNKWNETQNILKEQTLALRKEGIGVVLDSELPHLIGIDDDLLSTGIILYHLKEGQTYVGRDDASTEQDIVLHGLDLESEHCIFENIGGTVTLIPLSGSQCSVNGVQIVEATHLNQGAVILLGRTNMFRFNHPKEAAKLREKRKSGLLSSFSLSMTDLSKSRENLSAVMLYNPGLEFERQQREELEKLESKRKLIEEMEEKQKSDKAELERMQQEVETQRKETEIVQLQIRKQEESLKRRSFHIENKLKDLLAEKEKFEEERLREQQEIELQKKRQEEETFLRVQEELQRLKELNNNEKAEKFQIFQELDQLQKEKDEQYAKLELEKKRLEEQEKEQVMLVAHLEEQLREKQEMIQLLRRGEVQWVEEEKRDLEGIRESLLRVKEARAGGDEDGEELEKAQLRFFEFKRRQLVKLVNLEKDLVQQKDILKKEVQEEQEILECLKCEHDKESRLLEKHDESVTDVTEVPQDFEKIKPVEYRLQYKERQLQYLLQNHLPTLLEEKQRAFEILDRGPLSLDNTLYQVEKEMEEKEEQLAQYQANANQLQKLQATFEFTANIARQEEKVRKKEKEILESREKQQREALERALARLERRHSALQRHSTLGMEIEEQRQKLASLNSGSREQSGLQASLEAEQEALEKDQERLEYEIQQLKQKIYEVDGVQKDHHGTLEGKVASSSLPVSAEKSHLVPLMDARINAYIEEEVQRRLQDLHRVISEGCSTSADTMKDNEKLHNGTIQRKLKYELCRDLLCVLMPEPDAAACANHPLLQQDLVQLSLDWKTEIPDLVLPNGVQVSSKFQTTLVDMIYFLHGNMEVNVPSLAEVQLLLYTTVKVMGDSGHDQCQSLVLLNTHIALVKEDCVFYPRIRSRNIPPPGAQFDVIKCHALSEFRCVVVPEKKNVSTVELVFLQKLKPSVGSRNSPPEHLQEAPNVQLFTTPLYLQGSQNVAPEVWKLTFNSQDEALWLISHLTRL

SEQ ID NO: 890565 - protein, 1287 aa, Homo sapiens
MASVKVAVRVRPMNRREKDLEAKFIIQMEKSKTTITNLKIPEGGTGDSGRERTKTFTYDFSFYSADTKSPDYVSQEMVFKTLGTDVVKSAFEGYNACVFAYGQTGSGKSYTMMGNSGDSGLIPRICEGLFSRINETTRWDEASFRTEVSYLEIYNERVRDLLRRKSSKTFNLRVREHPKEGPYVEDLSKHLVQNYGDVEELMDAGNINRTTAATGMNDVSSRSHAIFTIKFTQAKFDSEMPCETVSKIHLVDLAGSERADATGATGVRLKEGGNINKSLVTLGNVISALADLSQDAANTLAKKKQVFVPYRDSVLTWLLKDSLGGNSKTIMIATISPADVNYGETLSTLRYANRAKNIINKPTINEDANVKLIRELRAEIARLKTLLAQGNQIALLDSPTALSMEEKLQQNEARVQELTKEWTNKWNETQNILKEQTLALRKEGIGVVLDSELPHLIGIDDDLLSTGIILYHLKEGQTYVGRDDASTEQDIVLHGLDLESEHCIFENIGGTVTLIPLSGSQCSVNGVQIVEATHLNQGAVILLGRTNMFRFNHPKEAAKLREKRKSGLLSSFSLSMTDLSKSRENLSAVMLYNPGLEFERQQREELEKLESKRKLIEEMEEKQKSDKAELERMQQEVETQRKETEIVQLQIRKQEESLKRRSFHIENKLKDLLAEKEKFEEERLREQQEIELQKKRQEEETFLRVQEELQRLKELNNNEKAEKFQIFQELDQLQKEKDEQYAKLELEKKRLEEQEKEQVMLVAHLEEQLREKQEMIQLLRRGEVQWVEEEKRDLEGIRESLLRVKEARAGGDEDGEELEKAQLRFFEFKRRQLVKLVNLEKDLVQQKDILKKEVQEEQEILECLKCEHDKESRLLEKHDESVTDVTEVPQDFEKIKPVEYRLQYKERQLQYLLQNHLPTLLEEKQRAFEILDRGPLSLDNTLYQVEKEMEEKEEQLAQYQANANQLQKLQATFEFTANIARQEEKVRKKEKEILESREKQQREALERALARLERRHSALQRHSTLGMEIEEQRQKLASLNSGSREQSGLQASLEAEQEALEKDQERLEYEIQQLKQKIYEVDGVQKDHHGTLEGKVASSSLPVSAEKSHLVPLMDARINAYIEEEVQRRLQDLHRVISEGCSTSADTMKDNEKLHNGTIQRKLKYERMVSRSLGANPDDLKDPIKISIPRYVLCGQGKDAHFEFEVKLAALEFPPKKLFGNKDERVIAERRSHLEKYLRDFFSVMLQSATSPLHINKVGLTLSKHTICEFSPFFKKGVFDYSSHGTG

SEQ ID NO: 890566 - protein, 1276 aa, Homo sapiens
MASVKVAVRVRPMNRREKDLEAKFIIQMEKSKTTITNLKIPEGGTGDSGRERTKTFTYDFSFYSADTKSPDYVSQEMVFKTLGTDVVKSAFEGYNACVFAYGQTGSGKSYTMMGNSGDSGLIPRICEGLFSRINETTRWDEASFRTEVSYLEIYNERVRDLLRRKSSKTFNLRVREHPKEGPYVEDLSKHLVQNYGDVEELMDAGNINRTTAATGMNDVSSRSHAIFTIKFTQAKFDSEMPCETVSKIHLVDLAGSERADATGATGVRLKEGGNINKSLVTLGNVISALADLSQDAANTLAKKKQVFVPYRDSVLTWLLKDSLGGNSKTIMIATISPADVNYGETLSTLRYANRAKNIINKPTINEDANVKLIRELRAEIARLKTLLAQGNQIALLDSPTALSMEEKLQQNEARVQELTKEWTNKWNETQNILKEQTLALRKEGIGVVLDSELPHLIGIDDDLLSTGIILYHLKEGQTYVGRDDASTEQDIVLHGLDLESEHCIFENIGGTVTLIPLSGSQCSVNGVQIVEATHLNQGAVILLGRTNMFRFNHPKEAAKLREKRKSGLLSSFSLSMTDLSKSRENLSAVMLYNPGLEFERQQREELEKLESKRKLIEEMEEKQKSDKAELERMQQEVETQRKETEIVQLQIRKQEESLKRRSFHIENKLKDLLAEKEKFEEERLREQQEIELQKKRQEEETFLRVQEELQRLKELNNNEKAEKFQIFQELDQLQKEKDEQYAKLELEKKRLEEQEKEQVMLVAHLEEQLREKQEMIQLLRRGEVQWVEEEKRDLEGIRESLLRVKEARAGGDEDGEELEKAQLRFFEFKRRQLVKLVNLEKDLVQQKDILKKEVQEEQEILECLKCEHDKESRLLEKHDESVTDVTEVPQDFEKIKPVEYRLQYKERQLQYLLQNHLPTLLEEKQRAFEILDRGPLSLDNTLYQVEKEMEEKEEQLAQYQANANQLQKLQATFEFTANIARQEEKVRKKEKEILESREKQQREALERALARLERRHSALQRHSTLGMEIEEQRQKLASLNSGSREQSGLQASLEAEQEALEKDQERLEYEIQQLKQKIYEVDGVQKDHHGTLEGKVASSSLPVSAEKSHLVPLMDARINAYIEEEVQRRLQDLHRVISEGCSTSADTMKDNEKLHNGTIQRKLKYEITVLDETWTVFRRYSRFREMHKTLKLKYAELAALEFPPKKLFGNKDERVIAERRSHLEKYLRDFFSVMLQSATSPLHINKVGLTLSKHTICEFSPFFKKGVFDYSSHGTG

SEQ ID NO: 890567 - protein, 395 aa, Homo sapiens
MASVKVAVRVRPMNRREKDLEAKFIIQMEKSKTTITNLKIPEGGTGDSGRERTKTFTYDFSFYSADTKSPDYVSQEMVFKTLGTDVVKSAFEGYNACVFAYGQTGSGKSYTMMGNSGDSGLIPRICEGLFSRINETTRWDEASFRTEVSYLEIYNERVRDLLRRKSSKTFNLRVREHPKEGPYVEDLSKHLVQNYGDVEELMDAGNINRTTAATGMNDVSSRSHAIFTIKFTQAKFDSEMPCETVSKIHLVDLAGSERADATGATGVRLKEGGNINKSLVTLGNVISALADLSQDAANTLAKKKQVFVPYRDSVLTWLLKDSLGGNSKTIMIATISPADVNYGETLSTLRYANRAKNIINKPTINEDANVKLIRELRAEIARLKTLLAQGNQGFF

SEQ ID NO: 890568 - protein, 414 aa, Homo sapiens
MASVKVAVRVRPMNRREKDLEAKFIIQMEKSKTTITNLKIPEGGTGDSGRERTKTFTYDFSFYSADTKSPDYVSQEMVFKTLGTDVVKSAFEGYNACVFAYGQTGSGKSYTMMGNSGDSGLIPRICEGLFSRINETTRWDEASFRTEVSYLEIYNERVRDLLRRKSSKTFNLRVREHPKEGPYVEDLSKHLVQNYGDVEELMDAGNINRTTAATGMNDVSSRSHAIFTIKFTQAKFDSEMPCETVSKIHLVDLAGSERADATGATGVRLKEGGNINKSLVTLGNVISALADLSQDAANTLAKKKQVFVPYRDSVLTWLLKDSLGGNSKTIMIATISPADVNYGETLSTLRYANRAKNIINKPTINEDANVKLIRELRAEIARLKTLLAQGNQSGPVGAVLSTWDYVALEALGIP

SEQ ID NO: 890569 - protein, 388 aa, Homo sapiens
MASVKVAVRVRPMNRREKDLEAKFIIQMEKSKTTITNLKIPEGGTGDSGRERTKTFTYDFSFYSADTKSPDYVSQEMVFKTLGTDVVKSAFEGYNACVFAYGQTGSGKSYTMMGNSGDSGLIPRICEGLFSRINETTRWDEASFRTEVSYLEIYNERVRDLLRRKSSKTFNLRVREHPKEGPYVEDLSKHLVQNYGDVEELMDAGNINRTTAATGMNDVSSRSHAIFTIKFTQAKFDSEMPCETVSKIHLVDLAGSERADATGATGVRLKEGGNINKSLVTLGNVISALADLSQDAANTLAKKKQVFVPYRDSVLTWLLKDSLGGNSKTIMIATISPADVNYGETLSTLRYANRAKNIINKPTINEDANVKLIRELRGVFLRFMDNFL

SEQ ID NO: 890570 - protein, 129 aa, Homo sapiens
GQSVRFLSSAEGLLLTVFSYNKYLSQQLCRDLLCVLMPEPDAAACANHPLLQQDLVQLSLDWKTEIPDLVLPNGVQVSSKFQTTLVDMIYFLHGNMEVNVPSLAEVQLLLYTTVKVMGDSGHDQCQSLV

SEQ ID NO: 890571 - protein, 313 aa, Homo sapiens
MPNTAMKKKVLLMGKSGSGKTSMRSIIFANYIARDTRRLGATIDVEHSHVRFLGNLVLNLWDCGGQDTFMENYFTSQRDNIFRNVEVLIYVFDVESRELEKDMHYYQSCLEAILQNSPDAKIFCLVHKMDLVQEDQRDLIFKEREEDLRRLSRPLECACFRTSIWDETLYKAWSSIVYQLIPNVQQLEMNLRNFAQIIEADEVLLFERATFLVISHYQCKEQRDVHRFEKISNIIKQFKLSCSKLAASFQSMEVRNSNFAAFIDIFTSNTYVMVVMSDPSIPSAATLINIRNARKHFEKLERVDGPKHSLLMR

SEQ ID NO: 890572 - protein, 398 aa, Homo sapiens
KEIGYVRLVLIGNEADSRGRSHLSKSQPVRGLSSPGFALSTLLPAQLRGGAERGAACESPAAPDPSLGAACRPRPQAQSAVPRRVMPNTAMKKKVLLMGKSGSGKTSMRSIIFANYIARDTRRLGATIDVEHSHVRFLGNLVLNLWDCGGQDTFMENYFTSQRDNIFRNVEVLIYVFDVESRELEKDMHYYQSCLEAILQNSPDAKIFCLVHKMDLVQEDQRDLIFKEREEDLRRLSRPLECACFRTSIWDETLYKAWSSIVYQLIPNVQQLEMNLRNFAQIIEADEVLLFERATFLVISHYQCKEQRDVHRFEKISNIIKQFKLSCSKLAASFQSMEVRNSNFAAFIDIFTSNTYVMVVMSDPSIPSAATLINIRNARKHFEKLERVDGPKHSLLMR

SEQ ID NO: 890573 - protein, 378 aa, Homo sapiens
VRVGSYGPVRGLSSPGFALSTLLPAQLRGGAERGAACESPAAPDPSLGAACRPRPQAQSAVPRRVMPNTAMKKKVLLMGKSGSGKTSMRSIIFANYIARDTRRLGATIDVEHSHVRFLGNLVLNLWDCGGQDTFMENYFTSQRDNIFRNVEVLIYVFDVESRELEKDMHYYQSCLEAILQNSPDAKIFCLVHKMDLVQEDQRDLIFKEREEDLRRLSRPLECACFRTSIWDETLYKAWSSIVYQLIPNVQQLEMNLRNFAQIIEADEVLLFERATFLVISHYQCKEQRDVHRFEKISNIIKQFKLSCSKLAASFQSMEVRNSNFAAFIDIFTSNTYVMVVMSDPSIPSAATLINIRNARKHFEKLERVDGPKHSLLMR

SEQ ID NO: 890574 - protein, 313 aa, Homo sapiens; identical to SEQ ID NO: 890571

SEQ ID NO: 890575 - protein, 313 aa, Homo sapiens; identical to SEQ ID NO: 890571

SEQ ID NO: 890576 - protein, 295 aa, Homo sapiens
MPNTAMKKKVLLMGKSGSGKTSMRSIIFANYIARDTRRLGATIDVEHSHVRFLGNLVLNLWDCGGQDTFMENYFTSQRDNIFRNVEVLIYVFDVESRELEKDMHYYQSCLEAILQNSPDAKIFCLVHEDLRRLSRPLECACFRTSIWDETLYKAWSSIVYQLIPNVQQLEMNLRNFAQIIEADEVLLFERATFLVISHYQCKEQRDVHRFEKISNIIKQFKLSCSKLAASFQSMEVRNSNFAAFIDIFTSNTYVMVVMSDPSIPSAATLINIRNARKHFEKLERVDGPKHSLLMR

SEQ ID NO: 890577 - protein, 162 aa, Homo sapiens
RGYNECDAYYTIAAYCQEYCGSTIDPADGGFDMGFSGVISGVRKRHLHRDEDAVFERATFLVISHYQCKEQRDVHRFEKISNIIKQFKLSCSKLAASFQSMEVRNSNFAAFIDIFTSNTYVMVVMSDPSIPSAATLINIRNARKHFEKLERVDGPKHSLLMR

SEQ ID NO: 890578 - protein, 504 aa, Homo sapiens
EAGHLQLARRTPLTVPTMLRAPGCLLRTSVAPAAALAAALLSSLARCSLLEPRDPVASSLSPYFGTKTRYEDVNPVLLSGPEAPWRDPELLEGTCTPVQLVALIRHGTRYPTVKQIRKLRQLHGLLQARGSRDGGASSTGSRDLGAALADWPLWYADWMDGQLVEKGRQDMRQLALRLASLFPALFSRENYGRLRLITSSKHRCMDSSAAFLQGLWQHYHPGLPPPDVADMEFGPPTVNDKLMRFFDHCEKFLTEVEKNATALYHVEAFKTGPEMQNILKKVAATLQVPVNDLNADLIQVAFFTCSFDLAIKGVKSPWCDVFDIDDAKVLEYLNDLKQYWKRGYGYTINSRSSCTLFQDIFQHLDKAVEQKQRSQPISSPVILQFGHAETLLPLLSLMGYFKDKEPLTAYNYKKQMHRKFRSGLIVPYASNLIFVLYHCENAKTPKEQFRVQMLLNEKVLPLAYSQETVSFYEDLKNHYKDILQSCQTSEECELARANSTSDEL

SEQ ID NO: 890579 - protein, 329 aa, Homo sapiens
EAGHLQLARRTPLTVPTMLRAPGCLLRTSVAPAAALAAALLSSLARCSLLEPRDPVASSLSPYFGTKTRYEDVNPVLLSGPEAPWRDPELLEGTCTPVQLVALIRHGTRYPTVKQIRKLRQLHGLLQARGSRDGGASSTGSRDLGAALADWPLWYADWMDGQLVEKGRQDMRQLALRLASLFPALFSRENYGRLRLITSSKHRCMDSSAAFLQGLWQHYHPGLPPPDVADMEFGPPTVNDKLMRFFDHCEKFLTEVEKNATALYHVEAFKTGPEMQNILKKVAATLQVPVNDLNAGLSQFLLQSSSSLVMQRLFFHCFLSWATSKTRNP

SEQ ID NO: 890580 - protein, 107 aa, Homo sapiens [sequence omitted]

SEQ ID NO: 890581 - protein, 401 aa, Homo sapiens
EAGHLQLARRTPLTVPTMLRAPGCLLRTSVAPAAALAAALLSSLARCSLLEPRDPVASSLSPYFGTKTRYEDVNPVLLSGPEAPWRDPELLEGTCTPVQLVALIRHGTRYPTVKQIRKLRQLHGLLQARGSRDGGASSTGSRDLGAALADWPLWYADWMDGQLVEKGRQDMRQLALRLASLFPALFSRENYGRLRLITSSKHRCMDSSAAFLQGLWQHYHPGLPPPDVADMEFGPPTVNDKLMRFFDHCEKFLTEVEKNATALYHVEAFKTGPEMQNILKKVAATLQVPVNDLNADLIQVAFFTCSFDLAIKGVKSPWCDVFDIDDAKVLEYLNDLKQYWKRGYGYTINSRSSCTLFQDIFQHLDKAVEQKQRSQPISSPVMQRLFFHCFLSWATSKTRNP

SEQ ID NO: 890582 - protein, 426 aa, Homo sapiens
MCDRNGGRRLRQWLIEQIDSSMYPGLIWENEEKSMFRIPWKHAGKQDYNQEVDASIFKAWAVFKGKFKEGDKAEPATWKTRLRCALNKSPDFEEVTDRSQLDISEPYKVYRIVPEEEQKCKLGVATAGCVNEVTEMECGRSEIDELIKEPSVDDYMGMIKRSPSPPEACRSQLLPDWWAQQPSTGVPLVTGYTTYDAHHSAFSQMVISFYYGGKLVGQATTTCPEGCRLSLSQPGLPGTKLYGPEGLELVRFPPADAIPSERQRQVTRKLFGHLERGVLLHSSRQGVFVKRLCQGRVFCSGNAVVCKGRPNKLERDEVVQVFDTSQFFRELQQFYNSQGRLPDGRVVLCFGEEFPDMAPLRSKLILVQIEQLYVRQLAEEAGKSCGAGSVMQAPEEPPPDQVFRMFPDICASHQRSFFRENQQITV

SEQ ID NO: 890583 - protein, 209 aa, Homo sapiens
MCDRNGGRRLRQWLIEQIDSSMYPGLIWENEEKSMFRIPWKHAGKQDYNQEVDASIFKAWAVFKGKFKEGDKAEPATWKTRLRCALNKSPDFEEVTDRSQLDISEPYKVYRIVPEEEQKCKLGVATAGCVNEVTEMECGRSEIDELIKESCSSSITARAGFLTAGWCCALGKSFRIWPPCAPNSFSCRLSSCMSGNWQKRLGRAVEPAL

SEQ ID NO: 890584 - protein, 454 aa, Homo sapiens
TSSGGDVMIHPVTNRPVDERSFQSRSLVEKEKVSRSGGYCHQWMELDPSPRTGLWRPPLPKLLLILVGPQDGLPICQCSGRHKMRVSAPRLALARTTPESYKPPPEYLARAKDVMRLGCREQARKQELFPSHTKFRRKLFLEERAQNCKLGVATAGCVNEVTEMECGRSEIDELIKEPSVDDYMGMIKRSPSPPEACRSQLLPDWWAQQPSTGVPLVTGYTTYDAHHSAFSQMVISFYYGGKLVGQATTTCPEGCRLSLSQPGLPGTKLYGPEGLELVRFPPADAIPSERQRQVTRKLFGHLERGVLLHSSRQGVFVKRLCQGRVFCSGNAVVCKGRPNKLERDEVVQVFDTSQFFRELQQFYNSQGRLPDGRVVLCFGEEFPDMAPLRSKLILVQIEQLYVRQLAEEAGKSCGAGSVMQAPEEPPPDQVFRMFPDICASHQRSFFRENQQITV

SEQ ID NO: 890585 - protein, 222 aa, Homo sapiens
MVISFYYGGKLVGQATTTCPEGCRLSLSQPGLPGTKLYGPEGLELVRFPPADAIPSERQRQVTRKLFGHLERGVLLHSSRQGVFVKRLCQGRVFCSGNAVVCKGRPNKLERDEVVQVFDTSQFFRELQQFYNSQGRLPDGRVVLCFGEEFPDMAPLRSKLILVQIEQLYVRQLAEEAGKSCGAGSVMQAPEEPPPDQVFRMFPDICASHQRSFFRENQQITV

SEQ ID NO: 890586 - protein, 445 aa, Homo sapiens
SAAASVGTRAARRRQDGGRMCDRNGGRRLRQWLIEQIDSSMYPGLIWENEEKSMFRIPWKHAGKQDYNQEVDASIFKAWAVFKGKFKEGDKAEPATWKTRLRCALNKSPDFEEVTDRSQLDISEPYKVYRIVPEEEQKCKLGVATAGCVNEVTEMECGRSEIDELIKEPSVDDYMGMIKRSPSPPEACRSQLLPDWWAQQPSTGVPLVTGYTTYDAHHSAFSQMVISFYYGGKLVGQATTTCPEGCRLSLSQPGLPGTKLYGPEGLELVRFPPADAIPSERQRQVTRKLFGHLERGVLLHSSRQGVFVKRLCQGRVFCSGNAVVCKGRPNKLERDEVVQVFDTSQFFRELQQFYNSQGRLPDGRVVLCFGEEFPDMAPLRSKLILVQIEQLYVRQLAEEAGKSCGAGSVMQAPEEPPPDQVFRMFPDICASHQRSFFRENQQITV

SEQ ID NO: 890587 - protein, 436 aa, Homo sapiens
MAGVPESLNLMCDRNGGRRLRQWLIEQIDSSMYPGLIWENEEKSMFRIPWKHAGKQDYNQEVDASIFKAWAVFKGKFKEGDKAEPATWKTRLRCALNKSPDFEEVTDRSQLDISEPYKVYRIVPEEEQKCKLGVATAGCVNEVTEMECGRSEIDELIKEPSVDDYMGMIKRSPSPPEACRSQLLPDWWAQQPSTGVPLVTGYTTYDAHHSAFSQMVISFYYGGKLVGQATTTCPEGCRLSLSQPGLPGTKLYGPEGLELVRFPPADAIPSERQRQVTRKLFGHLERGVLLHSSRQGVFVKRLCQGRVFCSGNAVVCKGRPNKLERDEVVQVFDTSQFFRELQQFYNSQGRLPDGRVVLCFGEEFPDMAPLRSKLILVQIEQLYVRQLAEEAGKSCGAGSVMQAPEEPPPDQVFRMFPDICASHQRSFFRENQQITV

SEQ ID NO: 890588 - protein, 222 aa, Homo sapiens; identical to SEQ ID NO: 890585

SEQ ID NO: 890589 - protein, 894 aa, Homo sapiens
MARQKKMGQSVLRAVFFLVLGLLGHSHGGFPNTISIGGLFMRNTVQEHSAFRFAVQLYNTNQNTTEKPFHLNYHVDHLDSSNSFSVTNAFCSQFSRGVYAIFGFYDQMSMNTLTSFCGALHTSFVTPSFPTDADVQFVIQMRPALKGAILSLLGHYKWEKFVYLYDTERGFSILQAIMEAAVQNNWQVTARSVGNIKDVQEFRRIIEEMDRRQEKRYLIDCEVERINTILEQVVILGKHSRGYHYMLANLGFTDILLERVMHGGANITGFQIVNNENPMVQQFIQRWVRLDEREFPEAKNAPLKYTSALTHDAILVIAEAFRYLRRQRVDVSRRGSAGDCLANPAVPWSQGIDIERALKMVQVQGMTGNIQFDTYGRRTNYTIDVYEMKVSGSRKAGYWNEYERFVPFSDQQISNDSASSENRTIVVTTILESPYVMYKKNHEQLEGNERYEGYCVDLAYEIAKHVRIKYKLSIVGDGKYGARDPETKIWNGMVGELVYGRADIAVAPLTITLVREEVIDFSKPFMSLGISIMIKKPQKSKPGVFSFLDPLAYEIWMCIVFAYIGVSVVLFLVSRFSPYEWHLEDNNEEPRDPQSPPDPPNEFGIFNSLWFSLGAFMQQGCDISPRSLSGRIVGGVWWFFTLIIISSYTANLAAFLTVERMVSPIESAEDLAKQTEIAYGTLDSGSTKEFFRRSKIAVYEKMWSYMKSAEPSVFTKTTADGVARVRKSKGKFAFLLESTMNEYIEQRKPCDTMKVGGNLDSKGYGVATPKGSALGNAVNLAVLKLNEQGLLDKLKNKWWYDKGECGSGGGDSKDKTSALSLSNVAGVFYILVGGLGLAMMVALIEFCYKSRAESKRMKLTKNTQNFKPAPATNTQNYATYREGYNVYGTESVKI

SEQ ID NO: 890590 - protein, 894 aa, Homo sapiens
MARQKKMGQSVLRAVFFLVLGLLGHSHGGFPNTISIGGLFMRNTVQEHSAFRFAVQLYNTNQNTTEKPFHLNYHVDHLDSSNSFSVTNAFCSQFSRGVYAIFGFYDQMSMNTLTSFCGALHTSFVTPSFPTDADVQFVIQMRPALKGAILSLLGHYKWEKFVYLYDTERGFSILQAIMEAAVQNNWQVTARSVGNIKDVQEFRRIIEEMDRRQEKRYLIDCEVERINTILEQVVILGKHSRGYHYMLANLGFTDILLERVMHGGANITGFQIVNNENPMVQQFIQRWVRLDEREFPEAKNAPLKYTSALTHDAILVIAEAFRYLRRQRVDVSRRGSAGDCLANPAVPWSQGIDIERALKMVQVQGMTGNIQFDTYGRRTNYTIDVYEMKVSGSRKAGYWNEYERFVPFSDQQISNDSASSENRTIVVTTILESPYVMYKKNHEQLEGNERYEGYCVDLAYEIAKHVRIKYKLSIVGDGKYGARDPETKIWNGMVGELVYGRADIAVAPLTITLVREEVIDFSKPFMSLGISIMIKKPQKSKPGVFSFLDPLAYEIWMCIVFAYIGVSVVLFLVSRFSPYEWHLEDNNEEPRDPQSPPDPPNEFGIFNSLWFSLGAFMQQGCDISPRSLSGRIVGGVWWFFTLIIISSYTANLAAFLTVERMVSPIESAEDLAKQTEIAYGTLDSGSTKEFFRRSKIAVYEKMWSYMKSAEPSVFTKTTADGVARVRKSKGKFAFLLESTMNEYIEQRKPCDTMKVGGNLDSKGYGVATPKGSALGTPVNLAVLKLSEQGILDKLKNKWWYDKGECGAKDSGSKDKTSALSLSNVAGVFYILVGGLGLAMMVALIEFCYKSRAESKRMKLTKNTQNFKPAPATNTQNYATYREGYNVYGTESVKI

SEQ ID NO: 890591 - protein, 369 aa, Homo sapiens
MSLGISIMIKKPQKSKPGVFSFLDPLAYEIWMCIVFAYIGVSVVLFLVSRFSPYEWHLEDNNEEPRDPQSPPDPPNEFGIFNSLWFSLGAFMQQGCDISPRSLSGRIVGGVWWFFTLIIISSYTANLAAFLTVERMVSPIESAEDLAKQTEIAYGTLDSGSTKEFFRRSKIAVYEKMWSYMKSAEPSVFTKTTADGVARVRKSKGKFAFLLESTMNEYIEQRKPCDTMKVGGNLDSKGYGVATPKGSALGTPVNLAVLKLSEQGILDKLKNKWWYDKGECGAKDSGSKDKTSALSLSNVAGVFYILVGGLGLAMMVALIEFCYKSRAESKRMKLTKNTQNFKPAPATNTQNYATYREGYNVYGTESVKI

SEQ ID NO: 890592 - protein, 201 aa, Homo sapiens
MARQKKMGQSVLRAVFFLVLGLLGHSHGGFPNTISIGGLFMRNTVQEHSAFRFAVQLYNTNQNTTEKPFHLNYHVDHLDSSNSFSVTNAFCSQFSRGVYAIFGFYDQMSMNTLTSFCGALHTSFVTPSFPTDADVQFVIQMRPALKGAILSLLGHYKWEKFVYLYDTERGKKRHLLCSLDIHVIVFKLPQLMCPLLPINKI

SEQ ID NO: 890593 - protein, 894 aa, Homo sapiens; identical to SEQ ID NO: 890589

SEQ ID NO: 890594 - protein, 144 aa, Homo sapiens
MARQKKMGQSVLRAVFFLVLGLLGHSHGGFPNTISIGGLFMRNTVQEHSAFRFAVQLYNTNQNTTEKPFHLNYHVDHLDSSNSFSVTNACPAERDYLPWPGSIRENNWTALPCCKDHGLLHLKCSPGGARQNWAYCIWGVTGEL

SEQ ID NO: 890595 - protein, 272 aa, Homo sapiens [sequence omitted]

SEQ ID NO: 890596 - protein, 361 aa, Homo sapiens
MSEARKGPDEAEESQYDSGIESLRSLRSLPESTSAPASGPSDGSPQPCTHPPGPVKEPQEKEDADGERADSTYGSSSLTYTLSLLGGPEAEDPAPRLPLPHVGALSPQQLEALTYISEDGDTLVHLAVIHEAPAVLLCCLALLPQEVLDIQNNLYQTALHLAVHLDQPGAVRALVLKGASRALQDRHGDTALHVACQRQHLACARCLLEGRPEPGRGTSHSLDLQLQNWQGLACLHIATLQKNQPLMELLLRNGADIDVQEGTSGKTALHLAVETQERGLVQFLLQAGAQVDARMLNGCTPLHLAAGRGLMGISSTLCKAGADSLLRNVEDETPQDLTEESLVLLPFDDLKISGKLLLCTD

SEQ ID NO: 890597 - protein, 141 aa, Homo sapiens
MSEARKGPDEAEESQYDSGIESLRSLRSLPESTSAPASGPSDGSPQPCTHPPGPVKEPQEKEDADGERADSTYGSSSLTYTLSLLGGPEAEDPAPRLPLPHVGALSPQQLEALTYISEDGDTQHSIWLYIWTNRAQFGHWC

SEQ ID NO: 890598 - protein, 361 aa, Homo sapiens; identical to SEQ ID NO: 890596

SEQ ID NO: 890599 - protein, 361 aa, Homo sapiens; identical to SEQ ID NO: 890596

SEQ ID NO: 890600 - protein, 361 aa, Homo sapiens; identical to SEQ ID NO: 890596

SEQ ID NO: 890601 - protein, 263 aa, Homo sapiens
MSEARKGPDEAEESQYDSGIESLRSLRSLPESTSAPASGPSDGSPQPCTHPPGPVKEPQEKEDADGERADSTYGSSSLTYTLSLLGGPEAEDPAPRLPLPHVGALSPQQLEALTYISEDGDTLVHLAVIHEAPAVLLCCLALLPQEVLDIQNNLYQTALHLAVHLDQPGAVRALVLKGASRALQDRHGDTALHVACQRQHLACARCLLEGRPEPGRGTSHSLDLQLQNWQGLACLHIATLQKNQPLMELLLRNGADIDVQEQW

SEQ ID NO: 890602 - protein, 467 aa, Homo sapiens
MSSAPTTPPSVDKVDGFSRKSVRKARQKRSQSSSQFRSQGKPIELTPLPLLKDVPSSEQPELFLKKLQQCCVIFDFMDTLSDLKMKEYKRSTLNELVDYITISRGCLTEQTYPEVVRMVSCNIFRTLPPSDSNEFDPEEDEPTLEASWPHLQLVYEFFIRFLESQEFQPSIAKKYIDQKFVLQLLELFDSEDPRERDYLKTVLHRIYGKFLGLRAFIRKQINNIFLRFVYETEHFNGVAELLEILGSIINGFALPLKAEHKQFLVKVLIPLHTVRSLSLFHAQLAYCIVQFLEKDPSLTEPVIRGLMKFWPKTCSQKEVMFLGELEEILDVIEPSQFVKIQEPLFKQIAKCVSSPHFQVAERALYYWNNEYIMSLIEENSNVILPIMFSSLYRISKEHWNPAIVALVYNVLKAFMEMNSTMFDELTATYKSDRQREKKKEKEREELWKKLEDLELKRGLRRDGIIPT

SEQ ID NO: 890603 - protein, 467 aa, Homo sapiens; identical to SEQ ID NO: 890602

SEQ ID NO: 890604 - protein, 467 aa, Homo sapiens; identical to SEQ ID NO: 890602

SEQ ID NO: 890605 - protein, 161 aa, Homo sapiens
MKFWPKTCSQKEVMFLGELEEILDVIEPSQFVKIQEPLFKQIAKCVSSPHFQVAERALYYWNNEYIMSLIEENSNVILPIMFSSLYRISKEHWNPAIVALVYNVLKAFMEMNSTMFDELTATYKSDRQREKKKEKEREELWKKLEDLELKRGLRRDGIIPT

SEQ ID NO: 890606 - protein, 161 aa, Homo sapiens; identical to SEQ ID NO: 890605

SEQ ID NO: 890607 - protein, 467 aa, Homo sapiens; identical to SEQ ID NO: 890602

SEQ ID NO: 890608 - protein, 427 aa, Homo sapiens
MSSAPTTPPSVDKVDGFSRKSVRKARQKRSQSSSQFRSQGKPIELTPLPLLKDVPSSEQPELFLKKLQQCCVIFDFMDTLSDLKMKEYKRSTLNELVDYITISRGCLTEQTYPEVVRMVSCNIFRTLPPSDSNEFDPEEDEPTLEASWPHLQLVYEFFIRFLESQEFQPSIAKKYIDQKFVLQLLELFDSEDPRERDYLKTVLHRIYGKFLGLRAFIRKQINNIFLRFVYETEHFNGVAELLEILGSIINGFALPLKAEHKQFLVKVLIPLHTVRSLSLFHAQLAYCIVQFLEKDPSLTEPVIRGLMKFWPKTCSQKEVAERALYYWNNEYIMSLIEENSNVILPIMFSSLYRISKEHWNPAIVALVYNVLKAFMEMNSTMFDELTATYKSDRQREKKKEKEREELWKKLEDLELKRGLRRDGIIPT

SEQ ID NO: 890609 - protein, 244 aa, Homo sapiens
MSSAPTTPPSVDKVDGFSRKSVRKARQKRSQSSSQFRSQGKPIELTPLPLLKDVPSSEQPELFLKKLQQCCVIFDFMDTLSDLKMKEYKRSTLNELVDYITISRGCLTEQTYPEVVRMVSCNIFRTLPPSDSNEFDPEEDEPTLEASWPHLQLVYEFFIRFLESQEFQPSIAKKYIDQKFVLQLLELFDSEDPRERDYLKTVLHRIYGKFLGLRAFIRKQINNIFLRFVTETKDLNLVTKKHVT

SEQ ID NO: 890610 - protein, 135 aa, Homo sapiens
RDMSSAPTTPPSVDKVDGFSRKSVRKARQKRSQSSSQFRSQGKPIELTPLPLLKGKAHDQVMHSFSIDLSTSIYNFLFVEFYMCCKLKGWDTSHTLKLLMCDQIYPLSFLKAQFSLSLGKLKETLSGEYLTLMSR

SEQ ID NO: 890611 - protein, 283 aa, Homo sapiens
MSAGWFRRRFLPGEPLPAPRPPGPHASPVPYRRPRFLRGSSSSPGAADASRRPDSRPVRSPARGRTLPWNAGYAEIINAEKSEFNEDQAACGKLCIRRCEFGAEEEWLTLCPEEDEVIGRELEASGQMGGCTALVAVSLQGKLYMANAGDSRAILVRRDEIRPLSFEFTPETERQRIQQLAFVYPELLAGEFTRLEFPRRLKGDDLGQKVLFRDHHMSGWSYKRVEKSDLKYPLIHGQGRQARLLGTLAVSRGLGDHQLRVLDTNIQLKPFLLSVPQVRGQRC

SEQ ID NO: 890612 - protein, 459 aa, Homo sapiens
MSAGWFRRRFLPGEPLPAPRPPGPHASPVPYRRPRFLRGSSSSPGAADASRRPDSRPVRSPARGRTLPWNAGYAEIINAEKSEFNEDQAACGKLCIRRCEFGAEEEWLTLCPEEFLTGHYWALFDGHGGPAAAILAANTLHSCLRRQLEAVVEGLVATQPPMHLNGRCICPSDPQFVEEKGIRAEDLVIGALESAFQECDEVIGRELEASGQMGGCTALVAVSLQGKLYMANAGDSRAILVRRDEIRPLSFEFTPETERQRIQQLAFVYPELLAGEFTRLEFPRRLKGDDLGQKVLFRDHHMSGWSYKRVEKSDLKYPLIHGQGRQARLLGTLAVSRGLGDHQLRVLDTNIQLKPFLLSVPQVTVLDVDQLELQEDDVVVMATDGLWDVLSNEQVAWLVRSFLPGNQEDPHRFSKLAQMLIHSTQGKEDSLTEEGQVSYDDVSVFVIPLHSQGQESSDH

SEQ ID NO: 890613 - protein, 448 aa, Homo sapiens
MSAGWFRRRFLPGEPLPAPRPPGPHASPVPYRRPRFLRGSSSSPGAADASRRPDSRPVRSPARGRTLPWNAGYAEIINAEKSEFNEDQAACGKLCIRRCEFGAEEEWLTLCPEEFLTGHYWALFDGHGGPAAAILAANTLHSCLRRQLEAVVEGLVATQPPMHLNGRCICPSDPQFVEEKGIRAEDLVIGALESAFQECDEVIGRELEASGQMGGCTALVAVSLQGKLYMANAGDSRAILVRRDEIRPLSFEFTPETERQRIQQLAFVYPELLAGEFTRLEFPRRLKGDDLGQKVLFRDHHMSGWSYKRVEKSDLKYPLIHGQGRQARLLGTLAVSRGLGDHQLRVLDTNIQLKPFLLSVPQVTVLDVDQLELQEDDVVVMATDGLWDVLSNEQVAWLVRSFLPGNQEDPHSLSAGWSSQVLKAGPDADTQHTGKGRQSHRGRAGVLR

SEQ ID NO: 890614 - protein, 650 aa, Homo sapiens
MPAPCPTDGPASFAAPAPAPGRPTPRAAQTPGPCAAPHEDARYPGMQATPSECPSPTPSSGPGLNPLRVLRPPRKREELSDSPHPPVDSPFLPSPPNPDNFPVIPTQRFPWDSDLPLREDRRSGRTCSPGASKMRPRDSVEFQHSGLWRFPLALYPQHLTLGMTCAVWNRALGCDRTGAGMATYPYRLALGHQVAPEELGPDFYLSHEASEVRKLTSWLSKCVFRDSTGELLPQREGSSPCAGLGPCAHGDIGVSLEGRLPFPGLRIINAEKSEFNEDQAACGKLCIRRCEFGAEEEWLTLCPEEFLTGHYWALFDGHGGPAAAILAANTLHSCLRRQLEAVVEGLVATQPPMHLNGRCICPSDPQFVEEKGIRAEDLVIGALESAFQECDEVIGRELEASGQMGGCTALVAVSLQGKLYMANAGDSRAILVRRDEIRPLSFEFTPETERQRIQQLAFVYPELLAGEFTRLEFPRRLKGDDLGQKVLFRDHHMSGWSYKRVEKSDLKYPLIHGQGRQARLLGTLAVSRGLGDHQLRVLDTNIQLKPFLLSVPQVTVLDVDQLELQEDDVVVMATDGLWDVLSNEQVAWLVRSFLPGNQEDPHRFSKLAQMLIHSTQGKEDSLTEEGQVSYDDVSVFVIPLHSQGQESSDH

SEQ ID NO: 890615 - protein, 431 aa, Homo sapiens
MSAGWFRRRFLPGEPLPAPRPPGPHASPVPYRRPRFLRGSSSSPGAADASRRPDSRPVRSPARGRTLPWNAGYAEIINAEKSEFNEDQAACGKLCIRRCEFGAEEEWLTLCPEEFLTGHYWALFDGHGGPAAAILAANTLHSCLRRQLEAVVEGLVATQPPMHLNGRCICPSDPQFVEEKGIRAEDLVIGALESAFQECDEVIGRELEASGQMGGCTALVAVSLQGKLYMANAGDSRAILVRRDEIRPLSFEFTPETERQRIQQLAFVYPELLAGEFTRLEFPRRLKGDDLGQKVLFRDHHMSGWSYKRVEKSDLKYPLIHGQGRQARLLGTLAVSRGLGDHQLRVLDTNIQLKPFLLSVPQVTVLDVDQLELQEDDVVVMATDGLWDVLSNEQVAWLVRSFLPGNQEDPHRYCSCWGPAWAWVGASSKPK

SEQ ID NO: 890616 - protein, 459 aa, Homo sapiens; identical to SEQ ID NO: 890612

SEQ ID NO: 890617 - protein, 374 aa, Homo sapiens
MSAGWFRRRFLPGEPLPAPRPPGPHASPVPYRRPRFLRGSSSSPGAADASRRPDSRPVRSPARGRTLPWNAGYAEIINAEKSEFNEDQAACGKLCIRRCEFGAEEEWLTLCPEEDEVIGRELEASGQMGGCTALVAVSLQGKLYMANAGDSRAILVRRDEIRPLSFEFTPETERQRIQQLAFVYPELLAGEFTRLEFPRRLKGDDLGQKVLFRDHHMSGWSYKRVEKSDLKYPLIHGQGRQARLLGTLAVSRGLGDHQLRVLDTNIQLKPFLLSVPQVTVLDVDQLELQEDDVVVMATDGLWDVLSNEQVAWLVRSFLPGNQEDPHRFSKLAQMLIHSTQGKEDSLTEEGQVSYDDVSVFVIPLHSQGQESSDH

SEQ ID NO: 890618 - protein, 438 aa, Homo sapiens
MPAPCPTDGPASFAAPAPAPGRPTPRAAQTPGPCAAPHEDARYPGMQATPSECPSPTPSSGPGLNPLRVLRPPRKREELSDSPHPPVDSPFLPSPPNPDNFPVIPTQRFPWDSDLPLREDRRSGRTCSPGASKMRPETRIINAEKSEFNEDQAACGKLCIRRCEFGAEEEWLTLCPEEDEVIGRELEASGQMGGCTALVAVSLQGKLYMANAGDSRAILVRRDEIRPLSFEFTPETERQRIQQLAFVYPELLAGEFTRLEFPRRLKGDDLGQKVLFRDHHMSGWSYKRVEKSDLKYPLIHGQGRQARLLGTLAVSRGLGDHQLRVLDTNIQLKPFLLSVPQVTVLDVDQLELQEDDVVVMATDGLWDVLSNEQVAWLVRSFLPGNQEDPHRFSKLAQMLIHSTQGKEDSLTEEGQVSYDDVSVFVIPLHSQGQESSDH

SEQ ID NO: 890619 - protein, 459 aa, Homo sapiens; identical to SEQ ID NO: 890612

SEQ ID NO: 890620 - protein, 201 aa, Homo sapiens
MPAPCPTDGPASFAAPAPAPGRPTPRAAQTPGPCAAPHEDARYPGMQATPSECPSPTPSSGPGLNPLRVLRPPRKREELSDSPHPPVDSPFLPSPPNPDNFPVIPTQRFPWDSDLPLREDRRSGRTCSPGASKMRPRDSVEFQHSGLWRFPLALYPQHLTLGMTCAVWNRALGCDRTGAGMATYPYRLALGHQVGSRGAGP

SEQ ID NO: 890621 - protein, 102 aa, Homo sapiens
MDTKEEKKERKQSYFARLKKKKQAKQNAETASAVATRTHTGKEDNNTVVLEPDKCNIAVEEEYMTDEKKKRKSNQLKEIRRTELKRYYSIGEYSWRYCSIFI

SEQ ID NO: 890622 - protein, 931 aa, Homo sapiens
MDTKEEKKERKQSYFARLKKKKQAKQNAETASAVATRTHTGKEDNNTVVLEPDKCNIAVEEEYMTDEKKKRKSNQLKEIRRTELKRYYSIDDNQNKTHDKKEKKMVVQKPHGTMEYTAGNQDTLNSIALKFNITPNKLVELNKLFTHTIVPGQVLFVPDANSPSSTLRLSSSSPGATVSPSSSDAEYDKLPDADLARKALKPIERVLSSTSEEDEPGVVKFLKMNCRYFTDGKGVVGGVMIVTPNNIMFDPHKSDPLVIENGCEEYGLICPMEEVVSIALYNDISHMKIKDALPSPGEWEDLASEKDINPFSKFKSINKEKRQQNGEKIMTSDSRPIVPLEKSTGHTPTKPSGSSVSEKLKKLDSSRETSHGSPTVTKLSKEPSDTSSAFESTAKENFLGEDDDFVDLEELSSQTGGGMHKKDTLKECLSLDPEERKKAESQINNSAVEMQVQSALAFLGTENDVELKGALDLETCEKQDIMPEVDKQSGSPESRVENTLNIHEDLDKVKLIEYYLTKNKEGPQVSENLQKTELSDGKSIEPGGIDITLSSSLSQAGDPITEGNKEPDKTWVKKGEPLPVKLNSSTEANVIKEALDSSLESTLDNSCQGAQMDNKSEVQLWLLKRIQVPIEDILPSKEEKSKTPPMFLCIKVGKPMRKSFATHTAAMVQQYGKRRKQPEYWFAVPRERVDHLYTFFVQWSPDVYGKDAKEQGFVVVEKEELNMIDNFFSEPTTKSWEIITVEEAKRRKSTCSYYEDEDEEVLPVLRPHSALLENMHIEQLARRLPARVQGYPWRLAYSTLEHGTSLKTLYRKSASLDSPVLLVIKDMDNQIFGAYATHPFKFSDHYYGTGETFLYTFSPHFKVFKWSGENSYFINGDISSLELGGGGGRFGLWLDADLYHGRSNSCSTFNNDILSKKEDFIVQDLEVWAFD

SEQ ID NO: 890623 - protein, 931 aa, Homo sapiens; identical to SEQ ID NO: 890622

SEQ ID NO: 890624 - protein, 931 aa, Homo sapiens; identical to SEQ ID NO: 890622

SEQ ID NO: 890625 - protein, 942 aa, Homo sapiens
MDTKEEKKERKQSYFARLKKKKQAKQNAETASAVATRTHTGKEDNNTVVLEPDKCNIAVEEEYMTDEKKKRKSNQLKEIRRTELKRYYSIDDNQNKTHDKKEKKMVVQKPHGTMEYTAGNQDTLNSIALKFNITPNKLVELNKLFTHTIVPGQVLFVPDANSPSSTLRLSSSSPGATVSPSSSDAEYDKLPDADLARKALKPIERVLSSTSEEDEPGVVKFLKMNCRYFTDGKGVVGGVMIVTPNNIMFDPHKSDPLVIENGCEEYGLICPMEEVVSIALYNDISHMKIKDALPSDLPQDLCPLYRPGEWEDLASEKDINPFSKFKSINKEKRQQNGEKIMTSDSRPIVPLEKSTGHTPTKPSGSSVSEKLKKLDSSRETSHGSPTVTKLSKEPSDTSSAFESTAKENFLGEDDDFVDLEELSSQTGGGMHKKDTLKECLSLDPEERKKAESQINNSAVEMQVQSALAFLGTENDVELKGALDLETCEKQDIMPEVDKQSGSPESRVENTLNIHEDLDKVKLIEYYLTKNKEGPQVSENLQKTELSDGKSIEPGGIDITLSSSLSQAGDPITEGNKEPDKTWVKKGEPLPVKLNSSTEANVIKEALDSSLESTLDNSCQGAQMDNKSEVQLWLLKRIQVPIEDILPSKEEKSKTPPMFLCIKVGKPMRKSFATHTAAMVQQYGKRRKQPEYWFAVPRERVDHLYTFFVQWSPDVYGKDAKEQGFVVVEKEELNMIDNFFSEPTTKSWEIITVEEAKRRKSTCSYYEDEDEEVLPVLRPHSALLENMHIEQLARRLPARVQGYPWRLAYSTLEHGTSLKTLYRKSASLDSPVLLVIKDMDNQIFGAYATHPFKFSDHYYGTGETFLYTFSPHFKVFKWSGENSYFINGDISSLELGGGGGRFGLWLDADLYHGRSNSCSTFNNDILSKKEDFIVQDLEVWAFD

SEQ ID NO: 890626 - protein, 931 aa, Homo sapiens; identical to SEQ ID NO: 890622

SEQ ID NO: 890627 - protein, 252 aa, Homo sapiens [sequence omitted]

SEQ ID NO: 890628 - protein, 219 aa, Homo sapiens
MRGQRLPLDIQIFYCARPDEEPFVKIITVEEAKRRKSTCSYYEDEDEEVLPVLRPHSALLENMHIEQLARRLPARVQGYPWRLAYSTLEHGTSLKTLYRKSASLDSPVLLVIKDMDNQIFGAYATHPFKFSDHYYGTGETFLYTFSPHFKVFKWSGENSYFINGDISSLELGGGGGRFGLWLDADLYHGRSNSCSTFNNDILSKKEDFIVQDLEVWAFD

SEQ ID NO: 890629 - protein, 159 aa, Homo sapiens
MRGQRLPLDIQIFYCARPDEEPFVKIITVEEAKRRKSTCSYYEDEDEEVLPVLRPHSALLENMHIEQLARRLPARVQGYPWRLAYSTLEHGTSLKTLYRKSASLDSPVLLVIKDMDNQIFGAYATHPFKFSDHYYGTGETFLYTFSPHFKGTIWFMARC

SEQ ID NO: 890630 - protein, 931 aa, Homo sapiens; identical to SEQ ID NO: 890622

SEQ ID NO: 890631 - protein, 72 aa, Homo sapiens
RSLFCLRCSPINLTTSCSAYIPPSSANPDEGYKVSASTHVKTLVLPGRTTHYTLGLPGQVDLTTPTSSKSIQ

SEQ ID NO: 890632 - protein, 566 aa, Homo sapiens
MDTKEEKKERKQSYFARLKKKKQAKQNAETASAVATRTHTGKEDNNTVVLEPDKCNIAVEEEYMTDEKKKRKSNQLKEIRRTELKRYYSIDDNQNKTHDKKEKKMVVQKPHGTMEYTAGNQDTLNSIALKFNITPNKLVELNKLFTHTIVPGQVLFVPDANSPSSTLRLSSSSPGATVSPSSSDAEYDKLPDADLARKALKPIERVLSSTSEEDEPGVVKFLKMNCRYFTDGKGVVGGVMIVTPNNIMFDPHKSDPLVIENGCEEYGLICPMEEVVSIALYNDISHMKIKDALPSPGEWEDLASEKDINPFSKFKSINKEKRQQNGEKIMTSDSRPIVPLEKSTGHTPTKPSGSSVSEKLKKLDSSRETSHGSPTVTKLSKEPSDTSSAFESTAKENFLGEDDDFVDLEELSSQTGGGMHKKDTLKECLSLDPEERKKAESQINNSAVEMQVQSALAFLGTENDVELKGALDLETCEKQDIMPEVDKQSGSPESRVENTLNIHEDLDKVKLIEYYLTKNKEGPQVSENLQKTELSDGKSIEPGEDPEFSSSSSRRPASGSKLYRTP

SEQ ID NO: 890633 - protein, 79 aa, Homo sapiens
VRVQGSEAGWGVRGFLALGIAGFAAIVAYGLYKLKSRGNTKMSIHLIHMRVAAQGFVVGAMTVGMGYSMYREFWAKPKP

SEQ ID NO: 890634 - protein, 79 aa, Homo sapiens; identical to SEQ ID NO: 890633

SEQ ID NO: 890635 - protein, 117 aa, Homo sapiens
ARAGIRSRLGCERFSRSRNLQAITMSTDTGVSLPSHEEDQGSKLTRKTKEAPFVPVGAAGFAAIVAYGLYKLKSRGNTKMSIHLIHMRVAAQGFVVGAMTVGMGYSMYREFWAKPKP

SEQ ID NO: 890636 - protein, 117 aa, Homo sapiens; identical to SEQ ID NO: 890635

SEQ ID NO: 890637 - protein, 336 aa, Homo sapiens
MLGTRPAVLNRPRRNRLASAAMAAGVPCALVTSCSSVFSGDQLVQHILGTEDLIVEVTSNDAVRFYPWTIDNKYYSADINLCVVPNKFLVTAEIAESVQAFVVYFDSTQKSGLDSVSSWLPLAKAWLPEVMILVCDRVSEDGINRQKAQEWCIKHGFELVELSPEELPEEDDDFPESTGVKRIVQALNANVWSNVVMKNDRNQGFSLLNSLTGTNHSIGSADPCHPEQPHLPAADSTESLSDHRGGASNTTDAQVDSIVDPMLDLDIQELASLTTGGGDVENFERLFSKLKEMKDKAATLPHEQRKVHAEKVAKAFWMAIGGDRDEIEGLSSDEEH

SEQ ID NO: 890638 - protein, 336 aa, Homo sapiens; identical to SEQ ID NO: 890637

SEQ ID NO: 890639 - protein, 336 aa, Homo sapiens; identical to SEQ ID NO: 890637

SEQ ID NO: 890640 - protein, 206 aa, Homo sapiens
MILVCDRVSEDGINRQKAQEWCIKHGFELVELSPEELPEEDDDFPESTGVKRIVQALNANVWSNVVMKNDRNQGFSLLNSLTGTNHSIGSADPCHPEQPHLPAADSTESLSDHRGGASNTTDAQVDSIVDPMLDLDIQELASLTTGGGDVENFERLFSKLKEMKDKAATLPHEQRKVHAEKVAKAFWMAIGGDRDEIEGLSSDEEH

SEQ ID NO: 890641 - protein, 336 aa, Homo sapiens; identical to SEQ ID NO: 890637

SEQ ID NO: 890642 - protein, 215 aa, Homo sapiens
MLGTRPAVLNRPRRNRLASAAMAAGVPCALVTSCSSVFSGDQLVQHILGTEDLIVEVTSNDAVRFYPWTIDNKYYSADINLCVVPNKFLVTAEIAESVQAFVVYFDSTQKSGLDSVSSWLPLAKAWLPEVMILVCDRVSEDGINRQKAQEWCIKHGFELVELSPEELPEEDDDFPESTGVKRIVQALNANVWSNVVMKNVSWTLIFKGQIFNLKI

SEQ ID NO: 890643 - protein, 353 aa, Homo sapiens
MLGTRPAVLNRPRRNRLASAAMAAGVPCALVTSCSSVFSGDQLVQHILGTEDLIVEVTSNDAVRFYPWTIDNKYYSADINLCVVPNKFLVTAEIAESVQAFVVYFDSTQKSGLDSVSSWLPLAKAWLPEVMILVCDRVSEDGINRQKAQEWCIKHGFELVELSPEELPEEDDDFPESTGVKRIVQALNANVWSNVVMKNDRNQGFSLLNSLTGTNHSIGSADPCHPEQPHLPAADSTESLSDHRGGASNTTDAQVDSIVDPMLDLDIQELASLTTGGGDVENFERLFSKLKEMKDKAATLPHEQRKVHAEKVRQSARYLLNTYKRSSAIIIIIYHTCVFLKGLSVSFSLNINF

SEQ ID NO: 890644 - protein, 301 aa, Homo sapiens
MLGTRPAVLNRPRRNRLASAAMAAGVPCALVTSCSSVFSGDQLVQHILGTEDLIVEVTSNDAVRFYPWTIDNKYYSADINLCVVPNKFLVTAEIAESVQAFVVYFDSTQKSGLDSVSSWLPLAKAWLPEVMILVCDRVSEDGINRQKAQEWCIKHGFELVELSPEELPEEDDDFPESTGVKRIVQALNANVWSNVVMKNDRNQGFSLLNSLTGTNHSIGSADPCHPEQPHLPAADSTESLSDHRGGASNTTDAQVDSIVDPMLDLDIQELASLTTGGGDVENFERLFSKLKEMKDKDASCL

SEQ ID NO: 890645 - protein, 301 aa, Homo sapiens; identical to SEQ ID NO: 890644

SEQ ID NO: 890646 - protein, 259 aa, Homo sapiens
GTRGVQSFGSLFCDRITYAKRAQSLARPERGRCWAAADGRSTLGPVSGSSPASGAGPASSSGPATIESGSAGKAAPGSAARSCAGSARAAPRRAGGMAAVLALRVVAGLAAAALVAMLLEHYGLAGQPSPLPRPAPPRRPHPAPGPGDSNIFWGLQISDIHLSRFRDPGRAVDLEKFCSETIDIIQPALVLATGDLTDAKTKEQLGSRQHEVEWQTYQGILKKTRVMEKTKWLDIKGNHGKSQEPDYNKDKSFFPPSGT

SEQ ID NO: 890647 - protein, 513 aa, Homo sapiens
MEKTKWLDIKGNHDAFNIPSLDSIKNYYRKYSAVRRDGSFHYVHSTPFGNYSFICVDATVNPGPKRPYNFFGILDKKKMEELLLLAKESSRSNHTIWFGHFTTSTILSPSPGIRSIMSSAIAYLCGHLHTLGGLMPVLHTRHFQGTLELEVGDWKDNRRYRIFAFDHDLFSFADLIFGKWPVVLITNPKSLLYSCGEHEPLERLLHSTHIRVLAFSLSSITSVTVKIDGVHLGQAVHVSGPIFVLKWNPRNYSSGTHNIEVIVQDSAGRSKSVHHIFSVQENNHLSFDPLASFILRTDHYIMARVLFVLIVLSQLTILIIFRYRGYPELKEPSGFINLTSFSLHVLSKINIFYYSVLLLTLYTVLGPWFFGEIIDGKFGCCFSFGIFVNGHFLQGSITFIIGILQLAFFNIPLMAYMCWSLLQRCFGHNFRSHLHQRKYLKIMPVHLLMLLLYIWQVYSCYFLYATYGTLAFLFSPLRTWLTLLTPVLIRYVWTLNSTKFGIFMVQLKSHLSS

SEQ ID NO: 890648 - protein, 511 aa, Homo sapiens
MANLPGYSEEDKSHGKNQVAGYQRKSWKYSAVRRDGSFHYVHSTPFGNYSFICVDATVNPGPKRPYNFFGILDKKKMEELLLLAKESSRSNHTIWFGHFTTSTILSPSPGIRSIMSSAIAYLCGHLHTLGGLMPVLHTRHFQGTLELEVGDWKDNRRYRIFAFDHDLFSFADLIFGKWPVVLITNPKSLLYSCGEHEPLERLLHSTHIRVLAFSLSSITSVTVKIDGVHLGQAVHVSGPIFVLKWNPRNYSSGTHNIEVIVQDSAGRSKSVHHIFSVQENNHLSFDPLASFILRTDHYIMARVLFVLIVLSQLTILIIFRYRGYPELKEPSGFINLTSFSLHVLSKINIFYYSVLLLTLYTVLGPWFFGEIIDGKFGCCFSFGIFVNGHFLQGSITFIIGILQLAFFNIPLMAYMCWSLLQRCFGHNFRSHLHQRKYLKIMPVHLLMLLLYIWQVYSCYFLYATYGTLAFLFSPLRTWLTLLTPVLIRYVWTLNSTKFGIFMVQLKSHLSS

SEQ ID NO: 890649 - protein, 424 aa, Homo sapiens
MEKTKWLDIKGNHEKDGGALITGQGKQSEQPYNLVWTLYNIHYSFSITRNPVNNEGTLELEVGDWKDNRRYRIFAFDHDLFSFADLIFGKWPVVLITNPKSLLYSCGEHEPLERLLHSTHIRVLAFSLSSITSVTVKIDGVHLGQAVHVSGPIFVLKWNPRNYSSGTHNIEVIVQDSAGRSKSVHHIFSVQENNHLSFDPLASFILRTDHYIMARVLFVLIVLSQLTILIIFRYRGYPELKEPSGFINLTSFSLHVLSKINIFYYSVLLLTLYTVLGPWFFGEIIDGKFGCCFSFGIFVNGHFLQGSITFIIGILQLAFFNIPLMAYMCWSLLQRCFGHNFRSHLHQRKYLKIMPVHLLMLLLYIWQVYSCYFLYATYGTLAFLFSPLRTWLTLLTPVLIRYVWTLNSTKFGIFMVQLKSHLSS

SEQ ID NO: 890650 - protein, 511 aa, Homo sapiens; identical to SEQ ID NO: 890648

SEQ ID NO: 890651 - protein, 126 aa, Homo sapiens
ITGQGKQSEQPYNLVWTLYNIHYSFSITRNPVNNEVRQASKIRINLFLVFLFCCYLFCFSGKTFLLVWPHALSLFIYFIYFSLVSSAIAYLCGHLHTLGGLMPVLHTRHFQGTLELEVGDWKDNRR

SEQ ID NO: 890652 - protein, 739 aa, Homo sapiens
GTRGVQSFGSLFCDRITYAKRAQSLARPERGRCWAAADGRSTLGPVSGSSPASGAGPASSSGPATIESGSAGKAAPGSAARSCAGSARAAPRRAGGMAAVLALRVVAGLAAAALVAMLLEHYGLAGQPSPLPRPAPPRRPHPAPGPGDSNIFWGLQISDIHLSRFRDPGRAVDLEKFCSETIDIIQPALVLATGDLTDAKTKEQLGSRQHEVEWQTYQGILKKTRVMEKTKWLDIKGNHDAFNIPSLDSIKNYYRKYSAVRRDGSFHYVHSTPFGNYSFICVDATVNPGPKRPYNFFGILDKKKMEELLLLAKESSRSNHTIWFGHFTTSTILSPSPGIRSIMSSAIAYLCGHLHTLGGLMPVLHTRHFQGTLELEVGDWKDNRRYRIFAFDHDLFSFADLIFGKWPVVLITNPKSLLYSCGEHEPLERLLHSTHIRVLAFSLSSITSVTVKIDGVHLGQAVHVSGPIFVLKWNPRNYSSGTHNIEVIVQDSAGRSKSVHHIFSVQENNHLSFDPLASFILRTDHYIMARVLFVLIVLSQLTILIIFRYRGYPELKEPSGFINLTSFSLHVLSKINIFYYSVLLLTLYTVLGPWFFGEIIDGKFGCCFSFGIFVNGHFLQGSITFIIGILQLAFFNIPLMAYMCWSLLQRCFGHNFRSHLHQRKYLKIMPVHLLMLLLYIWQVYSCYFLYATYGTLAFLFSPLRTWLTLLTPVLIRYVWTLNSTKFGIFMVQLKSHLSS

SEQ ID NO: 890653 - protein, 79 aa, Homo sapiens
AAAYYYYYCSNSSFYRCTGPCKALTAVLGIQQLSKVQFQGQGTFEDLGPTLTTPEILVPRPVFPQDCGLSASLVGSVFN

SEQ ID NO: 890654 - protein, 435 aa, Homo sapiens
MEELLLLAKESSRSNHTIWFGHFTTSTILSPSPGIRSIMSSAIAYLCGHLHTLGGLMPVLHTRHFQGTLELEVGDWKDNRRYRIFAFDHDLFSFADLIFGKWPVVLITNPKSLLYSCGEHEPLERLLHSTHIRVLAFSLSSITSVTVKIDGVHLGQAVHVSGPIFVLKWNPRNYSSGTHNIEVIVQDSAGRSKSVHHIFSVQENNHLSFDPLASFILRTDHYIMARVLFVLIVLSQLTILIIFRYRGYPELKEPSGFINLTSFSLHVLSKINIFYYSVLLLTLYTVLGPWFFGEIIDGKFGCCFSFGIFVNGHFLQGSITFIIGILQLAFFNIPLMAYMCWSLLQRCFGHNFRSHLHQRKYLKIMPVHLLMLLLYIWQVYSCYFLYATYGTLAFLFSPLRTWLTLLTPVLIRYVWTLNSTKFGIFMVQLKSHLSS

SEQ ID NO: 890655 - protein, 435 aa, Homo sapiens; identical to SEQ ID NO: 890654

SEQ ID NO: 890656 - protein, 593 aa, Homo sapiens
GTRGVQSFGSLFCDRITYAKRAQSLARPERGRCWAAADGRSTLGPVSGSSPASGAGPASSSGPATIESGSAGKAAPGSAARSCAGSARAAPRRAGGMAAVLALRVVAGLAAAALVAMLLEHYGLAGQPSPLPRPAPPRRPHPAPGPGDSNIFWGLQISDIHLSRFRDPGRAVDLEKFCSETIDIIQPALVLATGDLTDAKTKEQLGSRQHEVEWQTYQGILKKTRVMEKTKWLDIKGNHDAFNIPSLDSIKNYYRKYSAVRRDGSFHYVHSTPFGNYSFICVDATVNPGPKRPYNFFGILDKKKMEELLLLAKESSRSNHTIWFGHFTTSTILSPSPGIRSIMSSAIAYLCGHLHTLGGLMPVLHTRHFQGTLELEVGDWKDNRRYRIFAFDHDLFSFADLIFGKWPVVLITNPKSLLYSCGEHEPLERLLHSTHIRVLAFSLSSITSVTVKIDGVHLGQAVHVSGPIFVLKWNPRNYSSGTHNIEVIVQDSAGRSKSVHHIFSVQENNHLSFDPLASFILRTDHYIMARVLFVLIVLSQLTILIIFRYRGYPELKEPSGFINLTSFSLHVLSKINIFYYSVLLLTLYTVLGK

SEQ ID NO: 890657 - protein, 719 aa, Homo sapiens
MPRRKKKVKEVSESRNLEKKDVETTSSVSVKRKRRLEDAFIVISDSDGEEPKEENGLQKTKTKQSNRAKCLAKRKIAQMTEEEQFALALKMSEQEAREVNSQEEEEEELLRKAIAESLNSCRPSDASATRSRPLATGPSSQSHQEKTTDSGLTEGIWQLVPPSLFKGSHISQGNEAEEREEPWDHTEKTEEEPVSGSSGSWDQSSQPVFENVNVKSFDRCTGHSAEHTQCGKPQESTGRGSAFLKAVQGSGDTSRHCLPTLADAKGLQDTGGTVNYFWGIPFCPDGVDPNQYTKVILCQLEVYQKSLKMAQRQLLNKKGFGEPVLPRPPSLIQNECGQGEQASEKNECISEDMGDEDKEERQESRASDWHSKTKDFQESSIKSLKEKLLLEEEPTTSHGQSSQGIVEETSEEGNSVPASQSVAALTSKRSLVLMPESSAEEITVCPETQLSSSETFDLEREVSPGSRDILDGVRIIMADKEVGNKEDAEKEVAISTFSSSNQVSCPLCDQCFPPTKIERHAMYCNGLMEEDTVLTRRQKEAKTKSDSGTAAQTSLDIDKNEKCYLCKSLVPFREYQCHVDSCLQLAKADQGDGPEGSGRACSTVEGKWQQRLKNPKEKGHSEGRLLSFLEQSEHKTSDADIKSSETGAFRVPSPGMEEAGCSREMQSSFTRRDLNESPVKSFVSISEATDCLVDFKKQVTVQPGSRTRTKAGRGRRRKF

SEQ ID NO: 890658 - protein, 349 aa, Homo sapiens
MLPLPDLDLWPLDRLPSPIKRKPQTLGSLKSSQGIVEETSEEGNSVPASQSVAALTSKRSLVLMPESSAEEITVCPETQLSSSETFDLEREVSPGSRDILDGVRIIMADKEVGNKEDAEKEVAISTFSSSNQVSCPLCDQCFPPTKIERHAMYCNGLMEEDTVLTRRQKEAKTKSDSGTAAQTSLDIDKNEKCYLCKSLVPFREYQCHVDSCLQLAKADQGDGPEGSGRACSTVEGKWQQRLKNPKEKGHSEGRLLSFLEQSEHKTSDADIKSSETGAFRVPSPGMEEAGCSREMQSSFTRRDLNESPVKSFVSISEATDCLVDFKKQVTVQPGSRTRTKAGRGRRRKF

SEQ ID NO: 890659 - protein, 719 aa, Homo sapiens; identical to SEQ ID NO: 890657

SEQ ID NO: 890660 - protein, 641 aa, Homo sapiens
MTEEEQFALALKMSEQEAREVNSQEEEEEELLRKAIAESLNSCRPSDASATRSRPLATGPSSQSHQEKTTDSGLTEGIWQLVPPSLFKGSHISQGNEAEEREEPWDHTEKTEEEPVSGSSGSWDQSSQPVFENVNVKSFDRCTGHSAEHTQCGKPQESTGRGSAFLKAVQGSGDTSRHCLPTLADAKGLQDTGGTVNYFWGIPFCPDGVDPNQYTKVILCQLEVYQKSLKMAQRQLLNKKGFGEPVLPRPPSLIQNECGQGEQASEKNECISEDMGDEDKEERQESRASDWHSKTKDFQESSIKSLKEKLLLEEEPTTSHGQSSQGIVEETSEEGNSVPASQSVAALTSKRSLVLMPESSAEEITVCPETQLSSSETFDLEREVSPGSRDILDGVRIIMADKEVGNKEDAEKEVAISTFSSSNQVSCPLCDQCFPPTKIERHAMYCNGLMEEDTVLTRRQKEAKTKSDSGTAAQTSLDIDKNEKCYLCKSLVPFREYQCHVDSCLQLAKADQGDGPEGSGRACSTVEGKWQQRLKNPKEKGHSEGRLLSFLEQSEHKTSDADIKSSETGAFRVPSPGMEEAGCSREMQSSFTRRDLNESPVKSFVSISEATDCLVDFKKQVTVQPGSRTRTKAGRGRRRKF

SEQ ID NO: 890661 - protein, 349 aa, Homo sapiens; identical to SEQ ID NO: 890658

SEQ ID NO: 890662 - protein, 349 aa, Homo sapiens; identical to SEQ ID NO: 890658

SEQ ID NO: 890663 - protein, 349 aa, Homo sapiens; identical to SEQ ID NO: 890658

SEQ ID NO: 890664 - protein, 785 aa, Homo sapiens
VTRGSTHAYSRPPATRRRSTERPAPASEYPPPAHSSAHPSLPPFLPQRVRGPLLSGRGASRRQDKRMPRRKKKVKEVSESRNLEKKDVETTSSVSVKRKRRLEDAFIVISDSDGEEPKEENGLQKTKTKQSNRAKCLAKRKIAQMTEEEQFALALKMSEQEAREVNSQEEEEEELLRKAIAESLNSCRPSDASATRSRPLATGPSSQSHQEKTTDSGLTEGIWQLVPPSLFKGSHISQGNEAEEREEPWDHTEKTEEEPVSGSSGSWDQSSQPVFENVNVKSFDRCTGHSAEHTQCGKPQESTGRGSAFLKAVQGSGDTSRHCLPTLADAKGLQDTGGTVNYFWGIPFCPDGVDPNQYTKVILCQLEVYQKSLKMAQRQLLNKKGFGEPVLPRPPSLIQNECGQGEQASEKNECISEDMGDEDKEERQESRASDWHSKTKDFQESSIKSLKEKLLLEEEPTTSHGQSSQGIVEETSEEGNSVPASQSVAALTSKRSLVLMPESSAEEITVCPETQLSSSETFDLEREVSPGSRDILDGVRIIMADKEVGNKEDAEKEVAISTFSSSNQVSCPLCDQCFPPTKIERHAMYCNGLMEEDTVLTRRQKEAKTKSDSGTAAQTSLDIDKNEKCYLCKSLVPFREYQCHVDSCLQLAKADQGDGPEGSGRACSTVEGKWQQRLKNPKEKGHSEGRLLSFLEQSEHKTSDADIKSSETGAFRVPSPGMEEAGCSREMQSSFTRRDLNESPVKSFVSISEATDCLVDFKKQVTVQPGSRTRTKAGRGRRRKF

SEQ ID NO: 890665 - protein, 719 aa, Homo sapiens; identical to SEQ ID NO: 890657

SEQ ID NO: 890666 - protein, 411 aa, Homo sapiens [sequence omitted]

SEQ ID NO: 890667 - protein, 286 aa, Homo sapiens
MPESSAEEITVCPETQLSSSETFDLEREVSPGSRDILDGVRIIMADKEVGNKEDAEKEVAISTFSSSNQVSCPLCDQCFPPTKIERHAMYCNGLMEEDTVLTRRQKEAKTKSDSGTAAQTSLDIDKNEKCYLCKSLVPFREYQCHVDSCLQLAKADQGDGPEGSGRACSTVEGKWQQRLKNPKEKGHSEGRLLSFLEQSEHKTSDADIKSSETGAFRVPSPGMEEAGCSREMQSSFTRRDLNESPVKSFVSISEATDCLVDFKKQVTVQPGSRTRTKAGRGRRRKF

SEQ ID NO: 890668 - protein, 438 aa, Homo sapiens
MPRRKKKVKEVSESRNLEKKDVETTSSVSVKRKRRLEDAFIVISDSDGEEPKEENGLQKTKTKQSNRAKCLAKRKIAQMTEEEQFALALKMSEQEAREVNSQEEEEEELLRKAIAESLNSSQGIVEETSEEGNSVPASQSVAALTSKRSLVLMPESSAEEITVCPETQLSSSETFDLEREVSPGSRDILDGVRIIMADKEVGNKEDAEKEVAISTFSSSNQVSCPLCDQCFPPTKIERHAMYCNGLMEEDTVLTRRQKEAKTKSDSGTAAQTSLDIDKNEKCYLCKSLVPFREYQCHVDSCLQLAKADQGDGPEGSGRACSTVEGKWQQRLKNPKEKGHSEGRLLSFLEQSEHKTSDADIKSSETGAFRVPSPGMEEAGCSREMQSSFTRRDLNESPVKSFVSISEATDCLVDFKKQVTVQPGSRTRTKAGRGRRRKF

SEQ ID NO: 890669 - protein, 438 aa, Homo sapiens; identical to SEQ ID NO: 890668

SEQ ID NO: 890670 - protein, 561 aa, Homo sapiens
MPRRKKKVKEVSESRNLEKKDVETTSSVSVKRKRRLEDAFIVISDSDGEEPKEENGLQKTKTKQSNRAKCLAKRKIAQMTEEEQFALALKMSEQEAREVNSQEEEEEELLRKAIAESLNSCRPSDASATRSRPLATGPSSQSHQEKTTDSGLTEGIWQLVPPSLFKGSHISQGNEAEEREEPWDHTEKTEEEPVSGSSGSWDQSSQPVFENVNVKSFDRCTGHSAEHTQCGKPQESTGRGSAFLKAVQGSGDTSRHCLPTLADAKGLQDTGGTVNYFWGIPFCPDGVDPNQYTKVILCQLEVYQKSLKMAQRQLLNKKGFGEPVLPRPPSLIQNECGQGEQASEKNECISEDMGDEDKEERQESRASDWHSKTKDFQESSIKSLKEKLLLEEEPTTSHGQSSQGIVEETSEEGNSVPASQSVAALTSKRSLVLMPESSAEEITVCPETQLSSSETFDLEREVSPGSRDILDGVRIIMADKEVGNKEDAEKEVAISTFSSSNQVSCPLCDQCFPPTKIERHAMYCNGLMEEDTGKDPAGQPNSYFFVWWFYNPIHYNAGKKT

SEQ ID NO: 890671 - protein, 478 aa, Homo sapiens
MPRRKKKVKEVSESRNLEKKDVETTSSVSVKRKRRLEDAFIVISDSDGEEPKEENGLQKTKTKQSNRAKCLAKRKIAQMTEEEQFALALKMSEQEAREVNSQEEEEEELLRKAIAESLNSCRPSDASATRSRPLATGPSSQSHQEKTTDSGLTEGIWQLVPPSLFKGSHISQGNEAEEREEPWDHTEKTEEEPVSGSSGSWDQSSQPVFENVNVKSFDRCTGHSAEHTQCGKPQESTGRGSAFLKAVQGSGDTSRHCLPTLADAKGLQDTGGTVNYFWGIPFCPDGVDPNQYTKVILCQLEVYQKSLKMAQRQLLNKKGFGEPVLPRPPSLIQNECGQGEQASEKNECISEDMGDEDKEERQESRASDWHSKTKDFQESSIKSLKEKLLLEEEPTTSHGQSSQGIVEETSEEGNSVPASQSVAALTSKRSLVLMPESSAEEITVCPETSKSSEVDWKRVLRYEIWVGRDTGSGGRNAR

SEQ ID NO: 890672 - protein, 214 aa, Homo sapiens
QRLTKEMDLKGVEEHAMYCNGLMEEDTVLTRRQKEAKTKSDSGTAAQTSLDIDKNEKCYLCKSLVPFREYQCHVDSCLQLAKADQGDGPEGSGRACSTVEGKWQQRLKNPKEKGHSEGRLLSFLEQSEHKTSDADIKSSETGAFRVPSPGMEEAGCSREMQSSFTRRDLNESPVKSFVSISEATDCLVDFKKQVTVQPGSRTRTKAGRGRRRKF

SEQ ID NO: 890673 - protein, 483 aa, Homo sapiens
MPRRKKKVKEVSESRNLEKKDVETTSSVSVKRKRRLEDAFIVISDSDGEEPKEENGLQKTKTKQSNRAKCLAKRKIAQMTEEEQFALALKMSEQEAREVNSQEEEEEELLRKAIAESLNSCRPSDASATRSRPLATGPSSQSHQEKTTDSGLTEGIWQLVPPSLFKGSHISQGNEAEEREEPWDHTEKTEEEPVSGSSGSWDQSSQPVFENVNVKSFDRCTGHSAEHTQCGKPQESTGRGSAFLKAVQGSGDTSRHCLPTLADAKGLQDTGGTVNYFWGIPFCPDGVDPNQYTKVILCQLEVYQKSLKMAQRQLLNKKGFGEPVLPRPPSLIQNECGQGEQASEKNECISEDMGDEDKEERQESRASDWHSKTKDFQESSIKSLKEKLLLEEEPTTSHGQSSQGIVEETSEEGNSVPASQSVAALTSKRSLVLMPESSAEEITVCPETQLSSSETFDLEREVSPGSRDILDGVRIIMADKEVW

SEQ ID NO: 890674 - protein, 415 aa, Homo sapiens
MPRRKKKVKEVSESRNLEKKDVETTSSVSVKRKRRLEDAFIVISDSDGEEPKEENGLQKTKTKQSNRAKCLAKRKIAQMTEEEQFALALKMSEQEAREVNSQEEEEEELLRKAIAESLNSCRPSDASATRSRPLATGPSSQSHQEKTTDSGLTEGIWQLVPPSLFKGSHISQGNEAEEREEPWDHTEKTEEEPVSGSSGSWDQSSQPVFENVNVKSFDRCTGHSAEHTQCGKPQESTGRGSAFLKAVQGSGDTSRHCLPTLADAKGLQDTGGTVNYFWGIPFCPDGVDPNQYTKVILCQLEVYQKSLKMAQRQLLNKKGFGEPVLPRPPSLIQNECGQGEQASEKNECISEDMGDEDKEERQESRASDWHSKTKDFQESSIKSLKEKLLLEEEPTTSHGQVRVSDAVIKDDLFTD

SEQ ID NO: 890675 - protein, 109 aa, Homo sapiens
MKISVAAIPFFLLITIALGTKTESSSQTGGKPKVVKIQLKLVGGPYHPSECCFTYTTYKIPRQRIMDYYETNSQCSKPGIVFITKRGHSVCTNPSDKWVQDYIKDMKEN

SEQ ID NO: 890676 - protein, 113 aa, Homo sapiens
MKVSVAALSCLMLVAVLGSQAQFTNDAETELMMSKLPLENPVVLNSFHFAADCCTSYISQSIPCSLMKSYFETSSECSKPGVIFLTKKGRQVCAKPSGPGVQDCMKKLKPYSI

SEQ ID NO: 890677 - protein, 85 aa, Homo sapiens
MKISVAAIPFFLLITIALGTKTESSSRECNALSSFQPRALSDVICQLRGTRWESIGALTGSQETGAPYAVLWIVRMLPGMELENP

SEQ ID NO: 890678 - protein, 110 aa, Homo sapiens
YRPPLKREILAPQGAKKFRPKGPKPKVIECQKLPLENPVVLNSFHFAADCCTSYISQSIPCSLMKSYFETSSECSKPGVIFLTKKGRQVCAKPSGPGVQDCMKKLKPYSI

SEQ ID NO: 890679 - protein, 113 aa, Homo sapiens; identical to SEQ ID NO: 890676

SEQ ID NO: 890680 - protein, 85 aa, Homo sapiens
SHQASSPPTTASHSMKISVAAIPFFLLITIALGTKTESSSRECNALSSFQPRACREISRSEVGAQGKTRSRDSERRAGIFLKLCV

SEQ ID NO: 890681 - protein, 113 aa, Homo sapiens; identical to SEQ ID NO: 890676

SEQ ID NO: 890682 - protein, 113 aa, Homo sapiens; identical to SEQ ID NO: 890676

SEQ ID NO: 890683 - protein, 89 aa, Homo sapiens
QEQPMVWPLTRGPSSASDALSSGGPYHPSECCFTYTTYKIPRQRIMDYYETNSQCSKPGIVFITKRGHSVCTNPSDKWVQDYIKDMKEN

SEQ ID NO: 890684 - protein, 113 aa, Homo sapiens; identical to SEQ ID NO: 890676

SEQ ID NO: 890685 - protein, 190 aa, Homo sapiens
MARHVFLTGPPGVGKTTLIHKASEVLKSSGVPVDGFYTEEVRQGGRRIGFDVVTLSGTRGPLSRVGLEPPPGKRECRVGQYVVDLTSFEQLALPVLRNADCSSGPGQRVCVIDEIGKMELFSQLFIQAVRQTLSTPGTIILGTIPVPKGKPLALVEEIRNRKDVKVFNVTKENRNHLLPDIVTCVQSSRK

SEQ ID NO: 890686 - protein, 107 aa, Homo sapiens
RVVLLTMAKAESPKEHDPFTYDYQSLQIGGLVIARILFILGILIVLSRRCRCKFNQQQRTGEPGDTRWAGPESRPWSGPDLNCDPNLDCSPDRNPYPRPPVWPGTCS

SEQ ID NO: 890687 - protein, 107 aa, Homo sapiens; identical to SEQ ID NO: 890686

SEQ ID NO: 890688 - protein, 107 aa, Homo sapiens; identical to SEQ ID NO: 890686

SEQ ID NO: 890689 - protein, 228 aa, Homo sapiens
MARHVFLTGPPGVGKTTLIHKASEVLKSSGVPVDGFYTEEVRQGGRRIGFDVVTLSGTRGPLSRVGLEPPPGKRECRVGQYVVDLTSFEQLALPVLRNADCSSGPGQRVCVIDEIGKMELFSQLFIQAVRQTLSTPGTIILGTIPVPKGKPLALVEEIRNRKDVKVFNSPYCVIEDQSKFSSCVSQSTLTEPGWRQKLLQSLLNSEWKKRAPVVPTSVSPPFYLRWIP

SEQ ID NO: 890690 - protein, 107 aa, Homo sapiens; identical to SEQ ID NO: 890686

SEQ ID NO: 890691 - protein, 107 aa, Homo sapiens; identical to SEQ ID NO: 890686

SEQ ID NO: 890692 - protein, 116 aa, Homo sapiens
LTARYRGRVVLTSFEQLALPVLRNADCSSGPGQRVCVIDEIGKMELFSQLFIQAVRQTLSTPGTIILGTIPVPKGKPLALVEEIRNRKDVKVFNVTKENRNHLLPDIVTCVQSSRK

SEQ ID NO: 890693 - protein, 190 aa, Homo sapiens; identical to SEQ ID NO: 890685

SEQ ID NO: 890694 - protein, 116 aa, Homo sapiens; identical to SEQ ID NO: 890692

SEQ ID NO: 890695 - protein, 190 aa, Homo sapiens; identical to SEQ ID NO: 890685

SEQ ID NO: 890696 - protein, 228 aa, Homo sapiens; identical to SEQ ID NO: 890689

SEQ ID NO: 890697 - protein, 107 aa, Homo sapiens; identical to SEQ ID NO: 890686

SEQ ID NO: 890698 - protein, 181 aa, Homo sapiens
GAQVDYVFAKVKWKGKGGKYTKSDFKEYEKEQDKPPNLVLKDKVKPKQDTKYDLILDEQAEDSKSSHSHTSKKHKKKTHHCSEEKEDEDYMPIKNTNQDIYREMGFGHYEEEESCWEKQKSEKRDRTQNRSRSRSRERDGHYSNSHKSKYQTDLYERERSKKRDRSRSPKKSKDKEKSKYR

SEQ ID NO: 890699 - protein, 492 aa, Homo sapiens
MAVLLETTLGDVVIDLYTEERPRACLNFLKLCKIKYYNYCLIHNVQRDFIIQTGDPTGTGRGGESIFGQLYGDQASFFEAEKVPRIKHKKKGTVSMVNNGSDQHGSQFLITTGENLDYLDGVHTVFGEVTEGMDIIKKINETFVDKDFVPYQDIRINHTVILDDPFDDPPDLLIPDRSPEPTREQLDSGRIGADEEIDDFKGRSAEEVEEIKAEKEAKTQAILLEMVGDLPDADIKPPENVLFVCKLNPVTTDEDLEIIFSRFGPIRSCEVIRDWKTGESLCYAFIEFEKEEDCEKAFFKMDNVLIDDRRIHVDFSQSVAKVKWKGKGGKYTKSDFKEYEKEQDKPPNLVLKDKVKPKQDTKYDLILDEQAEDSKSSHSHTSKKHKKKTHHCSEEKEDEDYMPIKNTNQDIYREMGFGHYEEEESCWEKQKSEKRDRTQNRSRSRSRERDGHYSNSHKSKYQTDLYERERSKKRDRSRSPKKSKDKEKSKYR

SEQ ID NO: 890700 - protein, 492 aa, Homo sapiens; identical to SEQ ID NO: 890699

SEQ ID NO: 890701 - protein, 477 aa, Homo sapiens
MAVLLETTLGDVVIDLYTEERPRACLNFLKLCKIKYYNYCLIHNVQRDFIIQTGDPTGTGRGGESIFGQLYGDQASFFEAEKVPRIKHKKKGTVSMVNNGSDQHGSQFLITTGENLDYLDGVHTVFGEVTEGMDIIKKINETFVDKDFVPYQDIRINHTVILDDPFDDPPDLLIPDRSPEPTREQLDSGRIGADEEIDDFKGRSAEEVEEIKAEKEAKTQAILLEMVGDLPDADIKPPENVLFVCKLNPVTTDEDLEIIFSRFGPIRSCEVIRDWKTGESLCYAFIEFEKEEDCEKAFFKMDNVLIDDRRIHVDFSQSVAKVKWKGKGGKYTKSDFKEYEKEQDKPPNLVLKDKVKPKQDTKYDLILDEQAEDSKSSHSHTSKKHKKKTHHCSEEKEDEDYMPIKNTNQDIYREMGFGHYEEEESCWEKQKRMAIIVIVINQNTKQIFMKEKGVKRETEAEVQRSPKIKKNLSIDER

SEQ ID NO: 890702 - protein, 221 aa, Homo sapiens
KAFFKIHMYSSVIYKHIVHFEECFLTFFKMDNVLIDDRRIHVDFSQSVAKVKWKGKGGKYTKSDFKEYEKEQDKPPNLVLKDKVKPKQDTKYDLILDEQAEDSKSSHSHTSKKHKKKTHHCSEEKEDEDYMPIKNTNQDIYREMGFGHYEEEESCWEKQKSEKRDRTQNRSRSRSRERDGHYSNSHKSKYQTDLYERERSKKRDRSRSPKKSKDKEKSKYR

SEQ ID NO: 890703 - protein, 421 aa, Homo sapiens
MSATLILEPPGRCCWNEPVRIAVRGLAPEQRVTLRASLRDEKGALFRAHARYCADARGELDLERAPALGGSFAGLEPMGLLWALEPEKPFWRFLKRDVQIPFVVELEVLDGHDPEPGRLLCQAQHERHFLPPGVRRQSVRAGRVRATLFLPPGPGPFPGIIDIFGIGGGLLEYRASLLAGHGFATLALAYYNFEDLPNNMDNISLEYFEEAVCYMLQHPQVKGPGIGLLGISLGADICLSMASFLKNVSATVSINGSGISGNTAINYKHSSIPPLGYDLRRIKVAFSGLVDIVDIRNALVGGYKNPSMIPIEKAQGPILLIVGQDDHNWRSELYAQTVSERLQAHGKEKPQIICYPGTGHYIEPPYFPLCPASLHRLLNKHVIWGGEPRAHSKAQEDAWKQILAFFCKHLGGTQKTAVPKL

SEQ ID NO: 890704 - protein, 2220 aa, Homo sapiens
MIRIAALNASSTIEDDHEGSFKSHKTQTKEAQEAEAFALYHKALDLQKHDRFEESAKAYHELLEASLLREAVSSGDEKEGLKHPGLILKYSTYKNLAQLAAQREDLETAMEFYLEAVMLDSTDVNLWYKIGHVALRLIRIPLARHAFEEGLRCNPDHWPCLDNLITVLYTLSDYTTCLYFICKALEKDCRYSKGLVLKEKIFEEQPCLRKDSLRMFLKCDMSIHDVSVSAAETQAIVDEALGLRKKRQALIVREKEPDLKLVQPIPFFTWKCLGESLLAMYNHLTTCEPPRPSLGKRIDLSDYQDPSQPLESSMVVTPVNVIQPSTVSTNPAVAVAEPVVSYTSVATTSFPLHSPGLLETGAPVGDISGGDKSKKGVKRKKISEESGETAKRRSARVRNTKCKKEEKVDFQELLMKFLPSRLRKLDPEEEDDSFNNYEVQSEAKLESFPSIGPQRLSFDSATFMESEKQDVHEFLLENLTNGGILELMMRYLKAMGHKFLVRWPPGLAEVVLSVYHSWRRHSTSLPNPLLRDCSNKHIKDMMLMSLSCMELQLDQWLLTKGRSSAVSPRNCPAGMVNGRFGPDFPGTHCLGDLLQLSFASSQRDLFEDGWLEFVVRVYWLKARFLALQGDMEQALENYDICTEMLQSSTAIQVEAGAERRDIVIRLPNLHNDSVVSLEEIDKNLKSLERCQSLEEIQRLYEAGDYKAVVHLLRPTLCTSGFDRAKHLEFMTSIPERPAQLLLLQDSLLRLKDYRQCFECSDVALNEAVQQMVNSGEAAAKEEWVATVTQLLMGIEQALSADSSGSILKVSSSTTGLVRLTNNLIQVIDCSMAVQEEAKEPHVSSVLPWIILHRIIWQEEDTFHSLCHQQQLQNPAEEGMSETPMLPSSLMLLNTAHEYLGRRSWCCNSDGALLRFYVRVLQKELAASTSEDTHPYKEELETALEQCFYCLYSFPSKKSKARYLEEHSAQQVDLIWEDALFMFEYFKPKTLPEFDSYKTSTVSADLANLLKRIATIVPRTERPALSLDKVSAYIEGTSTEVPCLPEGADPSPPVVNELYYLLADYHFKNKEQSKAIKFYMHDICICPNRFDSWAGMALARASRIQDKLNSNELKSDGPIWKHATPVLNCFRRALEIDSSNLSLWIEYGTMSYALHSFASRQLKQWRGELPPELVQQMEGRRDSMLETAKHCFTSAARCEGDGDEEEWLIHYMLGKVAEKQQQPPTVYLLHYRQAGHYLHEEAARYPKKIHYHNPPELAMEALEVYFRLHASILKLLGKPDSGVGAEVLVNFMKEAAEGPFARGEEKNTPKASEKEKACLVDEDSHSSAGTLPGPGASLPSSSGPGLTSPPYTATPIDHDYVKCKKPHQQATPDDRSQDSTAVALSDSSSTQDFFNEPTSLLEGSRKSYTEKRLPILSSQAGATGKDLQGATEERGKNEESLESTEGFRAAEQGVQKPAAETPASACIPGKPSASTPTLWDGKKRGDLPGEPVAFPQGLPAGAEEQRQFLTEQCIASFRLCLSRFPQHYKSLYRLAFLYTYSKTHRNLQWARDVLLGSSIPWQQLQHMPAQGLFCERNKTNFFNGIWRIPVDEIDRPGSFAWHMNRSIVLLLKVLAQLRDHSTLLKVSSMLQRTPDQGKKYLRDADRQVLAQRAFILTVKVLEDTLSELAEGSERPGPKVCGLPGARMTTDVSHKASPEDGQEGLPQPKKPPLADGSGPGPEPGGKVGLLNHRPVAMDAGDSADQSGERKDKESPRAGPTEPMDTSEATVCHSDLERTPPLLPGRPARDRGPESRPTELSLEELSISARQQPTPLTPAQPAPAPAPATTTGTRAGGHPEEPLSRLSRKRKLLEDTESGKTLLLDAYRVWQQGQKGVAYDLGRVERIMSETYMLIKQVDEEAALEQAVKFCQVHLGAAAQRQASGDTPTTPKHPKDSRENFFPVTVVPTAPDPVPADSVQRPSDAHTKPRPALAAATTIITCPPSASASTLDQSKDPGPPRPHRPEATPSMASLGPEGEELARVAEGTSFPPQEPRHSPQVKMAPTSSPAEPHCWPAEAALGTGAEPTCSQEGKLRPEPRRDGEAQEAASETQPLSSPPTAASSKAPSSGSAQPPEGHPGKPEPSRAKSRPLPNMPKLVIPSAATKFPPEITVTPPTPTLLSPKGSISEETKQKLKSAILSAQSAANVRKESLCQPALEVLETSSQESSLESETDEDDDYMDI

SEQ ID NO: 890705 - protein, 2175 aa, Homo sapiens
MIRIAALNASSTIEDDHEGSFKSHKTQTKEAQEAEAFALYHKALDLQKHDRFEESAKAYHELLEASLLREAVMLDSTDVNLWYKIGHVALRLIRIPLARHAFEEGLRCNPDHWPCLDNLITVLYTLSDYTTCLYFICKALEKDCRYSKGLVLKEKIFEEQPCLRKDSLRMFLKCDMSIHDVSVSAAETQAIVDEALGLRKKRQALIVREKEPDLKLVQPIPFFTWKCLGESLLAMYNHLTTCEPPRPSLGKRIDLSDYQDPSQPLESSMVVTPVNVIQPSTVSTNPAVAVAEPVVSYTSVATTSFPLHSPGLLETGAPVGDISGGDKSKKGVKRKKISEESGETAKRRSARVRNTKCKKEEKVDFQELLMKFLPSRLRKLDPEEEDDSFNNYEVQSEAKLESFPSIGPQRLSFDSATFMESEKQDVHEFLLENLTNGGILELMMRYLKAMGHKFLVRWPPGLAEVVLSVYHSWRRHSTSLPNPLLRDCSNKHIKDMMLMSLSCMELQLDQWLLTKGRSSAVSPRNCPAGMVNGRFGPDFPGTHCLGDLLQLSFASSQRDLFEDGWLEFVVRVYWLKARFLALQGDMEQALENYDICTEMLQSSTAIQVEAGAERRDIVIRLPNLHNDSVVSLEEIDKNLKSLERCQSLEEIQRLYEAGDYKAVVHLLRPTLCTSGFDRAKHLEFMTSIPERPAQLLLLQDSLLRLKDYRQCFECSDVALNEAVQQMVNSGEAAAKEEWVATVTQLLMGIEQALSADSSGSILKVSSSTTGLVRLTNNLIQVIDCSMAVQEEAKEPHVSSVLPWIILHRIIWQEEDTFHSLCHQQQLQNPAEEGMSETPMLPSSLMLLNTAHEYLGRRSWCCNSDGALLRFYVRVLQKELAASTSEDTHPYKEELETALEQCFYCLYSFPSKKSKARYLEEHSAQQVDLIWEDALFMFEYFKPKTLPEFDSYKTSTVSADLANLLKRIATIVPRTERPALSLDKVSAYIEGTSTEVPCLPEGADPSPPVVNELYYLLADYHFKNKEQSKAIKFYMHDICICPNRFDSWAGMALARASRIQDKLNSNELKSDGPIWKHATPVLNCFRRALEIDSSNLSLWIEYGTMSYALHSFASRQLKQWRGELPPELVQQMEGRRDSMLETAKHCFTSAARCEGDGDEEEWLIHYMLGKVAEKQQQPPTVYLLHYRQAGHYLHEEAARYPKKIHYHNPPELAMEALEVYFRLHASILKLLGKPDSGVGAEVLVNFMKEAAEGPFARGEEKNTPKASEKEKACLVDEDSHSSAGTLPGPGASLPSSSGPGLTSPPYTATPIDHDYVKCKKPHQQATPDDRSQDSTAVALSDSSSTQDFFNEPTSLLEGSRKSYTEKRLPILSSQAGATGKDLQGATEERGKNEESLESTEGFRAAEQGVQKPAAETPASACIPGKPSASTPTLWDGKKRGDLPGEPVAFPQGLPAGAEEQRQFLTEQCIASFRLCLSRFPQHYKSLYRLAFLYTYSKTHRNLQWARDVLLGSSIPWQQLQHMPAQGLFCERNKTNFFNGIWRIPVDEIDRPGSFAWHMNRSIVLLLKVLAQLRDHSTLLKVSSMLQRTPDQGKKYLRDADRQVLAQRAFILTVKVLEDTLSELAEGSERPGPKVCGLPGARMTTDVSHKASPEDGQEGLPQPKKPPLADGSGPGPEPGGKVGLLNHRPVAMDAGDSADQSGERKDKESPRAGPTEPMDTSEATVCHSDLERTPPLLPGRPARDRGPESRPTELSLEELSISARQQPTPLTPAQPAPAPAPATTTGTRAGGHPEEPLSRLSRKRKLLEDTESGKTLLLDAYRVWQQGQKGVAYDLGRVERIMSETYMLIKQVDEEAALEQAVKFCQVHLGAAAQRQASGDTPTTPKHPKDSRENFFPVTVVPTAPDPVPADSVQRPSDAHTKPRPALAAATTIITCPPSASASTLDQSKDPGPPRPHRPEATPSMASLGPEGEELARVAEGTSFPPQEPRHSPQVKMAPTSSPAEPHCWPAEAALGTGAEPTCSQEGKLRPEPRRDGEAQEAASETQPLSSPPTAASSKAPSSGSAQPPEGHPGKPEPSRAKSRPLPNMPKLVIPSAATKFPPEITVTPPTPTLLSPKGSISEETKQKLKSAILSAQSAANVRKESLCQPALEVLETSSQESSLESETDEDDDYMDI

SEQ ID NO: 890706 - protein, 2220 aa, Homo sapiens; identical to SEQ ID NO: 890704

SEQ ID NO: 890707 - protein, 2220 aa, Homo sapiens; identical to SEQ ID NO: 890704

SEQ ID NO: 890708 - protein, 2144 aa, Homo sapiens
MIRIAALNASSTIEDDHEGSFKSHKTQTKEAQEAEAFALYHKALDLQKHDRFEESAKAYHELLEASLLREAVMLDSTDVNLWYKIGHVALRLIRIPLARHAFEEGLRCNPDHWPCLDNLITVLYTLSDYTTCLYFICKALEKDCRYSKGLVLKEKIFEEQPCLRKDSLRMFLKCDMSIHDVSVSAAETQAIVDEALGLRKKRQALIVREKEPDLKLVQPIPFFTWKCLGESLLAMYNHLTTCEPPRPSLGKRIDLSDYQDPSQPLESSMVVTPVNVIQPSTVSTNPAVAVAEPVVSYTSVATTSFPLHSPGLLETGAPVGDISGGDKSKKGVKRKKISEESGETAKRRSARVRNTKCKKEEKVDFQELLMKFLPSRLRKLDPEEEDDSFNNYEVQSEAKLESFPSIGPQRLSFDSATFMESEKQDVHEFLLENLTNGGILELMMRYLKAMGHKFLVRWPPGLAEVVLSVYHSWRRHSTSLPNPLLRDCSNKHIKDMMLMSLSCMELQLDQWLLTKGRSSAVSPRNCPAGMVNGRFGPDFPGTHCLGDLLQLSFASSQRDLFEDGWLEFVVRVYWLKARFLALQGDMEQALENYDICTEMLQSSTAIQVEAGAERRDIVIRLPNLHNDSVVSLEEIDKNLKSLERCQSLEEIQRLYEAGDYKAVVHLLRPTLCTSGFDRAKHLEFMTSIPERPAQLLLLQDSLLRLKDYRQCFECSDVALNEAVQQMVNSGEAAAKEEWVATVTQLLMGIEQALSADSSGSILKVSSSTTGLVRLTNNLIQVIDCSMAVQEEAKEPHVSSVLPWIILHRIIWQEEDTFHSLCHQQQLQNPAEEGMSETPMLPSSLMLLNTAHEYLGRRSWCCNSDGALLRFYVRVLQKELAASTSEDTHPYKEELETALEQCFYCLYSFPSKKSKARYLEEHSAQQVDLIWEDALFMFEYFKPKTLPEFDSYKTSTVSADLANLLKRIATIVPRTERPALSLDKVSAYIEGTSTEVPCLPEGADPSPPVVNELYYLLADYHFKNKEQSKAIKFYMHDICICPNRFDSWAGMALARASRIQDKLNSNELKSDGPIWKHATPVLNCFRRALEIDSSNLSLWIEYGTMSYALHSFASRQLKQWRGELPPELVQQMEGRRDSMLETAKHCFTSAARCEGDGDEEEWLIHYMLGKVAEKQQQPPTVYLLHYRQAGHYLHEEAARYPKKIHYHNPPELAMEALEVYFRLHASILKLLGKPDSGVGAEVLVNFMKEAAEGPFARGEEKNTPKASEKEKACLVDEDSHSSAGTLPGPGASLPSSSDRSQDSTAVALSDSSSTQDFFNEPTSLLEGSRKSYTEKRLPILSSQAGATGKDLQGATEERGKNEESLESTEGFRAAEQGVQKPAAETPASACIPGKPSASTPTLWDGKKRGDLPGEPVAFPQGLPAGAEEQRQFLTEQCIASFRLCLSRFPQHYKSLYRLAFLYTYSKTHRNLQWARDVLLGSSIPWQQLQHMPAQGLFCERNKTNFFNGIWRIPVDEIDRPGSFAWHMNRSIVLLLKVLAQLRDHSTLLKVSSMLQRTPDQGKKYLRDADRQVLAQRAFILTVKVLEDTLSELAEGSERPGPKVCGLPGARMTTDVSHKASPEDGQEGLPQPKKPPLADGSGPGPEPGGKVGLLNHRPVAMDAGDSADQSGERKDKESPRAGPTEPMDTSEATVCHSDLERTPPLLPGRPARDRGPESRPTELSLEELSISARQQPTPLTPAQPAPAPAPATTTGTRAGGHPEEPLSRLSRKRKLLEDTESGKTLLLDAYRVWQQGQKGVAYDLGRVERIMSETYMLIKQVDEEAALEQAVKFCQVHLGAAAQRQASGDTPTTPKHPKDSRENFFPVTVVPTAPDPVPADSVQRPSDAHTKPRPALAAATTIITCPPSASASTLDQSKDPGPPRPHRPEATPSMASLGPEGEELARVAEGTSFPPQEPRHSPQVKMAPTSSPAEPHCWPAEAALGTGAEPTCSQEGKLRPEPRRDGEAQEAASETQPLSSPPTAASSKAPSSGSAQPPEGHPGKPEPSRAKSRPLPNMPKLVIPSAATKFPPEITVTPPTPTLLSPKGSISEETKQKLKSAILSAQSAANVRKESLCQPALEVLETSSQESSLESETDEDDDYMDI

SEQ ID NO: 890709 - protein, 1007 aa, Homo sapiens
MVGLKANKNKQCVAACCPGHGPISSVADWPVEQILATGKAAHTRGVVLQVYFRLHASILKLLGKPDSGVGAEVLVNFMKEAAEGPFARGEEKNTPKASEKEKACLVDEDSHSSAGTLPGPGASLPSSSGPGLTSPPYTATPIDHDYVKCKKPHQQATPDDRSQDSTAVALSDSSSTQDFFNEPTSLLEGSRKSYTEKRLPILSSQAGATGKDLQGATEERGKNEESLESTEGFRAAEQGVQKPAAETPASACIPGKPSASTPTLWDGKKRGDLPGEPVAFPQGLPAGAEEQRQFLTEQCIASFRLCLSRFPQHYKSLYRLAFLYTYSKTHRNLQWARDVLLGSSIPWQQLQHMPAQGLFCERNKTNFFNGIWRIPVDEIDRPGSFAWHMNRSIVLLLKVLAQLRDHSTLLKVSSMLQRTPDQGKKYLRDADRQVLAQRAFILTVKVLEDTLSELAEGSERPGPKVCGLPGARMTTDVSHKASPEDGQEGLPQPKKPPLADGSGPGPEPGGKVGLLNHRPVAMDAGDSADQSGERKDKESPRAGPTEPMDTSEATVCHSDLERTPPLLPGRPARDRGPESRPTELSLEELSISARQQPTPLTPAQPAPAPAPATTTGTRAGGHPEEPLSRLSRKRKLLEDTESGKTLLLDAYRVWQQGQKGVAYDLGRVERIMSETYMLIKQVDEEAALEQAVKFCQVHLGAAAQRQASGDTPTTPKHPKDSRENFFPVTVVPTAPDPVPADSVQRPSDAHTKPRPALAAATTIITCPPSASASTLDQSKDPGPPRPHRPEATPSMASLGPEGEELARVAEGTSFPPQEPRHSPQVKMAPTSSPAEPHCWPAEAALGTGAEPTCSQEGKLRPEPRRDGEAQEAASETQPLSSPPTAASSKAPSSGSAQPPEGHPGKPEPSRAKSRPLPNMPKLVIPSAATKFPPEITVTPPTPTLLSPKGSISEETKQKLKSAILSAQSAANVRKESLCQPALEVLETSSQESSLESETDEDDDYMDI

SEQ ID NO: 890710 - protein, 649 aa, Homo sapiens
MAIGSPLTVREGIWRIPVDEIDRPGSFAWHMNRSIVLLLKVLAQLRDHSTLLKVSSMLQRTPDQGKKYLRDADRQVLAQRAFILTVKVLEDTLSELAEGSERPGPKVCGLPGARMTTDVSHKASPEDGQEGLPQPKKPPLADGSGPGPEPGGKVGLLNHRPVAMDAGDSADQSGERKDKESPRAGPTEPMDTSEATVCHSDLERTPPLLPGRPARDRGPESRPTELSLEELSISARQQPTPLTPAQPAPAPAPATTTGTRAGGHPEEPLSRLSRKRKLLEDTESGKTLLLDAYRVWQQGQKGVAYDLGRVERIMSETYMLIKQVDEEAALEQAVKFCQVHLGAAAQRQASGDTPTTPKHPKDSRENFFPVTVVPTAPDPVPADSVQRPSDAHTKPRPALAAATTIITCPPSASASTLDQSKDPGPPRPHRPEATPSMASLGPEGEELARVAEGTSFPPQEPRHSPQVKMAPTSSPAEPHCWPAEAALGTGAEPTCSQEGKLRPEPRRDGEAQEAASETQPLSSPPTAASSKAPSSGSAQPPEGHPGKPEPSRAKSRPLPNMPKLVIPSAATKFPPEITVTPPTPTLLSPKGSISEETKQKLKSAILSAQSAANVRKESLCQPALEVLETSSQESSLESETDEDDDYMDI

SEQ ID NO: 890711 - protein, 2194 aa, Homo sapiens
MIRIAALNASSTIEDDHEGSFKSHKTQTKEAQEAEAFALYHKALDLQKHDRFEESAKAYHELLEASLLREAVMLDSTDVNLWYKIGHVALRLIRIPLARHAFEEGLRCNPDHWPCLDNLITVLYTLSDYTTCLYFICKALEKDCRYSKGLVLKEKIFEEQPCLRKDSLRMFLKCDMSIHDVSVSAAETQAIVDEALGLRKKRQALIVREKEPDLKLVQPIPFFTWKCLGESLLAMYNHLTTCEPPRPSLGKRIDLSDYQDPSQPLESSMVVTPVNVIQPSTVSTNPAVAVAEPVVSYTSVATTSFPLHSPGLLETGAPVGDISGGDKSKKGVKRKKISEESGETAKRRSARVRNTKCKKEEKVDFQELLMKFLPSRLRKLDPEEEDDSFNNYEVQSEAKLESFPSIGPQRLSFDSATFMESEKQDVHEFLLENLTNGGILELMMRYLKAMGHKFLVRWPPGLAEVVLSVYHSWRRHSTSLPNPLLRDCSNKHIKDMMLMSLSCMELQLDQWLLTKGRSSAVSPRNCPAGMVNGRFGPDFPGTHCLGDLLQLSFASSQRDLFEDGWLEFVVRVYWLKARFLALQGDMEQALENYDICTEMLQSSTAIQVEAGAERRDIVIRLPNLHNDSVVSLEEIDKNLKSLERCQSLEEIQRLYEAGDYKAVVHLLRPTLCTSGFDRAKHLEFMTSIPERPAQLLLLQDSLLRLKDYRQCFECSDVALNEAVQQMVNSGEAAAKEEWVATVTQLLMGIEQALSADSSGSILKVSSSTTGLVRLTNNLIQVIDCSMAVQEEAKEPHVSSVLPWIILHRIIWQEEDTFHSLCHQQQLQNPAEEGMSETPMLPSSLMLLNTAHEYLGRRSWCCNSDGALLRFYVRVLQKELAASTSEDTHPYKEELETALEQCFYCLYSFPSKKSKARYLEEHSAQQVDLIWEDALFMFEYFKPKTLPEFDSYKTSTVSADLANLLKRIATIVPRTERPALSLDKVSAYIEGTSTEVPCLPEGADPSPPVVNELYYLLADYHFKNKEQSKAIKFYMHDICICPNRFDSWAGMALARASRIQDKLNSNELKSDGPIWKHATPVLNCFRRALEIDSSNLSLWIEYGTMSYALHSFASRQLKQWRGELPPELVQQMEGRRDSMLETAKHCFTSAARCEGDGDEEEWLIHYMLGKVAEKQQQPPTVYLLHYRQAGHYLHEEAARYPKKIHYHNPPELAMEALEVYFRLHASILKLLGKPDSGVGAEVLVNFMKEAAEGPFARGEEKNTPKASEKEKACLVDEDSHSSAGTLPGPGASLPSSSGPGLTSPPYTATPIDHDYVKCKKPHQQATPDDRSQDSTAVALSDSSSTQDFFNEPTSLLEGSRKSYTEKRLPILSSQAGATGKDLQGATEERGKNEESLESTEGFRAAEQGVQKPAAETPASACIPGKPSASTPTLWDGKKRGDLPGEPVAFPQGLPAGAEEQRQFLTEQCIASFRLCLSRFPQHYKSLYRLAFLYTYSKTHRNLQWARDVLLGSSIPWQQLQHMPAQGLFCERNKTNFFNGIWRIPVDEIDRPGSFAWHMNRSIVLLLKVLAQLRDHSTLLKVSSMLQRTPDQGKKYLRDADRQVLAQRAFILTVKVLEDTLSELAEGSERPGPKVCGLPGARMTTDVSHKASPEDGQEGLPQPKKPPLADGSGPGPEPGGKVGLLNHRPVAMDAGDSADQSGERKDKESPRAGPTEPMDTSEATVCHSDLERTPPLLPGRPARDRGPESRPTELSLEELSISARQQPTPLTPAQPAPAPAPATTTGTRAGGHPEEPLSRLSRKRKLLEDTESGKTLLLDAYRVWQQGQKGVAYDLGRVERIMSETYMLIKQVDEEAALEQAVKFCQVHLGAAAQRQASGDTPTTPKHPKDSRENFFPVTVVPTAPDPVPADSVQRPSDAHTKPRPALAAATTIITCPPSASASTLDQSKDPGPPRPHRPEATPSMASLGPEGEELARVAEGTSFPPQEPRHSPQVKMAPTSSPAEPHCWPAEAALGTGAEPTCSQEGKLRPEPRRDGEAQEAASETQPLSSPPTAASSKAPSSGSAQPPEGHPGKPEPSRAKSRPLGYVPRTLGRPPRATLGLAHVDYRFKTAGIPASVPTWWCLVATCQGSPRCNGWLAPTVTGGLLSPSFTTGELELVKTLQLLKKQLKWECWIQCMAYAHDGQRLMDLKRFKT

SEQ ID NO: 890712 - protein, 2085 aa, Homo sapiens
MIRIAALNASSTIEDDHEGSFKSHKTQTKEAQEAEAFALYHKALDLQKHDRFEESAKAYHELLEASLLREAVMLDSTDVNLWYKIGHVALRLIRIPLARHAFEEGLRCNPDHWPCLDNLITVLYTLSDYTTCLYFICKALEKDCRYSKGLVLKEKIFEEQPCLRKDSLRMFLKCDMSIHDVSVSAAETQAIVDEALGLRKKRQALIVREKEPDLKLVQPIPFFTWKCLGESLLAMYNHLTTCEPPRPSLGKRIDLSDYQDPSQPLESSMVVTPVNVIQPSTVSTNPAVAVAEPVVSYTSVATTSFPLHSPGLLETGAPVGDISGGDKSKKGVKRKKISEESGETAKRRSARVRNTKCKKEEKVDFQELLMKFLPSRLRKLDPEEEDDSFNNYEVQSEAKLESFPSIGPQRLSFDSATFMESEKQDVHEFLLENLTNGGILELMMRYLKAMGHKFLVRWPPGLAEVVLSVYHSWRRHSTSLPNPLLRDCSNKHIKDMMLMSLSCMELQLDQWLLTKGRSSAVSPRNCPAGMVNGRFGPDFPGTHCLGDLLQLSFASSQRDLFEDGWLEFVVRVYWLKARFLALQGDMEQALENYDICTEMLQSSTAIQVEAGAERRDIVIRLPNLHNDSVVSLEEIDKNLKSLERCQSLEEIQRLYEAGDYKAVVHLLRPTLCTSGFDRAKHLEFMTSIPERPAQLLLLQDSLLRLKDYRQCFECSDVALNEAVQQMVNSGEAAAKEEWVATVTQLLMGIEQALSADSSGSILKVSSSTTGLVRLTNNLIQVIDCSMAVQEEAKEPHVSSVLPWIILHRIIWQEEDTFHSLCHQQQLQNPAEEGMSETPMLPSSLMLLNTAHEYLGRRSWCCNSDGALLRFYVRVLQKELAASTSEDTHPYKEELETALEQCFYCLYSFPSKKSKARYLEEHSAQQVDLIWEDALFMFEYFKPKTLPEFDSYKTSTVSADLANLLKRIATIVPRTERPALSLDKVSAYIEGTSTEVPCLPEGADPSPPVVNELYYLLADYHFKNKEQSKAIKFYMHDICICPNRFDSWAGMALARASRIQDKLNSNELKSDGPIWKHATPVLNCFRRALEIDSSNLSLWIEYGTMSYALHSFASRQLKQWRGELPPELVQQMEGRRDSMLETAKHCFTSAARCEGDGDEEEWLIHYMLGKVAEKQQQPPTVYLLHYRQAGHYLHEEAARYPKKIHYHNPPELAMEALEVYFRLHASILKLLGKPDSGVGAEVLVNFMKEAAEGPFARGEEKNTPKASEKEKACLVDEDSHSSAGTLPGPGASLPSSSGPGLTSPPYTATPIDHDYVKCKKPHQQATPDDRSQDSTAVALSDSSSTQDFFNEPTSLLEGSRKSYTEKRLPILSSQAGATGKDLQGATEERGKNEESLESTEGFRAAEQGVQKPAAETPASACIPGKPSASTPTLWDGKKRGDLPGEPVAFPQGLPAGAEEQRQFLTEQCIASFRLCLSRFPQHYKSLYRLAFLYTYSKTHRNLQWARDVLLGSSIPWQQLQHMPAQGLFCERNKTNFFNGIWRIPVDEIDRPGSFAWHMNRSIVLLLKVLAQLRDHSTLLKVSSMLQRTPDQGKKYLRDADRQVLAQRAFILTVKVLEDTLSELAEGSERPGPKVCGLPGARMTTDVSHKASPEDGQEGLPQPKKPPLADGSGPGPEPGGKVGLLNHRPVAMDAGDSADQSGERKDKESPRAGPTEPMDTSEATVCHSDLERTPPLLPGRPARDRGPESRPTELSLEELSISARQQPTPLTPAQPAPAPAPATTTGTRAGGHPEEPLSRLSRKRKLLEDTESGKTLLLDAYRVWQQGQKGVAYDLGRVERIMSETYMLIKQVDEEAALEQAVKFCQVHLGAAAQRQASGDTPTTPKHPKDSRENFFPVTVVPTAPDPVPADSVQRPSDAHTKPRPALAAATTIITCPPSASASTLDQSKDPGPPRPHRPEATPSMASLGPEGEELARVAEGTSFPPQEPRHSPQVKMAPTSSPAEPHCWPAEAALGTGAEPTCSQEGKLRPEPRRDGDEIPITIFNVLSYLFCFLCLSFLYTILLLCTYILIIPFQACPMSLVCIYK

SEQ ID NO: 890713 - protein, 595 aa, Homo sapiens
MIRIAALNASSTIEDDHEGSFKSHKTQTKEAQEAEAFALYHKALDLQKHDRFEESAKAYHELLEASLLREAVMLDSTDVNLWYKIGHVALRLIRIPLARHAFEEGLRCNPDHWPCLDNLITVLYTLSDYTTCLYFICKALEKDCRYSKGLVLKEKIFEEQPCLRKDSLRMFLKCDMSIHDVSVSAAETQAIVDEALGLRKKRQALIVREKEPDLKLVQPIPFFTWKCLGESLLAMYNHLTTCEPPRPSLGKRIDLSDYQDPSQPLESSMVVTPVNVIQPSTVSTNPAVAVAEPVVSYTSVATTSFPLHSPGLLETGAPVGDISGGDKSKKGVKRKKISEESGETAKRRSARVRNTKCKKEEKVDFQELLMKFLPSRLRKLDPEEEDDSFNNYEVQSEAKLESFPSIGPQRLSFDSATFMESEKQDVHEFLLENLTNGGILELMMRYLKAMGHKFLVRWPPGLAEVVLSVYHSWRRHSTSLPNPLLRDCSNKHIKDMMLMSLSCMELQLDQWLLTKGRSSAVSPRNCPAGMVNGRFGPARPGMPPGQDPGQDQRPTWMPLPTQPPGLPSPPPHGILPVPRSGCPHHMGAQRRRGPP

SEQ ID NO: 890714 - protein, 1246 aa, Homo sapiens
MIRIAALNASSTIEDDHEGSFKSHKTQTKEAQEAEAFALYHKALDLQKHDRFEESAKAYHELLEASLLREAVMLDSTDVNLWYKIGHVALRLIRIPLARHAFEEGLRCNPDHWPCLDNLITVLYTLSDYTTCLYFICKALEKDCRYSKGLVLKEKIFEEQPCLRKDSLRMFLKCDMSIHDVSVSAAETQAIVDEALGLRKKRQALIVREKEPDLKLVQPIPFFTWKCLGESLLAMYNHLTTCEPPRPSLGKRIDLSDYQDPSQPLESSMVVTPVNVIQPSTVSTNPAVAVAEPVVSYTSVATTSFPLHSPGLLETGAPVGDISGGDKSKKGVKRKKISEESGETAKRRSARVRNTKCKKEEKVDFQELLMKFLPSRLRKLDPEEEDDSFNNYEVQSEAKLESFPSIGPQRLSFDSATFMESEKQDVHEFLLENLTNGGILELMMRYLKAMGHKFLVRWPPGLAEVVLSVYHSWRRHSTSLPNPLLRDCSNKHIKDMMLMSLSCMELQLDQWLLTKGRSSAVSPRNCPAGMVNGRFGPDFPGTHCLGDLLQLSFASSQRDLFEDGWLEFVVRVYWLKARFLALQGDMEQALENYDICTEMLQSSTAIQVEAGAERRDIVIRLPNLHNDSVVSLEEIDKNLKSLERCQSLEEIQRLYEAGDYKAVVHLLRPTLCTSGFDRAKHLEFMTSIPERPAQLLLLQDSLLRLKDYRQCFECSDVALNEAVQQMVNSGEAAAKEEWVATVTQLLMGIEQALSADSSGSILKVSSSTTGLVRLTNNLIQVIDCSMAVQEEAKEPHVSSVLPWIILHRIIWQEEDTFHSLCHQQQLQNPAEEGMSETPMLPSSLMLLNTAHEYLGRRSWCCNSDGALLRFYVRVLQKELAASTSEDTHPYKEELETALEQCFYCLYSFPSKKSKARYLEEHSAQQVDLIWEDALFMFEYFKPKTLPEFDSYKTSTVSADLANLLKRIATIVPRTERPALSLDKVSAYIEGTSTEVPCLPEGADPSPPVVNELYYLLADYHFKNKEQSKAIKFYMHDICICPNRFDSWAGMALARASRIQDKLNSNELKSDGPIWKHATPVLNCFRRALEIDSSNLSLWIEYGTMSYALHSFASRQLKQWRGELPPELVQQMEGRRDSMLETAKHCFTSAARCEGDGDEEEWLIHYMLGKVAEKQQQPPTVYLLHYRQAGHYLHEEAARYPKKIHYHNPPELAMEALEVTPCWPRAGKQGRGRLVSLSPWACGSRFQ

SEQ ID NO: 890715 - protein, 1051 aa, Homo sapiens
MIRIAALNASSTIEDDHEGSFKSHKTQTKEAQEAEAFALYHKALDLQKHDRFEESAKAYHELLEASLLREAVMLDSTDVNLWYKIGHVALRLIRIPLARHAFEEGLRCNPDHWPCLDNLITVLYTLSDYTTCLYFICKALEKDCRYSKGLVLKEKIFEEQPCLRKDSLRMFLKCDMSIHDVSVSAAETQAIVDEALGLRKKRQALIVREKEPDLKLVQPIPFFTWKCLGESLLAMYNHLTTCEPPRPSLGKRIDLSDYQDPSQPLESSMVVTPVNVIQPSTVSTNPAVAVAEPVVSYTSVATTSFPLHSPGLLETGAPVGDISGGDKSKKGVKRKKISEESGETAKRRSARVRNTKCKKEEKVDFQELLMKFLPSRLRKLDPEEEDDSFNNYEVQSEAKLESFPSIGPQRLSFDSATFMESEKQDVHEFLLENLTNGGILELMMRYLKAMGHKFLVRWPPGLAEVVLSVYHSWRRHSTSLPNPLLRDCSNKHIKDMMLMSLSCMELQLDQWLLTKGRSSAVSPRNCPAGMVNGRFGPDFPGTHCLGDLLQLSFASSQRDLFEDGWLEFVVRVYWLKARFLALQGDMEQALENYDICTEMLQSSTAIQVEAGAERRDIVIRLPNLHNDSVVSLEEIDKNLKSLERCQSLEEIQRLYEAGDYKAVVHLLRPTLCTSGFDRAKHLEFMTSIPERPAQLLLLQDSLLRLKDYRQCFECSDVALNEAVQQMVNSGEAAAKEEWVATVTQLLMGIEQALSADSSGSILKVSSSTTGLVRLTNNLIQVIDCSMAVQEEAKEPHVSSVLPWIILHRIIWQEEDTFHSLCHQQQLQNPAEEGMSETPMLPSSLMLLNTAHEYLGRRSWCCNSDGALLRFYVRVLQKELAASTSEDTHPYKEELETALEQCFYCLYSFPSKKSKARYLEEHSAQQVDLIWEDALFMFEYFKPKTLPEFDSYKTSTVSADLANLLKRIATIVPRTERPALSLDKVSAYIEGTSTEVPCLPEGADPSPPVVNELYYLLADYHFKNKEQSKAIKFYMHDICICPNRSDMHRWML

SEQ ID NO: 890716 - protein, 467 aa, Homo sapiens
MIRIAALNASSTIEDDHEGSFKSHKTQTKEAQEAEAFALYHKALDLQKHDRFEESAKAYHELLEASLLREAVMLDSTDVNLWYKIGHVALRLIRIPLARHAFEEGLRCNPDHWPCLDNLITVLYTLSDYTTCLYFICKALEKDCRYSKGLVLKEKIFEEQPCLRKDSLRMFLKCDMSIHDVSVSAAETQAIVDEALGLRKKRQALIVREKEPDLKLVQPIPFFTWKCLGESLLAMYNHLTTCEPPRPSLGKRIDLSDYQDPSQPLESSMVVTPVNVIQPSTVSTNPAVAVAEPVVSYTSVATTSFPLHSPGLLETGAPVGDISGGDKSKKGVKRKKISEESGETAKRRSARVRNTKCKKEEKVDFQELLMKFLPSRLRKLDPEEEDDSFNNYEVQSEAKLESFPSIGPQRLSFDSATFMESEKQDVHEFLLENLTNGGILELMMRSAGAQWAELIMVLGIFSLISHQ

SEQ ID NO: 890717 - protein, 79 aa, Homo sapiens
LQGRRRRESPPDVARQGTSQAWNAPWAGPWAGPEAHMDATPHTAPRPAQPTSSWHPPCTQVRLSTPHGSPEEEGPALAM

SEQ ID NO: 890718 - protein, 607 aa, Homo sapiens
NEPPRPWPGARPSSTAQMPRRSRRGIWRIPVDEIDRPGSFAWHMNRSIVLLLKVLAQLRDHSTLLKVSSMLQRTPDQGKKYLRDADRQVLAQRAFILTVKVLEDTLSELAEGSERPGPKVCGLPGARMTTDVSHKASPEDGQEGLPQPKKPPLADGSGPGPEPGGKVGLLNHRPVAMDAGDSADQSGERKDKESPRAGPTEPMDTSEATVCHSDLERTPPLLPGRPARDRGPESRPTELSLEELSISARQQPTPLTPAQPAPAPAPATTTGTRAGGHPEEPLSRLSRKRKLLEDTESGKTLLLDAYRVWQQGQKGVAYDLGRVERIMSETYMLIKQVDEEAALEQAVKFCQVHLGAAAQRQASGDTPTTPKHPKDSRENFFPVTVVPTAPDPVPADSVQRPSDAHTKPRPALAAATTIITCPPSASASTLDQSKDPGPPRPHRPEATPSMASLGPEGKLRPEPRRDGEAQEAASETQPLSSPPTAASSKAPSSGSAQPPEGHPGKPEPSRAKSRPLPNMPKLVIPSAATKFPPEITVTPPTPTLLSPKGSISEETKQKLKSAILSAQSAANVRKESLCQPALEVLETSSQESSLESETDEDDDYMDI

SEQ ID NO: 890719 - protein, 2217 aa, Homo sapiens
AAGGSRGSHRVMSSVRNFKSHKDQTKEAQEAEAFALYHKALDLQKHDRFEESAKAYHELLEASLLREAVSSGDEKEGLKHPGLILKYSTYKNLAQLAAQREDLETAMEFYLEAVMLDSTDVNLWYKIGHVALRLIRIPLARHAFEEGLRCNPDHWPCLDNLITVLYTLSDYTTCLYFICKALEKDCRYSKGLVLKEKIFEEQPCLRKDSLRMFLKCDMSIHDVSVSAAETQAIVDEALGLRKKRQALIVREKEPDLKLVQPIPFFTWKCLGESLLAMYNHLTTCEPPRPSLGKRIDLSDYQDPSQPLESSMVVTPVNVIQPSTVSTNPAVAVAEPVVSYTSVATTSFPLHSPGLLETGAPVGDISGGDKSKKGVKRKKISEESGETAKRRSARVRNTKCKKEEKVDFQELLMKFLPSRLRKLDPEEEDDSFNNYEVQSEAKLESFPSIGPQRLSFDSATFMESEKQDVHEFLLENLTNGGILELMMRYLKAMGHKFLVRWPPGLAEVVLSVYHSWRRHSTSLPNPLLRDCSNKHIKDMMLMSLSCMELQLDQWLLTKGRSSAVSPRNCPAGMVNGRFGPDFPGTHCLGDLLQLSFASSQRDLFEDGWLEFVVRVYWLKARFLALQGDMEQALENYDICTEMLQSSTAIQVEAGAERRDIVIRLPNLHNDSVVSLEEIDKNLKSLERCQSLEEIQRLYEAGDYKAVVHLLRPTLCTSGFDRAKHLEFMTSIPERPAQLLLLQDSLLRLKDYRQCFECSDVALNEAVQQMVNSGEAAAKEEWVATVTQLLMGIEQALSADSSGSILKVSSSTTGLVRLTNNLIQVIDCSMAVQEEAKEPHVSSVLPWIILHRIIWQEEDTFHSLCHQQQLQNPAEEGMSETPMLPSSLMLLNTAHEYLGRRSWCCNSDGALLRFYVRVLQKELAASTSEDTHPYKEELETALEQCFYCLYSFPSKKSKARYLEEHSAQQVDLIWEDALFMFEYFKPKTLPEFDSYKTSTVSADLANLLKRIATIVPRTERPALSLDKVSAYIEGTSTEVPCLPEGADPSPPVVNELYYLLADYHFKNKEQSKAIKFYMHDICICPNRFDSWAGMALARASRIQDKLNSNELKSDGPIWKHATPVLNCFRRALEIDSSNLSLWIEYGTMSYALHSFASRQLKQWRGELPPELVQQMEGRRDSMLETAKHCFTSAARCEGDGDEEEWLIHYMLGKVAEKQQQPPTVYLLHYRQAGHYLHEEAARYPKKIHYHNPPELAMEALEVYFRLHASILKLLGKPDSGVGAEVLVNFMKEAAEGPFARGEEKNTPKASEKEKACLVDEDSHSSAGTLPGPGASLPSSSGPGLTSPPYTATPIDHDYVKCKKPHQQATPDDRSQDSTAVALSDSSSTQDFFNEPTSLLEGSRKSYTEKRLPILSSQAGATGKDLQGATEERGKNEESLESTEGFRAAEQGVQKPAAETPASACIPGKPSASTPTLWDGKKRGDLPGEPVAFPQGLPAGAEEQRQFLTEQCIASFRLCLSRFPQHYKSLYRLAFLYTYSKTHRNLQWARDVLLGSSIPWQQLQHMPAQGLFCERNKTNFFNGIWRIPVDEIDRPGSFAWHMNRSIVLLLKVLAQLRDHSTLLKVSSMLQRTPDQGKKYLRDADRQVLAQRAFILTVKVLEDTLSELAEGSERPGPKVCGLPGARMTTDVSHKASPEDGQEGLPQPKKPPLADGSGPGPEPGGKVGLLNHRPVAMDAGDSADQSGERKDKESPRAGPTEPMDTSEATVCHSDLERTPPLLPGRPARDRGPESRPTELSLEELSISARQQPTPLTPAQPAPAPAPATTTGTRAGGHPEEPLSRLSRKRKLLEDTESGKTLLLDAYRVWQQGQKGVAYDLGRVERIMSETYMLIKQVDEEAALEQAVKFCQVHLGAAAQRQASGDTPTTPKHPKDSRENFFPVTVVPTAPDPVPADSVQRPSDAHTKPRPALAAATTIITCPPSASASTLDQSKDPGPPRPHRPEATPSMASLGPEGEELARVAEGTSFPPQEPRHSPQVKMAPTSSPAEPHCWPAEAALGTGAEPTCSQEGKLRPEPRRDGEAQEAASETQPLSSPPTAASSKAPSSGSAQPPEGHPGKPEPSRAKSRPLPNMPKLVIPSAATKFPPEITVTPPTPTLLSPKGSISEETKQKLKSAILSAQSAANVRKESLCQPALEVLETSSQESSLESETDEDDDYMDI

SEQ ID NO: 890720 - protein, 2006 aa, Homo sapiens
MIRIAALNASSTIEDDHEGSFKSHKTQTKEAQEAEAFALYHKALDLQKHDRFEESAKAYHELLEASLLREAVMLDSTDVNLWYKIGHVALRLIRIPLARHAFEEGLRCNPDHWPCLDNLITVLYTLSDYTTCLYFICKALEKDCRYSKGLVLKEKIFEEQPCLRKDSLRMFLKCDMSIHDVSVSAAETQAIVDEALGLRKKRQALIVREKEPDLKLVQPIPFFTWKCLGESLLAMYNHLTTCEPPRPSLGKRIDLSDYQDPSQPLESSMVVTPVNVIQPSTVSTNPAVAVAEPVVSYTSVATTSFPLHSPGLLETGAPVGDISGGDKSKKGVKRKKISEESGETAKRRSARVRNTKCKKEEKVDFQELLMKFLPSRLRKLDPEEEDDSFNNYEVQSEAKLESFPSIGPQRLSFDSATFMESEKQDVHEFLLENLTNGGILELMMRYLKAMGHKFLVRWPPGLAEVVLSVYHSWRRHSTSLPNPLLRDCSNKHIKDMMLMSLSCMELQLDQWLLTKGRSSAVSPRNCPAGMVNGRFGPDFPGTHCLGDLLQLSFASSQRDLFEDGWLEFVVRVYWLKARFLALQGDMEQALENYDICTEMLQSSTAIQVEAGAERRDIVIRLPNLHNDSVVSLEEIDKNLKSLERCQSLEEIQRLYEAGDYKAVVHLLRPTLCTSGFDRAKHLEFMTSIPERPAQLLLLQDSLLRLKDYRQCFECSDVALNEAVQQMVNSGEAAAKEEWVATVTQLLMGIEQALSADSSGSILKVSSSTTGLVRLTNNLIQVIDCSMAVQEEAKEPHVSSVLPWIILHRIIWQEEDTFHSLCHQQQLQNPAEEGMSETPMLPSSLMLLNTAHEYLGRRSWCCNSDGALLRFYVRVLQKELAASTSEDTHPYKEELETALEQCFYCLYSFPSKKSKARYLEEHSAQQVDLIWEDALFMFEYFKPKTLPEFDSYKTSTVSADLANLLKRIATIVPRTERPALSLDKVSAYIEGTSTEVPCLPEGADPSPPVVNELYYLLADYHFKNKEQSKAIKFYMHDICICPNRFDSWAGMALARASRIQDKLNSNELKSDGPIWKHATPVLNCFRRALEIDSSNLSLWIEYGTMSYALHSFASRQLKQWRGELPPELVQQMEGRRDSMLETAKHCFTSAARCEGDGDEEEWLIHYMLGKVAEKQQQPPTVYLLHYRQAGHYLHEEAARYPKKIHYHNPPELAMEALEVYFRLHASILKLLGKPDSGVGAEVLVNFMKEAAEGPFARGEEKNTPKASEKEKACLVDEDSHSSAGTLPGPGASLPSSSGPGLTSPPYTATPIDHDYVKCKKPHQQATPDDRSQDSTAVALSDSSSTQDFFNEPTSLLEGSRKSYTEKRLPILSSQAGATGKDLQGATEERGKNEESLESTEGFRAAEQGVQKPAAETPASACIPGKPSASTPTLWDGKKRGDLPGEPVAFPQGLPAGAEEQRQFLTEQCIASFRLCLSRFPQHYKSLYRLAFLYTYSKTHRNLQWARDVLLGSSIPWQQLQHMPAQGLFCERNKTNFFNGIWRIPVDEIDRPGSFAWHMNRSIVLLLKVLAQLRDHSTLLKVSSMLQRTPDQGKKYLRDADRQVLAQRAFILTVKVLEDTLSELAEGSERPGPKVCGLPGARMTTDVSHKASPEDGQEGLPQPKKPPLADGSGPGPEPGGKVGLLNHRPVAMDAGDSADQSGERKDKESPRAGPTEPMDTSEATVCHSDLERTPPLLPGRPARDRGPESRPTELSLEELSISARQQPTPLTPAQPAPAPAPATTTGTRAGGHPEEPLSRLSRKRKLLEDTESGKTLLLDAYRVWQQGQKGVAYDLGRVERIMSETYMLIKQVDEEAALEQAVKFCQVHLGAAAQRQASGDTPTTPKHPKDSRENFFPVTVVPTAPDPVPADSVQRPSDAHTKPRPALAAATTIITCPPSASASTLDQSKDPGPPRPHRPEATPSMASLGPGPPLLLPPCLKDPACFLAADPALAHSLCHPWRLTCLPS

SEQ ID NO: 890721 - protein, 678 aa, Homo sapiens
PRAGSWLVGACAARKRKPPARATLRRKAPTRSCAVPLLGMGIWRIPVDEIDRPGSFAWHMNRSIVLLLKVLAQLRDHSTLLKVSSMLQRTPDQGKKYLRDADRQVLAQRAFILTVKVLEDTLSELAEGSERPGPKVCGLPGARMTTDVSHKASPEDGQEGLPQPKKPPLADGSGPGPEPGGKVGLLNHRPVAMDAGDSADQSGERKDKESPRAGPTEPMDTSEATVCHSDLERTPPLLPGRPARDRGPESRPTELSLEELSISARQQPTPLTPAQPAPAPAPATTTGTRAGGHPEEPLSRLSRKRKLLEDTESGKTLLLDAYRVWQQGQKGVAYDLGRVERIMSETYMLIKQVDEEAALEQAVKFCQVHLGAAAQRQASGDTPTTPKHPKDSRENFFPVTVVPTAPDPVPADSVQRPSDAHTKPRPALAAATTIITCPPSASASTLDQSKDPGPPRPHRPEATPSMASLGPEGEELARVAEGTSFPPQEPRHSPQVKMAPTSSPAEPHCWPAEAALGTGAEPTCSQEGKLRPEPRRDGEAQEAASETQPLSSPPTAASSKAPSSGSAQPPEGHPGKPEPSRAKSRPLPNMPKLVIPSAATKFPPEITVTPPTPTLLSPKGSISEETKQKLKSAILSAQSAANVRKESLCQPALEVLETSSQESSLESETDEDDDYMDI

SEQ ID NO: 890722 - protein, 2175 aa, Homo sapiens; identical to SEQ ID NO: 890705

SEQ ID NO: 890723 - protein, 1828 aa, Homo sapiens
MIRIAALNASSTIEDDHEGSFKSHKTQTKEAQEAEAFALYHKALDLQKHDRFEESAKAYHELLEASLLREAVMLDSTDVNLWYKIGHVALRLIRIPLARHAFEEGLRCNPDHWPCLDNLITVLYTLSDYTTCLYFICKALEKDCRYSKGLVLKEKIFEEQPCLRKDSLRMFLKCDMSIHDVSVSAAETQAIVDEALGLRKKRQALIVREKEPDLKLVQPIPFFTWKCLGESLLAMYNHLTTCEPPRPSLGKRIDLSDYQDPSQPLESSMVVTPVNVIQPSTVSTNPAVAVAEPVVSYTSVATTSFPLHSPGLLETGAPVGDISGGDKSKKGVKRKKISEESGETAKRRSARVRNTKCKKEEKVDFQELLMKFLPSRLRKLDPEEEDDSFNNYEVQSEAKLESFPSIGPQRLSFDSATFMESEKQDVHEFLLENLTNGGILELMMRYLKAMGHKFLVRWPPGLAEVVLSVYHSWRRHSTSLPNPLLRDCSNKHIKDMMLMSLSCMELQLDQWLLTKGRSSAVSPRNCPAGMVNGRFGPDFPGTHCLGDLLQLSFASSQRDLFEDGWLEFVVRVYWLKARFLALQGDMEQALENYDICTEMLQSSTAIQVEAGAERRDIVIRLPNLHNDSVVSLEEIDKNLKSLERCQSLEEIQRLYEAGDYKAVVHLLRPTLCTSGFDRAKHLEFMTSIPERPAQLLLLQDSLLRLKDYRQCFECSDVALNEAVQQMVNSGEAAAKEEWVATVTQLLMGIEQALSADSSGSILKVSSSTTGLVRLTNNLIQVIDCSMAVQEEAKEPHVSSVLPWIILHRIIWQEEDTFHSLCHQQQLQNPAEEGMSETPMLPSSLMLLNTAHEYLGRRSWCCNSDGALLRFYVRVLQKELAASTSEDTHPYKEELETALEQCFYCLYSFPSKKSKARYLEEHSAQQVDLIWEDALFMFEYFKPKTLPEFDSYKTSTVSADLANLLKRIATIVPRTERPALSLDKVSAYIEGTSTEVPCLPEGADPSPPVVNELYYLLADYHFKNKEQSKAIKFYMHDICICPNRFDSWAGMALARASRIQDKLNSNELKSDGPIWKHATPVLNCFRRALEIDSSNLSLWIEYGTMSYALHSFASRQLKQWRGELPPELVQQMEGRRDSMLETAKHCFTSAARCEGDGDEEEWLIHYMLGKVAEKQQQPPTVYLLHYRQAGHYLHEEAARYPKKIHYHNPPELAMEALEVYFRLHASILKLLGKPDSGVGAEVLVNFMKEAAEGPFARGEEKNTPKASEKEKACLVDEDSHSSAGTLPGPGASLPSSSGPGLTSPPYTATPIDHDYVKCKKPHQQATPDDRSQDSTAVALSDSSSTQDFFNEPTSLLEGSRKSYTEKRLPILSSQAGATGKDLQGATEERGKNEESLESTEGFRAAEQGVQKPAAETPASACIPGKPSASTPTLWDGKKRGDLPGEPVAFPQGLPAGAEEQRQFLTEQCIASFRLCLSRFPQHYKSLYRLAFLYTYSKTHRNLQWARDVLLGSSIPWQQLQHMPAQGLFCERNKTNFFNGIWRIPVDEIDRPGSFAWHMNRSIVLLLKVLAQLRDHSTLLKVSSMLQRTPDQGKKYLRDADRQVLAQRAFILTVKVLEDTLSELAEGSERPGPKVCGLPGARMTTDVSHKASPEDGQEGLPQPKKPPLADGSGPGPEPGGKVGLLNHRPVAMDAGDSADQSGERKDKESPRAGPTEPMDTSEATVCHSDLERTPPLLPGRPARDRGPESRPTELSLEELSISARQQPTPLTPAQPAPAPAPATTTGTRAGGHPEEPLSRLSRKRKLLEDTESGKTLLLDAYRVIHPSTPG

SEQ ID NO: 890724 - protein, 1656 aa, Homo sapiens
MIRIAALNASSTIEDDHEGSFKSHKTQTKEAQEAEAFALYHKALDLQKHDRFEESAKAYHELLEASLLREAVMLDSTDVNLWYKIGHVALRLIRIPLARHAFEEGLRCNPDHWPCLDNLITVLYTLSDYTTCLYFICKALEKDCRYSKGLVLKEKIFEEQPCLRKDSLRMFLKCDMSIHDVSVSAAETQAIVDEALGLRKKRQALIVREKEPDLKLVQPIPFFTWKCLGESLLAMYNHLTTCEPPRPSLGKRIDLSDYQDPSQPLESSMVVTPVNVIQPSTVSTNPAVAVAEPVVSYTSVATTSFPLHSPGLLETGAPVGDISGGDKSKKGVKRKKISEESGETAKRRSARVRNTKCKKEEKVDFQELLMKFLPSRLRKLDPEEEDDSFNNYEVQSEAKLESFPSIGPQRLSFDSATFMESEKQDVHEFLLENLTNGGILELMMRYLKAMGHKFLVRWPPGLAEVVLSVYHSWRRHSTSLPNPLLRDCSNKHIKDMMLMSLSCMELQLDQWLLTKGRSSAVSPRNCPAGMVNGRFGPDFPGTHCLGDLLQLSFASSQRDLFEDGWLEFVVRVYWLKARFLALQGDMEQALENYDICTEMLQSSTAIQVEAGAERRDIVIRLPNLHNDSVVSLEEIDKNLKSLERCQSLEEIQRLYEAGDYKAVVHLLRPTLCTSGFDRAKHLEFMTSIPERPAQLLLLQDSLLRLKDYRQCFECSDVALNEAVQQMVNSGEAAAKEEWVATVTQLLMGIEQALSADSSGSILKVSSSTTGLVRLTNNLIQVIDCSMAVQEEAKEPHVSSVLPWIILHRIIWQEEDTFHSLCHQQQLQNPAEEGMSETPMLPSSLMLLNTAHEYLGRRSWCCNSDGALLRFYVRVLQKELAASTSEDTHPYKEELETALEQCFYCLYSFPSKKSKARYLEEHSAQQVDLIWEDALFMFEYFKPKTLPEFDSYKTSTVSADLANLLKRIATIVPRTERPALSLDKVSAYIEGTSTEVPCLPEGADPSPPVVNELYYLLADYHFKNKEQSKAIKFYMHDICICPNRFDSWAGMALARASRIQDKLNSNELKSDGPIWKHATPVLNCFRRALEIDSSNLSLWIEYGTMSYALHSFASRQLKQWRGELPPELVQQMEGRRDSMLETAKHCFTSAARCEGDGDEEEWLIHYMLGKVAEKQQQPPTVYLLHYRQAGHYLHEEAARYPKKIHYHNPPELAMEALEVYFRLHASILKLLGKPDSGVGAEVLVNFMKEAAEGPFARGEEKNTPKASEKEKACLVDEDSHSSAGTLPGPGASLPSSSGPGLTSPPYTATPIDHDYVKCKKPHQQATPDDRSQDSTAVALSDSSSTQDFFNEPTSLLEGSRKSYTEKRLPILSSQAGATGKDLQGATEERGKNEESLESTEGFRAAEQGVQKPAAETPASACIPGKPSASTPTLWDGKKRGDLPGEPVAFPQGLPAGAEEQRQFLTEQCIASFRLCLSRFPQHYKSLYRLAFLYTYSKTHRNLQWARDVLLGSSIPWQQLQHMPAQGLFCERNKTNFFNGIWRIPVDEIDRPGSFAWHMNRSIVLLLKVLAQLRDHSTLLKVSSMLQRTPDQGKKYLRDADRQVLAQRAFILTVKVLEDTLSELAEGSERPGPKVCGLPGARMTTDVSHKASPEDGPP

SEQ ID NO: 890725 - protein, 1144 aa, Homo sapiens
MIRIAALNASSTIEDDHEGSFKSHKTQTKEAQEAEAFALYHKALDLQKHDRFEESAKAYHELLEASLLREAVMLDSTDVNLWYKIGHVALRLIRIPLARHAFEEGLRCNPDHWPCLDNLITVLYTLSDYTTCLYFICKALEKDCRYSKGLVLKEKIFEEQPCLRKDSLRMFLKCDMSIHDVSVSAAETQAIVDEALGLRKKRQALIVREKEPDLKLVQPIPFFTWKCLGESLLAMYNHLTTCEPPRPSLGKRIDLSDYQDPSQPLESSMVVTPVNVIQPSTVSTNPAVAVAEPVVSYTSVATTSFPLHSPGLLETGAPVGDISGGDKSKKGVKRKKISEESGETAKRRSARVRNTKCKKEEKVDFQELLMKFLPSRLRKLDPEEEDDSFNNYEVQSEAKLESFPSIGPQRLSFDSATFMESEKQDVHEFLLENLTNGGILELMMRYLKAMGHKFLVRWPPGLAEVVLSVYHSWRRHSTSLPNPLLRDCSNKHIKDMMLMSLSCMELQLDQWLLTKGRSSAVSPRNCPAGMVNGRFGPDFPGTHCLGDLLQLSFASSQRDLFEDGWLEFVVRVYWLKARFLALQGDMEQALENYDICTEMLQSSTAIQVEAGAERRDIVIRLPNLHNDSVVSLEEIDKNLKSLERCQSLEEIQRLYEAGDYKAVVHLLRPTLCTSGFDRAKHLEFMTSIPERPAQLLLLQDSLLRLKDYRQCFECSDVALNEAVQQMVNSGEAAAKEEWVATVTQLLMGIEQALSADSSGSILKVSSSTTGLVRLTNNLIQVIDCSMAVQEEAKEPHVSSVLPWIILHRIIWQEEDTFHSLCHQQQLQNPAEEGMSETPMLPSSLMLLNTAHEYLGRRSWCCNSDGALLRFYVRVLQKELAASTSEDTHPYKEELETALEQCFYCLYSFPSKKSKARYLEEHSAQQVDLIWEDALFMFEYFKPKTLPEFDSYKTSTVSADLANLLKRIATIVPRTERPALSLDKVSAYIEGTSTEVPCLPEGADPSPPVVNELYYLLADYHFKNKEQSKAIKFYMHDICICPNRFDSWAGMALARASRIQDKLNSNELKSDGPIWKHATPVLNCFRRALEIDSSNLSLWIEYGTMSYALHSFASRQLKQWRGELPPELVQQWPQSWAGWGLKLLP

SEQ ID NO: 890726 - protein, 415 aa, Homo sapiens
MIRIAALNASSTIEDDHEGSFKSHKTQTKEAQEAEAFALYHKALDLQKHDRFEESAKAYHELLEASLLREAVMLDSTDVNLWYKIGHVALRLIRIPLARHAFEEGLRCNPDHWPCLDNLITVLYTLSDYTTCLYFICKALEKDCRYSKGLVLKEKIFEEQPCLRKDSLRMFLKCDMSIHDVSVSAAETQAIVDEALGLRKKRQALIVREKEPDLKLVQPIPFFTWKCLGESLLAMYNHLTTCEPPRPSLGKRIDLSDYQDPSQPLESSMVVTPVNVIQPSTVSTNPAVAVAEPVVSYTSVATTSFPLHSPGLLETGAPVGDISGGDKSKKGVKRKKISEESGETAKRRSARVRNTKCKKEEKVDFQELLMKFLPSRYCVFFLIVRNKPTKLQHTPSITFLIPLPPSSLVSSSVFP

SEQ ID NO: 890727 - protein, 115 aa, Homo sapiens
TLETDLINVGTVGRCSFFLVRYEHMKELTLERNPMNVNNVEKPLVVLVTFGYIKELTLGRKPYECKECGKAFIYPTSFQGHMRMHTGEKPYKCKECGKAFSLHSSFRETYKNSQL

SEQ ID NO: 890728 - protein, 115 aa, Homo sapiens; identical to SEQ ID NO: 890727

SEQ ID NO: 890729 - protein, 115 aa, Homo sapiens; identical to SEQ ID NO: 890727

SEQ ID NO: 890730 - protein, 115 aa, Homo sapiens; identical to SEQ ID NO: 890727

SEQ ID NO: 890731 - protein, 145 aa, Homo sapiens [sequence omitted]

SEQ ID NO: 890732 - protein, 145 aa, Homo sapiens [sequence omitted]

SEQ ID NO: 890733 - protein, 145 aa, Homo sapiens [sequence omitted]

SEQ ID NO: 890734 - protein, 145 aa, Homo sapiens [sequence omitted]

SEQ ID NO: 890735 - protein, 145 aa, Homo sapiens [sequence omitted]

SEQ ID NO: 890736 - protein, 145 aa, Homo sapiens [sequence omitted]

SEQ ID NO: 890737 - protein, 145 aa, Homo sapiens [sequence omitted]

SEQ ID NO: 890738 - protein, 130 aa, Homo sapiens
MWQKYAGSRRSMPLGARILFHGVFYAGGFAIVYYLIQKFHSRALYYKLAVEQLQSHPEAQEALGPPLNIHYLKLIDRENFVDIVDAKLKIPVSGSKSEGLLYVHSSRGGPFQRAQGWSADSCVQAQWGKR

SEQ ID NO: 890739 - protein, 145 aa, Homo sapiens [sequence omitted]

SEQ ID NO: 890740 - protein, 182 aa, Homo sapiens
MWQKYAGSRRSMPLGARILFHGVFYAGGFAIVYYLIQKFHSRALYYKLAVEQLQSHPEAQEALGPPLNIHYLKLIDRENFVDIVDAKLKIPVSGSKSEGLLYVHSSRGGPFQRWHLDEVFLELKDGQQIPVFKLSGENGDEVIISTIWPLGWWPISVTDTPATQFSSHQWDDGMCQHMVILV

SEQ ID NO: 890741 - protein, 145 aa, Homo sapiens [sequence omitted]

SEQ ID NO: 890742 - protein, 214 aa, Homo sapiens
LVIDVGAWIRLPIIETAQGGNLNVTDTESMMVLACQLSGFLIKHGCPNADSRISELLRPSQDFQESCAMMWQKYAGSRRSMPLGARILFHGVFYAGGFAIVYYLIQKFHSRALYYKLAVEQLQSHPEAQEALGPPLNIHYLKLIDRENFVDIVDAKLKIPVSGSKSEGLLYVHSSRGGPFQRWHLDEVFLELKDGQQIPVFKLSGENGDEVKKE

SEQ ID NO: 890743 - protein, 145 aa, Homo sapiens [sequence omitted]

SEQ ID NO: 890744 - protein, 145 aa, Homo sapiens [sequence omitted]

SEQ ID NO: 890745 - protein, 145 aa, Homo sapiens [sequence omitted]

SEQ ID NO: 890746 - protein, 114 aa, Homo sapiens
MWQKYAGSRRSMPLGARILFHGVFYAGGFAIVYYLIQKFHSRALYYKLAVEQLQSHPEAQEALGPPLNIHYLKLIDRENFVDIVDAKECAFPANRRLVPAEGEESLLSPGKSWS

SEQ ID NO: 890747 - protein, 145 aa, Homo sapiens [sequence omitted]

SEQ ID NO: 890748 - protein, 145 aa, Homo sapiens [sequence omitted]

SEQ ID NO: 890749 - protein, 68 aa, Homo sapiens
TGDRRFYWMLMGVGKVPRSMGAESVSKVRKASAIFWKPLRHESQVEEEANAQAEAQKKKDEAEVQVNR

SEQ ID NO: 890750 - protein, 68 aa, Homo sapiens; identical to SEQ ID NO: 890749

SEQ ID NO: 890751 - protein, 68 aa, Homo sapiens; identical to SEQ ID NO: 890749

SEQ ID NO: 890752 - protein, 68 aa, Homo sapiens; identical to SEQ ID NO: 890749

SEQ ID NO: 890753 - protein, 68 aa, Homo sapiens; identical to SEQ ID NO: 890749

SEQ ID NO: 890754 - protein, 258 aa, Homo sapiens
MPPQQGDPAFPDRCEAPPVPPRRERGGRGGRGPGEPGGRGRAGGAEGRGVKCVLVGDGAVGKTSLVVSYTTNGYPTEYIPTAFDNFSAVVSVDGRPVRLQLCDTAGQDEFDKLRPLCYTNTDIFLLCFSVVSPSSFQNVSEKWVPEIRCHCPKAPIILVGTQSDLREDVKVLIELDKCKEKPVPEEAAKLCAEEIKAASYIECSALTQKNLKEVFDAAIVAGIQYSDTQQQPKKSKSRTPDKMKNLSKSWWKKYCCFV

SEQ ID NO: 890755 - protein, 258 aa, Homo sapiens; identical to SEQ ID NO: 890754

SEQ ID NO: 890756 - protein, 168 aa, Homo sapiens
GPLSSNSAGQSGWRRRSAEPRPSLAAFVYWPCGPEPPLSRAGDAPAAVGDSSSLPQPSGAEGRSGRALLARDRKPALRGSMPPQQGDPAFPDRCEAPPVPPRRERGGRGGRGPGEPGGRGRAGGAEGRGVKCVLVGDGAVGKTSLVVSYTTNGYPTEYIPTAFDNFSG

SEQ ID NO: 890757 - protein, 258 aa, Homo sapiens; identical to SEQ ID NO: 890754

SEQ ID NO: 890758 - protein, 258 aa, Homo sapiens; identical to SEQ ID NO: 890754

SEQ ID NO: 890759 - protein, 258 aa, Homo sapiens; identical to SEQ ID NO: 890754

SEQ ID NO: 890760 - protein, 258 aa, Homo sapiens; identical to SEQ ID NO: 890754

SEQ ID NO: 890761 - protein, 258 aa, Homo sapiens; identical to SEQ ID NO: 890754

SEQ ID NO: 890762 - protein, 567 aa, Homo sapiens
QKASRQEEPDSLSYYCAAETNGVGAASGTPPSKATLEGKVASPKHCVLARPKGTPPLPPVRKSSLDQKNRASPQHSASGSGTSSPLNQPAAFPAGLPDEPSGKTKDASSSSKLFSAKLEQLASRSNSLGRATVSHYECLSPERAESLSSVSSRLHAGKDGTMPRAGRSLGRSAGTSPPSSGASPKAGQSKISAVSRLLLASPRARGPSASTTKTLSFSTKSLPQAVGQGSSSPPGGKHTPWSTQSLSRNRSSGLASKLPLRAVSGRISELLQGGAGARGLQLRAGPEAEARGGALAEDEPAAAHLLPSPYSKITPPRRPHRCSSGHGSDNSSVLSGELPPAMGKTALFYHSGGSSGYESVMRDSEATGSASSAQDSTSENSSSVGGRCRSLKTPKKRSNPGSQRRRLIPALSLDTSSPVRKPPNSTGVRWVDGPLRSSPRGLGEPFEIKVYEIDDVERLQRRRGGASKEAMCFNAKLKILEHRQQRIAEVRAKYEWLMKELEATKQYLMLDPNKWLSEFDLEQVWELDSLEYLEALECVTERLESRVNFCKAHLMMITCFDITSRRR

SEQ ID NO: 890763 - protein, 437 aa, Homo sapiens
MQLPRWWELGDPCAWTGQGRGTRRMSPATTGTFLLTVYSIFSKVHSDRNVYPSAGVLFVHVLEREYFKGEFPPYPKPGEISNDPITFNTNLMGYPDRPGWLRYIQRTPYSDGVLYGSPTAENVGKPTIIEITAYNRRTFETARHNLIINIMSAEDFPLPYQAEFFIKNMNVEEMLASEVLGDFLGAVKNVWQPERLNAINITSALDRGGRVPLPINDLKEGVYVMVGADVPFSSCLREVENPQNQLRCSQEMEPVITCDKKFRTQFYIDWCKISLVDKTKQVSTYQEVIRGEGILPDGGEYKPPSDSLKSRDYYTDFLITLAVPSAVALVLFLILAYIMCCRREGVEKRNMQTPDIQLVHHSAIQKSTKELRDMSKNREIAWPLSTLPVFHPVTGEIIPPLHTDNYDSTNMPLMQTQQNLPHQTQIPQQQTTGKWYP

SEQ ID NO: 890764 - protein, 239 aa, Homo sapiens
SRLEIPSVYLSRVHVPHYDLKEGVYVMVGADVPFSSCLREVENPQNQLRCSQEMEPVITCDKKFRTQFYIDWCKISLVDKTKQVSTYQEVIRGEGILPDGGEYKPPSDSLKSRDYYTDFLITLAVPSAVALVLFLILAYIMCCRREGVEKRNMQTPDIQLVHHSAIQKSTKELRDMSKNREIAWPLSTLPVFHPVTGEIIPPLHTDNYDSTNMPLMQTQQNLPHQTQIPQQQTTGKWYP

SEQ ID NO: 890765 - protein, 437 aa, Homo sapiens; identical to SEQ ID NO: 890763

SEQ ID NO: 890766 - protein, 462 aa, Homo sapiens
MQLPRWWELGDPCAWTGQGRGTRRMSPATTGTFLLTVYSIFSKVHSDRNVYPSAGVLFVHVLEREYFKGEFPPYPKPGEISNDPITFNTNLMGYPDRPGWLRYIQRTPYSDGVLYGSPTAENVGKPTIIEITAYNRRTFETARHNLIINIMSAEDFPLPYQAEFFIKNMNVEEMLASEVLGDFLGAVKNVWQPERLNAINITSALDRGGRVPLPINDLKEGVYVMVGADVPFSSCLREVENPQNQLRCSQEMEPVITCDKKFRTQFYIDWCKISLVDKTKQVSTYQEVIRGEGILPDGGEYKPPSDSLKSRDYYTDFLITLAVPSAVALVLFLILAYIMCCRREGVEKRNMQTPDIQLVHHSAIQKSTKELRDMSKNREIAWPLSTLPVFHPVTGEIIPPLHTDNYDSTNMPLMQTQQWSFAPVAQAGVQWSDLGSLQPPPPRNLPHQTQIPQQQTTGKWYP

SEQ ID NO: 890767 - protein, 460 aa, Homo sapiens
MQLPRWWELGDPCAWTGQGRGTRRMSPATTGTFLLTVYSIFSKVHSDRNVYPSAGVLFVHVLEREYFKGEFPPYPKPGEISNDPITFNTNLMGYPDRPGWLRYIQRTPYSDGVLYGSPTAENVGKPTIIEITAYNRRTFETARHNLIINIMSAEDFPLPYQAEFFIKNMNVEEMLASEVLGDFLGAVKNVWQPERLNAINITSALDRGGRVPLPINDLKEGVYVMVGADVPFSSCLREVENPQNQLRCSQEMEPVITCDKKFRTQFYIDWCKISLVDKTKQVSTYQEVIRGEGILPDGGEYKPPSDSLKSRDYYTDFLITLAVPSAVALVLFLILAYIMCCRREGVEKRNMQTPDIQLVHHSAIQKSTKELRDMSKNREIAWPLSTLPVFHPVTGEIIPPLHTDNYDSTNMPLMQTQQNLPHQTQIPQQQTTGDFRLTTFQRFEVNGIPEERKLTEAMNL

SEQ ID NO: 890768 - protein, 346 aa, Homo sapiens
MQLPRWWELGDPCAWTGQGRGTRRMSPATTGTFLLTVYSIFSKVHSDRNVYPSAGVLFVHVLEREYFKGEFPPYPKPGEISNDPITFNTNLMGYPDRPGWLRYIQRTPYSDGVLYGSPTAENVGKPTIIEITAYNRRTFETARHNLIINIMSAEDFPLPYQAEFFIKNMNVEEMLASEVLGDFLGAVKNVWQPERLNAINITSALDRGGRVPLPINDLKEGVYVMVGADVPFSSCLREVENPQNQLRCSQEMEPVITCDKKFRTQFYIDWCKISLVDKTKQVSTYQEVIRGEGILPDGGEYKPPSDSLKSRDYYTDFLITLAVPSAVALVLFLILAYIMCCRREGV

SEQ ID NO: 890769 - protein, 408 aa, Homo sapiens
MAAGMKDVYSIFSKVHSDRNVYPSAGVLFVHVLEREYFKGEFPPYPKPGEISNDPITFNTNLMGYPDRPGWLRYIQRTPYSDGVLYGSPTAENVGKPTIIEITAYNRRTFETARHNLIINIMSAEDFPLPYQAEFFIKNMNVEEMLASEVLGDFLGAVKNVWQPERLNAINITSALDRGGRVPLPINDLKEGVYVMVGADVPFSSCLREVENPQNQLRCSQEMEPVITCDKKFRTQFYIDWCKISLVDKTKQVSTYQEVIRGEGILPDGGEYKPPSDSLKSRDYYTDFLITLAVPSAVALVLFLILAYIMCCRREGVEKRNMQTPDIQLVHHSAIQKSTKELRDMSKNREIAWPLSTLPVFHPVTGEIIPPLHTDNYDSTNMPLMQTQQNLPHQTQIPQQQTTGKWYP

SEQ ID NO: 890770 - protein, 437 aa, Homo sapiens; identical to SEQ ID NO: 890763

SEQ ID NO: 890771 - protein, 428 aa, Homo sapiens
MQLPRWWELGDPCAWTGQGRGTRRMSPATTGTFLLTVYSIFSKVHSDRNVYPSAGVLFVHVLEREYFKGEFPPYPKPGEISNDPITFNTNLMGYPDRPGWLRYIQRTPYSDGVLYGSPTAENVGKPTIIEITAYNRRTFETARHNLIINIMSAEDFPLPYQAEFFIKNMNVEEMLASEVLGDFLGAVKNVWQPERLNAINITSALDRGGRVPLPINDLKEGVYVMVGADVPFSSCLREVENPQNQLRCSQEMEPVITCDKKFRTQFYIDWCKISLVDKTKQVSTYQEVIRGEGILPDGGEYKPPSDSLKSRDYYTDFLITLAVPSAVALVLFLILAYIMCCRREGVIQLVHHSAIQKSTKELRDMSKNREIAWPLSTLPVFHPVTGEIIPPLHTDNYDSTNMPLMQTQQNLPHQTQIPQQQTTGKWYP

SEQ ID NO: 890772 - protein, 355 aa, Homo sapiens
MQLPRWWELGDPCAWTGQGRGTRRMSPATTGTFLLTVYSIFSKVHSDRNVYPSAGVLFVHVLEREYFKGEFPPYPKPGEISNDPITFNTNLMGYPDRPGWLRYIQRTPYSDGVLYGSPTAENVGKPTIIEITAYNRRTFETARHNLIINIMSAEDFPLPYQAEFFIKNMNVEEMLASEVLGDFLGAVKNVWQPERLNAINITSALDRGGRVPLPINDLKEGVYVMVGADVPFSSCLREVENPQNQLRCSQEMEPVITCDKKFRTQFYIDWCKISLVDKTKQVSTYQEVIRGEGILPDGGEYKPPSDSLKSRDYYTDFLITLAVPSAVALVLFLILAYIMCCRREGVEKRNMQTPE

SEQ ID NO: 890773 - protein, 347 aa, Homo sapiens
MQLPRWWELGDPCAWTGQGRGTRRMSPATTGTFLLTVYSIFSKVHSDRNVYPSAGVLFVHVLEREYFKGEFPPYPKPGEISNDPITFNTNLMGYPDRPGWLRYIQRTPYSDGVLYGSPTAENVGKPTIIEITAYNRRTFETARHNLIINIMSAEDFPLPYQAEFFIKNMNVEEMLASEVLGDFLGAVKNVWQPERLNAINITSALDRGGRVPLPINDLKEGVYVMVGADVPFSSCLREVENPQNQLRCSQEMEPVITCDKKFRTQFYIDWCKISLVDKTKQVSTYQEVIRGEGILPDGGEYKPPSDSLKSRDYYTDFLITLAVPSGGGGGGGKRAGAGAGRGGGGGG

SEQ ID NO: 890774 - protein, 1290 aa, Homo sapiens
EWSPCSKTCHDMVSPAGTRVRTRTIRQFPIGSEKECPEFEEKEPCLSQGDGVVPCATYGWRTTEWTECRVDPLLSQQDKRRGNQTALCGGGIQTREVYCVQANENLLSQLSTHKNKEASKPMDLKLCTGPIPNTTQLCHIPCPTECEVSPWSAWGPCTYENCNDQQGKKGFKLRKRRITNEPTGGSGVTGNCPHLLEAIPCEEPACYDWKAVRLGDCEPDNGKECGPGTQVQEVVCINSDGEEVDRQLCRDAIFPIPVACDAPCPKDCVLSTWSTWSSCSHTCSGKTTEGKQIRARSILAYAGEEGGIRCPNSSALQEVRSCNEHPCTVYHWQTGPWGQCIEDTSVSSFNTTTTWNGEASCSVGMQTRKVICVRVNVGQVGPKKCPESLRPETVRPCLLPCKKDCIVTPYSDWTSCPSSCKEGDSSIRKQSRHRVIIQLPANGGRDCTDPLYEEKACEAPQACQSYRWKTHKWRRCQLVPWSVQQDSPGAQEGCGPGRQARAITCRKQDGGQAGIHECLQYAGPVPALTQACQIPCQDDCQLTSWSKFSSCNGDCGAVRTRKRTLVGKSKKKEKCKNSHLYPLIETQYCPCDKYNAQPVGNWSDCILPEGKVEVLLGMKVQGDIKECGQGYRYQAMACYDQNGRLVETSRCNSHGYIEEACIIPCPSDCKLSEWSNWSRCSKSCGSGVKVRSKWLREKPYNGGRPCPKLDHVNQAQVYEVVPCHSDCNQYLWVTEPWSICKVTFVNMRENCGEGVQTRKVRCMQNTADGPSEHVEDYLCDPEEMPLGSRVCKLPCPEDCVISEWGPWTQCVLPCNQSSFRQRSADPIRQPADEGRSCPNAVEKEPCNLNKNCYHYDYNVTDWSTCQLSEKAVCGNGIKTRMLDCVRSDGKSVDLKYCEALGLEKNWQMNTSCMVECPVNCQLSDWSPWSECSQTCGLTGKMIRRRTVTQPFQGDGRPCPSLMDQSKPCPVKPCYRWQYGQWSPCQVQEAQCGEGTRTRNISCVVSDGSADDFSKVVDEEFCADIELIIDGNKNMVLEESCSQPCPGDCYLKDWSSWSLCQLTCVNGEDLGFGGIQVRSRPVIIQELENQHLCPEQMLETKSCYDGQCYEYKWMASAWKGSSRTVWCQRSDGINVTGGCLVMSQPDADRSCNPPCSQPHSYCSETKTCHCEEGYTEVMSSNSTLEQCTLIPVVVLPTMEDKRGDVKTSRAVHPTQPSSNPAGRGRTWFLQPFGPDGRLKTWVYGVAAGAFVLLIFIVSMIYLACKKPKKPQRRQNNRLKPLTLAYDGDADM

SEQ ID NO: 890775 - protein, 81 aa, Homo sapiens
GQLDSTEEVDSTEDGGQHRGGGQHRGGGQQEQEEWKKARRLSKQGRQCLPPQWPYQRGYRFLPATWIPEVALVSAPSKPSS

SEQ ID NO: 890776 - protein, 677 aa, Homo sapiens
MSKSRKSGRKPEDSANKVDSVYHHSGHTKEATDSFLLPGSLKLPWSLHLLNLVLKSFPLHELSQSPPINSQCKLLLLVDKKILTDLPYKCYCQDNMRTHNSKWSLSVSYGYFAQGSMASWCRLMGLKPSSLIFQASVLPIPLNYLSGLFFEILTLQVHRTTFTWENKNKGCSAFFRNFFEKGDGNACTPKSRPTQWLIEMNNKGKTVLGFPEYLVLKLWHKQPPVRASLLPGRGVETRGRVCSLALKAEGDNLEAVQTPWPLELACLFEDAGSDANRRPSGKLLNLTCLSFLIWKMRTLGLGLLEKLNELRQVPGTQSLLCVFIIMSSAGRRSSFSGVRLALIIWSGLGFLGWTPCCIFLIHPPGLNWGIKESMCNCIITVATLNDHLLVVPGTAYTYVHQINPMKYILSSFYRSETIGVQRADVIFPGSQRVPDSGINSCIPRHNHYMSKGCPEPPGTANCDISLKRLSTWSGSDGCQCVQMQSWSGGGEGGLLGTEKAFCAFSEGSSLRTKGTRQTAPQVLQALLAGEGCGNGKLVPTAMSQPRLNRERRMLDRNLHPHVTFLQCDPSGPSPPDSGTMTAPIGEAGGRISPVLGKLFTMTVKALCLLPRPVTFYPGLTLGKLKVEVQDYASPPGYQADSYIFQLTLINEEGLVSLSWFQMKPGSRGVRKLQQDGT

SEQ ID NO: 890777 - protein, 356 aa, Homo sapiens
RVRAEKAVAAAAAAAETLKSESGLRVRGLLIRILVLSVSVCEWTVPDAMTLNGGGSGAGGSRGGGQERERRRGSTPWGPAPPLHRRSMPVDERDLQAALTPGALTAAAAGTGTQGPRLDWPEDSEDSLSSGGSDSDESVYKVLLLGAPGVGKSALARIFGGVEDGPEAEAAGHTYDRSIVVDGEEASLMVYDIWEQDGGRWLPGHCMAMGDAYVIVYSVTDKGSFEKASELRVQLRRARQTDDVPIILVGNKSDLVRSREVSVDEGRACAVVFDCKFIETSAALHHNVQALFEGVVRQIRLRRDSKEANARRQAGTRRRESLGKKAKRFLGRIVARNSRKMAFRAKSKSCHDLSVL

SEQ ID NO: 890778 - protein, 328 aa, Homo sapiens
SYASKQPQRLAQPTAPGASEQAQTLGPSELPAGHPQPHGHGQIDSAALRSGSQGPVRASPPALPFVSHHSGSGWDLRMTRVGRAHGLGFGSDRPSCALFRATMLAHAALRLFARLSRLRGACLPPAALASLLSLRRRFWRTTPSISAWHRCGATAADVSVTLRQRTTARGPALAPPRTVTRAPQVAACCHEADGPSSVCAPAAPGPAVLRLSSLPCRPDLHECAMASPWPAVAVHLRPPVLLRACPDSRDAPPPAFHARSSGLVACVGPVSALRAAGRLLSGAHPALLRRVAPHDAVARPVARPSSLSSARRHRAPRPPRAAPLSRRA

SEQ ID NO: 890779 - protein, 356 aa, Homo sapiens; identical to SEQ ID NO: 890777

SEQ ID NO: 890780 - protein, 356 aa, Homo sapiens; identical to SEQ ID NO: 890777

SEQ ID NO: 890781 - protein, 324 aa, Homo sapiens
RVRAEKAVAAAAAAAETLKSESGLRVRGLLIRILVLSVSVCEWIGPGHRCTLNGGEQSDVGRGMPLVVGLGRAEALSGGERLQTMIVYIGLLLSGGLPGVVEEVCPGRAIFRAVCGGLGPVSLDGCLVAAPMHRLHLYVGPEDRGNHYIVSTNILWKHGLVLLAWYAPCQVELAIGGDSPYVIVYSVTDKGSFEKASELRVQLRRARQTDDVPIILVGNKSDLVRSREVSVDEGRACAVVFDCKFIETSAALHHNVQALFEGVVRQIRLRRDSKEANARRQAGTRRRESLGKKAKRFLGRIVARNSRKMAFRAKSKSCHDLSVL

SEQ ID NO: 890782 - protein, 170 aa, Homo sapiens
RVRAEKAVAAAAAAAETLKSESGLRVRGLLIRILVLSVSVCEWTVPDAMTLNGGGSGAGGSRGGGQERERRRGSTPWGPAPPLHRRSMPVDERDLQAALTPGALTAAAAGTGTQGPRLDWPEDSEDSLSSGGSDSDESVYKVLLLGAPGVGKSAMAFRAKSKSCHDLSVL

SEQ ID NO: 890783 - protein, 272 aa, Homo sapiens
RVRAEKAVAAAAAAAETLKSESGLRVRGLLIRILVLSVSVCEWTVPDAMTLNGGGSGAGGSRGGGQERERRRGSTPWGPAPPLHRRSMPVDERDLQAALTPGALTAAAAGTGTQGPRLDWPEDSEDSLSSGGSDSDESVYKVLLLGAPGVGKSALARIFGGVEDGPEAEAAGHTYDRSIVVDGEEASLMVYDIWEQDGGRWLPGHCMAMGDAYVIVYSVTDKGRGPQRCMRRLICVPSSRSAAAGQACVPGEDSAFFHSPGVPALEGGSSVR

SEQ ID NO: 890784 - protein, 208 aa, Homo sapiens
RVRAEKAVAAAAAAAETLKSESGLRVRGLLIRILVLSVSVCEWTVPDAMTLNGGGSGAGGSRGGGQERERRRGSTPWGPAPPLHRRSMPVDERDLQAALTPGALTAAAAGTGTQGPRLDWPEDSEDSLSSGGSDSDESVYKVLLLGAPGVGKSALARIFGGVEDGPEAEAAGHTYDRSIVVDGEEASLPCSAGQPAAPVLLPNVVDHE

SEQ ID NO: 890785 - protein, 112 aa, Homo sapiens
MQALCLLGDAAVPSTLSTGAGVSVFSGRTLQILEWQLPWVATVGGDSSFTHPLFTGACLSPPTQGPQRCMRRLICVPSSRSAAAGQACVPGEDSAFFHSPGVPALEGGSSVR

SEQ ID NO: 890786 - protein, 398 aa, Homo sapiens
RVRAEKAVAAAAAAAETLKSESGLRVRGLLIRILVLSVSVCEWTVPDAMTLNGGGSGAGGSRGGGQERERRRGSTPWGPAPPLHRRSMPVDERDLQAALTPGALTAAAAGTGTQGPRLDWPEDSEDSLSSGGSDSDESVYKVLLLGAPGVGKSALARIFGGVEDGPEAEAAGHTYDRSIVVDGEEASLMVYDIWEQVGCKQRPRAGEGGVSWVRGLGVPGSCRGHEDCWADVCCVFFQDGGRWLPGHCMAMGDAYVIVYSVTDKGSFEKASELRVQLRRARQTDDVPIILVGNKSDLVRSREVSVDEGRACAVVFDCKFIETSAALHHNVQALFEGVVRQIRLRRDSKEANARRQAGTRRRESLGKKAKRFLGRIVARNSRKMAFRAKSKSCHDLSVL

SEQ ID NO: 890787 - protein, 1014 aa, Homo sapiens
RSMPASAPPRRPRPPPPSLSLLLVLLGLGGRRLRAEPGDGAQTWARVSRPPAPEAAGLFQGTFPDGFLWAVGSAAYQTEGGWQQHGKGASIWDTFTHHPLAPPGDSRNASLPLGAPSPLQPATGDVASDSYNNVFRDTEALRELGVTHYRFSISWARVLPNGSAGVPNREGLRYYRRLLERLRELGVQPVVTLYHWDLPQRLQDAYGGWANRALADHFRDYAELCFRHFGGQVKYWITIDNPYVVAWHGYATGRLAPGIRGSPRLGYLVAHNLLLAHAKVWHLYNTSFRPTQGGQVSIALSSHWINPRRMTDHSIKECQKSLDFVLGWFAKPVFIDGDYPESMKNNLSSILPDFTESEKKFIKGTADFFALCFGPTLSFQLLDPHMKFRQLESPNLRQLLSWIDLEFNHPQIFIVENGWFVSGTTKRDDAKYMYYLKKFIMETLKAIKLDGVDVIGYTAWSLMDGFEWHRGYSIRRGLFYVDFLSQDKMLLPKSSALFYQKLIEKNGFPPLPENQPLEGTFPCDFAWGVVDNYIQVDTTLSQFTDLNVYLWDVHHSKRLIKVDGVVTKKRKSYCVDFAAIQPQIALLQEMHVTHFRFSLDWALILPLGNQSQVNHTILQYYRCMASELVRVNITPVVALWQPMAPNQGLPRLLARQGAWENPYTALAFAEYARLCFQELGHHVKLWITMNEPYTRNMTYSAGHNLLKAHALAWHVYNEKFRHAQNGKISIALQADWIEPACPFSQKDKEVAERVLEFDIGWLAEPIFGSGDYPWVMRDWLNQRNNFLLPYFTEDEKKLIQGTFDFLALSHYTTILVDSEKEDPIKYNDYLEVQEMTDITWLNSPSQVAVVPWGLRKVLNWLKFKYGDLPMYIISNGIDDGLHAEDDQLRVYYMQNYINEALKAHILDGINLCGYFAYSFNDRTAPRFGLYRYAADQFEPKASMKHYRKIIDSNGFPGPETLERFCPEEFTVCTECSFFHTRKSLLAFIAFLFFASIISLSLIFYYSKKGRRSYK

SEQ ID NO: 890788 - protein, 1014 aa, Homo sapiens; identical to SEQ ID NO: 890787

SEQ ID NO: 890789 - protein, 366 aa, Homo sapiens
FLFLLELSYKTTGLNREPTVSLNSKSGTPMDQNEHSHWGPHAKGQCASRSELRIILVGKTGTGKSAAGNSILRKQAFESKLGSQTLTKTCSKSQGSWGNREIVIIDTPDMFSWKDHCEALYKEVQRCYLLSAPGPHVLLLVTQLGRYTSQDQQAAQRVKEIFGEDAMGHTIVLFTHKEDLNGGSLMDYMHDSDNKALSKLVAACGGRICAFNNRAEGSNQDDQVKELMDCIEDLLMEKNGDHYTNGLYSLIQRSKCGPVGSDERVKEFKQSLIKYMETQRSYTALAEANCLKGALIKTQLCVLFCIQLFLRLIILWLCILHSMCNLFCCLLFSMCNLFCSLLFIIPKKLMIFLRTVIRLERKTPRL

SEQ ID NO: 890790 - protein, 366 aa, Homo sapiens; identical to SEQ ID NO: 890789

SEQ ID NO: 890791 - protein, 72 aa, Homo sapiens
FLFLLELSYKTTGLNREPTVSLNSKSGTPMDQNEHSHWGERKVKRAIWLPLSKLQRGVSGAAWLLFSEYRNV

SEQ ID NO: 890792 - protein, 405 aa, Homo sapiens
NITIRHDARAQEDKRTVVHRLYSTEISVSMSIRVLSIIDLDKRNGPVFIWTFIDQRYHACEIIEVYTYHVRIVVNQSSSQRRNLGYQIMTLEIILVGKTGTGKSAAGNSILRKQAFESKLGSQTLTKTCSKSQGSWGNREIVIIDTPDMFSWKDHCEALYKEVQRCYLLSAPGPHVLLLVTQLGRYTSQDQQAAQRVKEIFGEDAMGHTIVLFTHKEDLNGGSLMDYMHDSDNKALSKLVAACGGRICAFNNRAEGSNQDDQVKELMDCIEDLLMEKNGDHYTNGLYSLIQRSKCGPVGSDERVKEFKQSLIKYMETQRSYTALAEANCLKGALIKTQLCVLFCIQLFLRLIILWLCILHSMCNLFCCLLFSMCNLFCSLLFIIPKKLMIFLRTVIRLERKTPRL

SEQ ID NO: 890793 - protein, 318 aa, Homo sapiens
METRYNLKSPAVKRLMKEAAELKDPTDHYHAQPLEDNLFEWHFTVRGPPDSDFDGGVYHGRIVLPPEYPMKPPSIILLTANGRFEVGKKICLSISGHHPETWQPSWSIRTALLAIIGFMPTKGEGAIGSLDYTPEERRALAKKSQDFCCEGCGSAMKDVLLPLKSGSDSSQADQEAKELARQISFKAEVNSSGKTISESDLNHSFSLTDLQDDIPTTFQGATASTSYGLQNSSAASFHQPTQPVAKNTSMSPRQRRAQQQSQRRLSTSPDVIQGHQPRDNHTDHGGSAVLIVILTLALAALIFRRIYLANEYIFDFEL

SEQ ID NO: 890794 - protein, 318 aa, Homo sapiens; identical to SEQ ID NO: 890793

SEQ ID NO: 890795 - protein, 318 aa, Homo sapiens; identical to SEQ ID NO: 890793

SEQ ID NO: 890796 - protein, 318 aa, Homo sapiens; identical to SEQ ID NO: 890793

SEQ ID NO: 890797 - protein, 401 aa, Homo sapiens
RPRQGWACDYPRRLTSSPGARFSAAPAGAGACQALREAGAQWRRRRHREASASPALSLATPGSGRVERRWQRPGRPEPSQRPTMETRYNLKSPAVKRLMKEAAELKDPTDHYHAQPLEDNLFEWHFTVRGPPDSDFDGGVYHGRIVLPPEYPMKPPSIILLTANGRFEVGKKICLSISGHHPETWQPSWSIRTALLAIIGFMPTKGEGAIGSLDYTPEERRALAKKSQDFCCEGCGSAMKDVLLPLKSGSDSSQADQEAKELARQISFKAEVNSSGKTISESDLNHSFSLTDLQDDIPTTFQGATASTSYGLQNSSAASFHQPTQPVAKNTSMSPRQRRAQQQSQRRLSTSPDVIQGHQPRDNHTDHGGSAVLIVILTLALAALIFRRIYLANEYIFDFEL

SEQ ID NO: 890798 - protein, 235 aa, Homo sapiens
METRYNLKSPAVKRLMKEAAELKDPTDHYHAQPLEDNLFEWHFTVRGPPDSDFDGGVYHGRIVLPPEYPMKPPSIILLTANGRFEVGKKICLSISGHHPETWQPSWSIRTALLAIIGFMPTKGEGAIGSLDYTPEERRALAKKSQDFCCEGCGSAMKDVLLPLKSGSDSSQADQEAKELARQISFKAEVNSSGKTISESDLNHSFSLTDLQDDIPTTFQGATASTSFQTKFLKIS

SEQ ID NO: 890799 - protein, 249 aa, Homo sapiens [sequence omitted]

SEQ ID NO: 890800 - protein, 343 aa, Homo sapiens
EPRMLHLENFKETTNHLLSRAIHHPEVLMYLWFPKAVKRLMKEAAELKDPTDHYHAQPLEDNLFEWHFTVRGPPDSDFDGGVYHGRIVLPPEYPMKPPSIILLTANGRFEVGKKICLSISGHHPETWQPSWSIRTALLAIIGFMPTKGEGAIGSLDYTPEERRALAKKSQDFCCEGCGSAMKDVLLPLKSGSDSSQADQEAKELARQISFKAEVNSSGKTISESDLNHSFSLTDLQDDIPTTFQGATASTSYGLQNSSAASFHQPTQPVAKNTSMSPRQRRAQQQSQRRLSTSPDVIQGHQPRDNHTDHGGSAVLIVILTLALAALIFRRIYLANEYIFDFEL

SEQ ID NO: 890801 - protein, 110 aa, Homo sapiens
METRYNLKSPAVKRLMKEAAELKDPTDHYHAQPLEDNLFEWHFTVRGPPDSDFDGGVYHGRIVLPPEYPMKPPSIILLTANGRFEVGKKICLSISGHHPETWQPSWSSKC

SEQ ID NO: 890802 - protein, 96 aa, Homo sapiens
TSREENNAWWFHGILWWQYYPPVINSSMSPRQRRAQQQSQRRLSTSPDVIQGHQPRDNHTDHGGSAVLIVILTLALAALIFRRIYLANEYIFDFEL

SEQ ID NO: 890803 - protein, 278 aa, Homo sapiens
METRYNLKSPAVKRLMKEAAELKDPTDHYHAQPLEDNLFEWHFTVRGPPDSDFDGGVYHGRIVLPPEYPMKPPSIILLTANGRFEVGKKICLSISGHHPETWQPSWSIRTALLAIIGFMPTKGEGAIGSLDYTPEERRALAKKSQDFCCEGCGSAMKDVLLPLKSGSDSSQADQEAKELARQISFKYGLQNSSAASFHQPTQPVAKNTSMSPRQRRAQQQSQRRLSTSPDVIQGHQPRDNHTDHGGSAVLIVILTLALAALIFRRIYLANEYIFDFEL

SEQ ID NO: 890804 - protein, 143 aa, Homo sapiens
METRYNLKSPAVKRLMKEAAELKDPTDHYHAQPLEDNLFEWHFTVRGPPDSDFDGGVYHGRIVLPPEYPMKPPSIILLTANGRFEVGKKICLSISGHHPETWQPSWSIRTALLAIIGFMPTKGEGAIGSLDYTPEERRALAKK

SEQ ID NO: 890805 - protein, 110 aa, Homo sapiens; identical to SEQ ID NO: 890801

SEQ ID NO: 890806 - protein, 559 aa, Homo sapiens
LSGPRGARAAAATRRREEEEAAGVQEAGQRMEEEAMNGDRTESDWQGLVSEYLVCKRKLESKKEALLILSKELDTCQQERDQYKLMANQLRERHQSLKKKYRELIDGDPSLPPEKRKQANLAQLLRDSQDRNKHLGEEIKELQQRLGEVQGDNKLLRMTIAKQRLGDEAIGVRHFAAHEREDLVQQLERAKEQIESLEHDLQASVDELQDVKEERSSYQDKVERLNQELNHILSGHENRIIDVDALCMENRYLQERLKQLHEEVNLLKSNIAKYKNALERRKNSKGQGKSSSSALTGVLSAKQVQDLLSEDHGCSLPATPQSISDLKSLATALLETIHEKNMVIQHQRQTNKILGNRVAELEKKLRTLEVSGLWSLPGGKDTILFSDPTLPSGQRSRSPLLKFVEQPTENKADPKDGEAQKQEEDESCAAAEALTAPEDAGRPAVNSPANQSRGNQCKLFHPSLPQLPSEEEVNSLGREIIKLTKEQAAAELEEVRRESPIEGQRSETGPAPPGLAIQGELPKSHLDSFEASRPAAKASTPEDGKGIPEGGGMRSTVKT

SEQ ID NO: 890807 - protein, 171 aa, Homo sapiens
LSGPRGARAAAATRRREEEEAAGVQEAGQRMEEEAMNGDRTESDWQGLVSEYLVCKRKLESKKEALLILSKELDTCQQERDQYKLMANQLRERHQSLKKKYRELIDGDPSLPPEKRKQANLAQLLRDSQDRNKHLGEEIKELQQRLGEVQGDNKGRLRSKKKMKVVPLLRR

SEQ ID NO: 890808 - protein, 559 aa, Homo sapiens; identical to SEQ ID NO: 890806

SEQ ID NO: 890809 - protein, 319 aa, Homo sapiens
MDVDALCMEKRYLQERLKQLHEEVNLLKSNIAKYKNALERRKNSKGQGKSSSSALTGVLSAKQVQDLLSEDHGCSLPATPQSISDLKSLATALLETIHEKNMVIQHQRQTNKILGNRVAELEKKLRTLEVSGLWSLPGGKDTILFSDPTLPSGQRSRSPLLKFVEQPTENKADPKDGEAQKQEEDESCAAAEALTAPEDAGRPAVNSPANQSRGNQCKLFHPSLPQLPSEEEVNSLGREIIKLTKEQAAAELEEVRRESPIEGQRSETGPAPPGLAIQGELPKSHLDSFEASRPAAKASTPEDGKGIPEGGGMRSTVKT

SEQ ID NO: 890810 - protein, 559 aa, Homo sapiens; identical to SEQ ID NO: 890806

SEQ ID NO: 890811 - protein, 174 aa, Homo sapiens
EVKKITDGLHALQEASNKDAEALAAAQQHFNAVSAGLSSNEDGAEATLAGQMMACKNDISKAQTEAKHGSDEVEACSAEELKEMQDKVIKLQEELSENDKKIKALNHEIEELEKRKDKETGGILRSLEDALAEAQRVNTKSQSAFDLKKKNLACEESKRKELEKNMVEVSELNV

SEQ ID NO: 890812 - protein, 1197 aa, Homo sapiens
MHIKSIILEGFKSYAQRTEVNGFDPLFNAITGLNGSGKSNILDSICFLLGISNLSQVRASNLQDLVYKNGQAGITKASVSITFDNSDKKQSPLGFEVHDEITVTRQVVIGGRNKYLINGVNANNTRVQDLFCSVGLNVNNPHFLIMQGRITKVLNMKPPEILSMIEEAAGTRMYEYKKIAAQKTIEKKEAKLKEIKTILEEEITPTIQKLKEERSSYLEYQKVMREIEHLSRLYIAYQFLLAEDTKVRSAEELKEMQDKVIKLQEELSENDKKIKALNHEIEELEKRKDKETGGILRSLEDALAEAQRVNTKSQSAFDLKKKNLACEESKRKELEKNMVEDSKTLAAKEKEVKKITDGLHALQEASNKDAEALAAAQQHFNAVSAGLSSNEDGAEATLAGQMMACKNDISKAQTEAKQAQMKLKHAQQELKNKQAEVKKMDSGYRKDQEALEAVKRLKEKLEAEMKKLNYEENKEESLLEKRRQLSRDIGRLKETYEALLARFPNLRFAYKDPEKNWNRNCVKGLVASLISVKDTSATTALELVAGERLYNVVVDTEVTGKKLLERGELKRRYTIIPLNKISARCIAPETLRVAQNLVGPDNVHVALSLVEYKPELQKAMEFVFGTTFVCDNMDNAKKVAFDKRIMTRTVTLGGDVFDPHGTLSGGARSQAASILTKFQELKDVQDELRIKENELRALEEELAGLKNTAEKYRQLKQQWEMKTEEADLLQTKLQQSSYHKQQEELDALKKTIEESEETLKNTKEIQRKAEEKYEVLENKMKNAEAERERELKDAQKKLDCAKTKADASSKKMKEKQQEVEAITLELEELKREHTSYKQQLEAVNEAIKSYESQIEVMAAEVAKNKESVNKAQEEVTKQKEVITAQDTVIKAKYAEVAKHKEQNNDSQLKIKELDHNISKHKREAEDGAAKVSKMLKDYDWINAERHLFGQPNSAYDFKTNNPKEAGQRLQKLQEMKEKLGRNVNMRAMNVLTEAEERYNDLMKKKRIVENDKSKILTTIEDLDQKKNQALNIAWQKVNKDFGSIFSTLLPGANAMLAPPEGQTVLDGLEFKVALGNTWKENLTELSGGQRSLVALSLILSMLLFKPAPIYILDEVDAALDLSHTQNIGQMLRTHFTHSQFIVVSLKEGMFNNANVLFKTKFVDGVSTVARFTQCQNGKISKEAKSKAKPPKGAHVEV

SEQ ID NO: 890813 - protein, 1197 aa, Homo sapiens; identical to SEQ ID NO: 890812

SEQ ID NO: 890814 - protein, 1197 aa, Homo sapiens; identical to SEQ ID NO: 890812

SEQ ID NO: 890815 - protein, 1197 aa, Homo sapiens; identical to SEQ ID NO: 890812

SEQ ID NO: 890816 - protein, 1197 aa, Homo sapiens; identical to SEQ ID NO: 890812

SEQ ID NO: 890817 - protein, 1099 aa, Homo sapiens
MHIKSIILEGFKSYAQRTEVNGFDPLFNAITGLNGSGKSNILDSICFLLGISNLSQVRASNLQDLVYKNGQAGITKASVSITFDNSDKKQSPLGFEVHDEITVTRQVVIGGRNKYLINGVNANNTRVQDLFCSVGLNVNNPHFLIMQGRITKVLNMKPPEILSMIEEAAGTRMYEYKKIAAQKTIEKKEAKLKEIKTILEEEITPTIQKLKEERSSYLEYQKVMREIEHLSRLYIAYQFLLAEDTKVRSAEELKEMQDKVIKLQEELSENDKKIKALNHEIEELEKRKDKETGGILRSLEDALAEAQRVNTKSQSAFDLKKKNLACEESKRKELEKNMVEDSKTLAAKEKEVKKITDGLHALQEASNKDAEALAAAQQHFNAVSAGLSSNEDGAEATLAGQMMACKNDISKAQTEAKQAQMKLKHAQQELKNKQAEVKKMDSGYRKDQEALEAVKRLKEKLEAEMKKLNYEENKEESLLEKRRQLSRDIGRLKETYEALLARFPNLRFAYKDPEKNWNRNCVKGLVASLISVKDTSATTALELVAGERLYNVVVDTEVTGKKLLERGELKRRYTIIPLNKISARCIAPETLRVAQNLVGPDNVHVALSLVEYKPELQKAMEFVFGTTFVCDNMDNAKKVAFDKRIMTRTVTLGGDVFDPHGTLSGGARSQAASILTKFQELKDVQDELRIKENELRALEEELAGLKNTAEKYRQLKQQWEMKTEEADLLQTKLQQSSYHKQQEELDALKKTIEESEETLKNTKEIQRKAEEKYEVLENKMKNAEAERERELKDAQKKLDCAKTKADASSKKMKEKQQEVEAITLELEELKREHTSYKQQLEAVNEAIKSYESQIEVMAAEVAKNKESVNKAQEEVTKQKEVITAQDTVIKAKYAEVAKHKEQNNDSQLKIKELDHNISKHKREAEDGAAKVSKMLKDYDWINAERHLFGQPNSAYDFKTNNPKEAGQRLQKLQEMKEKLGRNVNMRAMNVLTEAEERYNDLMKKKRIVENDKSKILTTIEDLDQKKNQALNIAWQKVNKDFGSIFSTLLPGANAMLAPPEGQTVLDGLEFKVALGNTWKENLTELSGGQRQKQQNHTTG

SEQ ID NO: 890818 - protein, 1197 aa, Homo sapiens; identical to SEQ ID NO: 890812

SEQ ID NO: 890819 - protein, 1197 aa, Homo sapiens; identical to SEQ ID NO: 890812

SEQ ID NO: 890820 - protein, 1197 aa, Homo sapiens; identical to SEQ ID NO: 890812

SEQ ID NO: 890821 - protein, 1147 aa, Homo sapiens
MHIKSIILEGFKSYAQRTEVNGFDPLFNAITGLNGSGKSNILDSICFLLGISNLSQVVIGGRNKYLINGVNANNTRVQDLFCSVGLNVNNPHFLIMQGRITKVLNMKPPEILSMIEEAAGTRMYEYKKIAAQKTIEKKEAKLKEIKTILEEEITPTIQKLKEERSSYLEYQKVMREIEHLSRLYIAYQFLLAEDTKVRSAEELKEMQDKVIKLQEELSENDKKIKALNHEIEELEKRKDKETGGILRSLEDALAEAQRVNTKSQSAFDLKKKNLACEESKRKELEKNMVEDSKTLAAKEKEVKKITDGLHALQEASNKDAEALAAAQQHFNAVSAGLSSNEDGAEATLAGQMMACKNDISKAQTEAKQAQMKLKHAQQELKNKQAEVKKMDSGYRKDQEALEAVKRLKEKLEAEMKKLNYEENKEESLLEKRRQLSRDIGRLKETYEALLARFPNLRFAYKDPEKNWNRNCVKGLVASLISVKDTSATTALELVAGERLYNVVVDTEVTGKKLLERGELKRRYTIIPLNKISARCIAPETLRVAQNLVGPDNVHVALSLVEYKPELQKAMEFVFGTTFVCDNMDNAKKVAFDKRIMTRTVTLGGDVFDPHGTLSGGARSQAASILTKFQELKDVQDELRIKENELRALEEELAGLKNTAEKYRQLKQQWEMKTEEADLLQTKLQQSSYHKQQEELDALKKTIEESEETLKNTKEIQRKAEEKYEVLENKMKNAEAERERELKDAQKKLDCAKTKADASSKKMKEKQQEVEAITLELEELKREHTSYKQQLEAVNEAIKSYESQIEVMAAEVAKNKESVNKAQEEVTKQKEVITAQDTVIKAKYAEVAKHKEQNNDSQLKIKELDHNISKHKREAEDGAAKVSKMLKDYDWINAERHLFGQPNSAYDFKTNNPKEAGQRLQKLQEMKEKLGRNVNMRAMNVLTEAEERYNDLMKKKRIVENDKSKILTTIEDLDQKKNQALNIAWQKVNKDFGSIFSTLLPGANAMLAPPEGQTVLDGLEFKVALGNTWKENLTELSGGQRSLVALSLILSMLLFKPAPIYILDEVDAALDLSHTQNIGQMLRTHFTHSQFIVVSLKEGMFNNANVLFKTKFVDGVSTVARFTQCQNGKISKEAKSKAKPPKGAHVEV

SEQ ID NO: 890822 - protein, 1147 aa, Homo sapiens; identical to SEQ ID NO: 890821

SEQ ID NO: 890823 - protein, 1106 aa, Homo sapiens
MHIKSIILEGFKSYAQRTEVNGFDPLFNAITGLNGSGKSNILDSICFLLGISNLSQGRITKVLNMKPPEILSMIEEAAGTRMYEYKKIAAQKTIEKKEAKLKEIKTILEEEITPTIQKLKEERSSYLEYQKVMREIEHLSRLYIAYQFLLAEDTKVRSAEELKEMQDKVIKLQEELSENDKKIKALNHEIEELEKRKDKETGGILRSLEDALAEAQRVNTKSQSAFDLKKKNLACEESKRKELEKNMVEDSKTLAAKEKEVKKITDGLHALQEASNKDAEALAAAQQHFNAVSAGLSSNEDGAEATLAGQMMACKNDISKAQTEAKQAQMKLKHAQQELKNKQAEVKKMDSGYRKDQEALEAVKRLKEKLEAEMKKLNYEENKEESLLEKRRQLSRDIGRLKETYEALLARFPNLRFAYKDPEKNWNRNCVKGLVASLISVKDTSATTALELVAGERLYNVVVDTEVTGKKLLERGELKRRYTIIPLNKISARCIAPETLRVAQNLVGPDNVHVALSLVEYKPELQKAMEFVFGTTFVCDNMDNAKKVAFDKRIMTRTVTLGGDVFDPHGTLSGGARSQAASILTKFQELKDVQDELRIKENELRALEEELAGLKNTAEKYRQLKQQWEMKTEEADLLQTKLQQSSYHKQQEELDALKKTIEESEETLKNTKEIQRKAEEKYEVLENKMKNAEAERERELKDAQKKLDCAKTKADASSKKMKEKQQEVEAITLELEELKREHTSYKQQLEAVNEAIKSYESQIEVMAAEVAKNKESVNKAQEEVTKQKEVITAQDTVIKAKYAEVAKHKEQNNDSQLKIKELDHNISKHKREAEDGAAKVSKMLKDYDWINAERHLFGQPNSAYDFKTNNPKEAGQRLQKLQEMKEKLGRNVNMRAMNVLTEAEERYNDLMKKKRIVENDKSKILTTIEDLDQKKNQALNIAWQKVNKDFGSIFSTLLPGANAMLAPPEGQTVLDGLEFKVALGNTWKENLTELSGGQRSLVALSLILSMLLFKPAPIYILDEVDAALDLSHTQNIGQMLRTHFTHSQFIVVSLKEGMFNNANVLFKTKFVDGVSTVARFTQCQNGKISKEAKSKAKPPKGAHVEV

SEQ ID NO: 890824 - protein, 1025 aa, Homo sapiens
EVKKITDGLHALQEASNKDAEALAAAQQHFNAVSAGLSSNEDGAEATLAGQMMACKNDISKAQTEAKHGSDEVEACSAEELKEMQDKVIKLQEELSENDKKIKALNHEIEELEKRKDKETGGILRSLEDALAEAQRVNTKSQSAFDLKKKNLACEESKRKELEKNMVEDSKTLAAKEKEVKKITDGLHALQEASNKDAEALAAAQQHFNAVSAGLSSNEDGAEATLAGQMMACKNDISKAQTEAKQAQMKLKHAQQELKNKQAEVKKMDSGYRKDQEALEAVKRLKEKLEAEMKKLNYEENKEESLLEKRRQLSRDIGRLKETYEALLARFPNLRFAYKDPEKNWNRNCVKGLVASLISVKDTSATTALELVAGERLYNVVVDTEVTGKKLLERGELKRRYTIIPLNKISARCIAPETLRVAQNLVGPDNVHVALSLVEYKPELQKAMEFVFGTTFVCDNMDNAKKVAFDKRIMTRTVTLGGDVFDPHGTLSGGARSQAASILTKFQELKDVQDELRIKENELRALEEELAGLKNTAEKYRQLKQQWEMKTEEADLLQTKLQQSSYHKQQEELDALKKTIEESEETLKNTKEIQRKAEEKYEVLENKMKNAEAERERELKDAQKKLDCAKTKADASSKKMKEKQQEVEAITLELEELKREHTSYKQQLEAVNEAIKSYESQIEVMAAEVAKNKESVNKAQEEVTKQKEVITAQDTVIKAKYAEVAKHKEQNNDSQLKIKELDHNISKHKREAEDGAAKVSKMLKDYDWINAERHLFGQPNSAYDFKTNNPKEAGQRLQKLQEMKEKLGRNVNMRAMNVLTEAEERYNDLMKKKRIVENDKSKILTTIEDLDQKKNQALNIAWQKVNKDFGSIFSTLLPGANAMLAPPEGQTVLDGLEFKVALGNTWKENLTELSGGQRSLVALSLILSMLLFKPAPIYILDEVDAALDLSHTQNIGQMLRTHFTHSQFIVVSLKEGMFNNANVLFKTKFVDGVSTVARFTQCQNGKISKEAKSKAKPPKGAHVEV

SEQ ID NO: 890825 - protein, 250 aa, Homo sapiens
MHIKSIILEGFKSYAQRTEVNGFDPLFNAITGLNGSGKSNILDSICFLLGISNLSQVRASNLQDLVYKNGQAGITKASVSITFDNSDKKQSPLGFEVHDEITVTRQVVIGGRNKYLINGVNANNTRVQDLFCSVGLNVNNPHFLIMQGRITKVLNMKPPEILSMIEEAAGTRMYEYKKIAAQKTIEKKEAKLKEIKTILEEEITPTIQKLKEERSSYLEYQKVMREIEHLSRLYIAYQFLLAEDTKVTLS

SEQ ID NO: 890826 - protein, 518 aa, Homo sapiens
LRAPWPHLPAQPGPGGGDAMTLILTSLLFFGLSLGPRTRVQAENLPKPILWAEPGPVITWHNPVTIWCQGTLEAQGYRLDKEGNSMSRHILKTLESENKVKLSIPSMMWEHAGRYHCYYQSPAGWSEPSDPLELVVTAYSRPTLSALPSPVVTSGVNVTLRCASRLGLGRFTLIEEGDHRLSWTLNSHQHNHGKFQALFPMGPLTFSNRGTFRCYGYENNTPYVWSEPSDPLQLLVSGVSRKPSLLTLQGPVVTPGENLTLQCGSDVGYIRYTLYKEGADGLPQRPGRQPQAGLSQANFTLSPVSRSYGGQYRCYGAHNVSSEWSAPSDPLDILIAGQISDRPSLSVQPGPTVTSGEKVTLLCQSWDPMFTFLLTKEGAAHPPLRLRSMYGAHKYQAEFPMSPVTSAHAGTYRCYGSRSSNPYLLSHPSEPLELVVSGATETLNPAQKKSDSKTAPHLQDYTVENLIRMGVAGLVLLFLGILLFEAQHSQRSPPRCSQEANSRKDNAPFRVVEPWEQI

SEQ ID NO: 890827 - protein, 515 aa, Homo sapiens
MASQGLKEKKKTCSGFGGKSLTGNSLPGLSLGPRTRVQAENLPKPILWAEPGPVITWHNPVTIWCQGTLEAQGYRLDKEGNSMSRHILKTLESENKVKLSIPSMMWEHAGRYHCYYQSPAGWSEPSDPLELVVTAYSRPTLSALPSPVVTSGVNVTLRCASRLGLGRFTLIEEGDHRLSWTLNSHQHNHGKFQALFPMGPLTFSNRGTFRCYGYENNTPYVWSEPSDPLQLLVSGVSRKPSLLTLQGPVVTPGENLTLQCGSDVGYIRYTLYKEGADGLPQRPGRQPQAGLSQANFTLSPVSRSYGGQYRCYGAHNVSSEWSAPSDPLDILIAGQISDRPSLSVQPGPTVTSGEKVTLLCQSWDPMFTFLLTKEGAAHPPLRLRSMYGAHKYQAEFPMSPVTSAHAGTYRCYGSRSSNPYLLSHPSEPLELVVSGATETLNPAQKKSDSKTAPHLQDYTVENLIRMGVAGLVLLFLGILLFEAQHSQRSPPRCSQEANSRKDNAPFRVVEPWEQI

SEQ ID NO: 890828 - protein, 518 aa, Homo sapiens; identical to SEQ ID NO: 890826

SEQ ID NO: 890829 - protein, 460 aa, Homo sapiens
LRAPWPHLPAQPGPGGGDAMTLILTSLLFFGLSLGPRTRVQAENLPKPILWAEPGPVITWHNPVTIWCQGTLEAQGYRLDKEGNSMSRHILKTLESENKVKLSIPSMMWEHAGRYHCYYQSPAGWSEPSDPLELVVTAYSRPTLSALPSPVVTSGVNVTLRCASRLGLGRFTLIEEGDHRLSWTLNSHQHNHGKFQALFPMGPLTFSNRGTFRCYGYENNTPYVWSEPSDPLQLLVSGVSRKPSLLTLQGPVVTPGENLTLQCGSDVGYIRYTLYKEGADGLPQRPGRQPQAGLSQANFTLSPVSRSYGGQYRCYGAHNVSSEWSAPSDPLDILIAGQISDRPSLSVQPGPTVTSGEKVTLLCQSWDPMFTFLLTKEGAAHPPLRLRSMYGAHKYQAEFPMSPVTSAHAGTYRCYGSRSSNPYLLSHPSEPLELVVSGEGADPVHSELKGVLGNEKGELP

SEQ ID NO: 890830 - protein, 161 aa, Homo sapiens
SGSSWERQFRLCVRVDKMAKIAKTHEDIEAQIREIQGKKAALDEAQGVGLDSTGYYDQEIYGGSDSRFAGYVTSIAATELEDDDDDYSSSTSLLGQKKPGYHAPVALLNDIPQSTEQYDPFAEHRPPKIADREDEYKKHRRTMIISPERLDPFADGFYSAA

SEQ ID NO: 890831 - protein, 71 aa, Homo sapiens
AEVLGSASSVCVFEWTKWRRSPRLTKILKHRFEKFKARRQLLMKLKEWASILQVIMTRKFMVEVTADLLDT

SEQ ID NO: 890832 - protein, 93 aa, Homo sapiens
MPLASPIQHHEVTRGVAPSMALRDGVCRIPLSAEFTAQCTDSQAPQMKRAPRCCCLAVVAQCPHHCPVLGCWSGCRCCCYCVFELHWLYCIQE

SEQ ID NO: 890833 - protein, 171 aa, Homo sapiens
MAEPPHSYCFVLGDNIIAQHRGKGLAAFLKAIGYLIPLMDAEYANYYTREVMLILIREFQSPDEEMKKIVLKVVKQCCGTDGVEANYIKTEILPPFFKHFWQHRMALDRRNYRQLVDTTVELANKVGAAEIISRIVDDLKDEAEQYRKMVMGDKSRDVIAQHQEQAMFAFN

SEQ ID NO: 890834 - protein, 152 aa, Homo sapiens
SVGTDVSLKRGEASLSLPLVGGSLAGMMITGLWTPWTGPWLSWLPEEGQGPPMSPVSAFWNCPSLKEALERAEQLCYECGECLEDPRDVIAQHRGKGLAAFLKAIGYLIPLMDAEYANYYTREVMLILIREFQSPDEEMKKIVLKVVKQCWG

SEQ ID NO: 890835 - protein, 1158 aa, Homo sapiens
MNARTYMDVMREQHLTKEEREIRQQLAEKAKAGELKVVNGAAASQPPSKRKRRWDQTADQTPGATPKKLSSWDQAETPGHTPSLRWDETPGRAKGSETPGATPGSKIWDPTPSHTPAGAATPGRGDTPGHATPGHGGATSSARKNRWDETPKTERDTPGHGSGWAETPRTDRGGDSIGETPTPGASKRKSRWDETPASQMGGSTPVLTPGKTPIGTPAMNMATPTPGHIMSMTPEQLQAWRWEREIDERNRPLSDEELDAMFPEGYKVLPPPAGYVPIRTPARKLTATPTPLGGMTGFHMQTEDRTMKSVNDQPSGNLPFLKPDDIQYFDKLLVDVDESTLSPEEQKERKIMKLLLKIKNGTPPMRKAALRQITDKAREFGAGPLFNQILPLLMSPTLEDQERHLLVKVIDRILYKLDDLVRPYVHKILVVIEPLLIDEDYYARVEGREIISNLAKAAGLATMISTMRPDIDNMDEYVRNTTARAFAVVASALGIPSLLPFLKAVCKSKKSWQARHTGIKIVQQIAILMGCAILPHLRSLVEIIEHGLVDEQQKVRTISALAIAALAEAATPYGIESFDSVLKPLWKGIRQHRGKGLAAFLKAIGYLIPLMDAEYANYYTREVMLILIREFQSPDEEMKKIVLKVVKQCCGTDGVEANYIKTEILPPFFKHFWQHRMALDRRNYRQLVDTTVELANKVGAAEIISRIVDDLKDEAEQYRKMVMETIEKIMGNLGAADIDHKLEEQLIDGILYAFQEQTTEDSVMLNGFGTVVNALGKRVKPYLPQICGTVLWRLNNKSAKVRQQAADLISRTAVVMKTCQEEKLMGHLGVVLYEYLGEEYPEVLGSILGALKAIVNVIGMHKMTPPIKDLLPRLTPILKNRHEKVQENCIDLVGRIADRGAEYVSAREWMRICFELLELLKAHKKAIRRATVNTFGYIAKAIGPHDVLATLLNNLKVQERQNRVCTTVAIAIVAETCSPFTVLPALMNEYRVPELNVQNGVLKSLSFLFEYIGEMGKDYIYAVTPLLEDALMDRDLVHRQTASAVVQHMSLGVYGFGCEDSLNHLLNYVWPNVFETSPHVIQAVMGALEGLRVAIGPCRMLQYCLQGLFHPARKVRDVYWKIYNSIYIGSQDALIAHYPRIYNDDKNTYIRYELDYIL

SEQ ID NO: 890836 - protein, 1158 aa, Homo sapiens; identical to SEQ ID NO: 890835

SEQ ID NO: 890837 - protein, 980 aa, Homo sapiens
EVDLEDPVHCSIRWDETPASQMGGSTPVLTPGKTPIGTPAMNMATPTPGHIMSMTPEQLQAWRWEREIDERNRPLSDEELDAMFPEGYKVLPPPAGYVPIRTPARKLTATPTPLGGMTGFHMQTEDRTMKSVNDQPSGNLPFLKPDDIQYFDKLLVDVDESTLSPEEQKERKIMKLLLKIKNGTPPMRKAALRQITDKAREFGAGPLFNQILPLLMSPTLEDQERHLLVKVIDRILYKLDDLVRPYVHKILVVIEPLLIDEDYYARVEGREIISNLAKAAGLATMISTMRPDIDNMDEYVRNTTARAFAVVASALGIPSLLPFLKAVCKSKKSWQARHTGIKIVQQIAILMGCAILPHLRSLVEIIEHGLVDEQQKVRTISALAIAALAEAATPYGIESFDSVLKPLWKGIRQHRGKGLAAFLKAIGYLIPLMDAEYANYYTREVMLILIREFQSPDEEMKKIVLKVVKQCCGTDGVEANYIKTEILPPFFKHFWQHRMALDRRNYRQLVDTTVELANKVGAAEIISRIVDDLKDEAEQYRKMVMETIEKIMGNLGAADIDHKLEEQLIDGILYAFQEQTTEDSVMLNGFGTVVNALGKRVKPYLPQICGTVLWRLNNKSAKVRQQAADLISRTAVVMKTCQEEKLMGHLGVVLYEYLGEEYPEVLGSILGALKAIVNVIGMHKMTPPIKDLLPRLTPILKNRHEKVQENCIDLVGRIADRGAEYVSAREWMRICFELLELLKAHKKAIRRATVNTFGYIAKAIGPHDVLATLLNNLKVQERQNRVCTTVAIAIVAETCSPFTVLPALMNEYRVPELNVQNGVLKSLSFLFEYIGEMGKDYIYAVTPLLEDALMDRDLVHRQTASAVVQHMSLGVYGFGCEDSLNHLLNYVWPNVFETSPHVIQAVMGALEGLRVAIGPCRMLQYCLQGLFHPARKVRDVYWKIYNSIYIGSQDALIAHYPRIYNDDKNTYIRYELDYIL

SEQ ID NO: 890838 - protein, 659 aa, Homo sapiens
SVGTDVSLKRGEASLSLPLVGGSLAGMMITGLWTPWTGPWLSWLPEEGQGPPMSPVSAFWNCPSLKEALERAEQLCYECGECLEDPRDVIAQHRGKGLAAFLKAIGYLIPLMDAEYANYYTREVMLILIREFQSPDEEMKKIVLKVVKQCCGTDGVEANYIKTEILPPFFKHFWQHRMALDRRNYRQLVDTTVELANKVGAAEIISRIVDDLKDEAEQYRKMVMETIEKIMGNLGAADIDHKLEEQLIDGILYAFQEQTTEDSVMLNGFGTVVNALGKRVKPYLPQICGTVLWRLNNKSAKVRQQAADLISRTAVVMKTCQEEKLMGHLGVVLYEYLGEEYPEVLGSILGALKAIVNVIGMHKMTPPIKDLLPRLTPILKNRHEKVQENCIDLVGRIADRGAEYVSAREWMRICFELLELLKAHKKAIRRATVNTFGYIAKAIGPHDVLATLLNNLKVQERQNRVCTTVAIAIVAETCSPFTVLPALMNEYRVPELNVQNGVLKSLSFLFEYIGEMGKDYIYAVTPLLEDALMDRDLVHRQTASAVVQHMSLGVYGFGCEDSLNHLLNYVWPNVFETSPHVIQAVMGALEGLRVAIGPCRMLQYCLQGLFHPARKVRDVYWKIYNSIYIGSQDALIAHYPRIYNDDKNTYIRYELDYIL

SEQ ID NO: 890839 - protein, 586 aa, Homo sapiens
MAEPPHSYCFVLGDNIIAQHRGKGLAAFLKAIGYLIPLMDAEYANYYTREVMLILIREFQSPDEEMKKIVLKVVKQCCGTDGVEANYIKTEILPPFFKHFWQHRMALDRRNYRQLVDTTVELANKVGAAEIISRIVDDLKDEAEQYRKMVMETIEKIMGNLGAADIDHKLEEQLIDGILYAFQEQTTEDSVMLNGFGTVVNALGKRVKPYLPQICGTVLWRLNNKSAKVRQQAADLISRTAVVMKTCQEEKLMGHLGVVLYEYLGEEYPEVLGSILGALKAIVNVIGMHKMTPPIKDLLPRLTPILKNRHEKVQENCIDLVGRIADRGAEYVSAREWMRICFELLELLKAHKKAIRRATVNTFGYIAKAIGPHDVLATLLNNLKVQERQNRVCTTVAIAIVAETCSPFTVLPALMNEYRVPELNVQNGVLKSLSFLFEYIGEMGKDYIYAVTPLLEDALMDRDLVHRQTASAVVQHMSLGVYGFGCEDSLNHLLNYVWPNVFETSPHVIQAVMGALEGLRVAIGPCRMLQYCLQGLFHPARKVRDVYWKIYNSIYIGSQDALIAHYPRIYNDDKNTYIRYELDYIL

SEQ ID NO: 890840 - protein, 311 aa, Homo sapiens
ETGDLFVLQLKGMHKMTPPIKDLLPRLTPILKNRHEKVQENCIDLVGRIADRGAEYVSAREWMRICFELLELLKAHKKAIRRATVNTFGYIAKAIGPHDVLATLLNNLKVQERQNRVCTTVAIAIVAETCSPFTVLPALMNEYRVPELNVQNGVLKSLSFLFEYIGEMGKDYIYAVTPLLEDALMDRDLVHRQTASAVVQHMSLGVYGFGCEDSLNHLLNYVWPNVFETSPHVIQAVMGALEGLRVAIGPCRMLQYCLQGLFHPARKVRDVYWKIYNSIYIGSQDALIAHYPRIYNDDKNTYIRYELDYIL

SEQ ID NO: 890841 - protein, 1140 aa, Homo sapiens
MNARTYMDVMREQHLTKEEREIRQQLAEKAKAGELKVVNGAAASQPPSKRKRRWDQTADQTPGATPKKLSSWDQAETPGHTPSLRWDETPGRAKGSETPGATPGSKIWDPTPSHTPAGAATPGRGDTPGHATPGHGGATSSARKNRWDETPKTERDTPGHGSGWAETPRTDRGGDSIGETPTPGASKRKSRWDETPASQMGGSTPVLTPGKTPIGTPAMNMATPTPGHIMSMTPEQLQAWRWEREIDERNRPLSDEELDAMFPEGYKVLPPPAGYVPIRTPARKLTATPTPLGGMTGFHMQTEDRTMKSVNDQPSGNLPFLKPDDIQYFDKLLVDVDESTLSPEEQKERKIMKLLLKIKNGTPPMRKAALRQITDKAREFGAGPLFNQILPLLMSPTLEDQERHLLVKVIDRILYKLDDLVRPYVHKILVVIEPLLIDEDYYARVEGREIISNLAKAAGLATMISTMRPDIDNMDEYVRNTTARAFAVVASALGIPSLLPFLKAVCKSKKSWQARHTGIKIVQQIAILMGCAILPHLRSLVEIIEHGLVDEQQKVRTISALAIAALAEAATPYGIESFDSVLKPLWKGIRQHRGKGLAAFLKAIGYLIPLMDAEYANYYTREVMLILIREFQSPDEEMKKIVLKVVKQCCGTDGVEANYIKTEILPPFFKHFWQHRMALDRRNYRQLVDTTVELANKVGAAEIISRIVDDLKDEAEQYRKMVMETIEKIMGNLGAADIDHKLEEQLIDGILYAFQEQTTEDSVMLNGFGTVVNALGKRVKPYLPQICGTVLWRLNNKSAKVRQQAADLISRTAVVMKTCQEEKLMGHLGVVLYEYLGEEYPEVLGSILGALKAIVNVIGMHKMTPPIKDLLPRLTPILKNRHEKVQENCIDLVGRIADRGAEYVSAREWMRICFELLELLKAHKKAIRRATVNTFGYIAKAIGPHDVLATLLNNLKVQERQNRVCTTVAIAIVAETCSPFTVLPALMNEYRVPELNVQNGVLKSLSFLFEYIGEMGKDYIYAVTPLLEDALMDRDLVHRQTASAVVQHMSLGVYGFGCEDSLNHLLNYVWPNVFETSPHVIQAVMGALEGLRVAIGPCRMLQYCLQGLFHPARKVRDVYWPRIYNDDKNTYIRYELDYIL

SEQ ID NO: 890842 - protein, 277 aa, Homo sapiens
IDHKLEEQLIDLVVYADRGAEYVSAREWMRICFELLELLKAHKKAIRRATVNTFGYIAKAIGPHDVLATLLNNLKVQERQNRVCTTVAIAIVAETCSPFTVLPALMNEYRVPELNVQNGVLKSLSFLFEYIGEMGKDYIYAVTPLLEDALMDRDLVHRQTASAVVQHMSLGVYGFGCEDSLNHLLNYVWPNVFETSPHVIQAVMGALEGLRVAIGPCRMLQYCLQGLFHPARKVRDVYWKIYNSIYIGSQDALIAHYPRIYNDDKNTYIRYELDYIL

SEQ ID NO: 890843 - protein, 1040 aa, Homo sapiens
MNARTYMDVMREQHLTKEEREIRQQLAEKAKAGELKVVNGAAASQPPSKRKRRWDQTADQTPGATPKKLSSWDQAETPGHTPSLRWDETPGRAKGSETPGATPGSKIWDPTPSHTPAGAATPGRGDTPGHATPGHGGATSSARKNRWDETPKTERDTPGHGSGWAETPRTDRGGDSIGETPTPGASKRKSRWDETPASQMGGSTPVLTPGKTPIGTPAMNMATPTPGHIMSMTPEQLQAWRWEREIDERNRPLSDEELDAMFPEGYKVLPPPAGYVPIRTPARKLTATPTPLGGMTGFHMQTEDRTMKSVNDQPSGNLPFLKPDDIQYFDKLLVDVDESTLSPEEQKERKIMKLLLKIKNGTPPMRKAALRQITDKAREFGAGPLFNQILPLLMSPTLEDQERHLLVKVIDRILYKLDDLVRPYVHKILVVIEPLLIDEDYYARVEGREIISNLAKAAGLATMISTMRPDIDNMDEYVRNTTARAFAVVASALGIPSLLPFLKAVCKSKKSWQARHTGIKIVQQIAILMGCAILPHLRSLVEIIEHGLVDEQQKVRTISALAIAALAEAATPYGIESFDSVLKPLWKGIRQHRGKGLAAFLKAIGYLIPLMDAEYANYYTREVMLILIREFQSPDEEMKKIVLKVVKQCCGTDGVEANYIKTEILPPFFKHFWQHRMALDRRNYRQLVDTTVELANKVGAAEIISRIVDDLKDEAEQYRKMVMETIEKIMGNLGAADIDHKLEEQLIDGILYAFQEQTTEDSVMLNGFGTVVNALGKRVKPYLPQICGTVLWRLNNKSAKVRQQAADLISRTAVVMKTCQEEKLMGHLGVVLYEYLGEEYPEVLGSILGALKAIVNVIGMHKMTPPIKDLLPRLTPILKNRHEKVQENCIDLVGRIADRGAEYVSAREWMRICFELLELLKAHKKAIRRATVNTFGYIAKAIGPHDVLATLLNNLKVQERQNRVCTTVAIAIVAETCSPFTVLPALMNEYRVPELNVQNGVLKSLSFLFEYIGEMGKDYIYAVTPLLENANLCVFFEHDL

SEQ ID NO: 890844 - protein, 743 aa, Homo sapiens
MNARTYMDVMREQHLTKEEREIRQQLAEKAKAGELKVVNGAAASQPPSKRKRRWDQTADQTPGATPKKLSSWDQAETPGHTPSLRWDETPGRAKGSETPGATPGSKIWDPTPSHTPAGAATPGRGDTPGHATPGHGGATSSARKNRWDETPKTERDTPGHGSGWAETPRTDRGGDSIGETPTPGASKRKSRWDETPASQMGGSTPVLTPGKTPIGTPAMNMATPTPGHIMSMTPEQLQAWRWEREIDERNRPLSDEELDAMFPEGYKVLPPPAGYVPIRTPARKLTATPTPLGGMTGFHMQTEDRTMKSVNDQPSGNLPFLKPDDIQYFDKLLVDVDESTLSPEEQKERKIMKLLLKIKNGTPPMRKAALRQITDKAREFGAGPLFNQILPLLMSPTLEDQERHLLVKVIDRILYKLDDLVRPYVHKILVVIEPLLIDEDYYARVEGREIISNLAKAAGLATMISTMRPDIDNMDEYVRNTTARAFAVVASALGIPSLLPFLKAVCKSKKSWQARHTGIKIVQQIAILMGCAILPHLRSLVEIIEHGLVDEQQKVRTISALAIAALAEAATPYGIESFDSVLKPLWKGIRQHRGKGLAAFLKAIGYLIPLMDAEYANYYTREVMLILIREFQSPDEEMKKIVLKVVKQCCGTDGVEANYIKTEILPPFFKHFWQHRMALDRRNYRQLVDTTVELANKVGAAEIISRIVDDLKDEAEQYRKMVMGDKSRDVIAQHQEQAMFAFN

SEQ ID NO: 890845 - protein, 720 aa, Homo sapiens
MNARTYMDVMREQHLTKEEREIRQQLAEKAKAGELKVVNGAAASQPPSKRKRRWDQTADQTPGATPKKLSSWDQAETPGHTPSLRWDETPGRAKGSETPGATPGSKIWDPTPSHTPAGAATPGRGDTPGHATPGHGGATSSARKNRWDETPKTERDTPGHGSGWAETPRTDRGGDSIGETPTPGASKRKSRWDETPASQMGGSTPVLTPGKTPIGTPAMNMATPTPGHIMSMTPEQLQAWRWEREIDERNRPLSDEELDAMFPEGYKVLPPPAGYVPIRTPARKLTATPTPLGGMTGFHMQTEDRTMKSVNDQPSGNLPFLKPDDIQYFDKLLVDVDESTLSPEEQKERKIMKLLLKIKNGTPPMRKAALRQITDKAREFGAGPLFNQILPLLMSPTLEDQERHLLVKVIDRILYKLDDLVRPYVHKILVVIEPLLIDEDYYARVEGREIISNLAKAAGLATMISTMRPDIDNMDEYVRNTTARAFAVVASALGIPSLLPFLKAVCKSKKSWQARHTGIKIVQQIAILMGCAILPHLRSLVEIIEHGLVDEQQKVRTISALAIAALAEAATPYGIESFDSVLKPLWKGIRQHRGKGLAAFLKAIGYLIPLMDAEYANYYTREVMLILIREFQSPDEEMKKIVLKVQKMREDEDKGPPCGPVNCNEKIVVLLQRLKPEIKDVIEQLNLVTTCLQLQIPRIEDVTILEWLMGADSGNSRSPH

SEQ ID NO: 890846 - protein, 161 aa, Homo sapiens; identical to SEQ ID NO: 890830

SEQ ID NO: 890847 - protein, 1321 aa, Homo sapiens
SGSSWERQFRLCVRVDKMAKIAKTHEDIEAQIREIQGKKAALDEAQGVGLDSTGYYDQEIYGGSDSRFAGYVTSIAATELEDDDDDYSSSTSLLGQKKPGYHAPVALLNDIPQSTEQYDPFAEHRPPKIADREDEYKKHRRTMIISPERLDPFADGGKTPDPKMNARTYMDVMREQHLTKEEREIRQQLAEKAKAGELKVVNGAAASQPPSKRKRRWDQTADQTPGATPKKLSSWDQAETPGHTPSLRWDETPGRAKGSETPGATPGSKIWDPTPSHTPAGAATPGRGDTPGHATPGHGGATSSARKNRWDETPKTERDTPGHGSGWAETPRTDRGGDSIGETPTPGASKRKSRWDETPASQMGGSTPVLTPGKTPIGTPAMNMATPTPGHIMSMTPEQLQAWRWEREIDERNRPLSDEELDAMFPEGYKVLPPPAGYVPIRTPARKLTATPTPLGGMTGFHMQTEDRTMKSVNDQPSGNLPFLKPDDIQYFDKLLVDVDESTLSPEEQKERKIMKLLLKIKNGTPPMRKAALRQITDKAREFGAGPLFNQILPLLMSPTLEDQERHLLVKVIDRILYKLDDLVRPYVHKILVVIEPLLIDEDYYARVEGREIISNLAKAAGLATMISTMRPDIDNMDEYVRNTTARAFAVVASALGIPSLLPFLKAVCKSKKSWQARHTGIKIVQQIAILMGCAILPHLRSLVEIIEHGLVDEQQKVRTISALAIAALAEAATPYGIESFDSVLKPLWKGIRQHRGKGLAAFLKAIGYLIPLMDAEYANYYTREVMLILIREFQSPDEEMKKIVLKVVKQCCGTDGVEANYIKTEILPPFFKHFWQHRMALDRRNYRQLVDTTVELANKVGAAEIISRIVDDLKDEAEQYRKMVMETIEKIMGNLGAADIDHKLEEQLIDGILYAFQEQTTEDSVMLNGFGTVVNALGKRVKPYLPQICGTVLWRLNNKSAKVRQQAADLISRTAVVMKTCQEEKLMGHLGVVLYEYLGEEYPEVLGSILGALKAIVNVIGMHKMTPPIKDLLPRLTPILKNRHEKVQENCIDLVGRIADRGAEYVSAREWMRICFELLELLKAHKKAIRRATVNTFGYIAKAIGPHDVLATLLNNLKVQERQNRVCTTVAIAIVAETCSPFTVLPALMNEYRVPELNVQNGVLKSLSFLFEYIGEMGKDYIYAVTPLLEDALMDRDLVHRQTASAVVQHMSLGVYGFGCEDSLNHLLNYVWPNVFETSPHVIQAVMGALEGLRVAIGPCRMLQYCLQGLFHPARKVRDVYWKIYNSIYIGSQDALIAHYPRIYNDDKNTYIRYELDYIL

SEQ ID NO: 890848 - protein, 171 aa, Homo sapiens
SGSSWERQFRLCVRVDKMAKIAKTHEDIEAQIREIQGKKAALDEAQGVGLDSTGYYDQEIYGGSDSRFAGYVTSIAATELEDDDDDYSSSTSLLGQKKPGYHAPVALLNDIPQSTEQYDPFAEHRPPKIADREDEYKKHRRTMIISPERLDPFADGNSFPLFYKYSEIYLY

SEQ ID NO: 890849 - protein, 1158 aa, Homo sapiens; identical to SEQ ID NO: 890835

SEQ ID NO: 890850 - protein, 1178 aa, Homo sapiens
GRLLLLNSRPRLRGKTPDPKMNARTYMDVMREQHLTKEEREIRQQLAEKAKAGELKVVNGAAASQPPSKRKRRWDQTADQTPGATPKKLSSWDQAETPGHTPSLRWDETPGRAKGSETPGATPGSKIWDPTPSHTPAGAATPGRGDTPGHATPGHGGATSSARKNRWDETPKTERDTPGHGSGWAETPRTDRGGDSIGETPTPGASKRKSRWDETPASQMGGSTPVLTPGKTPIGTPAMNMATPTPGHIMSMTPEQLQAWRWEREIDERNRPLSDEELDAMFPEGYKVLPPPAGYVPIRTPARKLTATPTPLGGMTGFHMQTEDRTMKSVNDQPSGNLPFLKPDDIQYFDKLLVDVDESTLSPEEQKERKIMKLLLKIKNGTPPMRKAALRQITDKAREFGAGPLFNQILPLLMSPTLEDQERHLLVKVIDRILYKLDDLVRPYVHKILVVIEPLLIDEDYYARVEGREIISNLAKAAGLATMISTMRPDIDNMDEYVRNTTARAFAVVASALGIPSLLPFLKAVCKSKKSWQARHTGIKIVQQIAILMGCAILPHLRSLVEIIEHGLVDEQQKVRTISALAIAALAEAATPYGIESFDSVLKPLWKGIRQHRGKGLAAFLKAIGYLIPLMDAEYANYYTREVMLILIREFQSPDEEMKKIVLKVVKQCCGTDGVEANYIKTEILPPFFKHFWQHRMALDRRNYRQLVDTTVELANKVGAAEIISRIVDDLKDEAEQYRKMVMETIEKIMGNLGAADIDHKLEEQLIDGILYAFQEQTTEDSVMLNGFGTVVNALGKRVKPYLPQICGTVLWRLNNKSAKVRQQAADLISRTAVVMKTCQEEKLMGHLGVVLYEYLGEEYPEVLGSILGALKAIVNVIGMHKMTPPIKDLLPRLTPILKNRHEKVQENCIDLVGRIADRGAEYVSAREWMRICFELLELLKAHKKAIRRATVNTFGYIAKAIGPHDVLATLLNNLKVQERQNRVCTTVAIAIVAETCSPFTVLPALMNEYRVPELNVQNGVLKSLSFLFEYIGEMGKDYIYAVTPLLEDALMDRDLVHRQTASAVVQHMSLGVYGFGCEDSLNHLLNYVWPNVFETSPHVIQAVMGALEGLRVAIGPCRMLQYCLQGLFHPARKVRDVYWKIYNSIYIGSQDALIAHYPRIYNDDKNTYIRYELDYIL

SEQ ID NO: 890851 - protein, 1158 aa, Homo sapiens; identical to SEQ ID NO: 890835

SEQ ID NO: 890852 - protein, 1158 aa, Homo sapiens; identical to SEQ ID NO: 890835

SEQ ID NO: 890853 - protein, 512 aa, Homo sapiens
KKGRKNLCFNVVCFYTICPTTLFYHFWQHRMALDRRNYRQLVDTTVELANKVGAAEIISRIVDDLKDEAEQYRKMVMETIEKIMGNLGAADIDHKLEEQLIDGILYAFQEQTTEDSVMLNGFGTVVNALGKRVKPYLPQICGTVLWRLNNKSAKVRQQAADLISRTAVVMKTCQEEKLMGHLGVVLYEYLGEEYPEVLGSILGALKAIVNVIGMHKMTPPIKDLLPRLTPILKNRHEKVQENCIDLVGRIADRGAEYVSAREWMRICFELLELLKAHKKAIRRATVNTFGYIAKAIGPHDVLATLLNNLKVQERQNRVCTTVAIAIVAETCSPFTVLPALMNEYRVPELNVQNGVLKSLSFLFEYIGEMGKDYIYAVTPLLEDALMDRDLVHRQTASAVVQHMSLGVYGFGCEDSLNHLLNYVWPNVFETSPHVIQAVMGALEGLRVAIGPCRMLQYCLQGLFHPARKVRDVYWKIYNSIYIGSQDALIAHYPRIYNDDKNTYIRYELDYIL

SEQ ID NO: 890854 - protein, 1140 aa, Homo sapiens; identical to SEQ ID NO: 890841

SEQ ID NO: 890855 - protein, 232 aa, Homo sapiens
DPYETECAHSVILQRHGPHDVLATLLNNLKVQERQNRVCTTVAIAIVAETCSPFTVLPALMNEYRVPELNVQNGVLKSLSFLFEYIGEMGKDYIYAVTPLLEDALMDRDLVHRQTASAVVQHMSLGVYGFGCEDSLNHLLNYVWPNVFETSPHVIQAVMGALEGLRVAIGPCRMLQYCLQGLFHPARKVRDVYWKIYNSIYIGSQDALIAHYPRIYNDDKNTYIRYELDYIL

SEQ ID NO: 890856 - protein, 880 aa, Homo sapiens
MNARTYMDVMREQHLTKEEREIRQQLAEKAKAGELKVVNGAAASQPPSKRKRRWDQTADQTPGATPKKLSSWDQAETPGHTPSLRWDETPGRAKGSETPGATPGSKIWDPTPSHTPAGAATPGRGDTPGHATPGHGGATSSARKNRWDETPKTERDTPGHGSGWAETPRTDRGGDSIGETPTPGASKRKSRWDETPASQMGGSTPVLTPGKTPIGTPAMNMATPTPGHIMSMTPEQLQAWRWEREIDERNRPLSDEELDAMFPEGYKVLPPPAGYVPIRTPARKLTATPTPLGGMTGFHMQTEDRTMKSVNDQPSGNLPFLKPDDIQYFDKLLVDVDESTLSPEEQKERKIMKLLLKIKNGTPPMRKAALRQITDKAREFGAGPLFNQILPLLMSPTLEDQERHLLVKVIDRILYKLDDLVRPYVHKILVVIEPLLIDEDYYARVEGREIISNLAKAAGLATMISTMRPDIDNMDEYVRNTTARAFAVVASALGIPSLLPFLKAVCKSKKSWQARHTGIKIVQQIAILMGCAILPHLRSLVEIIEHGLVDEQQKVRTISALAIAALAEAATPYGIESFDSVLKPLWKGIRQHRGKGLAAFLKAIGYLIPLMDAEYANYYTREVMLILIREFQSPDEEMKKIVLKVVKQCCGTDGVEANYIKTEILPPFFKHFWQHRMALDRRNYRQLVDTTVELANKVGAAEIISRIVDDLKDEAEQYRKMVMETIEKIMGNLGAADIDHKLEEQLIDGILYAFQEQTTEDSVMLNGFGTVVNALGKRVKPYLPQICGTVLWRLNNKSAKVRQQAADLISRTAVVMKTCQEEKLMGHLGVVLYEYLGEEYPEVLGSILGALKAIVNVIGMEFAGYIRLFLVLTFFFFFFS

SEQ ID NO: 890857 - protein, 161 aa, Homo sapiens; identical to SEQ ID NO: 890830

SEQ ID NO: 890858 - protein, 112 aa, Homo sapiens
WAETPRTDRGGDSIGETPTPGASKRKSRWDETPASQMGGSTPVLTPGKTPIGTPAMNMATPTPGRTVSLDIIVFFSINYLIFSFVVFCVLLMSTSSKNKEIYKFKSWFAFII

SEQ ID NO: 890859 - protein, 1189 aa, Homo sapiens
MKTRQNKDSMSMRSGRKKEAPGPREELRSRGRASPGGVSTSSSDGKAEKSRQTAKKARVEEASTPKVNKQGRSEEISESESEETNAPKKTKTEQELPRPQSPSDLDSLDGRSLNDDGSSDPRDIDQDNRSTSPSIYSPGSVENDSDSSSGLSQGPARPYHPPPLFPPSPQPPDSTPRQPEASFEPHPSVTPTGYHAPMEPPTSRMFQAPPGAPPPHPQLYPGGTGGVLSGPPMGPKGGGAASSVGGPNGGKQHPPPTTPISVSSSGASGAPPTKPPTTPVGGGNLPSAPPPANFPHVTPNLPPPPALRPLNNASASPPGLGAQPLPGHLPSPHAMGQGMGGLPPGPEKGPTLAPSPHSLPPASSSAPAPPMRFPYSSSSSSSAAASSSSSSSSSSASPFPASQALPSYPHSFPPPTSLSVSNQPPKYTQPSLPSQAVWSQGPPPPPPYGRLLANSNAHPGPFPPSTGAQSTAHPPVSTHHHHHQQQQQQQQQQQQQQQQQQHHGNSGPPPPGAFPHPLEGGSSHHAHPYAMSPSLGSLRPYPPGPAHLPPPHSQVSYSQAGPNGPPVSSSSNSSSSTSQGSYPCSHPSPSQGPQGAPYPFPPVPTVTTSSATLSTVIATVASSPAGYKTASPPGPPPYGKRAPSPGAYKTATPPGYKPGSPPSFRTGTPPGYRGTSPPAGPGTFKPGSPTVGPGPLPPAGPSGLPSLPPPPAAPASGPPLSATQIKQEPAEEYETPESPVPPARSPSPPPKVVDVPSHASQSARFNKHLDRGFNSCARSDLYFVPLEGSKLAKKRADLVEKVRREAEQRAREEKEREREREREKEREREKERELERSVKLAQEGRAPVECPSLGPVPHRPPFEPGSAVATVPPYLGPDTPALRTLSEYARPHVMSPGNRNHPFYVPLGAVDPGLLGYNVPALYSSDPAAREREREARERDLRDRLKPGFEVKPSELEPLHGVPGPGLDPFPRHGGLALQPGPPGLHPFPFHPSLGPLERERLALAAGPALRPDMSYAERLAAERQHAERVAALGNDPLARLQMLNVTPHHHQHSHIHSHLHLHQQDAIHAASASVHPLIDPLASGSHLTRIPYPAGTLPNPLLPHPLHENEVLRHQLFAAPYRDLPASLSAPMSAAHQLQAMHAQSAELQRLALEQQQWLHAHHPLHSVPLPAQEDYYSHLKKESDKPL

SEQ ID NO: 890860 - protein, 1189 aa, Homo sapiens; identical to SEQ ID NO: 890859

SEQ ID NO: 890861 - protein, 1283 aa, Homo sapiens
MKTRQNKDSMSMRSGRKKEAPGPREELRSRGRASPGGVSTSSSDGKAEKSRQTAKKARVEEASTPKVNKQGRSEEISESESEETNAPKKTKTEQELPRPQSPSDLDSLDGRSLNDDGSSDPRDIDQDNRSTSPSIYSPGSVENDSDSSSGLSQGPARPYHPPPLFPPSPQPPDSTPRQPEASFEPHPSVTPTGYHAPMEPPTSRMFQAPPGAPPPHPQLYPGGTGGVLSGPPMGPKGGGAASSVGGPNGGKQHPPPTTPISVSSSGASGAPPTKPPTTPVGGGNLPSAPPPANFPHVTPNLPPPPALRPLNNASASPPGLGAQPLPGHLPSPHAMGQGMGGLPPGPEKGPTLAPSPHSLPPASSSAPAPPMRFPYSSSSSSSAAASSSSSSSSSSASPFPASQALPSYPHSFPPPTSLSVSNQPPKYTQPSLPSQAVWSQGPPPPPPYGRLLANSNAHPGPFPPSTGAQSTAHPPVSTHHHHHQQQQQQQQQQQQQQQQQQHHGNSGPPPPGAFPHPLEGGSSHHAHPYAMSPSLGSLRPYPPGPAHLPPPHSQVSYSQAGPNGPPVSSSSNSSSSTSQGSYPCSHPSPSQGPQGAPYPFPPVPTVTTSSATLSTVIATVASSPAGYKTASPPGPPPYGKRAPSPGAYKTATPPGYKPGSPPSFRTGTPPGYRGTSPPAGPGTFKPGSPTVGPGPLPPAGPSGLPSLPPPPAAPASGPPLSATQIKQEPAEEYETPESPVPPARSPSPPPKVVDVPSHASQSASERPGGAEVGLERGRRQGGDERGSSREEALRWCSVLEKHAPLLRPGLVASEARSSSQPAGVVLRRGLQALAGAAALRAPSGSSHRLSARCFQPGRFNKHLDRGFNSCARSDLYFVPLEGSKLAKKRADLVEKVRREAEQRAREEKEREREREREKEREREKERELERSVKLAQEGRAPVECPSLGPVPHRPPFEPGSAVATVPPYLGPDTPALRTLSEYARPHVMSPGNRNHPFYVPLGAVDPGLLGYNVPALYSSDPAAREREREARERDLRDRLKPGFEVKPSELEPLHGVPGPGLDPFPRHGGLALQPGPPGLHPFPFHPSLGPLERERLALAAGPALRPDMSYAERLAAERQHAERVAALGNDPLARLQMLNVTPHHHQHSHIHSHLHLHQQDAIHAASASVHPLIDPLASGSHLTRIPYPAGTLPNPLLPHPLHENEVLRHQLFAAPYRDLPASLSAPMSAAHQLQAMHAQSAELQRLALEQQQWLHAHHPLHSVPLPAQEDYYSHLKKESDKPL

SEQ ID NO: 890862 - protein, 1277 aa, Homo sapiens
MKTRQNKDSMSMRSGRKKEAPGPREELRSRGRASPGGVSTSSSDGKAEKSRQTAKKARVEEASTPKVNKQGRSEEISESESEETNAPKKTKTEQELPRPQSPSDLDSLDGRSLNDDGSSDPRDIDQDNRSTSPSIYSPGSVENDSDSSSGLSQGPARPYHPPPLFPPSPQPPDSTPRQPEASFEPHPSVTPTGYHAPMEPPTSRMFQAPPGAPPPHPQLYPGGTGGVLSGPPMGPKGGGAASSVGGPNGGKQHPPPTTPISVSSSGASGAPPTKPPTTPVGGGNLPSAPPPANFPHVTPNLPPPPALRPLNNASASPPGLGAQPLPGHLPSPHAMGQGMGGLPPGPEKGPTLAPSPHSLPPASSSAPAPPMRFPYSSSSSSSAAASSSSSSSSSSASPFPASQALPSYPHSFPPPTSLSVSNQPPKYTQPSLPSQAVWSQGPPPPPPYGRLLANSNAHPGPFPPSTGAQSTAHPPVSTHHHHHQQQQQQQQQQQQHHGNSGPPPPGAFPHPLEGGSSHHAHPYAMSPSLGSLRPYPPGPAHLPPPHSQVSYSQAGPNGPPVSSSSNSSSSTSQGSYPCSHPSPSQGPQGAPYPFPPVPTVTTSSATLSTVIATVASSPAGYKTASPPGPPPYGKRAPSPGAYKTATPPGYKPGSPPSFRTGTPPGYRGTSPPAGPGTFKPGSPTVGPGPLPPAGPSGLPSLPPPPAAPASGPPLSATQIKQEPAEEYETPESPVPPARSPSPPPKVVDVPSHASQSASERPGGAEVGLERGRRQGGDERGSSREEALRWCSVLEKHAPLLRPGLVASEARSSSQPAGVVLRRGLQALAGAAALRAPSGSSHRLSARCFQPGRFNKHLDRGFNSCARSDLYFVPLEGSKLAKKRADLVEKVRREAEQRAREEKEREREREREKEREREKERELERSVKLAQEGRAPVECPSLGPVPHRPPFEPGSAVATVPPYLGPDTPALRTLSEYARPHVMSPGNRNHPFYVPLGAVDPGLLGYNVPALYSSDPAAREREREARERDLRDRLKPGFEVKPSELEPLHGVPGPGLDPFPRHGGLALQPGPPGLHPFPFHPSLGPLERERLALAAGPALRPDMSYAERLAAERQHAERVAALGNDPLARLQMLNVTPHHHQHSHIHSHLHLHQQDAIHAASASVHPLIDPLASGSHLTRIPYPAGTLPNPLLPHPLHENEVLRHQLFAAPYRDLPASLSAPMSAAHQLQAMHAQSAELQRLALEQQQWLHAHHPLHSVPLPAQEDYYSHLKKESDKPL

SEQ ID NO: 890863 - protein, 1086 aa, Homo sapiens
MEPPTSRMFQAPPGAPPPHPQLYPGGTGGVLSGPPMGPKGGGAASSVGGPNGGKQHPPPTTPISVSSSGASGAPPTKPPTTPVGGGNLPSAPPPANFPHVTPNLPPPPALRPLNNASASPPGLGAQPLPGHLPSPHAMGQGMGGLPPGPEKGPTLAPSPHSLPPASSSAPAPPMRFPYSSSSSSSAAASSSSSSSSSSASPFPASQALPSYPHSFPPPTSLSVSNQPPKYTQPSLPSQAVWSQGPPPPPPYGRLLANSNAHPGPFPPSTGAQSTAHPPVSTHHHHHQQQQQQQQQQQQQQQQQQHHGNSGPPPPGAFPHPLEGGSSHHAHPYAMSPSLGSLRPYPPGPAHLPPPHSQVSYSQAGPNGPPVSSSSNSSSSTSQGSYPCSHPSPSQGPQGAPYPFPPVPTVTTSSATLSTVIATVASSPAGYKTASPPGPPPYGKRAPSPGAYKTATPPGYKPGSPPSFRTGTPPGYRGTSPPAGPGTFKPGSPTVGPGPLPPAGPSGLPSLPPPPAAPASGPPLSATQIKQEPAEEYETPESPVPPARSPSPPPKVVDVPSHASQSASERPGGAEVGLERGRRQGGDERGSSREEALRWCSVLEKHAPLLRPGLVASEARSSSQPAGVVLRRGLQALAGAAALRAPSGSSHRLSARCFQPGRFNKHLDRGFNSCARSDLYFVPLEGSKLAKKRADLVEKVRREAEQRAREEKEREREREREKEREREKERELERSVKLAQEGRAPVECPSLGPVPHRPPFEPGSAVATVPPYLGPDTPALRTLSEYARPHVMSPGNRNHPFYVPLGAVDPGLLGYNVPALYSSDPAAREREREARERDLRDRLKPGFEVKPSELEPLHGVPGPGLDPFPRHGGLALQPGPPGLHPFPFHPSLGPLERERLALAAGPALRPDMSYAERLAAERQHAERVAALGNDPLARLQMLNVTPHHHQHSHIHSHLHLHQQDAIHAASASVHPLIDPLASGSHLTRIPYPAGTLPNPLLPHPLHENEVLRHQLFAAPYRDLPASLSAPMSAAHQLQAMHAQSAELQRLALEQQQWLHAHHPLHSVPLPAQEDYYSHLKKESDKPL

SEQ ID NO: 890864 - protein, 1231 aa, Homo sapiens
MKTRQNKDSMSMRSGRKKEAPGPREELRSRGRASPGGVSTSSSDGKAEKSRQTAKKARVEEASTPKVNKQGRSEEISESESEETNAPKKTKTEQELPRPQSPSDLDSLDGRSLNDDGSSDPRDIDQDNRSTSPSIYSPGSVENDSDSSSGLSQGPARPYHPPPLFPPSPQPPDSTPRQPEASFEPHPSVTPTGYHAPGKQHPPPTTPISVSSSGASGAPPTKPPTTPVGGGNLPSAPPPANFPHVTPNLPPPPALRPLNNASASPPGLGAQPLPGHLPSPHAMGQGMGGLPPGPEKGPTLAPSPHSLPPASSSAPAPPMRFPYSSSSSSSAAASSSSSSSSSSASPFPASQALPSYPHSFPPPTSLSVSNQPPKYTQPSLPSQAVWSQGPPPPPPYGRLLANSNAHPGPFPPSTGAQSTAHPPVSTHHHHHQQQQQQQQQQQQQQQQQQHHGNSGPPPPGAFPHPLEGGSSHHAHPYAMSPSLGSLRPYPPGPAHLPPPHSQVSYSQAGPNGPPVSSSSNSSSSTSQGSYPCSHPSPSQGPQGAPYPFPPVPTVTTSSATLSTVIATVASSPAGYKTASPPGPPPYGKRAPSPGAYKTATPPGYKPGSPPSFRTGTPPGYRGTSPPAGPGTFKPGSPTVGPGPLPPAGPSGLPSLPPPPAAPASGPPLSATQIKQEPAEEYETPESPVPPARSPSPPPKVVDVPSHASQSASERPGGAEVGLERGRRQGGDERGSSREEALRWCSVLEKHAPLLRPGLVASEARSSSQPAGVVLRRGLQALAGAAALRAPSGSSHRLSARCFQPGRFNKHLDRGFNSCARSDLYFVPLEGSKLAKKRADLVEKVRREAEQRAREEKEREREREREKEREREKERELERSVKLAQEGRAPVECPSLGPVPHRPPFEPGSAVATVPPYLGPDTPALRTLSEYARPHVMSPGNRNHPFYVPLGAVDPGLLGYNVPALYSSDPAAREREREARERDLRDRLKPGFEVKPSELEPLHGVPGPGLDPFPRHGGLALQPGPPGLHPFPFHPSLGPLERERLALAAGPALRPDMSYAERLAAERQHAERVAALGNDPLARLQMLNVTPHHHQHSHIHSHLHLHQQDAIHAASASVHPLIDPLASGSHLTRIPYPAGTLPNPLLPHPLHENEVLRHQLFAAPYRDLPASLSAPMSAAHQLQAMHAQSAELQRLALEQQQWLHAHHPLHSVPLPAQEDYYSHLKKESDKPL

SEQ ID NO: 890865 - protein, 753 aa, Homo sapiens
MSPSLGSLRPYPPGPAHLPPPHSQVSYSQAGPNGPPVSSSSNSSSSTSQGSYPCSHPSPSQGPQGAPYPFPPVPTVTTSSATLSTVIATVASSPAGYKTASPPGPPPYGKRAPSPGAYKTATPPGYKPGSPPSFRTGTPPGYRGTSPPAGPGTFKPGSPTVGPGPLPPAGPSGLPSLPPPPAAPASGPPLSATQIKQEPAEEYETPESPVPPARSPSPPPKVVDVPSHASQSASERPGGAEVGLERGRRQGGDERGSSREEALRWCSVLEKHAPLLRPGLVASEARSSSQPAGVVLRRGLQALAGAAALRAPSGSSHRLSARCFQPGRFNKHLDRGFNSCARSDLYFVPLEGSKLAKKRADLVEKVRREAEQRAREEKEREREREREKEREREKERELERSVKLAQEGRAPVECPSLGPVPHRPPFEPGSAVATVPPYLGPDTPALRTLSEYARPHVMSPGNRNHPFYVPLGAVDPGLLGYNVPALYSSDPAAREREREARERDLRDRLKPGFEVKPSELEPLHGVPGPGLDPFPRHGGLALQPGPPGLHPFPFHPSLGPLERERLALAAGPALRPDMSYAERLAAERQHAERVAALGNDPLARLQMLNVTPHHHQHSHIHSHLHLHQQDAIHAASASVHPLIDPLASGSHLTRIPYPAGTLPNPLLPHPLHENEVLRHQLFAAPYRDLPASLSAPMSAAHQLQAMHAQSAELQRLALEQQQWLHAHHPLHSVPLPAQEDYYSHLKKESDKPL

SEQ ID NO: 890866 - protein, 1149 aa, Homo sapiens
MKTRQNKDSMSMRSGRKKEAPGPREELRSRGRASPGGVSTSSSDGKAEKSRQTAKKARVEEASTPKVNKQGRSEEISESESEETNAPKKTKTEQELPRPQSPSDLDSLDGRSLNDDGSSDPRDIDQDNRSTSPSIYSPGSVENDSDSSSGLSQGPARPYHPPPLFPPSPQPPDSTPRQPEASFEPHPSVTPTGYHAPMEPPTSRMFQAPPGAPPPHPQLYPGGTGGVLSGPPMGPKGGGAASSVGGPNGGKQHPPPTTPISVSSSGASGAPPTKPPTTPVGGGNLPSAPPPANFPHVTPNLPPPPALRPLNNASASPPGLGAQPLPGHLPSPHAMGQGMGGLPPGPEKGPTLAPSPHSLPPASSSAPAPPMRFPYSSSSSSSAAASSSSSSSSSSASPFPASQALPSYPHSFPPPTSLSVSNQPPKYTQPSLPSQAVWSQGPPPPPPYGRLLANSNAHPGPFPPSTGAQSTAHPPVSTHHHHHQQQQQQQQQQQQQQQQQQHHGNSGPPPPGAFPHPLEGGSSHHAHPYAMSPSLGSLRPYPPGPAHLPPPHSQVSYSQAGPNGPPVSSSSNSSSSTSQGSYPCSHPSPSQGPQGAPYPFPPVPTVTTSSATLSTVIATVASSPAGYKTASPPGPPPYGKRAPSPGAYKTATPPGYKPGSPPSFRTGTPPGYRGTSPPAGPGTFKPGSPTVGPGPLPPAGPSGLPSLPPPPAAPASGPPLSATQIKQEPAEEYETPESPVPPARSPSPPPKVVDVPSHASQSASERPGGAEVGLERGRRQGGDERGSSREEALRWCSVLEKHAPLLRPGLVASEARSSSQPAGVVLRRGLQALAGAAALRAPSGSSHRLSARCFQPGRFNKHLDRGFNSCARSDLYFVPLEGSKLAKKRADLVEKVRREAEQRAREEKEREREREREKEREREKERELERSVKLAQEGRAPVECPSLGPVPHRPPFEPGSAVATVPPYLGPDTPALRTLSEYARPHVMSPGNRNHPFYVPLGAVDPGLLGYNVPALYSSDPAAREREREARERDLRDRLKPGFEVKPSELEPLHGVPGPGLDPFPRHGGLALQPGPPGLHPFPFHPSLGPLERERLALAAGPALRPDMSYAERLAGDSPSPPALPHPLAPAPAPARCYPCSLCLGAPSH

SEQ ID NO: 890867 - protein, 457 aa, Homo sapiens
KFQRIPIQHFLPPGYKIEVQTNDMVNVTTPWQVHQIPTHGIQPQPQPPPQHPSQPSAQSAPAPAQPAPQPPPAKVSKPSQPHHREREREREKEREREKERELERSVKLAQEGRAPVECPSLGPVPHRPPFEPGSAVATVPPYLGPDTPALRTLSEYARPHVMSPGNRNHPFYVPLGAVDPGLLGYNVPALYSSDPAAREREREARERDLRDRLKPGFEVKPSELEPLHGVPGPGLDPFPRHGGLALQPGPPGLHPFPFHPSLGPLERERLALAAGPALRPDMSYAERLAAERQHAERVAALGNDPLARLQMLNVTPHHHQHSHIHSHLHLHQQDAIHAASASVHPLIDPLASGSHLTRIPYPAGTLPNPLLPHPLHENEVLRHQLFAAPYRDLPASLSAPMSAAHQLQAMHAQSAELQRLALEQQQWLHAHHPLHSVPLPAQEDYYSHLKKESDKPL

SEQ ID NO: 890868 - protein, 1283 aa, Homo sapiens; identical to SEQ ID NO: 890861

SEQ ID NO: 890869 - protein, 1142 aa, Homo sapiens
MKTRQNKDSMSMRSGRKKEAPGPREELRSRGRASPGGVSTSSSDGKAEKSRQTAKKARVEEASTPKVNKQGRSEEISESESEETNAPKKTKTEQELPRPQSPSDLDSLDGRSLNDDGSSDPRDIDQDNRSTSPSIYSPGSVENDSDSSSGLSQGPARPYHPPPLFPPSPQPPDSTPRQPEASFEPHPSVTPTGYHAPMEPPTSRMFQAPPGAPPPHPQLYPGGTGGVLSGPPMGPKGGGAASSVGGPNGGKQHPPPTTPISVSSSGASGAPPTKPPTTPVGGGNLPSAPPPANFPHVTPNLPPPPALRPLNNASASPPGLGAQPLPGHLPSPHAMGQGMGGLPPGPEKGPTLAPSPHSLPPASSSAPAPPMRFPYSSSSSSSAAASSSSSSSSSSASPFPASQALPSYPHSFPPPTSLSVSNQPPKYTQPSLPSQAVWSQGPPPPPPYGRLLANSNAHPGPFPPSTGAQSTAHPPVSTHHHHHQQQQQQQQQQQQQQQQQQHHGNSGPPPPGAFPHPLEGGSSHHAHPYAMSPSLGSLRPYPPGPAHLPPPHSQVSYSQAGPNGPPVSSSSNSSSSTSQGSYPCSHPSPSQGPQGAPYPFPPVPTVTTSSATLSTVIATVASSPAGYKTASPPGPPPYGKRAPSPGAYKTATPPGYKPGSPPSFRTGTPPGYRGTSPPAGPGTFKPGSPTVGPGPLPPAGPSGLPSLPPPPAAPASGPPLSATQIKQEPAEEYETPESPVPPARSPSPPPKVVDVPSHASQSASERPGGAEVGLERGRRQGGDERGSSREEALRWCSVLEKHAPLLRPGLVASEARSSSQPAGVVLRRGLQALAGAAALRAPSGSSHRLSARCFQPGRFNKHLDRGFNSCARSDLYFVPLEGSKLAKKRADLVEKVRREAEQRAREEKEREREREREKEREREKERELERSVKLAQEGRAPVECPSLGPVPHRPPFEPGSAVATVPPYLGPDTPALRTLSEYARPHVMSPGNRNHPFYVPLGAVDPGLLGYNVPALYSSDPAAREREREARERDLRDRLKPGFEVKPSELEPLHGVPGPGLDPFPRHGGLALQPGPPGLHPFPFHPSLGPLERERLALAAGPALRPDMSYAERLAAERQHAERVAALGNDPLARLQMLNNSP

SEQ ID NO: 890870 - protein, 293 aa, Homo sapiens
TRARAVTYWFSEALVLGGESIELRGDWIPGTPRKQERVVSRTSLDMRGASAAWHTKPSELEPLHGVPGPGLDPFPRHGGLALQPGPPGLHPFPFHPSLGPLERERLALAAGPALRPDMSYAERLAAERQHAERVAALGNDPLARLQMLNVTPHHHQHSHIHSHLHLHQQDAIHAASASVHPLIDPLASGSHLTRIPYPAGTLPNPLLPHPLHENEVLRHQLFAAPYRDLPASLSAPMSAAHQLQAMHAQSAELQRLALEQQQWLHAHHPLHSVPLPAQEDYYSHLKKESDKPL

SEQ ID NO: 890871 - protein, 213 aa, Homo sapiens
GALELQEARVMLVPLVNLGPLERERLALAAGPALRPDMSYAERLAAERQHAERVAALGNDPLARLQMLNVTPHHHQHSHIHSHLHLHQQDAIHAASASVHPLIDPLASGSHLTRIPYPAGTLPNPLLPHPLHENEVLRHQLFAAPYRDLPASLSAPMSAAHQLQAMHAQSAELQRLALEQQQWLHAHHPLHSVPLPAQEDYYSHLKKESDKPL

SEQ ID NO: 890872 - protein, 115 aa, Homo sapiens
MLSMQPLPRCTLSLTPWPQGLTLPGSPTQLELSLTPCFLTLCTRTKFFVTSSLLPLTGTCRPPFLPRCQQLISCRPCTHSQLSCSAWRWNSSSGCMPITRCTVCRCLPRRTTTVT

SEQ ID NO: 890873 - protein, 133 aa, Homo sapiens
MHRSPSKLLAPASAASASVHPLIDPLASGSHLTRIPYPAGTLPNPLLPHPLHENEVLRHQLFAAPYRDLPASLSAPMSAAHQLQAMHAQSAELQRLALEQQQWLHAHHPLHSVPLPAQEDYYSHLKKESDKPL

SEQ ID NO: 890874 - protein, 1151 aa, Homo sapiens
MKTRQNKDSMSMRSGRKKEAPGPREELRSRGRASPGGVSTSSSDGKAEKSRQTAKKARVEEASTPKVNKQGRSEEISESESEETNAPKKTKTEQELPRPQSPSDLDSLDGRSLNDDGSSDPRDIDQDNRSTSPSIYSPGSVENDSDSSSGLSQGPARPYHPPPLFPPSPQPPDSTPRQPEASFEPHPSVTPTGYHAPMEPPTSRMFQAPPGAPPPHPQLYPGGTGGVLSGPPMGPKGGGAASSVGGPNGGKQHPPPTTPISVSSSGASGAPPTKPPTTPVGGGNLPSAPPPANFPHVTPNLPPPPALRPLNNASASPPGLGAQPLPGHLPSPHAMGQGMGGLPPGPEKGPTLAPSPHSLPPASSSAPAPPMRFPYSSSSSSSAAASSSSSSSSSSASPFPASQALPSYPHSFPPPTSLSVSNQPPKYTQPSLPSQAVWSQGPPPPPPYGRLLANSNAHPGPFPPSTGAQSTAHPPVSTHHHHHQQQQQQQQQQQQQQQQQQHHGNSGPPPPGAFPHPLEGGSSHHAHPYAMSPSLGSLRPYPPGPAHLPPPHSQVSYSQAGPNGPPVSSSSNSSSSTSQGSYPCSHPSPSQGPQGAPYPFPPVPTVTTSSATLSTVIATVASSPAGYKTASPPGPPPYGKRAPSPGAYKTATPPGYKPGSPPSFRTGTPPGYRGTSPPAGPGTFKPGSPTVGPGPLPPAGPSGLPSLPPPPAAPASGPPLSATQIKQEPAEEYETPESPVPPARSPSPPPKVVDVPSHASQSASERPGGAEVGLERGRRQGGDERGSSREEALRWCSVLEKHAPLLRPGLVASEARSSSQPAGVVLRRGLQALAGAAALRAPSGSSHRLSARCFQPGRFNKHLDRGFNSCARSDLYFVPLEGSKLAKKRADLVEKVRREAEQRAREEKEREREREREKEREREKERELERSVKLAQEGRAPVECPSLGPVPHRPPFEPGSAVATVPPYLGPDTPALRTLSEYARPHVMSPGNRNHPFYVPLGAVDPGLLGYNVPALYSSDPAAREREREARERDLRDRLKPGFEVKPSELEPLHGVPGPGLDPFPRHGGLALQPGPPGLHPFPFHPSLGPLERERLALAAGPALRPDMSYAERLAAERQHAERVAALGNDPLARLQMLNPPLPRWCDYFIC

SEQ ID NO: 890875 - protein, 926 aa, Homo sapiens
MKTRQNKDSMSMRSGRKKEAPGPREELRSRGRASPGGVSTSSSDGKAEKSRQTAKKARVEEASTPKVNKQGRSEEISESESEETNAPKKTKTEQELPRPQSPSDLDSLDGRSLNDDGSSDPRDIDQDNRSTSPSIYSPGSVENDSDSSSGLSQGPARPYHPPPLFPPSPQPPDSTPRQPEASFEPHPSVTPTGYHAPMEPPTSRMFQAPPGAPPPHPQLYPGGTGGVLSGPPMGPKGGGAASSVGGPNGGKQHPPPTTPISVSSSGASGAPPTKPPTTPVGGGNLPSAPPPANFPHVTPNLPPPPALRPLNNASASPPGLGAQPLPGHLPSPHAMGQGMGGLPPGPEKGPTLAPSPHSLPPASSSAPAPPMRFPYSSSSSSSAAASSSSSSSSSSASPFPASQALPSYPHSFPPPTSLSVSNQPPKYTQPSLPSQAVWSQGPPPPPPYGRLLANSNAHPGPFPPSTGAQSTAHPPVSTHHHHHQQQQQQQQQQQQQQQQQQHHGNSGPPPPGAFPHPLEGGSSHHAHPYAMSPSLGSLRPYPPGPAHLPPPHSQVSYSQAGPNGPPVSSSSNSSSSTSQGSYPCSHPSPSQGPQGAPYPFPPVPTVTTSSATLSTVIATVASSPAGYKTASPPGPPPYGKRAPSPGAYKTATPPGYKPGSPPSFRTGTPPGYRGTSPPAGPGTFKPGSPTVGPGPLPPAGPSGLPSLPPPPAAPASGPPLSATQIKQEPAEEYETPESPVPPARSPSPPPKVVDVPSHASQSARFNKHLDRGFNSCARSDLYFVPLEGSKLAKKRADLVEKVRREAEQRAREEKEREREREREKEREREKERELERSVKLAQEGRAPVECPSLGPVPHRPPFEPGSAVATVPPYLGPDTPALRTLSEYARPHVMSPGNRKSDHVCPGQWVPIVLILSPSPQLGPRA

SEQ ID NO: 890876 - protein, 682 aa, Homo sapiens
MKTRQNKDSMSMRSGRKKEAPGPREELRSRGRASPGGVSTSSSDGKAEKSRQTAKKARVEEASTPKVNKQGRSEEISESESEETNAPKKTKTEQELPRPQSPSDLDSLDGRSLNDDGSSDPRDIDQDNRSTSPSIYSPGSVENDSDSSSGLSQGPARPYHPPPLFPPSPQPPDSTPRQPEASFEPHPSVTPTGYHAPMEPPTSRMFQAPPGAPPPHPQLYPGGTGGVLSGPPMGPKGGGAASSVGGPNGGKQHPPPTTPISVSSSGASGAPPTKPPTTPVGGGNLPSAPPPANFPHVTPNLPPPPALRPLNNASASPPGLGAQPLPGHLPSPHAMGQGMGGLPPGPEKGPTLAPSPHSLPPASSSAPAPPMRFPYSSSSSSSAAASSSSSSSSSSASPFPASQALPSYPHSFPPPTSLSVSNQPPKYTQPSLPSQAVWSQGPPPPPPYGRLLANSNAHPGPFPPSTGAQSTAHPPVSTHHHHHQQQQQQQQQQQQQQQQQQHHGNSGPPPPGAFPHPLEGGSSHHAHPYAMSPSLGSLRPYPPGPAHLPPPHSQVSYSQAGPNGPPVSSSSNSSSSTSQGSYPCSHPSPSQGPQGAPYPFPPVPTVTTSSATLSTVIATVASSPAGYKTASPPGPPPYGKRAPSPGAYKTATPQRERRRSLCGGVWSEQEQLKQRWARRITA

SEQ ID NO: 890877 - protein, 637 aa, Homo sapiens
MKTRQNKDSMSMRSGRKKEAPGPREELRSRGRASPGGVSTSSSDGKAEKSRQTAKKARVEEASTPKVNKQGRSEEISESESEETNAPKKTKTEQELPRPQSPSDLDSLDGRSLNDDGSSDPRDIDQDNRSTSPSIYSPGSVENDSDSSSGLSQGPARPYHPPPLFPPSPQPPDSTPRQPEASFEPHPSVTPTGYHAPMEPPTSRMFQAPPGAPPPHPQLYPGGTGGVLSGPPMGPKGGGAASSVGGPNGGKQHPPPTTPISVSSSGASGAPPTKPPTTPVGGGNLPSAPPPANFPHVTPNLPPPPALRPLNNASASPPGLGAQPLPGHLPSPHAMGQGMGGLPPGPEKGPTLAPSPHSLPPASSSAPAPPMRFPYSSSSSSSAAASSSSSSSSSSASPFPASQALPSYPHSFPPPTSLSVSNQPPKYTQPSLPSQAVWSQGPPPPPPYGRLLANSNAHPGPFPPSTGAQSTAHPPVSTHHHHHQQQQQQQQQQQQQQQQQQHHGNSGPPPPGAFPHPLEGGSSHHAHPYAMSPSLGSLRPYPPGPAHLPPPHSQVSYSQAGPNGPPVSSSSNSSSSTSQGSYPCSHPSPSQGPQGAPYPFPPVPTVTTSSATLSTVIATVARVAEEVVDRRTPGCEV

SEQ ID NO: 890878 - protein, 650 aa, Homo sapiens
MKTRQNKDSMSMRSGRKKEAPGPREELRSRGRASPGGVSTSSSDGKAEKSRQTAKKARVEEASTPKVNKQGRSEEISESESEETNAPKKTKTEQELPRPQSPSDLDSLDGRSLNDDGSSDPRDIDQDNRSTSPSIYSPGSVENDSDSSSGLSQGPARPYHPPPLFPPSPQPPDSTPRQPEASFEPHPSVTPTGYHAPMEPPTSRMFQAPPGAPPPHPQLYPGGTGGVLSGPPMGPKGGGAASSVGGPNGGKQHPPPTTPISVSSSGASGAPPTKPPTTPVGGGNLPSAPPPANFPHVTPNLPPPPALRPLNNASASPPGLGAQPLPGHLPSPHAMGQGMGGLPPGPEKGPTLAPSPHSLPPASSSAPAPPMRFPYSSSSSSSAAASSSSSSSSSSASPFPASQALPSYPHSFPPPTSLSVSNQPPKYTQPSLPSQAVWSQGPPPPPPYGRLLANSNAHPGPFPPSTGAQSTAHPPVSTHHHHHQQQQQQQQQQQQQQQQQQHHGNSGPPPPGAFPHPLEGGSSHHAHPYAMSPSLGSLRPYPPGPAHLPPPHSQVSYSQAAAAAAAAAAAAASSITETSWGPPHMPMRLGKSKLVYAANAASVGSGPETQGLTPPQTGPTPPPCKRTRRVCGPPPTPHGGWFGQWKAGPP

SEQ ID NO: 890879 - protein, 546 aa, Homo sapiens
MKTRQNKDSMSMRSGRKKEAPGPREELRSRGRASPGGVSTSSSDGKAEKSRQTAKKARVEEASTPKVNKQGRSEEISESESEETNAPKKTKTEQELPRPQSPSDLDSLDGRSLNDDGSSDPRDIDQDNRSTSPSIYSPGSVENDSDSSSGLSQGPARPYHPPPLFPPSPQPPDSTPRQPEASFEPHPSVTPTGYHAPMEPPTSRMFQAPPGAPPPHPQLYPGGTGGVLSGPPMGPKGGGAASSVGGPNGGKQHPPPTTPISVSSSGASGAPPTKPPTTPVGGGNLPSAPPPANFPHVTPNLPPPPALRPLNNASASPPGLGAQPLPGHLPSPHAMGQGMGGLPPGPEKGPTLAPSPHSLPPASSSAPAPPMRFPYSSSSSSSAAASSSSSSSSSSASPFPASQALPSYPHSFPPPTSLSVSNQPPKYTQPSLPSQAVWSQGPPPPPPYGRLLANSNAHPGPFPPSTGAQSTAHPPVSTHHHHHQQQQQQQQQQQQHHGNSGPPPPGAFPHPLEGGSSHHAHPYAMSPSLGSLRPYPPGPAHLPPQS

SEQ ID NO: 890880 - protein, 585 aa, Homo sapiens
MKTRQNKDSMSMRSGRKKEAPGPREELRSRGRASPGGVSTSSSDGKAEKSRQTAKKARVEEASTPKVNKQGRSEEISESESEETNAPKKTKTEQELPRPQSPSDLDSLDGRSLNDDGSSDPRDIDQDNRSTSPSIYSPGSVENDSDSSSGLSQGPARPYHPPPLFPPSPQPPDSTPRQPEASFEPHPSVTPTGYHAPMEPPTSRMFQAPPGAPPPHPQLYPGGTGGVLSGPPMGPKGGGAASSVGGPNGGKQHPPPTTPISVSSSGASGAPPTKPPTTPVGGGNLPSAPPPANFPHVTPNLPPPPALRPLNNASASPPGLGAQPLPGHLPSPHAMGQGMGGLPPGPEKGPTLAPSPHSLPPASSSAPAPPMRFPYSSSSSSSAAASSSSSSSSSSASPFPASQALPSYPHSFPPPTSLSVSNQPPKYTQPSLPSQAVWSQGPPPPPPYGRLLANSNAHPGPFPPSTGAQSTAHPPVSTHHHHHQQQQQQQQQQQQQQQQQQQQQQQPAALTETSWGPPHMPMRLGKSKLVYAANPRAWEAGPRLRASPHRKPDPRPRRVSGHDGCAVRPLRPMGAGSVSGKRAPL

SEQ ID NO: 890881 - protein, 442 aa, Homo sapiens
MKTRQNKDSMSMRSGRKKEAPGPREELRSRGRASPGGVSTSSSDGKAEKSRQTAKKARVEEASTPKVNKQGRSEEISESESEETNAPKKTKTEQELPRPQSPSDLDSLDGRSLNDDGSSDPRDIDQDNRSTSPSIYSPGSVENDSDSSSGLSQGPARPYHPPPLFPPSPQPPDSTPRQPEASFEPHPSVTPTGYHAPMEPPTSRMFQAPPGAPPPHPQLYPGGTGGVLSGPPMGPKGGGAASSVGGPNGGKQHPPPTTPISVSSSGASGAPPTKPPTTPVGGGNLPSAPPPANFPHVTPNLPPPPALRPLNNASASPPGLGAQPLPGHLPSPHAMGQGMGGLPPGPEKGPTLAPSPHSLPPASSSAPAPPMRFPYSSSSSSSAAASSSSSSSSSSASPFPASQALPSYPHSFPPPTSLSVSNQPPASVTHPSSCHKCFLSTH

SEQ ID NO: 890882 - protein, 399 aa, Homo sapiens
MKTRQNKDSMSMRSGRKKEAPGPREELRSRGRASPGGVSTSSSDGKAEKSRQTAKKARVEEASTPKVNKQGRSEEISESESEETNAPKKTKTEQELPRPQSPSDLDSLDGRSLNDDGSSDPRDIDQDNRSTSPSIYSPGSVENDSDSSSGLSQGPARPYHPPPLFPPSPQPPDSTPRQPEASFEPHPSVTPTGYHAPMEPPTSRMFQAPPGAPPPHPQLYPGGTGGVLSGPPMGPKGGGAASSVGGPNGGKQHPPPTTPISVSSSGASGAPPTKPPTTPVGGGNLPSAPPPANFPHVTPNLPPPPALRPLNNASASPPGLGAQPLPGHLPSPHAMGQGMGGLPPGPEKGPTLAPSPHSLPPASSSAPAPPMRFPYSSSSSSSAAASSRVQVILVSEPPK

SEQ ID NO: 890883 - protein, 1445 aa, Homo sapiens
MAYSWQTDPNPNESHEKQYEHQEFLFVNQPHSSSQVSLGFDQIVDEISGKIPHYESEIDENTFFVPTAPKWDSTGHSLNEAHQISLNEFTSKSRELSWHQVSKAPAIGFSPSVLPKPQNTNKECSWGSPIGKHHGADDSRFSILAPSFTSLDKINLEKELENENHNYHIGFESSIPPTNSSFSSDFMPKEENKRSGHVNIVEPSLMLLKGSLQPGMWESTWQKNIESIGCSIQLVEVPQSSNTSLASFCNKVKKIRERYHAADVNFNSGKIWSTTTAFPYQLFSKTKFNIHIFIDNSTQPLHFMPCANYLVKDLIAEILHFCTNDQLLPKDHILSVCGSEEFLQNDHCLGSHKMFQKDKSVIQLHLQKSREAPGKLSRKHEEDHSQFYLNQLLEFMHIWKVSRQCLLTLIRKYDFHLKYLLKTQENVYNIIEEVKKICSVLGCVETKQITDAVNELSLILQRKGENFYQSSETSAKGLIEKVTTELSTSIYQLINVYCNSFYADFQPVNVPRCTSYLNPGLPSHLSFTVYAAHNIPETWVHRINFPLEIKSLPRESMLTVKLFGIACATNNANLLAWTCLPLFPKEKSILGSMLFSMTLQSEPPVEMITPGVWDVSQPSPVTLQIDFPATGWEYMKPDSEENRSNLEEPLKECIKHIARLSQKQTPLLLSEEKKRYLWFYRFYCNNENCSLPLVLGSAPGWDERTVSEMHTILRRWTFSQPLEALGLLTSSFPDQEIRKVAVQQLDNLLNDELLEYLPQLVQAVKFEWNLESPLVQLLLHRSLQSIQVAHRLYWLLKNAENEAYFKSWYQKLLAALQFCAGKALNDEFSKEQKLIKILGDIGERVKSASDHQRQEVLKKEIGRLEEFFQDVNTCHLPLNPALCIKGIDHDACSYFTSNALPLKITFINANLMGKNISIIFKAGDDLRQDMLVLQLIQVMDNIWLQEGLDMQMIIYRCLSTGKDQRLVQMVPDAVTLAKIHRHSGLIGPLKENTIKKWFSQHNHLKADYEKALRNFFYSCAGWCVVTFILGVCDRHNDNIMLTKSGHMFHIDFGKFLGHAQTFGGIKRDRAPFIFTSEMEYFITEGGKNPQHFQDFVELCCRAYNIIRKHSQLLLNLLEMMLYAGLPELSGIQDLKYVYNNLRPQDTDLEATSHFTKKIKESLECFPVKLNNLIHTLAQMSAISPAKSTSQTFPQESCLLSTTRSIERATILGFSKKSSNLYLIQVTHSNNETSLTEKSFEQFSKLHSQLQKQFASLTLPEFPHWWHLPFTNSDHRRFRDLNHYMEQILNVSHEVTNSDCVLSFFLSEAVQQTVESSPVYLGEKKFPDKKPKVQLVISYEDVKLTILVKHMKNIHLPDGSAPSAHVEFYLLPYPSEVRRRKTKSVPKCTDPTYNEIVVYDEVTELQGHVLMLIVKSKTVFVGAINIRLCSVPLDKEKWYPLGNSII

SEQ ID NO: 890884 - protein, 1341 aa, Homo sapiens
MAYSWQTDPNPNESHEKQYEHQEFLFVNQPHSSSQVSLGFDQIVDEISGKIPHYESEIDENTFFVPTAPKWDSTGHSLNEAHQISLNEFTSKSRELSWHQVSKAPAIGFSPSVLPKPQNTNKECSWGSPIGKHHGADDSRFSILAPSFTSLDKINLEKELENENHNYHIGFESSIPPTNSSFSSDFMPKEENKRSGHVNIVEPSLMLLKGSLQPGMWESTWQKNIESIGCSIQLVEVPQSSNTSLASFCNKVKKIRERYHAADVNFNSGKIWSTTTAFPYQLFSKTKFNIHIFIDNSTQPLHFMPCANYLVKDLIAEILHFCTNDQLLPKDHILSVCGSEEFLQNDHCLGSHKMFQKDKSVIQLHLQKSREAPGKLSRKHEEDHSQFYLNQLLEFMHIWKVSRQCLLTLIRKYDFHLKYLLKTQENVYNIIEEVKKICSVLGCVETKQITDAVNELSLILQRKGENFYQSSETSAKGLIEKVTTELSTSIYQLINVYCNSFYADFQPVNVPRCTSYLNPGLPSHLSFTVYAAHNIPETWVHSYKAFSFTCWLTYAGKKLCQVRNYRNIPDKKLFFFLVNWNETINFPLEIKSLPRESMLTVKLFGIACATNNANLLAWTCLPLFPKEKSILGSMLFSMTLQSEPPVEMITPGVWDVSQPSPVTLQIDFPATGWEYMKPDSEENRSNLEEPLKECIKHIARLSQKQTPLLLSEEKKRYLWFYRFYCNNENCSLPLVLGSAPGWDERTVSEMHTILRRWTFSQPLEALGLLTSSFPDQEIRKVAVQQLDNLLNDELLEYLPQLVQAVKFEWNLESPLVQLLLHRSLQSIQVAHRLYWLLKNAENEAYFKSWYQKLLAALQFCAGKALNDEFSKEQKLIKILGDIGERVKSASDHQRQEVLKKEIGRLEEFFQDVNTCHLPLNPALCIKGIDHDACSYFTSNALPLKITFINANLMGKNISIIFKAGDDLRQDMLVLQLIQVMDNIWLQEGLDMQMIIYRCLSTGKDQRLVQMVPDAVTLAKIHRHSGLIGPLKENTIKKWFSQHNHLKADYEKALRNFFYSCAGWCVVTFILGVCDRHNDNIMLTKSGHMFHIDFGKFLGHAQTFGGIKRDRAPFIFTSEMEYFITEGGKNPQHFQDFVELCCRAYNIIRKHSQLLLNLLEMMLYAGLPELSGIQDLKYVYNNLRPQDTDLEATSHFTKKIKESLECFPVKLNNLIHTLAQMSAISPAKSTSQTFPQESCLLSTTRSIERATILGFSKKSSNLYLIQVTHSNNETSLTEKSFEQFSKLHSQLQKQFASLTLPEFPHWWHLPFTNSDHRRFRDLNHYMEQILNVSHEVTNVCYN

SEQ ID NO: 890885 - protein, 638 aa, Homo sapiens
MAYSWQTDPNPNESHEKQYEHQEFLFVNQPHSSSQVSLGFDQIVDEISGKIPHYESEIDENTFFVPTAPKWDSTGHSLNEAHQISLNEFTSKSRELSWHQVSKAPAIGFSPSVLPKPQNTNKECSWGSPIGKHHGADDSRFSILAPSFTSLDKINLEKELENENHNYHIGFESSIPPTNSSFSSDFMPKEENKRSGHVNIVEPSLMLLKGSLQPGMWESTWQKNIESIGCSIQLVEVPQSSNTSLASFCNKVKKIRERYHAADVNFNSGKIWSTTTAFPYQLFSKTKFNIHIFIDNSTQPLHFMPCANYLVKDLIAEILHFCTNDQLLPKDHILSVCGSEEFLQNDHCLGSHKMFQKDKSVIQLHLQKSREAPGKLSRKHEEDHSQFYLNQLLEFMHIWKVSRQCLLTLIRKYDFHLKYLLKTQENVYNIIEEVKKICSVLGCVETKQITDAVNELSLILQRKGENFYQSSETSAKGLIEKVTTELSTSIYQLINVYCNSFYADFQPVNVPRCTSYLNPGLPSHLSFTVYAAHNIPETWVHSYKAFSFTCWLTYAGKKLCQVRNYRNIPDKKLFFFLVNWNETINFPLEIKSLPRESMLTVKLFGIACATNNANLLAWTCLPLFPKESSYTSVFPSHE

SEQ ID NO: 890886 - protein, 1486 aa, Homo sapiens
MAYSWQTDPNPNESHEKQYEHQEFLFVNQPHSSSQVSLGFDQIVDEISGKIPHYESEIDENTFFVPTAPKWDSTGHSLNEAHQISLNEFTSKSRELSWHQVSKAPAIGFSPSVLPKPQNTNKECSWGSPIGKHHGADDSRFSILAPSFTSLDKINLEKELENENHNYHIGFESSIPPTNSSFSSDFMPKEENKRSGHVNIVEPSLMLLKGSLQPGMWESTWQKNIESIGCSIQLVEVPQSSNTSLASFCNKVKKIRERYHAADVNFNSGKIWSTTTAFPYQLFSKTKFNIHIFIDNSTQPLHFMPCANYLVKDLIAEILHFCTNDQLLPKDHILSVCGSEEFLQNDHCLGSHKMFQKDKSVIQLHLQKSREAPGKLSRKHEEDHSQFYLNQLLEFMHIWKVSRQCLLTLIRKYDFHLKYLLKTQENVYNIIEEVKKICSVLGCVETKQITDAVNELSLILQRKGENFYQSSETSAKGLIEKVTTELSTSIYQLINVYCNSFYADFQPVNVPRCTSYLNPGLPSHLSFTVYAAHNIPETWVHSYKAFSFTCWLTYAGKKLCQVRNYRNIPDKKLFFFLVNWNETINFPLEIKSLPRESMLTVKLFGIACATNNANLLAWTCLPLFPKEKSILGSMLFSMTLQSEPPVEMITPGVWDVSQPSPVTLQIDFPATGWEYMKPDSEENRSNLEEPLKECIKHIARLSQKQTPLLLSEEKKRYLWFYRFYCNNENCSLPLVLGSAPGWDERTVSEMHTILRRWTFSQPLEALGLLTSSFPDQEIRKVAVQQLDNLLNDELLEYLPQLVQAVKFEWNLESPLVQLLLHRSLQSIQVAHRLYWLLKNAENEAYFKSWYQKLLAALQFCAGKALNDEFSKEQKLIKILGDIGERVKSASDHQRQEVLKKEIGRLEEFFQDVNTCHLPLNPALCIKGIDHDACSYFTSNALPLKITFINANLMGKNISIIFKAGDDLRQDMLVLQLIQVMDNIWLQEGLDMQMIIYRCLSTGKDQRLVQMVPDAVTLAKIHRHSGLIGPLKENTIKKWFSQHNHLKADYEKALRNFFYSCAGWCVVTFILGVCDRHNDNIMLTKSGHMFHIDFGKFLGHAQTFGGIKRDRAPFIFTSEMEYFITEGGKNPQHFQDFVELCCRAYNIIRKHSQLLLNLLEMMLYAGLPELSGIQDLKYVYNNLRPQDTDLEATSHFTKKIKESLECFPVKLNNLIHTLAQMSAISPAKSTSQTFPQESCLLSTTRSIERATILGFSKKSSNLYLIQVTHSNNETSLTEKSFEQFSKLHSQLQKQFASLTLPEFPHWWHLPFTNSDHRRFRDLNHYMEQILNVSHEVTNSDCVLSFFLSEAVQQTVESSPVYLGEKKFPDKKPKVQLVISYEDVKLTILVKHMKNIHLPDGSAPSAHVEFYLLPYPSEVRRRKTKSVPKCTDPTYNEIVVYDEVTELQGHVLMLIVKSKTVFVGAINIRLCSVPLDKEKWYPLGNSII

SEQ ID NO: 890887 - protein, 712 aa, Homo sapiens
MACTGPSLPSAFDILGAAGQDKLLYLKHKLKTPRPGCQGQDLLHAMVLLKLGQETEARISLEALKADAVARLVARQWAGVDSTEDPEEPPDVSWAVARLYHLLAEEKLCPASLRDVAYQEAVRTLSSRDDHRLGELQDEARNRCGWDIAGDPGSIRTLQSNLGCLPPSSALPSGTRSLPRPIDGVSDWSQGCSLRSTGSPASLASNLEISQSPTMPFLSLHRSPHGPSKLCDDPQASLVPEPVPGGCQEPEEMSWPPSGEIASPPELPSSPPPGLPEVAPDATSTGLPDTPAAPETSTNYPVECTEGSAGPQSLPLPILEPVKNPCSVKDQTPLQLSVEDTTSPNTKPCPPTPTTPETSPPPPPPPPSSTPCSAHLTPSSLFPSSLESSSEQKFYNFVILHARADEHIALRVREKLEALGVPDGATFCEDFQVPGRGELSCLQDAIDHSAFIILLLTSNFDCRLSLHQVNQAMMSNLTRQGSPDCVIPFLPLESSPAQLSSDTASLLSGLVRLDEHSQIFARKVANTFKPHRLQARKAMWRKEQDTRALREQSQHLDGERMQAAALNAAYSAYLQSYLSYQAQMEQLQVAFGSHMSFGTGAPYGARMPFGGQVPLGAPPPFPTWPGCPQPPPLHAWQAGTPPPPSPQPAAFPQSLPFPQSPAFPTASPAPPQSPGLQPLIIHHAQMVQLGLNNHMWNQRGSQAPEDKTQEAE

SEQ ID NO: 890888 - protein, 685 aa, Homo sapiens
MACTGPSLPSAFDILGAAGQDKLLYLKHKLKTPRPGCQGQDLLHAMVLLKLGQETEARISLEALKADAVARLVARQWAGVDSTEDPEEPPDVSWAVARLYHLLAEEKLCPASLRDVAYQEAVRTLSSRDDHRLGELQDEARNRCGWDIAGDPGSIRTLQSNLGCLPPSSALPSGTRSLPRPIDGVSDWSQGCSLRSTGSPASLASNLEISQSPTMPFLSLHRSPHGPSKLCDDPQASLVPEPVPGGCQEPEEMSWPPSGEIASPPELPSSPPPGLPEVAPDATSTGLPDTPAAPETSTNYPVECTEGSAGPQSLPLPILEPVKNPCSVKDQTPLQLSVEDTTSPNTKPCPPTPTTPETSPPPPPPPPSSTPCSAHLTPSSLFPSSLESSSEQKFYNFVILHARADEHIALRVREKLEALGVPDGATFCEDFQVPGRGELSCLQDAIDHSAFIILLLTSNFDCRLSLHQVNQAMMSNLTRQGSPDCVIPFLPLESSPAQLSSDTASLLSGLVRLDEHSQIFARKVANTFKPHRLQARKAMWRKEQDTRALREQSQHLDGERMQAAALNAAYSAYLQSYLSYQAQMEQLQVAFGSHMSFGTGAPYGARMPFGGQVPLGAPPPFPTWPGCPQPPPSPAFPTASPAPPQSPGLQPLIIHHAQMVQLGLNNHMWNQRGSQAPEDKTQEAE

SEQ ID NO: 890889 - protein, 277 aa, Homo sapiens
MACTGPSLPSAFDILGAAGQDKLLYLKHKLKTPRPGCQGQDLLHAMVLLKLGQETEARISLEALKADAVARLVARQWAGVDSTEDPEEPPDVSWAVARLYHLLAEEKLCPASLRDVAYQEAVRTLSSRDDHRLGELQDEARNRCGWDIAGDPGSIRTLQSNLGCLPPSSALPSGTRSLPRPIDGVSDWSQGCSLRSTGSPASLASNLEISQSPTMPFLSLHRSPHGPSKLCDDPQASLVPEPVPGGCQEPEEMSWPPSGEIASPPEHFQDIVREPFI

SEQ ID NO: 890890 - protein, 32 aa, Homo sapiens
MKQTPSPGVTVYESVVVVLYVNACKLDSPSGG

SEQ ID NO: 890891 - protein, 32 aa, Homo sapiens; identical to SEQ ID NO: 890890

SEQ ID NO: 890892 - protein, 729 aa, Homo sapiens
SLFISYSRMPPPCSDSCDFDDPRLLKNIEDRHPTAPCIQEFLTLLAVCHTVVPEKDGDNIIYQASSPDEAALVKGAKKLGFVFTARTPFSVIIEAMGQEQTFGILNVLEFSSDRKRMSVIVRTPSGRLRLYCKGADNVIFERLSKDSKYMEETLCHLEYFATEGLRTLCVAYADLSENEYEEWLKVYQEASTILKDRAQRLEECYEIIEKNLLLLGATAIEDRLQAGVPETIATLLKAEIKIWVLTGDKQETAINIGYSCRLVSQNMALILLKEDSLDATRAAITQHCTDLGNLLGKENDVALIIDGHTLKYALSFEVRRSFLDLALSCKAVICCRVSPLQKSEIVDVVKKRVKAITLAIGDGANDVGMIQTAHVGVGISGNEGMQATNNSDYAIAQFSYLEKLLLVHGAWSYNRVTKCILYCFYKNVVLYIIELWFAFVNGFSGQILFERWCIGLYNVIFTALPPFTLGIFERSCTQESMLRFPQLYKITQNGEGFNTKVFWGHCINALVHSLILFWFPMKALEHDTVLTSGHATDYLFVGNIVYTYVVVTVCLKAGLETTAWTKFSHLAVWGSMLTWLVFFGIYSTIWPTIPIAPDMRGQATMVLSSAHFWLGLFLVPTACLIEDVAWRAAKHTCKKTLLEEVQELETKSRVLGKAVLRDSNGKRLNERDRLIKRLGRKTPPTLFRGSSLQQGVPHGYAFSQEEHGAVSQEEVIRAYDTTKKKSRKK

SEQ ID NO: 890893 - protein, 729 aa, Homo sapiens; identical to SEQ ID NO: 890892

SEQ ID NO: 890894 - protein, 729 aa, Homo sapiens; identical to SEQ ID NO: 890892

SEQ ID NO: 890895 - protein, 325 aa, Homo sapiens
AAWLPGNREAAVPASESLSTMAKFVIAGRADCPYYAKTELVADYLQKNLPDFRIHKITQRPEVWEDWLKDVCEKNKWSHKNSPIIWRELLDRGGKGLLLGGYNEFLEHAQLYYDVTSSMTTELMMVIAQENLGAHIEKEQEEEALKTCINPLQVWITSASAPACYNLIPILTSGEVFGMHTEISITLFDNKQAEEHLKSLVVETQDLASPVLRSVSICTKVEEAFRQAHVIVVLDDSTNKEVFTLEDCLRSRVPLCRLYGYLIEKNAHESVRVIVGGRTFVNLKTVLLMRYAPRIAHNIIAVALGVEGEAKAILARKLKTAPSCE

SEQ ID NO: 890896 - protein, 325 aa, Homo sapiens
AAWLPGNREAAVPASESLSTMAKFVIAGRADCPYYAKTELVADYLQKNLPDFRIHKITQRPEVWEDWLKDVCEKNKWSHKNSPIIWRELLDRGGKGLLLGGYNEFLEHAQLYYDVTSSMTTELMMVIAQENLGAHIEKEQEEEALKTCINPLQVWITSEWVKREFVAILKNLTTTGRQFGGILAAHSIATTLKYWYHGSPPGEIVSLGILSEGQFGIPKGIVFSMPVKFENGTWVVLTDLKDVEISEQIMTRMTSDLIQEKLVALGDKIHFQPYQSGHKDLVPDEEKNLAMSDAAEFPNQIPQTTFEKPQSLEFLNEFEGKTVES

SEQ ID NO: 890897 - protein, 200 aa, Homo sapiens
YVDLRKTRVYRYESAIWGPLHYSRPVLNLIFDSEWVKREFVAILKNLTTTGRQFGGILAAHSIATTLKYWYHGSPPGEIVSLGILSEGQFGIPKGIVFSMPVKFENGTWVVLTDLKDVEISEQIMTRMTSDLIQEKLVALGDKIHFQPYQSGHKDLVPDEEKNLAMSDAAEFPNQIPQTTFEKPQSLEFLNEFEGKTVES

SEQ ID NO: 890898 - protein, 319 aa, Homo sapiens
AAWLPGNREAAVPASESLSTMAKFVIAGRADCPYYAKTELVADYLQKNLPDFRIHKITQRPEVWEDWLKDVCEKNKWSHKNSPIIWRELLDRGGKGLLLGGYNEFLEHAQLYYDVTSSMTTELMMVIAQENLGAHIEKEQEEEALKTCINPLQVWITSEWVKREFVAILKNLTTTGRQFGGILAAHSIATTLKYWYHGSPPGEIVSLGILSEGQFGIPKGIVFSMPVKFENGTWVVLTDLKDVEISEQIMTRMTSDLIQEKLVALGDKIHFQPYQSGHKDLVPDEEKNLAMSDAAEFPNQIPQTTFEKPQSLEFLNGRW

SEQ ID NO: 890899 - protein, 266 aa, Homo sapiens
WDIIQQDWLKDVCEKNKWSHKNSPIIWRELLDRGGKGLLLGGYNEFLEHAQLYYDVTSSMTTELMMVIAQENLGAHIEKEQEEEALKTCINPLQVWITSASAPACYNLIPILTSGEVFGMHTEISITLFDNKQAEEHLKSLVVETQDLASPVLRSVSICTKVEEAFRQAHVIVVLDDSTNKEVFTLEDCLRSRVPLCRLYGYLIEKNAHESVRVIVGGRTFVNLKTVLLMRYAPRIAHNIIAVALGVEGEAKAILARKLKTAPSCE

SEQ ID NO: 890900 - protein, 325 aa, Homo sapiens; identical to SEQ ID NO: 890896

SEQ ID NO: 890901 - protein, 637 aa, Homo sapiens
MALPLKTLLQPFHATGAESDKTEKSVLNCIYKVLHGCVYGAQCFSNPRYFPMSLSDLASVDYDPFMHLESLKEPEPLHSPDSERSSKLQPVTEVKTQMQHGLISIAARTVITHLVNHLGHYPMSGGPAMLTSQVCENHDNHYSESTELSPELFESPNIQFFVLNNTTLVSCIQIRSEENMPGGGLSAGLASANSNVRIIVRDLSGKYSWDSAILYGPPPVSGLSEPTSFMLSLSHQEKPEEPPTSNECLEDITVKDGLSLQFKRFRETVPTWDTIRDEEDVLDELLQYLGVTSPECLQRTGISLNIPAPQPVCISEKQENDVINAILKQHTEEKEFVEKHFNDLNMKAVEQDEPIPQKPQSAFYYCRLLLSILGMNSWDKRRSFHLLKKNEKLLRELRNLDSRQCRETHKIAVFYVAEGQEDKHSILTNTGGSQAYEDFVAGLGWEVNLTNHCGFMGGLQKNKSTGLTTPYFATSTVEVIFHVSTRMPSDSDDSLTKKLRHLGNDEVHIVWSEHTRDYRRGIIPTEFGDVLIVIYPMKNHMFSIQIMKKPEVPFFGPLFDGAIVNGKVLPIMVRATAINASRALKSLIPLYQNFYEERARYLQTIVQHHLEPTTFEDFAAQVFSPAPYHHLPSDADH

SEQ ID NO: 890902 - protein, 264 aa, Homo sapiens
MALPLKTLLQPFHATGAESDKTEKSVLNCIYKVLHGCVYGAQCFSNPRYFPMSLSDLASVDYDPFMHLESLKEPEPLHSPDSERSSKLQPVTEVKTQMQHGLISIAARTVITHLVNHLGHYPMSGGPAMLTSQVCENHDNHYSESTELSPELFESPNIQFFVLNNTTLVSCIQIRSEENMPGGGLSAGLASANSNVRIIVRDLSGKYSWDSAILYGPPPVSGLSEPTSFMLSLSHQEKPEEPPTSNECLEDITVKDGLSLQLCS

SEQ ID NO: 890903 - protein, 684 aa, Homo sapiens
MALPLKTLLQPFHATGAESDKTEKSVLNCIYKVLHGCVYGAQCFSNPRYFPMSLSDLASVDYDPFMHLESLKEPEPLHSPDSERSSKLQPVTEVKTQMQHGLISIAARTVITHLVNHLGHYPMSGGPAMLTSQVCENHDNHYSESTELSPELFESPNIQFFVLNNTTLVSCIQIRSEENMPGGGLSAGLASANSNVRIIVRDLSGKYSWDSAILYGPPPVSGLSEPTSFMLSLSHQEKPEEPPTSNECLEDITVKDGLSLQFKRFRETVPTWDTIRDEEDVLDELLQYLGVTSPECLQRTGISLNIPAPQPVCISEKQENDVINAILKQHTEEKEFVEKHFNDLNMKAVEQDEPIPQKPQSAFYYCRLLLSILGMNSWDKRRSFHLLKKNEKLLRELRNLDSRQCRETHKIAVFYVAEGQEDKHSILTNTGGSQAYEDFVAGLGWEVNLTNHCGFMGGLQKNKSTGLTTPYFATSTVEVIFHVSTRMPSDSDDSLTKKLRHLGNDEVHIVWSEHTRDYRRGIIPTEFGDVLIVIYPMKNHMFSIQIMKKPEVPFFGPLFDGAIVNGKVLPIMVRATAINASRALKSLIPLYQNFYEERARYLQTIVQHHLEPTTFEDFAAQVFSPAPYHHLPSDAGSYPEILPSETPTATQVDGADLASPMSPRTSKSRMSMKLRRSSGSANKS

SEQ ID NO: 890904 - protein, 639 aa, Homo sapiens
MALPLKTLLQPFHATGAESDKTEKSVLNCIYKVLHGCVYGAQCFSNPRYFPMSLSDLASVDYDPFMHLESLKEPEPLHSPDSERSSKLQPVTEVKTQMQHGLISIAARTVITHLVNHLGHYPMSGGPAMLTSQVCENHDNHYSESTELSPELFESPNIQFFVLNNTTLVSCIQIRSEENMPGGGLSAGLASANSNVRIIVRDLSGKYSWDSAILYGPPPVSGLSEPTSFMLSLSHQEKPEEPPTSNECLEDITVKDGLSLQFKRFRETVPTWDTIRDEEDVLDELLQYLGVTSPECLQRTGISLNIPAPQPVCISEKQENDVINAILKQHTEEKEFVEKHFNDLNMKAVEQDEPIPQKPQSAFYYCRLLLSILGMNSWDKRRSFHLLKKNEKLLRELRNLDSRQCRETHKIAVFYVAEGQEDKHSILTNTGGSQAYEDFVAGLGWEVNLTNHCGFMGGLQKNKSTGLTTPYFATSTVEVIFHVSTRMPSDSDDSLTKKLRHLGNDEVHIVWSEHTRDYRRGIIPTEFGDVLIVIYPMKNHMFSIQIMKKPEVPFFGPLFDGAIVNGKVLPIMVRATAINASRALKSLIPLYQNFLFSLKLCYSNVQYLLQSRKAKTKWNGIDELIGSANAVAFRYNKTL

SEQ ID NO: 890905 - protein, 231 aa, Homo sapiens
PIHLYFLFPVKTQMQHGLISIAARTVITHLVNHLGHYPMSGGPAMLTSQVCENHDNHYSESTELSPELFESPNIQFFVLNNTTLVSCIQIRSEENMPGGGLSAGLASANSNVRIIVRDLSGKYSWDSAILYGPPPVSGLSEPTSFMLSLSHQEKPEEPPTSNECLEDITVKDGLSLQFKRFRETVPTWDTIRDEEDVLDELLQYLGVTSPECLQRTGISLNIPAPQPVCIS

SEQ ID NO: 890906 - protein, 594 aa, Homo sapiens
MALPLKTLLQPFHATGAESDKTEKSVLNCIYKVLHGCVYGAQCFSNPRYFPMSLSDLASVDYDPFMHLESLKEPEPLHSPDSERSSKLQPVTEVKTQMQHGLISIAARTVITHLVNHLGHYPMSGGPAMLTSQVCENHDNHYSESTELSPELFESPNIQFFVLNNTTLVSCIQIRSEENMPGGGLSAGLASANSNVRIIVRDLSGKYSWDSAILYGPPPVSGLSEPTSFMLSLSHQEKPEEPPTSNECLEDITVKDGLSLQFKRFRETVPTWDTIRDEEDVLDELLQYLGVTSPECLQRTGISLNIPAPQPVCISEKQENDVINAILKQHTEEKEFVEKHFNDLNMKAVEQDEPIPQKPQSAFYYCRLLLSILGMNSWDKRRSFHLLKKNEKLLRELRNLDSRQCRETHKIAVFYVAEGQEDKHSILTNTGGSQAYEDFVAGLGWEVNLTNHCGFMGGLQKNKSTGLTTPYFATSTVEVIFHVSTRMPSDSDDSLTKKLRHLGNDEVHIVWSEHTRDYRRGIIPTEFGDVLIVIYPMKNHMFSIQIMKKPEVPFFGPLFDGAIVNGKVLPIMVRATAINASRALKSLIPLYQNF

SEQ ID NO: 890907 - protein, 454 aa, Homo sapiens
MALPLKTLLQPFHATGAESDKTEKSVLNCIYKVLHGCVYGAQCFSNPRYFPMSLSDLASVDYDPFMHLESLKEPEPLHSPDSERSSKLQPVTEVKTQMQHGLISIAARTVITHLVNHLGHYPMSGGPAMLTSQVCENHDNHYSESTELSPELFESPNIQFFVLNNTTLVSCIQIRSEENMPGGGLSAGLASANSNVRIIVRDLSGKYSWDSAILYGPPPVSGLSEPTSFMLSLSHQEKPEEPPTSNECLEDITVKDGLSLQFKRFRETVPTWDTIRDEEDVLDELLQYLGVTSPECLQRTGISLNIPAPQPVCISEKQENDVINAILKQHTEEKEFVEKHFNDLNMKAVEQDEPIPQKPQSAFYYCRLLLSILGMNSWDKRRSFHLLKKNEKLLRELRNLDSRQCRETHKIAVFYVAEGQEDKHSILTNTGGSQAYEDFVAGLGWELIIFKLYE

SEQ ID NO: 890908 - protein, 665 aa, Homo sapiens
MTSANKAIELQLQVKQNAEELQDFMRDLENWEKDIKQKDMELRRQNGVPEENLPPIRNGNFRKKKKGKAKESSKKTREENTKNRIKSYDYEAWAKLDVDRILDELDKDDSTHESLSQESESEEDGIHVDSQKALVLKEKGNKYFKQGKYDEAIDCYTKGMDADPYNPVLPTNRASAYFRLKKFAVAESDCNLAVALNRSYTKAYSRRGAARFALQKLEEAKKDYERVLELEPNNFEATNELRKISQALASKENSYPKEADIVIKSTEGERKQIEAQQNKQQAISEKDRGNGFFKEGKYERAIECYTRGIAADGANALLPANRAMAYLKIQKYEEAEKDCTQAILLDGSYSKAFARRGTARTFLGKLNEAKQDFETVLLLEPGNKQAVTELSKIKKELIEKGHWDDVFLDSTQRQNVVKPIDNPPHPGSTKPLKKVIIEETGNLIQTIDVPDSTTAAAPENNPINLANVIAATGTTSKKNSSQDDLFPTSDTPRAKVLKIEEVSDTSSLQPQASLKQDVCQSYSEKMPIEIEQKPAQFATTVLPPIPANSFQLESDFRQLKSSPDMLYQYLKQIEPSLYPKLFQKNLDPDVFNQIVKILHDFYIEKEKPLLIFEILQRLSELKRFDMAVMFMSETEKKIARALFNHIDKSGLKDSSVEELKKRYGG

SEQ ID NO: 890909 - protein, 665 aa, Homo sapiens; identical to SEQ ID NO: 890908

SEQ ID NO: 890910 - protein, 301 aa, Homo sapiens
MTSANKAIELQLQVKQNAEELQDFMRDLENWEKDIKQKDMELRRQNGVPEENLPPIRNGNFRKKKKGKAKESSKKTREENTKNRIKSYDYEAWAKLDVDRILDELDKDDSTHESLSQESESEEDGIHVDSQKALVLKEKGNKYFKQGKYDEAIDCYTKGMDADPYNPVLPTNRASAYFRLKKFAVAESDCNLAVALNRSYTKAYSRRGAARFALQKLEEAKKDYERVLELEPNNFEATNELRKISQALASKENSYPKEADIVIKSTEGERKQIEAQQNKQQAISEKDRGNGFSKRGNIKDN

SEQ ID NO: 890911 - protein, 665 aa, Homo sapiens; identical to SEQ ID NO: 890908

SEQ ID NO: 890912 - protein, 665 aa, Homo sapiens; identical to SEQ ID NO: 890908

SEQ ID NO: 890913 - protein, 130 aa, Homo sapiens
MTSANKAIELQLQVKQNAEELQDFMRDLENWEKDIKQKDMELRRQNGVPEENLPPIRNGNFRKKKKGKAKESSKKTREENTKNRIKSYDYEAWAKLDVCTPVKPLFGSRYRTFWEAEAREWLEPGRRRLQ

SEQ ID NO: 890914 - protein, 434 aa, Homo sapiens
MLPARCARLLTPHLLLVLVQLSPARGHRTTGPRFLISDRDPQCNLHCSRTQPKPICASDGRSYESMCEYQRAKCRDPTLGVVHRGRCKDAGQSKCRLERAQALEQAKKPQEAVFVPECGEDGSFTQVQCHTYTGYCWCVTPDGKPISGSSVQNKTPVCSGSVTDKPLSQGNSGRKDDGSKPTPTMETQPVFDGDEITAPTLWIKHLVIKDSKLNNTNIRNSEKVYSCDQERQSALEEAQQNPREGIVIPECAPGGLYKPVQCHQSTGYCWCVLVDTGRPLPGTSTRYVMPSCESDARAKTTEADDPFKDRELPGCPEGKKMEFITSLLDALTTDMVQAINSAAPTGGGRFSEPDPSHTLEERVVHWYFSQLDSNSSNDINKREMKPFKRYVKKKAKPKKCARRFTDYCDLNKDKVISLPELKGCLGVSKEGRLV

SEQ ID NO: 890915 - protein, 434 aa, Homo sapiens; identical to SEQ ID NO: 890914

SEQ ID NO: 890916 - protein, 434 aa, Homo sapiens; identical to SEQ ID NO: 890914

SEQ ID NO: 890917 - protein, 442 aa, Homo sapiens
MLPARCARLLTPHLLLVLVQLSPARGHRTTGPRFLISDRDPQCNLHCSRTQPKPICASDGRSYESMCEYQRAKCRDPTLGVVHRGRCKDAGQSKCRLERAQALEQAKKPQEAVFVPECGEDGSFTQVQCHTYTGYCWCVTPDGKPISGSSVQNKTPVCSGSVTDKPLSQGNSGRKDDGSKPTPTMETQPVFDGDEITAPTLWIKHLVIKDSKLNNTNIRNSEKVYSCDQERQSALEEAQQNPREGIVIPECAPGGLYKPVQCHQSTGYCWCVLVDTGRPLPGTSTRYVMPSCESDARAKTTEADDPFKDRELPGCPEGKKMEFITSLLDALTTDMVQAINSAAPTGGGRFSEPDPSHTLEERVVHWYFSQLDSNSSNDINKREMKPFKRYVKKKAKPKKCARRFTDYCDLNKDKVISLPELKGCLGVSKEAGGSLGSFPQAK

SEQ ID NO: 890918 - protein, 442 aa, Homo sapiens; identical to SEQ ID NO: 890917

SEQ ID NO: 890919 - protein, 434 aa, Homo sapiens; identical to SEQ ID NO: 890914

SEQ ID NO: 890920 - protein, 268 aa, Homo sapiens
MTIKKSEVHFHSHSLFAQTFSLSFSSPLEITAPTLWIKHLVIKDSKLNNTNIRNSEKVYSCDQERQSALEEAQQNPREGIVIPECAPGGLYKPVQCHQSTGYCWCVLVDTGRPLPGTSTRYVMPSCESDARAKTTEADDPFKDRELPGCPEGKKMEFITSLLDALTTDMVQAINSAAPTGGGRFSEPDPSHTLEERVVHWYFSQLDSNSSNDINKREMKPFKRYVKKKAKPKKCARRFTDYCDLNKDKVISLPELKGCLGVSKEGRLV

SEQ ID NO: 890921 - protein, 116 aa, Homo sapiens
GGSFSEPDPSHTLEERVVHWYFSQLDSNSRTFSEPDPSHTLEERVVHWYFSQLDSNSSNDINKREMKPFKRYVKKKAKPKKCARRFTDYCDLNKDKVISLPELKGCLGVSKEGRLV

SEQ ID NO: 890922 - protein, 108 aa, Homo sapiens
GSRAAAATNKGTHCGPQGQEGGGGRECLSQQGSGSALLLARWEVAWGPATEIRARPGQSPLETLWARTPGDAEARALQTSVLVGGFFTKLRVWPFIGKDLLGSKSKGF

SEQ ID NO: 890923 - protein, 108 aa, Homo sapiens; identical to SEQ ID NO: 890922

SEQ ID NO: 890924 - protein, 108 aa, Homo sapiens; identical to SEQ ID NO: 890922

SEQ ID NO: 890925 - protein, 108 aa, Homo sapiens; identical to SEQ ID NO: 890922

SEQ ID NO: 890926 - protein, 77 aa, Homo sapiens
SASTRLGLIGRGSTWLLPLSVEVEFGGGAELLFDGIKKHRVTLPGQEEPWDIRNLLIWIKKNLLKERPELFIQGDSV

SEQ ID NO: 890927 - protein, 122 aa, Homo sapiens
PGNLRARRKLRGVSCELGFLNMAAPLSVEVEFGGGAELLFDGIKKHRVTLPGQEEPWDIRNLLIWIKKNLLKERPELFIQGDSVRPGILVLINDADWELLGELDYQLQDQDSVLFISTLHGG

SEQ ID NO: 890928 - protein, 115 aa, Homo sapiens
SASTRLGLIGRGSTWLLPLSVEVEFGGGAELLFDGIKKHRVTLPGQEEPWDIRNLLIWIKKNLLKERPELFIQGDSVRPGILVLINDADWELLGELDYQLQDQDSVLFISTLHGG

SEQ ID NO: 890929 - protein, 128 aa, Homo sapiens
HLLSAYHVPGSKPDTEDTKINRSLSVPYSVQHFCPLEGGGGAELLFDGIKKHRVTLPGQEEPWDIRNLLIWIKKNLLKERPELFIQGDSVRPGILVLINDADWELLGELDYQLQDQDSVLFISTLHGG

SEQ ID NO: 890930 - protein, 97 aa, Homo sapiens
RKFAGAPEVEGSFLRARLPQHGCALVSGGGVRELTWLSFSLVLLCRGGAELLFDGIKKHRVTLPGQEEPWDIRNLLIWIKKNLLKERPELFIQGDSV

SEQ ID NO: 890931 - protein, 160 aa, Homo sapiens
SASTRLGLIGRGSTWLLPLSVEVEFGGGAELLFDGIKKHRVTLPGQEEPWDIRNLLIWIKKNLLKERPELFIQGDSVRPGILVLINDADWELLVSTLGDIPPPAPALAASVGKRWASPQAHIEWLGNPPPHSSPTLRLLESPTPGEEGMGSWGHGSTPPS

SEQ ID NO: 890932 - protein, 122 aa, Homo sapiens; identical to SEQ ID NO: 890927

SEQ ID NO: 890933 - protein, 135 aa, Homo sapiens
RKFAGAPEVEGSFLRARLPQHGCALVSGGGVRELTWLSFSLVLLCRGGAELLFDGIKKHRVTLPGQEEPWDIRNLLIWIKKNLLKERPELFIQGDSVRPGILVLINDADWELLGELDYQLQDQDSVLFISTLHGG

SEQ ID NO: 890934 - protein, 122 aa, Homo sapiens; identical to SEQ ID NO: 890927

SEQ ID NO: 890935 - protein, 122 aa, Homo sapiens; identical to SEQ ID NO: 890927

SEQ ID NO: 890936 - protein, 135 aa, Homo sapiens; identical to SEQ ID NO: 890933

SEQ ID NO: 890937 - protein, 74 aa, Homo sapiens
VRSVHPFPRDIRNLLIWIKKNLLKERPELFIQGDSVRPGILVLINDADWELLGELDYQLQDQDSVLFISTLHGG

SEQ ID NO: 890938 - protein, 167 aa, Homo sapiens
PGNLRARRKLRGVSCELGFLNMAAPLSVEVEFGGGAELLFDGIKKHRVTLPGQEEPWDIRNLLIWIKKNLLKERPELFIQGDSVRPGILVLINDADWELLVSTLGDIPPPAPALAASVGKRWASPQAHIEWLGNPPPHSSPTLRLLESPTPGEEGMGSWGHGSTPPS

SEQ ID NO: 890939 - protein, 80 aa, Homo sapiens
PGNLRARRKLRGVSCELGFLNMAAPLSVEVEFGGGAELLFDGIKKHRVTLPGQEEPWDIRNLLIWIKKNLLTKNEPFSST

SEQ ID NO: 890940 - protein, 121 aa, Homo sapiens
SASTRLGLIGRGSTWLLPLSVEVEFGGGAELLFDGIKKHRVTLPGQEEPWDIRNLLIWIKKNLLSWPAPLHRPPDGLLRPSPGCLQLILLGVEMRGGSKLNLGLASRSLGGCVCLSFLLHN

SEQ ID NO: 890941 - protein, 81 aa, Homo sapiens
SARRGFLNDPRPRYKISGGACAGLKEDLGACLLQSDCVVQEGKSPRQCLKEGYCNSLKYAFFECKRSVLDNRARFRGRKGY

SEQ ID NO: 890942 - protein, 114 aa, Homo sapiens
MLGPRLCCPGSLPSSSDCFCFLVTFSVWPALHNEASVSSKSTSLLSMIQKGERELPFSGSTNQIYKRTLVFPGSPALALDQSLWKRGWGPVILARPGLSICTVIANSCQNHMDE

SEQ ID NO: 890943 - protein, 213 aa, Homo sapiens
MAETYDFLFKFLVIGSAGTGKSCLLHQFIENKFKQDSNHTIGVEFGSRVVNVGGKTVKLQIWDTAGQERFRSVTRSYYRGAAGALLVYDITSRETYNSLAAWLTDARTLASPNIVVILCGNKKDLDPEREVTFLEASRFAQENELMFLETSALTGENVEEAFLKCARTILNKIDSGELDPERMGSGIQYGDASLRQLRQPRSAQAVAPQPCGC

SEQ ID NO: 890944 - protein, 113 aa, Homo sapiens
MGDPLSCLLSPCTAPSVPPTPSQTGLQPHNRRGVWIPGGQRGWEDCEATDLGHGWPGAVSVSDAELLPRGGWSPAGVRHHQSGDIHYWLLLTDARILVWQVDGRMDPDMVKWP

SEQ ID NO: 890945 - protein, 192 aa, Homo sapiens
MAETYDFLFKFLVIGSAGTGKSCLLHQFIENKFKQDSNHTIGVEFGSRVVNVGGKTVKLQIWDTAGQERFRRETYNSLAAWLTDARTLASPNIVVILCGNKKDLDPEREVTFLEASRFAQENELMFLETSALTGENVEEAFLKCARTILNKIDSGELDPERMGSGIQYGDASLRQLRQPRSAQAVAPQPCGC

SEQ ID NO: 890946 - protein, 237 aa, Homo sapiens
MAETYDFLFKFLVIGSAGTGKSCLLHQFIENKFKQDSNHTIGVEFGSRVVNVGGKTVKLQIWDTAGQERFRSVTRSYYRGAAGALLVYDITSRETYNSLAAWLTDARTLASPNIVVILCGNKKDLDPEREVTFLEASRFAQENELMFLETSALTGENVEEAFLKCARTILNKIDSGELDPERMGSGIQYGDAVLRQLRQPRSAQGVALSRVAAELCGASSPVLQDQPCWGHKKLWEP

SEQ ID NO: 890947 - protein, 105 aa, Homo sapiens
MRMVWAGGQPVGRAGLAIGTSPVLAFWSLLCRMSFTRFSLTSSHSSKENGFVETERALEDGGSSELSPLSLYCPFCSSYSQSNRTPTTQSAWSLDPGWSTWVGRL

SEQ ID NO: 890948 - protein, 239 aa, Homo sapiens
MVRERDWIGIHLFSLYLSLPVGIPDFGSIWSDFLFKFLVIGSAGTGKSCLLHQFIENKFKQDSNHTIGVEFGSRVVNVGGKTVKLQIWDTAGQERFRSVTRSYYRGAAGALLVYDITSRETYNSLAAWLTDARTLASPNIVVILCGNKKDLDPEREVTFLEASRFAQENELMFLETSALTGENVEEAFLKCARTILNKIDSGELDPERMGSGIQYGDASLRQLRQPRSAQAVAPQPCGC

SEQ ID NO: 890949 - protein, 260 aa, Homo sapiens
MVWAGGQPVGRAGLAIGTSPVLAFWSLLCRMSFTRFSLTSSHSSKENGFVETERALEDGGSSELSPLSLYCPFCSSYSQVKQDSNHTIGVEFGSRVVNVGGKTVKLQIWDTAGQERFRSVTRSYYRGAAGALLVYDITSRETYNSLAAWLTDARTLASPNIVVILCGNKKDLDPEREVTFLEASRFAQENELMFLETSALTGENVEEAFLKCARTILNKIDSGELDPERMGSGIQYGDASLRQLRQPRSAQAVAPQPCGC

SEQ ID NO: 890950 - protein, 213 aa, Homo sapiens; identical to SEQ ID NO: 890943

SEQ ID NO: 890951 - protein, 104 aa, Homo sapiens
MSHTILLVQPTKRPEGRTYADYESVNECMEGVCKMYEEHLKRMNPNSPSITYDISQLFDFIDDLADLSCLVYRADTQTYQPYNKDWIKEKIYVLLRRQAQQAGK

SEQ ID NO: 890952 - protein, 104 aa, Homo sapiens; identical to SEQ ID NO: 890951

SEQ ID NO: 890953 - protein, 104 aa, Homo sapiens; identical to SEQ ID NO: 890951

SEQ ID NO: 890954 - protein, 104 aa, Homo sapiens; identical to SEQ ID NO: 890951

SEQ ID NO: 890955 - protein, 104 aa, Homo sapiens; identical to SEQ ID NO: 890951

SEQ ID NO: 890956 - protein, 104 aa, Homo sapiens; identical to SEQ ID NO: 890951

SEQ ID NO: 890957 - protein, 102 aa, Homo sapiens
MNAWKVFVKCMKNIWISSMIWQTSAAWFTELIPRHTSLITKTGLKRRSTCSFVGRPNRLGNNCVGSTGGVGVGLEHRCVQRAVVEVLYHSNPVSTLLYSSQD

SEQ ID NO: 890958 - protein, 104 aa, Homo sapiens; identical to SEQ ID NO: 890951

SEQ ID NO: 890959 - protein, 104 aa, Homo sapiens; identical to SEQ ID NO: 890951

SEQ ID NO: 890960 - protein, 104 aa, Homo sapiens; identical to SEQ ID NO: 890951

SEQ ID NO: 890961 - protein, 104 aa, Homo sapiens; identical to SEQ ID NO: 890951

SEQ ID NO: 890962 - protein, 104 aa, Homo sapiens; identical to SEQ ID NO: 890951

SEQ ID NO: 890963 - protein, 124 aa, Homo sapiens
MNAWKVFVKCMKNIWISSMIWQTSAAWFTELIPRHTSLITKTGLKRRSTCSFVGRPNRLGNNCVGSTGGVGVGLEHRCVQRAVVEVLYPFFASLSSLCPTLASTDCLRITRGVPSHLAIPASLS

SEQ ID NO: 890964 - protein, 358 aa, Homo sapiens
MRATPLAAPAGSLSRKKRLELDDNLDTERPVQKRARSGPQPRLPPCLLPLSPPTAPDRATAVATASRLGPYVLLEPEEGGRAYQALHCPTGTEYTCKVYPVQEALAVLEPYARLPPHKHVARPTEVLAGTQLLYAFFTRTHGDMHSLVRSRHRIPEPEAAVLFRQMATALAHCHQHGLVLRDLKLCRFVFADRERKKLVLENLEDSCVLTGPDDSLWDKHACPAYVGPEILSSRASYSGKAADVWSLGVALFTMLAGHYPFQDSEPVLLFGKIRRGAYALPAGLSAPARCLVRCLLRREPAERLTATGILLHPWLRQDPMPLAPTRSHLWEAAQVVPDGLGLDEAREEEGDREVVLYG

SEQ ID NO: 890965 - protein, 358 aa, Homo sapiens; identical to SEQ ID NO: 890964

SEQ ID NO: 890966 - protein, 358 aa, Homo sapiens; identical to SEQ ID NO: 890964

SEQ ID NO: 890967 - protein, 358 aa, Homo sapiens; identical to SEQ ID NO: 890964

SEQ ID NO: 890968 - protein, 358 aa, Homo sapiens; identical to SEQ ID NO: 890964

SEQ ID NO: 890969 - protein, 358 aa, Homo sapiens; identical to SEQ ID NO: 890964

SEQ ID NO: 890970 - protein, 358 aa, Homo sapiens; identical to SEQ ID NO: 890964

SEQ ID NO: 890971 - protein, 358 aa, Homo sapiens; identical to SEQ ID NO: 890964

SEQ ID NO: 890972 - protein, 340 aa, Homo sapiens
MRATPLAAPAGSLSRKKRLELDDNLDTERPVQKRARSGPQPRLPPCLLPLSPPTAPDRATAVATASRLGPYVLLEPEEGGRAYQALHCPTGTEYTCKVYPVQEALAVLEPYARLPPHKHVARPTEVLAGTQLLYAFFTRTHGDMHSLVRSRHRIPEPEAAVLFRQMATALAHCHQHGLVLRDLKLCRFVFADRERKKLVLENLEDSCVLTGPDDSLWDKHACPAYVGPEILSSRASYSGKAADVWSLGVALFTMLAGHYPFQDSEPVLLFGKIRRGAYALPAGLSAPARCLVRCLLRREPAERLTATGILLHPWLRQDPMPLAPTRSHLLGTVFPASLSS

SEQ ID NO: 890973 - protein, 358 aa, Homo sapiens; identical to SEQ ID NO: 890964

SEQ ID NO: 890974 - protein, 358 aa, Homo sapiens; identical to SEQ ID NO: 890964

SEQ ID NO: 890975 - protein, 353 aa, Homo sapiens
MRATPLAAPAGSLSRKKRLELDDNLDTERPVQKRARSGPQPRLPPCLLPLSPPTAPDRATAVATASRLGPYVLLEPEEGGRAYQALHCPTGTEYTCKVYPVQEALAVLEPYARLPPHKHVARPTEVLAGTQLLYAFFTRTHGDMHSLVRSRHRIPEPEAAVLFRQMATALAHCHLRDLKLCRFVFADRERKKLVLENLEDSCVLTGPDDSLWDKHACPAYVGPEILSSRASYSGKAADVWSLGVALFTMLAGHYPFQDSEPVLLFGKIRRGAYALPAGLSAPARCLVRCLLRREPAERLTATGILLHPWLRQDPMPLAPTRSHLWEAAQVVPDGLGLDEAREEEGDREVVLYG

SEQ ID NO: 890976 - protein, 353 aa, Homo sapiens; identical to SEQ ID NO: 890975

SEQ ID NO: 890977 - protein, 190 aa, Homo sapiens
MSSWSPRRAGGPTRPCTALQALSIPARKKLVLENLEDSCVLTGPDDSLWDKHACPAYVGPEILSSRASYSGKAADVWSLGVALFTMLAGHYPFQDSEPVLLFGKIRRGAYALPAGLSAPARCLVRCLLRREPAERLTATGILLHPWLRQDPMPLAPTRSHLWEAAQVVPDGLGLDEAREEEGDREVVLYG

SEQ ID NO: 890978 - protein, 216 aa, Homo sapiens
MRATPLAAPAGSLSRKKRLELDDNLDTERPVQKRARSGPQPRLPPCLLPLSPPTAPDRATAVATASRLGPYVLLEPEEGGRAYQALHCPTGTEYTCKVYPVQEALAVLEPYARLPPHKHVARPTEVLAGTQLLYAFFTRTHGDMHSLVRSRHRIPEPEAAVLFRQMATALAHCHQHGLVLRDLKLCRCFVTWRKTVWRLGDWCDGKFLCRGALGPE

SEQ ID NO: 890979 - protein, 468 aa, Homo sapiens
MEAYRTQNCFLNSEIHQVTKIWRKVAEKEKALLTKCAYLQARNCQVESKYLAGLRRLQEALGDEASECSELLRQLVQEALQWEAGEASSDSIELSPISKYDEYGFLTVPDYEVEDLKLLAKIQALESRSHHLLGLEAVDRPLRERWAALGDLVPSAELKQLLRAGVPREHRPRVWRWLVHLRVQHLHTPGCYQELLSRGQAREHPAARQIELDLNRTFPNNKHFTCPTSSFPDKLRRVLLAFSWQNPTIGYCQGLNRLAAIALLVLEEEESAFWCLVAIVETIMPADYYCNTLTASQVDQRVLQDLLSEKLPRLMAHLGQHHVDLSLVTFNWFLVVFADSLISNILLRVWDAFLYEGTKVVFRYALAIFKYNEKEILRLQNGLEIYQYLRFFTKTISNSRKLMNIAFNDMNPFRMKQLRQLRMVHRERLEAELRELEQLKAEYLERRASRRRAVSEGCASEDEVEGEA

SEQ ID NO: 890980 - protein, 947 aa, Homo sapiens
PFGKLPAESPRFVPGGPADPSSLRSLRLAAMEGAGENAPESSSSAPGSEESARDPQVPPPEEESGDCARSLEAVPKKLCGYLSKFGGKGPIRGWKSRWFFYDERKCQLYYSRTAQDANPLDSIDLSSAVFDCKADAEEGIFEIKTPSRVITLKAATKQAMLYWLQQLQMKRWEFHNSPPAPPATPDAALAGNGPVLHLELGQEEAELEEFLCPVKTPPGLVGVAAALQPFPALQNISLKHLGTEIQNTMHNIRGNKQAQGTGHEPPGEDSPQSGEPQREEQPLASDASTPGREPEDSPKPAPKPSLTISFAQKAKRQNNTFPFFSEGITRNRTAQEKVAALEQQVLMLTKELKSQKELVKILHKALEAAQQEKRASSAYLAAAEDKDRLELVRHKVRQIAELGRRVEALEQERESLAHTASLREQQVQELQQHVQLLMDKNHAKQQVICKLSEKVTQDFTHPPDQSPLRPDAANRDFLSQQGKIEHLKDDMEAYRTQNCFLNSEIHQVTKIWRKVAEKEKALLTKCAYLQARNCQVESKYLAGLRRLQEALGDEASECSELLRQLVQEALQWEAGEASSDSIELSPISKYDEYGFLTVPDYEVEDLKLLAKIQALESRSHHLLGLEAVDRPLRERWAALGDLVPSAELKQLLRAGVPREHRPRVWRWLVHLRVQHLHTPGCYQELLSRGQAREHPAARQIELDLNRTFPNNKHFTCPTSSFPDKLRRVLLAFSWQNPTIGYCQGLNRLAAIALLVLEEEESAFWCLVAIVETIMPADYYCNTLTASQVDQRVLQDLLSEKLPRLMAHLGQHHVDLSLVTFNWFLVVFADSLISNILLRVWDAFLYEGTKYNEKEILRLQNGLEIYQYLRFFTKTISNSRKLMNIAFNDMNPFRMKQLRQLRMVHRERLEAELRELEQLKAEYLERRASRRRAVSEGCASEDEVEGEA

SEQ ID NO: 890981 - protein, 911 aa, Homo sapiens
PFGKLPAESPRFVPGGPADPSSLRSLRLAAMEGAGENAPESSSSAPGSEESARDPQVPPPEEESGDCARSLEAVPKKLCGYLSKFGGKGPIRGWKSRWFFYDERKCQLYYSRTAQDANPLDSIDLSSAVFDCKADAEAGDLRNQDSQPGYYPEGQEEAELEEFLCPVKTPPGLVGVAAALQPFPALQNISLKHLGTEIQNTMHNIRGNKQAQGTGHEPPGEDSPQSGEPQREEQPLASDASTPGREPEDSPKPAPKPSLTISFAQKAKRQNNTFPFFSEGITRNRTAQEKVAALEQQVLMLTKELKSQKELVKILHKALEAAQQEKRASSAYLAAAEDKDRLELVRHKVRQIAELGRRVEALEQERESLAHTASLREQQVQELQQHVQLLMDKNHAKQQVICKLSEKVTQDFTHPPDQSPLRPDAANRDFLSQQGKIEHLKDDMEAYRTQNCFLNSEIHQVTKIWRKVAEKEKALLTKCAYLQARNCQVESKYLAGLRRLQEALGDEASECSELLRQLVQEALQWEAGEASSDSIELSPISKYDEYGFLTVPDYEVEDLKLLAKIQALESRSHHLLGLEAVDRPLRERWAALGDLVPSAELKQLLRAGVPREHRPRVWRWLVHLRVQHLHTPGCYQELLSRGQAREHPAARQIELDLNRTFPNNKHFTCPTSSFPDKLRRVLLAFSWQNPTIGYCQGLNRLAAIALLVLEEEESAFWCLVAIVETIMPADYYCNTLTASQVDQRVLQDLLSEKLPRLMAHLGQHHVDLSLVTFNWFLVVFADSLISNILLRVWDAFLYEGTKVVFRYALAIFKYNEKEILRLQNGLEIYQYLRFFTKTISNSRKLMNIAFNDMNPFRMKQLRQLRMVHRERLEAELRELEQLKAEYLERRASRRRAVSEGCASEDEVEGEA

SEQ ID NO: 890982 - protein, 958 aa, Homo sapiens
PFGKLPAESPRFVPGGPADPSSLRSLRLAAMEGAGENAPESSSSAPGSEESARDPQVPPPEEESGDCARSLEAVPKKLCGYLSKFGGKGPIRGWKSRWFFYDERKCQLYYSRTAQDANPLDSIDLSSAVFDCKADAEEGIFEIKTPSRVITLKAATKQAMLYWLQQLQMKRWEFHNSPPAPPATPDAALAGNGPVLHLELGQEEAELEEFLCPVKTPPGLVGVAAALQPFPALQNISLKHLGTEIQNTMHNIRGNKQAQGTGHEPPGEDSPQSGEPQREEQPLASDASTPGREPEDSPKPAPKPSLTISFAQKAKRQNNTFPFFSEGITRNRTAQEKVAALEQQVLMLTKELKSQKELVKILHKALEAAQQEKRASSAYLAAAEDKDRLELVRHKVRQIAELGRRVEALEQERESLAHTASLREQQVQELQQHVQLLMDKNHAKQQVICKLSEKVTQDFTHPPDQSPLRPDAANRDFLSQQGKIEHLKDDMEAYRTQNCFLNSEIHQVTKIWRKVAEKEKALLTKCAYLQARNCQVESKYLAGLRRLQEALGDEASECSELLRQLVQEALQWEAGEASSDSIELSPISKYDEYGFLTVPDYEVEDLKLLAKIQALESRSHHLLGLEAVDRPLRERWAALGDLVPSAELKQLLRAGVPREHRPRVWRWLVHLRVQHLHTPGCYQELLSRGQAREHPAARQIELDLNRTFPNNKHFTCPTSSFPDKLRRVLLAFSWQNPTIGYCQGLNRLAAIALLVLEEEESAFWCLVAIVETIMPADYYCNTLTASQVDQRVLQDLLSEKLPRLMAHLGQHHVDLSLVTFNWFLVVFADSLISNILLRVWDAFLYEGTKVVFRYALAIFKYNEKEILRLQNGLEIYQYLRFFTKTISNSRKLMNIAFNDMNPFRMKQLRQLRMVHRERLEAELRELEQLKAEYLERRASRRRAVSEGCASEDEVEGEA

SEQ ID NO: 890983 - protein, 922 aa, Homo sapiens
PFGKLPAESPRFVPGGPADPSSLRSLRLAAMEGAGENAPESSSSAPGSEESARDPQVPPPEEESGDCARSLEAVPKKLCGYLSKFGGKGPIRGWKSRWFFYDERKCQLYYSRTAQDANPLDSIDLSSAVFDCKADAEEGIFEIKTPSRVITLKAATKQAMLYWLQQLQMKRWEFHNSPPAPPATPDAALAGNGPVLHLELGQEEAELEEFLCPVKTPPGLVGVAAALQPFPALQNISLKHLGTEIQNTMHNIRGNKQAQGTGHEPPGEDSPQSGEPQREEQPLASDASTPGITRNRTAQEKVAALEQQVLMLTKELKSQKELVKILHKALEAAQQEKRASSAYLAAAEDKDRLELVRHKVRQIAELGRRVEALEQERESLAHTASLREQQVQELQQHVQLLMDKNHAKQQVICKLSEKVTQDFTHPPDQSPLRPDAANRDFLSQQGKIEHLKDDMEAYRTQNCFLNSEIHQVTKIWRKVAEKEKALLTKCAYLQARNCQVESKYLAGLRRLQEALGDEASECSELLRQLVQEALQWEAGEASSDSIELSPISKYDEYGFLTVPDYEVEDLKLLAKIQALESRSHHLLGLEAVDRPLRERWAALGDLVPSAELKQLLRAGVPREHRPRVWRWLVHLRVQHLHTPGCYQELLSRGQAREHPAARQIELDLNRTFPNNKHFTCPTSSFPDKLRRVLLAFSWQNPTIGYCQGLNRLAAIALLVLEEEESAFWCLVAIVETIMPADYYCNTLTASQVDQRVLQDLLSEKLPRLMAHLGQHHVDLSLVTFNWFLVVFADSLISNILLRVWDAFLYEGTKVVFRYALAIFKYNEKEILRLQNGLEIYQYLRFFTKTISNSRKLMNIAFNDMNPFRMKQLRQLRMVHRERLEAELRELEQLKAEYLERRASRRRAVSEGCASEDEVEGEA

SEQ ID NO: 890984 - protein, 799 aa, Homo sapiens
PFGKLPAESPRFVPGGPADPSSLRSLRLAAMEGAGENAPESSSSAPGSEESARDPQVPPPEEESGDCARSLEAVPKKLCGYLSKFGGKGPIRGWKSRWFFYDERKCQLYYSRTAQDANPLDSIDLSSAVFDCKADAEEGIFEIKTPSRVITLKAATKQAMLYWLQQLQMKRWEFHNSPPAPPATPDAALAGNGPVLHLELGQEEAELEEFLCPVKTPPGLVGVAAALQPFPALQNISLKHLGTEIQNTMHNIRGNKQAQGTGHEPPGEDSPQSGEPQREEQPLASDASTPGREPEDSPKPAPKPSLTISFAQKAKRQNNTFPFFSEGITRNRTAQEKVAALEQQVLMLTKELKSQKELVKILHKALEAAQQEKRASSAYLAAAEDKDRLELVRHKVRQIAELLRQLVQEALQWEAGEASSDSIELSPISKYDEYGFLTVPDYEVEDLKLLAKIQALESRSHHLLGLEAVDRPLRERWAALGDLVPSAELKQLLRAGVPREHRPRVWRWLVHLRVQHLHTPGCYQELLSRGQAREHPAARQIELDLNRTFPNNKHFTCPTSSFPDKLRRVLLAFSWQNPTIGYCQGLNRLAAIALLVLEEEESAFWCLVAIVETIMPADYYCNTLTASQVDQRVLQDLLSEKLPRLMAHLGQHHVDLSLVTFNWFLVVFADSLISNILLRVWDAFLYEGTKVVFRYALAIFKYNEKEILRLQNGLEIYQYLRFFTKTISNSRKLMNIAFNDMNPFRMKQLRQLRMVHRERLEAELRELEQLKAEYLERRASRRRAVSEGCASEDEVEGEA

SEQ ID NO: 890985 - protein, 958 aa, Homo sapiens; identical to SEQ ID NO: 890982

SEQ ID NO: 890986 - protein, 747 aa, Homo sapiens
PFGKLPAESPRFVPGGPADPSSLRSLRLAAMEGAGENAPESSSSAPGSEESARDPQVPPPEEESGDCARSLEAVPKKLCGYLSKFGGKGPIRGWKSRWFFYDERKCQLYYSRTAQDANPLDSIDLSSAVFDCKADAEEGIFEIKTPSRVITLKAATKQAMLYWLQQLQMKRWEFHNSPPAPPATPDAALAGNGPVLHLELGQEEAELEEFLCPVKTPPGLVGVAAALQPFPALQNISLKHLGTEIQNTMHNIRGNKQAQGTGHEPPGEDSPQSGEPQREEQPLASDASTPGREPEDSPKPAPKPSLTISFAQKAKRQNNTFPFFSEGITRNRTAQEKVAALEQQVLMLTKELKSQKELVKILHKALEAAQQEKRASSAYLAAAEDKDRLELVRHKVRQIAELGRRVEALEQERESLAHTASLREQQVQELQQHVQLLMDKNHAKQQVICKLSEKVTQDFTHPPDQSPLRPDAANRDFLSQQGKIEHLKDDMEAYRTQNCFLNSEIHQVTKIWRKVAEKEKALLTKCAYLQARNCQVESKYLAGLRRLQEALGDEASECSELLRQLVQEALQWEAGEASSDSIELSPISKYDEYGFLTVPDYEVEDLKLLAKIQALESRSHHLLGLEAVDRPLRERWAALGDLVPSAELKQLLRAGVPREHRPRVWRWLVHLRVQHLHTPGCYQELLSRGQAREHPAARQIELDLNRTFPNNKHFTCPTSSFPDKLRRVLLAFSWQNPTIGYCQGLNR

SEQ ID NO: 890987 - protein, 733 aa, Homo sapiens
PFGKLPAESPRFVPGGPADPSSLRSLRLAAMEGAGENAPESSSSAPGSEESARDPQVPPPEEESGDCARSLEAVPKKLCGYLSKFGGKGPIRGWKSRWFFYDERKCQLYYSRTAQDANPLDSIDLSSAVFDCKADAEEGIFEIKTPSRVITLKAATKQAMLYWLQQLQMKRWEFHNSPPAPPATPDAALAGNGPVLHLELGQEEAELEEFLCPVKTPPGLVGVAAALQPFPALQNISLKHLGTEIQNTMHNIRGNKQAQGTGHEPPGEDSPQSGEPQREEQPLASDASTPGREPEDSPKPAPKPSLTISFAQKAKRQNNTFPFFSEGITRNRTAQEKVAALEQQVLMLTKELKSQKELVKILHKALEAAQQEKRASSAYLAAAEDKDRLELVRHKVRQIAELGRRVEALEQERESLAHTASLREQQVQELQQHVQLLMDKNHAKQQVICKLSEKVTQDFTHPPDQSPLRPDAANRDFLSQQGKIEHLKDDMEAYRTQNCFLNSEIHQVTKIWRKVAEKEKALLTKCAYLQARNCQVESKYLAGLRRLQEALGDEASECSELLRQLVQEALQWEAGEASSDSIELSPISKYDEYGFLTVPDYEVEDLKLLAKIQALESRSHHLLGLEAVDRPLRERWAALGDLVPSAELKQLLRAGVPREHRPRVWRWLVHLRVQHLHTPGCYQELLSRGQAREHPAARQIELDLNRTFPNNKHFSLPTASPIEGFHENKYTSS

SEQ ID NO: 890988 - protein, 71 aa, Homo sapiens
MHNIRGNKQAQGTGHEPPGEDSPQSGEPQREEQPLASDASTPGEPLSRAELPSGTSSSRLAQVPSFLPANQ

SEQ ID NO: 890989 - protein, 1008 aa, Homo sapiens
MSYDYHQNWGRDGGPRSSGGGYGGGPAGGHGGNRGSGGGGGGGGGGRGGRGRHPGHLKGREIGMWYAKKQGQKNKEAERQERAVVHMDERREEQIVQLLNSVQAKNDKESEAQISWFAPEDHGYGTEVSTKNTPCSENKLDIQEKKLINQEKKMFRIRNRSYIDRDSEYLLQENEPDGTLDQKLLEDLQKKKNDLRYIEMQHFREKLPSYGMQKELVNLIDNHQVTVISGETGCGKTTQVTQFILDNYIERGKGSACRIVCTQPRRISAISVAERVAAERAESCGSGNSTGYQIRLQSRLPRKQGSILYCTTGIILQWLQSDPYLSSVSHIVLDEIHERNLQSDVLMTVVKDLLNFRSDLKVILMSATLNAEKFSEYFGNCPMIHIPGFTFPVVEYLLEDVIEKIRYVPEQKEHRSQFKRGFMQGHVNRQEKEEKEAIYKERWPDYVRELRRRYSASTVDVIEMMEDDKVDLNLIVALIRYIVLEEEDGAILVFLPGWDNISTLHDLLMSQVMFKSDKFLIIPLHSLMPTVNQTQVFKRTPPGVRKIVIATNIAETSITIDDVVYVIDGGKIKETHFDTQNNISTMSAEWVSKANAKQRKGRAGRVQPGHCYHLYNGLRASLLDDYQLPEILRTPLEELCLQIKILRLGGIAYFLSRLMDPPSNEAVLLSIRHLMELNALDKQEELTPLGVHLARLPVEPHIGKMILFGALFCCLDPVLTIAASLSFKDPFVIPLGKEKIADARRKELAKDTRSDHLTVVNAFEGWEEARRRGFRYEKDYCWEYFLSSNTLQMLHNMKGQFAEHLLGAGFVSSRNPKDPESNINSDNEKIIKAVICAGLYPKVAKIRLNLGKKRKMVKVYTKTDGLVAVHPKSVNVEQTDFHYNWLIYHLKMRTSSIYLYDCTEVSPYCLLFFGGDISIQKDNDQETIAVDEWIVFQSPARIAHLVKELRKELDILLQEKIESPHPVDWNDTKSRDCAVLSAIIDLIKTQEKATPRNFPPRFQDGYYS

SEQ ID NO: 890990 - protein, 947 aa, Homo sapiens
SRTCYPCVLQQKNKEAERQERAVVHMDERREEQIVQLLNSVQAKNDKESEAQISWFAPEDHGYGTEVSTKNTPCSENKLDIQEKKLINQEKKMFRIRNRSYIDRDSEYLLQENEPDGTLDQKLLEDLQKKKNDLRYIEMQHFREKLPSYGMQKELVNLIDNHQVTVISGETGCGKTTQVTQFILDNYIERGKGSACRIVCTQPRRISAISVAERVAAERAESCGSGNSTGYQIRLQSRLPRKQGSILYCTTGIILQWLQSDPYLSSVSHIVLDEIHERNLQSDVLMTVVKDLLNFRSDLKVILMSATLNAEKFSEYFGNCPMIHIPGFTFPVVEYLLEDVIEKIRYVPEQKEHRSQFKRGFMQGHVNRQEKEEKEAIYKERWPDYVRELRRRYSASTVDVIEMMEDDKVDLNLIVALIRYIVLEEEDGAILVFLPGWDNISTLHDLLMSQVMFKSDKFLIIPLHSLMPTVNQTQVFKRTPPGVRKIVIATNIAETSITIDDVVYVIDGGKIKETHFDTQNNISTMSAEWVSKANAKQRKGRAGRVQPGHCYHLYNGLRASLLDDYQLPEILRTPLEELCLQIKILRLGGIAYFLSRLMDPPSNEAVLLSIRHLMELNALDKQEELTPLGVHLARLPVEPHIGKMILFGALFCCLDPVLTIAASLSFKDPFVIPLGKEKIADARRKELAKDTRSDHLTVVNAFEGWEEARRRGFRYEKDYCWEYFLSSNTLQMLHNMKGQFAEHLLGAGFVSSRNPKDPESNINSDNEKIIKAVICAGLYPKVAKIRLNLGKKRKMVKVYTKTDGLVAVHPKSVNVEQTDFHYNWLIYHLKMRTSSIYLYDCTEVSPYCLLFFGGDISIQKDNDQETIAVDEWIVFQSPARIAHLVKELRKELDILLQEKIESPHPVDWNDTKSRDCAVLSAIIDLIKTQEKATPRNFPPRFQDGYYS

SEQ ID NO: 890991 - protein, 1056 aa, Homo sapiens
MSYDYHQNWGRDGGPRSSGGGYGGGPAGGHGGNRGSGGGGGGGGGGRGGRGRHPGHLKGREIGMWYAKKQGQKNKEAERQERAVVHMDERREEQIVQLLNSVQAKNDKESEAQISWFAPEDHGYGTEVSTKNTPCSENKLDIQEKKLINQEKKMFRIRNRSYIDRDSEYLLQENEPDGTLDQKLLEDLQKKKNDLRYIEMQHFREKLPSYGMQKELVNLIDNHQVTVISGETGCGKTTQVTQFILDNYIERGKGSACRIVCTQPRRISAISVAERVAAERAESCGSGNSTGYQIRLQSRLPRKQGSILYCTTGIILQWLQSDPYLSSVSHIVLDEIHERNLQSDVLMTVVKDLLNFRSDLKVILMSATLNAEKFSEYFGNCPMIHIPGFTFPVVEYLLEDVIEKIRYVPEQKEHRSQFKRGFMQGHVNRQEKEEKEAIYKERWPDYVRELRRRYSASTVDVIEMMEDDKVDLNLIVALIRYIVLEEEDGAILVFLPGWDNISTLHDLLMSQVMFKSDKFLIIPLHSLMPTVNQTQVFKRTPPGVRKIVIATNIAETSITIDDVVYVIDGGKIKETHFDTQNNISTMSAEWVSKANAKQRKGRAGRVQPGHCYHLYNGLRASLLDDYQLPEILRTPLEELCLQIKILRLGGIAYFLSRLMDPPSNEAVLLSIRHLMELNALDKQEELTPLGVHLARLPVEPHIGKMILFGALFCCLDPVLTIAASLSFKDPFVIPLVRKMEIKPSYFRCEQELLRYIFHERFIRMSFSIIASEQFKLAMSAIFKGKEKIADARRKELAKDTRSDHLTVVNAFEGWEEARRRGFRYEKDYCWEYFLSSNTLQMLHNMKGQFAEHLLGAGFVSSRNPKDPESNINSDNEKIIKAVICAGLYPKVAKIRLNLGKKRKMVKVYTKTDGLVAVHPKSVNVEQTDFHYNWLIYHLKMRTSSIYLYDCTEVSPYCLLFFGGDISIQKDNDQETIAVDEWIVFQSPARIAHLVKELRKELDILLQEKIESPHPVDWNDTKSRDCAVLSAIIDLIKTQEKATPRNFPPRFQDGYYS

SEQ ID NO: 890992 - protein, 990 aa, Homo sapiens
MSYDYHQNWGRDGGPRSSGGGYGGGPAGGHGGNRGSGGGGGGGGGGRGGRGRHPGHLKGREIGMWYAKKQGQKNKEAERQERAVVHMDERREEQIVQLLNSVQAKNDKESEAQISWFAPEDHGYGTEVSTKNTPCSENKLDIQEKKLINQEKKMFRIRNRSYIDRDSEYLLQENEPDGTLDQKLLEDLQKKKNDLRYIEMQHFREKLPSYGMQKELVNLIDNHQVTVISGETGCGKTTQVTQFILDNYIERGKGSACRIVCTQPRRISAISVAERVAAERAESCGSGNSTGYQIRLQSRLPRKQGSILYCTTGIILQWLQSDPYLSSVSHIVLDEIHERNLQSDVLMTVVKDLLNFRSDLKVILMSATLNAEKFSEYFGNCPMIHIPGFTFPVVEYLLEDVIEKIRYVPEQKEHRSQFKRGFMQGHVNRQEKEEKEAIYKERWPDYVRELRRRYSASTVDVIEMMEDDKVDLNLIVALIRYIVLEEEDGAILVFLPGWDNISTLHDLLMSQVMFKSDKFLIIPLHSLMPTVNQTQVFKRTPPGVRKIVIATNIAETSITIDDVVYVIDGGKIKETHFDTQNNISTMSAEWVSKANAKQSLRASLLDDYQLPEILRTPLEELCLQIKILRLGGIAYFLSRLMDPPSNEAVLLSIRHLMELNALDKQEELTPLGVHLARLPVEPHIGKMILFGALFCCLDPVLTIAASLSFKDPFVIPLGKEKIADARRKELAKDTRSDHLTVVNAFEGWEEARRRGFRYEKDYCWEYFLSSNTLQMLHNMKGQFAEHLLGAGFVSSRNPKDPESNINSDNEKIIKAVICAGLYPKVAKIRLNLGKKRKMVKVYTKTDGLVAVHPKSVNVEQTDFHYNWLIYHLKMRTSSIYLYDCTEVSPYCLLFFGGDISIQKDNDQETIAVDEWIVFQSPARIAHLVKELRKELDILLQEKIESPHPVDWNDTKSRDCAVLSAIIDLIKTQEKATPRNFPPRFQDGYYS

SEQ ID NO: 890993 - protein, 796 aa, Homo sapiens
MSYDYHQNWGRDGGPRSSGGGYGGGPAGGHGGNRGSGGGGGGGGGGRGGRGRHPGHLKGREIGMWYAKKQGQKNKEAERQERAVVHMDERREEQIVQLLNSVQAKNDKESEAQISWFAPEDHGYGTEVSTKNTPCSENKLDIQEKKLINQEKKMFRIRNRSYIDRDSEYLLQENEPDGTLDQKLLEDLQKKKNDLRYIEMQHFREKLPSYGMQKELVNLIDNHQVTVISGETGCGKTTQVTQFILDNYIERGKGSACRIVCTQPRRISAISVAERVAAERAESCGSGNSTGYQIRLQSRLPRKQGSILYCTTGIILQWLQSDPYLSSVSHIVLDEIHERNLQSDVLMTVVKDLLNFRSDLKVILMSATLNAEKFSEYFGNCPMIHIPGFTFPVVEYLLEDVIEKIRYVPEQKEHRSQFKRGFMQGHVNRQEKEEKEAIYKERWPDYVRELRRRYSASTVDVIEMMEDDKVDLNLIVALIRYIVLEEEDGAILVFLPGWDNISTLHDLLMSQVMFKSDKFLIIPLHSLMPTVNQTQVFKRTPPGVRKIVIATNIAETSITIDDVVYVIDGGKIKETHFDTQNNISTMSAEWVSKANAKQRKGRAGRVQPGHCYHLYNGLRASLLDDYQLPEILRTPLEELCLQIKILRLGGIAYFLSRLMDPPSNEAVLLSIRHLMELNALDKQEELTPLGVHLARLPVEPHIGKMILFGALFCCLDPVLTIAASLSFKDPFVIPLGKEKIADARRKELAKDTRSDHLTVVNAFEGWEEARRRGFRYEKDYCWEYFLSSNTLQIMRR

SEQ ID NO: 890994 - protein, 348 aa, Homo sapiens
LLLRTHKQITQGKWGSSNALDKQEELTPLGVHLARLPVEPHIGKMILFGALFCCLDPVLTIAASLSFKDPFVIPLGKEKIADARRKELAKDTRSDHLTVVNAFEGWEEARRRGFRYEKDYCWEYFLSSNTLQMLHNMKGQFAEHLLGAGFVSSRNPKDPESNINSDNEKIIKAVICAGLYPKVAKIRLNLGKKRKMVKVYTKTDGLVAVHPKSVNVEQTDFHYNWLIYHLKMRTSSIYLYDCTEVSPYCLLFFGGDISIQKDNDQETIAVDEWIVFQSPARIAHLVKELRKELDILLQEKIESPHPVDWNDTKSRDCAVLSAIIDLIKTQEKATPRNFPPRFQDGYYS

SEQ ID NO: 890995 - protein, 810 aa, Homo sapiens
MSYDYHQNWGRDGGPRSSGGGYGGGPAGGHGGNRGSGGGGGGGGGGRGGRGRHPGHLKGREIGMWYAKKQGQKNKEAERQERAVVHMDERREEQIVQLLNSVQAKNDKESEAQISWFAPEDHGYGTEVSTKNTPCSENKLDIQEKKLINQEKKMFRIRNRSYIDRDSEYLLQENEPDGTLDQKLLEDLQKKKNDLRYIEMQHFREKLPSYGMQKELVNLIDNHQVTVISGETGCGKTTQVTQFILDNYIERGKGSACRIVCTQPRRISAISVAERVAAERAESCGSGNSTGYQIRLQSRLPRKQGSILYCTTGIILQWLQSDPYLSSVSHIVLDEIHERNLQSDVLMTVVKDLLNFRSDLKVILMSATLNAEKFSEYFGNCPMIHIPGFTFPVVEYLLEDVIEKIRYVPEQKEHRSQFKRGFMQGHVNRQEKEEKEAIYKERWPDYVRELRRRYSASTVDVIEMMEDDKVDLNLIVALIRYIVLEEEDGAILVFLPGWDNISTLHDLLMSQVMFKSDKFLIIPLHSLMPTVNQTQVFKRTPPGVRKIVIATNIAETSITIDDVVYVIDGGKIKETHFDTQNNISTMSAEWVSKANAKQRKGRAGRVQPGHCYHLYNGLRASLLDDYQLPEILRTPLEELCLQIKILRLGGIAYFLSRLMDPPSNEAVLLSIRHLMELNALDKQEELTPLGVHLARLPVEPHIGKMILFGALFCCLDPVLTIAASLSFKDPFVIPLGKEKIADARRKELAKDTRSDHLTVVNAFEAWEEARRRGLRHGKDDCRAPTRGCRHTPRHCKTEQDSMFELRVDGS

SEQ ID NO: 890996 - protein, 106 aa, Homo sapiens
YGTEVSTKNTPCSENKLDIQEKKLINQEKKMFRIRNRSYIDRDSEYLLQENEPDGTLDQKLLEDLQKKKNDLRYIEMQVVERCQKIFCHFFLTLYKNVCMVRGSCM

SEQ ID NO: 890997 - protein, 671 aa, Homo sapiens
MQPDMSLNVIKMKSSDFLESAELDSGGFGKVSLCFHRTQGLMIMKTVYKGPNCIEHNEALLEEAKMMNRLRHSRVVKLLGVIIEEGKYSLVMEYMEKGNLMHVLKAEMSTPLSVKGRIILEIIEGMCYLHGKGVIHKDLKPENILVDNDFHIKIADLGLASFKMWSKLNNEEHNELREVDGTAKKNGGTLYYMAPEHLNDVNAKPTEKSDVYSFAVVLWAIFANKEPYENAICEQQLIMCIKSGNRPDVDDITEYCPREIISLMKLCWEANPEARPTFPGIEEKFRPFYLSQLEESVEEDVKSLKKEYSNENAVVKRMQSLQLDCVAVPSSRSNSATEQPGSLHSSQGLGMGPVEESWFAPSLEHPQEENEPSLQSKLQDEANYHLYGSRMDRQTKQQPRQNVAYNREEERRRRVSHDPFAQQRPYENFQNTEGKGTAYSSAASHGNAVHQPSGLTSQPQVLYQNNGLYSSHGFGTRPLDPGTAGPRVWYRPIPSHMPSLHNIPVPETNYLGNTPTMPFSSLPPTDESIKYTIYNSTGIQIGAYNYMEIGGTSSSLLDSTNTNFKEEPAAKYQAIFDNTTSLTDKHLDPIRENLGKHWKNCARKLGFTQSQIDEIDHDYERDGLKEKVYQMLQKWVMREGIKGATVGKLAQALHQCSRIDLLSSLIYVSQN

SEQ ID NO: 890998 - protein, 671 aa, Homo sapiens; identical to SEQ ID NO: 890997

SEQ ID NO: 890999 - protein, 671 aa, Homo sapiens; identical to SEQ ID NO: 890997

SEQ ID NO: 891000 - protein, 606 aa, Homo sapiens
MMNRLRHSRVVKLLGVIIEEGKYSLVMEYMEKGNLMHVLKAEMSTPLSVKGRIILEIIEGMCYLHGKGVIHKDLKPENILVDNDFHIKIADLGLASFKMWSKLNNEEHNELREVDGTAKKNGGTLYYMAPEHLNDVNAKPTEKSDVYSFAVVLWAIFANKEPYENAICEQQLIMCIKSGNRPDVDDITEYCPREIISLMKLCWEANPEARPTFPGIEEKFRPFYLSQLEESVEEDVKSLKKEYSNENAVVKRMQSLQLDCVAVPSSRSNSATEQPGSLHSSQGLGMGPVEESWFAPSLEHPQEENEPSLQSKLQDEANYHLYGSRMDRQTKQQPRQNVAYNREEERRRRVSHDPFAQQRPYENFQNTEGKGTAYSSAASHGNAVHQPSGLTSQPQVLYQNNGLYSSHGFGTRPLDPGTAGPRVWYRPIPSHMPSLHNIPVPETNYLGNTPTMPFSSLPPTDESIKYTIYNSTGIQIGAYNYMEIGGTSSSLLDSTNTNFKEEPAAKYQAIFDNTTSLTDKHLDPIRENLGKHWKNCARKLGFTQSQIDEIDHDYERDGLKEKVYQMLQKWVMREGIKGATVGKLAQALHQCSRIDLLSSLIYVSQN

SEQ ID NO: 891001 - protein, 564 aa, Homo sapiens
MSTPLSVKGRIILEIIEGMCYLHGKGVIHKDLKPENILVDNDFHIKIADLGLASFKMWSKLNNEEHNELREVDGTAKKNGGTLYYMAPEHLNDVNAKPTEKSDVYSFAVVLWAIFANKEPYENAICEQQLIMCIKSGNRPDVDDITEYCPREIISLMKLCWEANPEARPTFPGIEEKFRPFYLSQLEESVEEDVKSLKKEYSNENAVVKRMQSLQLDCVAVPSSRSNSATEQPGSLHSSQGLGMGPVEESWFAPSLEHPQEENEPSLQSKLQDEANYHLYGSRMDRQTKQQPRQNVAYNREEERRRRVSHDPFAQQRPYENFQNTEGKGTAYSSAASHGNAVHQPSGLTSQPQVLYQNNGLYSSHGFGTRPLDPGTAGPRVWYRPIPSHMPSLHNIPVPETNYLGNTPTMPFSSLPPTDESIKYTIYNSTGIQIGAYNYMEIGGTSSSLLDSTNTNFKEEPAAKYQAIFDNTTSLTDKHLDPIRENLGKHWKNCARKLGFTQSQIDEIDHDYERDGLKEKVYQMLQKWVMREGIKGATVGKLAQALHQCSRIDLLSSLIYVSQN

SEQ ID NO: 891002 - protein, 354 aa, Homo sapiens [sequence omitted]

SEQ ID NO: 891003 - protein, 406 aa, Homo sapiens
FSYYSLTASEELLLLFVKLVGRGPSPKCFGLVSYLFSVCYFEIQIHDGAQILFYFLMFHDTHSNVDHFFSATEQPGSLHSSQGLGMGPVEESWFAPSLEHPQEENEPSLQSKLQDEANYHLYGSRMDRQTKQQPRQNVAYNREEERRRRVSHDPFAQQRPYENFQNTEGKGTAYSSAASHGNAVHQPSGLTSQPQVLYQNNGLYSSHGFGTRPLDPGTAGPRVWYRPIPSHMPSLHNIPVPETNYLGNTPTMPFSSLPPTDESIKYTIYNSTGIQIGAYNYMEIGGTSSSLLDSTNTNFKEEPAAKYQAIFDNTTSLTDKHLDPIRENLGKHWKNCARKLGFTQSQIDEIDHDYERDGLKEKVYQMLQKWVMREGIKGATVGKLAQALHQCSRIDLLSSLIYVSQN

SEQ ID NO: 891004 - protein, 171 aa, Homo sapiens
AYDLELACTKLWDLLFLDPVVIVPTDESIKYTIYNSTGIQIGAYNYMEIGGTSSSLLDSTNTNFKEEPAAKYQAIFDNTTSLTDKHLDPIRENLGKHWKNCARKLGFTQSQIDEIDHDYERDGLKEKVYQMLQKWVMREGIKGATVGKLAQALHQCSRIDLLSSLIYVSQN

SEQ ID NO: 891005 - protein, 529 aa, Homo sapiens
MMNRLRHSRVVKLLGVIIEEGKYSLVMEYMEKGNLMHVLKAEMSTPLSVKGRIILEIIEGMCYLHGKGVIHKDLKPENILVDNDFHIKIADLGLASFKMWSKLNNEEHNELREVDGTAKKNGGTLYYMAPEHLNDVNAKPTEKSDVYSFAVVLWAIFANKEPYENAICEQQLIMCIKSGNRPDVDDITEYCPREIISLMKLCWEANPEARPTFPGIEEKFRPFYLSQLEESVEEDVKSLKKEYSNENAVVKRMQSLQLDCVAVPSSRSNSATEQPGSLHSSQGLGMGPVEESWFAPSLEHPQEENEPSLQSKLQDEANYHLYGSRMDRQTKQQPRQNVAYNREEERRRRVSHDPFAQQRPYENFQNTEGKGTAYSSAASHGNAVHQPSGLTSQPQVLYQNNGLYSSHGFGTRPLDPGTAGPRVWYRPIPSHMPSLHNIPVPETNYLGNTPTMPFSSLPPTDESIKYTIYNSTGIQIGAYNYMEIGGTSSSLLDSTNTNFKEEPAAKYQAIFGKIPWKDSTPSNLELSYL

SEQ ID NO: 891006 - protein, 207 aa, Homo sapiens
MSTPLSVKGRIILEIIEGMCYLHGKGVIHKDLKPENILVDNDFHIKIADLGLASFKMWSKLNNEEHNELREVDGTAKKNGGTLYYMAPEHLNDVNAKPTEKSDVYSFAVVLWAIFANKEPYENAICEQQLIMCIKSGNRPDVDDITEYCPREIISLMKLCWEANPEARPTFPGIEEKFRPFYLSQLEESVEEDVKSLKVGNIADAQN

SEQ ID NO: 891007 - protein, 115 aa, Homo sapiens
EEIGTDPSMTPARGSDVLEVCTRLLRRWLCQPQHSTFPAHRHNEALLEEAKMMNRLRHSRVVKLLGVIIEEGKYSLVMEYMEKGNLMHVLKAEVERAPPHGDPQRLGPGCLLWLP

SEQ ID NO: 891008 - protein, 176 aa, Homo sapiens
QKGTWAGLRGAGGAGAPRRAARRARARGVVVSPKAEAAAGARRRRACEAVVLPALVFPLLSGWRRPKRCWARSPFLSLRRPLPALSRCTVSPTQDCPGPDMARGQQKIQSQQKNAKKQAGQKKKQGHDQKAAAKAALIYTCTVCRTQMPDPKTFKQHFESKHPKTPLPPELADVQA

SEQ ID NO: 891009 - protein, 165 aa, Homo sapiens
QKGTWAGLRGAGGAGAPRRAARRARARGVVVSPKAEAAAGARRRRACEAVVLPALVFPLLSGWRRPKRCWARSPFLSLRRPLPALSRCTVSPTQDCPGPESHCRPGCSAVVPSRVTATSASRIQAILHLSLPSSWNYRYGSWTAENSVSAEKCQKASWTKEETRT

SEQ ID NO: 891010 - protein, 140 aa, Homo sapiens
EEEEFYLSCAIKCLPSASTLPVAAYCITVIAVRRSESLPIAQSSRKKRSQSPTLSALMEVCSFDMARGQQKIQSQQKNAKKQAGQKKKQGHDQKAAAKAALIYTCTVCRTQMPDPKTFKQHFESKHPKTPLPPELADVQA

SEQ ID NO: 891011 - protein, 121 aa, Homo sapiens
QKGTWAGLRGAGGAGAPRRAARRARARGVVVSPKAEAAAGARGCCAPGSRVSPPERVEEAQAVLGALPLPFPPASSPGPLALHCLSDARLSRPGYGSWTAENSVSAEKCQKASWTKEETRT

SEQ ID NO: 891012 - protein, 221 aa, Homo sapiens
RGGPREGDEFGRLPGPAGGRVAGQPRKRSGNLTPGDSRRSAARVWRSRWTQGPGFGQSRPPGGASWSRVREDWLDGGCVAFGGREEEGVSEAGEAGWEGRCARLKLGSEKCWVETSLWVRSSSPLPKTMVLKARVRMWSAAWASSFPMVMENEPTSWTQNPFLLLLIYVGFKRSFGAELTCCLLRERLILELVSSTTSLFAAPSENHTESCIKNQHVGICK

SEQ ID NO: 891013 - protein, 121 aa, Homo sapiens; identical to SEQ ID NO: 891011

SEQ ID NO: 891014 - protein, 229 aa, Homo sapiens
QKGTWAGLRGAGGAGAPRRAARRARARGVVVSPKAEAAAGARRRRACEAVVLPALVFPLLSGWRRPKRCWARSPFLSLRRPLPALSRCTVSPTQDCPGPAPSENHTESCIKNQHSLTVAQAAVQWCHHASLQPLPPGFKQFSTSASQVAGITDMARGQQKIQSQQKNAKKQAGQKKKQGHDQKAAAKAALIYTCTVCRTQMPDPKTFKQHFESKHPKTPLPPELADVQA

SEQ ID NO: 891015 - protein, 176 aa, Homo sapiens; identical to SEQ ID NO: 891008

SEQ ID NO: 891016 - protein, 121 aa, Homo sapiens; identical to SEQ ID NO: 891011

SEQ ID NO: 891017 - protein, 121 aa, Homo sapiens; identical to SEQ ID NO: 891011

SEQ ID NO: 891018 - protein, 331 aa, Homo sapiens
RGGPREGDEFGRLPGPAGGRVAGQPRKRSGNLTPGDSRRSAARVWRSRWTQGPGFGQSRPPGGASWSRVREDWLDGGCVAFGGREEEGVSEAGEAGWEGRCARLKLGSEKCWVETSLWVRSSSPLPKTMVLKARVRMWSAAWASSFPMVMENEPTSWTQNPFLLLLIYVGFKRSFGAELTCCLLRERLILELVSSTTSLFAAPSENHTESCIKNQHSLTVAQAAVQWCHHASLQPLPPGFKQFSTSASQVAGITDMARGQQKIQSQQKNAKKQAGQKKKQGHDQKAAAKAALIYTCTVCRTQMPDPKTFKQHFESKHPKTPLPPELADVQA

SEQ ID NO: 891019 - protein, 121 aa, Homo sapiens; identical to SEQ ID NO: 891011

SEQ ID NO: 891020 - protein, 116 aa, Homo sapiens
TRDVIPYTSPTPASAWRTFLPKTMVLKARVRMWSAAWASSFPMVMENEPTSWTQNPFLLLLIYVGFKRSFGAELTCCLLRERLILELVSSTTSLFAAPSENHTESCIKNQHVGICK

SEQ ID NO: 891021 - protein, 121 aa, Homo sapiens
MRIMLLFTAILAFSLAQSFGAVCKEPQEEVVPGGGRSKRDPDLYQLLQRLFKSHSSLEGLLKALSQASTDPKESTSPEKRDMHDFFVGLMGKRSVQPDSPTDVNQENVPSFGILKYPPRAE

SEQ ID NO: 891022 - protein, 121 aa, Homo sapiens; identical to SEQ ID NO: 891021

SEQ ID NO: 891023 - protein, 440 aa, Homo sapiens
MKFLLIKDAPGKKKRKNLMLSFKRKHAKGQDLFDQIVYHLDLVETDYFGLQFLDSAQVAHWLDHAKPIKKQMKIGPAYALHFRVKYYSSEPNNLREEFTRYLFVLQLRHDILSGKLKCPYETAVELAALCLQAELGECELPEHTPELVSEFRFIPNQTEAMEFDIFQRWKECRGKSPAQAELSYLNKAKWLEMYGVDMHVVRGRDGCEYSLGLTPTGILIFEGANKIGLFFWPKITKMDFKKSKLTLVVVEDDDQGREQEHTFVFRLDSARTCKHLWKCAVEHHAFFRLRTPGNSKSNRSDFIRLGSRFRFSGRTEYQATHGSRLRRTSTFERKPSKRYPSRRHSTFKASNPVIAAQLCSKTNPEVHNYQPQYHPNIHPSQPRWHPHSPNVRPSFQDDRSHWKASASGDDSHFDYVHDQNQKNLGGMQSMMYRDKLMTAL

SEQ ID NO: 891024 - protein, 445 aa, Homo sapiens
HISAAGAAKATLYCRVFLLDGTEVSVDLPKHAKGQDLFDQIVYHLDLVETDYFGLQFLDSAQVAHWLDHAKPIKKQMKIGPAYALHFRVKYYSSEPNNLREEFTRYLFVLQLRHDILSGKLKCPYETAVELAALCLQAELGECELPEHTPELVSEFRFIPNQTEAMEFDIFQRWKECRGKSPAQAELSYLNKAKWLEMYGVDMHVVRGRDGCEYSLGLTPTGILIFEGANKIGLFFWPKITKMDFKKSKLTLVVVEDDDQGREQEHTFVFRLDSARTCKHLWKCAVEHHAFFRLRTPGNSKSNRSDFIRLGSRFRFSGRTEYQATHGSRLRRTSTFERKPSKRYPSRRHSTFKASNPVIAAQLCSKTNPEVHNYQPQYHPNIHPSQPRWHPHSPNVRPSFQDDRSHWKASASGDDSHFDYVHDQNQKNLGGMQSMMYRDKLMTAL

SEQ ID NO: 891025 - protein, 353 aa, Homo sapiens
MVDHQLTFPGIQIDKCPCNDIQAVGNITLRLYSTQVGGIGCGAERSRKVLTRSLVRLRGFRVRFQNLQTMNATGTVSIFQRWKECRGKSPAQAELSYLNKAKWLEMYGVDMHVVRGRDGCEYSLGLTPTGILIFEGANKIGLFFWPKITKMDFKKSKLTLVVVEDDDQGREQEHTFVFRLDSARTCKHLWKCAVEHHAFFRLRTPGNSKSNRSDFIRLGSRFRFSGRTEYQATHGSRLRRTSTFERKPSKRYPSRRHSTFKASNPVIAAQLCSKTNPEVHNYQPQYHPNIHPSQPRWHPHSPNVRPSFQDDRSHWKASASGDDSHFDYVHDQNQKNLGGMQSMMYRDKLMTAL

SEQ ID NO: 891026 - protein, 445 aa, Homo sapiens; identical to SEQ ID NO: 891024

SEQ ID NO: 891027 - protein, 317 aa, Homo sapiens
HISAAGAAKATLYCRVFLLDGTEVSVDLPKHAKGQDLFDQIVYHLDLVETDYFGLQFLDSAQVAHWLDHAKPIKKQMKIGPAYALHFRVKYYSSEPNNLREEFTRYLFVLQLRHDILSGKLKCPYETAVELAALCLQAELGECELPEHTPELVSEFRFIPNQTEAMEFDIFQRWKECRGKSPAQAELSYLNKAKWLEMYGVDMHVVRGRDGCEYSLGLTPTGILIFEGANKIGLFFWPKITKMDFKKSKLTLVVVEDDDQGREQEHTFVFRLDSARTCKHLWKCAVEHHAFFRLRTPGNSKSNRSDFIRLGSRFRFR

SEQ ID NO: 891028 - protein, 445 aa, Homo sapiens; identical to SEQ ID NO: 891024

SEQ ID NO: 891029 - protein, 134 aa, Homo sapiens
MVQQHDYLKFLVTPSCFSGGKMPTAQEIVLPFERGQGMGACPEKGDGLMKGGHSAREEGARTLSVLFHEEDYAGVCSPLVQSCPEIAQCKEQFSKDQKSCLKIAVRSQPLQVYTAQREGPPGVAVTEGSGRPVV

SEQ ID NO: 891030 - protein, 427 aa, Homo sapiens
HISAAGAAKATLYCRVFLLDGTEVSVDLPKHAKGQDLFDQIVYHLDLVETDYFGLQFLDSAQVAHWLDHAKPIKKQMKIGPAYALHFRVKYYSSEPNNLREEFTRYLFVLQLRHDILSGKLKCPYETAVELAALCLQAELGECELPEHTPELVSEFRFIPNQTEAMEFDIFQRWKECRGKSPAQAELSYLNKAKWLEMYGVDMHVVRGRDGCEYSLGLTPTGILIFEGANKIGLFFWPKITKMDFKKSKLTLVVVEDDDQGREQEHTFVFRLDSARTCKHLWKCAVEHHAFFRLRTPGNSKSNRSDFIRLGSRFRFSGRTEYQATHGSRLRRTSTFERKPSKRYPSRRHSTFKASNPVIAAQLCHPSQPRWHPHSPNVRPSFQDDRSHWKASASGDDSHFDYVHDQNQKNLGGMQSMMYRDKLMTAL

SEQ ID NO: 891031 - protein, 445 aa, Homo sapiens; identical to SEQ ID NO: 891024

SEQ ID NO: 891032 - protein, 213 aa, Homo sapiens
HISAAGAAKATLYCRVFLLDGTEVSVDLPKHAKGQDLFDQIVYHLDLVETDYFGLQFLDSAQVAHWLDHAKPIKKQMKIGPAYALHFRVKYYSSEPNNLREEFTRYLFVLQLRHDILSGKLKCPYETAVELAALCLQAELGECELPEHTPELVSEFRFIPNQTEAMEFDIFQRWKECRGKSPAQAELSYLNKAKWLEMYGVDMHVVRVRTVCV

SEQ ID NO: 891033 - protein, 534 aa, Homo sapiens [sequence omitted]

SEQ ID NO: 891034 - protein, 486 aa, Homo sapiens [sequence omitted]

SEQ ID NO: 891035 - protein, 534 aa, Homo sapiens [sequence omitted]

SEQ ID NO: 891036 - protein, 534 aa, Homo sapiens [sequence omitted]

SEQ ID NO: 891037 - protein, 534 aa, Homo sapiens [sequence omitted]

SEQ ID NO: 891038 - protein, 534 aa, Homo sapiens [sequence omitted]

SEQ ID NO: 891039 - protein, 534 aa, Homo sapiens [sequence omitted]

SEQ ID NO: 891040 - protein, 534 aa, Homo sapiens [sequence omitted]

SEQ ID NO: 891041 - protein, 534 aa, Homo sapiens [sequence omitted]

SEQ ID NO: 891042 - protein, 534 aa, Homo sapiens [sequence omitted]

SEQ ID NO: 891043 - protein, 534 aa, Homo sapiens [sequence omitted]

SEQ ID NO: 891044 - protein, 226 aa, Homo sapiens
MRLRGCGPRAAPASSAGASDARLLAPPGRNPFVHELRLSALQKAQVALMTLTLFPVRLLVAAAMMLLAWPLALVASLGSAEKEPEQPPALWRKVVDFLLKAIMRTMWFAGGFHRVAVKGRQALPTEAAILTLAPHSSYFDAIPVTMTMSSIVMKAESRDIPIWGTLIQYIRPVFVSRSDQDSRRKTVEEIKRRAQSNGKWPQIMIFPEGTCTNRCAFVRFGDPLVQ

SEQ ID NO: 891045 - protein, 84 aa, Homo sapiens [sequence omitted]

SEQ ID NO: 891046 - protein, 415 aa, Homo sapiens
MDFDKKGGKGETEEGRRMSKAGGGRSSHGIRSSGTSSGVLMVGPNFRVGKKIGCGNFGELRLGKNLYTNEYVAIKLEPIKSRAPQLHLEYRFYKQLSATEGVPQVYYFGPCGKYNAMVLELLGPSLEDLFDLCDRTFTLKTVLMIAIQLITRMEYVHTKSLIYRDVKPENFLVGRPGTKRQHAIHIIDFGLAKEYIDPETKKHIPYREHKSLTGTARYMSINTHLGKEQSRRDDLEALGHMFMYFLRGSLPWQGLKADTLKERYQKIGDTKRATPIEVLCENFPEEMATYLRYVRRLDFFEKPDYDYLRKLFTDLFDRSGFVFDYEYDWAGKPLPTPIGTVHTDLPSQPQLRDKTQPHSKNQALNSTNGELNADDPTAGHSNAPITAPAEVEVADETKCCCFFKRRKRKSLQRHK

SEQ ID NO: 891047 - protein, 367 aa, Homo sapiens
MDRWMVAVRMDRVAGKNLYTNEYVAIKLEPIKSRAPQLHLEYRFYKQLSATEGVPQVYYFGPCGKYNAMVLELLGPSLEDLFDLCDRTFTLKTVLMIAIQLITRMEYVHTKSLIYRDVKPENFLVGRPGTKRQHAIHIIDFGLAKEYIDPETKKHIPYREHKSLTGTARYMSINTHLGKEQSRRDDLEALGHMFMYFLRGSLPWQGLKADTLKERYQKIGDTKRATPIEVLCENFPEEMATYLRYVRRLDFFEKPDYDYLRKLFTDLFDRSGFVFDYEYDWAGKPLPTPIGTVHTDLPSQPQLRDKTQPHSKNQALNSTNGELNADDPTAGHSNAPITAPAEVEVADETKCCCFFKRRKRKSLQRHK

SEQ ID NO: 891048 - protein, 447 aa, Homo sapiens
MDFDKKGGKGETEEGRRMSKAGGGRSSHGIRSSGTSSGVLMVGPNFRVGKKIGCGNFGELRLGKNLYTNEYVAIKLVSRPLHPTPADVPPRDFRAATRSPGDSLLCPQEPIKSRAPQLHLEYRFYKQLSATEGVPQVYYFGPCGKYNAMVLELLGPSLEDLFDLCDRTFTLKTVLMIAIQLITRMEYVHTKSLIYRDVKPENFLVGRPGTKRQHAIHIIDFGLAKEYIDPETKKHIPYREHKSLTGTARYMSINTHLGKEQSRRDDLEALGHMFMYFLRGSLPWQGLKADTLKERYQKIGDTKRATPIEVLCENFPEEMATYLRYVRRLDFFEKPDYDYLRKLFTDLFDRSGFVFDYEYDWAGKPLPTPIGTVHTDLPSQPQLRDKTQPHSKNQALNSTNGELNADDPTAGHSNAPITAPAEVEVADETKCCCFFKRRKRKSLQRHK

SEQ ID NO: 891049 - protein, 415 aa, Homo sapiens; identical to SEQ ID NO: 891046

SEQ ID NO: 891050 - protein, 438 aa, Homo sapiens
MDFDKKGGKGETEEGRRMSKAGGGRSSHGIRSSGTSSGVLMVGPNFRVGKKIGCGNFGELRLGKNLYTNEYVAIKLEPIKSRAPQLHLEYRFYKQLSATEGVPQVYYFGPCGKYNAMVLELLGPSLEDLFDLCDRTFTLKTVLMIAIQLITRMEYVHTKSLIYRDVKPENFLVGRPGTKRQHAIHIIDFGLAKEYIDPETKKHIPYREHKSLTGTARYMSINTHLGKGELRARGGGRAPGPQLRLRPCPAEQSRRDDLEALGHMFMYFLRGSLPWQGLKADTLKERYQKIGDTKRATPIEVLCENFPEEMATYLRYVRRLDFFEKPDYDYLRKLFTDLFDRSGFVFDYEYDWAGKPLPTPIGTVHTDLPSQPQLRDKTQPHSKNQALNSTNGELNADDPTAGHSNAPITAPAEVEVADETKCCCFFKRRKRKSLQRHK

SEQ ID NO: 891051 - protein, 276 aa, Homo sapiens
MDFDKKGGKGETEEGRRMSKAGGGRSSHGIRSSGTSSGVLMVGPNFRVGKKIGCGNFGELRLGKNLYTNEYVAIKLEPIKSRAPQLHLEYRFYKQLSATEGVPQVYYFGPCGKYNAMVLELLGPSLEDLFDLCDRTFTLKTVLMIAIQLITRMEYVHTKSLIYRDVKPENFLVGRPGTKRQHAIHIIDFGLAKEYIDPETKKHIPYREHKSLTGTARYMSINTHLGKGRHAQGAVPEDRGHQTRHAHRGALRELPRGDGHVPALCAAPGLLREARL

SEQ ID NO: 891052 - protein, 154 aa, Homo sapiens
MLHQSSGAAGTAAAVSSQPGPGKGRVGAARRVLLDALAPGGCAPAPGTRGGRTGWCHPARPSALPRGARGHGASCLSAPTPGKQPETKRLKAPGPALQVYCRGLGAALDWRAVPQWGALEAAGQSGAAWGRAQGGGCESSFCFTKCTEMAFTFL

SEQ ID NO: 891053 - protein, 154 aa, Homo sapiens; identical to SEQ ID NO: 891052

SEQ ID NO: 891054 - protein, 154 aa, Homo sapiens; identical to SEQ ID NO: 891052

SEQ ID NO: 891055 - protein, 415 aa, Homo sapiens; identical to SEQ ID NO: 891046

SEQ ID NO: 891056 - protein, 415 aa, Homo sapiens; identical to SEQ ID NO: 891046

SEQ ID NO: 891057 - protein, 399 aa, Homo sapiens
MDRWMVAVRMDRVAGKNLYTNEYVAIKLVSRPLHPTPADVPPRDFRAATRSPGDSLLCPQEPIKSRAPQLHLEYRFYKQLSATEGVPQVYYFGPCGKYNAMVLELLGPSLEDLFDLCDRTFTLKTVLMIAIQLITRMEYVHTKSLIYRDVKPENFLVGRPGTKRQHAIHIIDFGLAKEYIDPETKKHIPYREHKSLTGTARYMSINTHLGKEQSRRDDLEALGHMFMYFLRGSLPWQGLKADTLKERYQKIGDTKRATPIEVLCENFPEEMATYLRYVRRLDFFEKPDYDYLRKLFTDLFDRSGFVFDYEYDWAGKPLPTPIGTVHTDLPSQPQLRDKTQPHSKNQALNSTNGELNADDPTAGHSNAPITAPAEVEVADETKCCCFFKRRKRKSLQRHK

SEQ ID NO: 891058 - protein, 359 aa, Homo sapiens
MDFDKKGGKGETEEGRRMSKAGGGRSSHGIRSSGTSSGVLMVGPNFRVGKKIGCGNFGELRLGKNLYTNEYVAIKLEPIKSRAPQLHLEYRFYKQLSATEGVPQVYYFGPCGKYNAMVLELLGPSLEDLFDLCDRTFTLKTVLMIAIQLITRMEYVHTKSLIYRDVKPENFLVGRPGTKRQHAIHIIDFGLAKEYIDPETKKHIPYREHKSLTGTARYMSINTHLGKEQSRRDDLEALGHMFMYFLRGSLPWQGLKADTLKERYQKIGDTKRATPIEVLCENFPEEMATYLRYVRRLDFFEKPDYDYLRKLFTDLFDRSGFVFDYEYDWAGKPLPTPIGTVHTDLPSQPQLRDKTQAAP

SEQ ID NO: 891059 - protein, 355 aa, Homo sapiens
MDFDKKGGKGETEEGRRMSKAGGGRSSHGIRSSGTSSGVLMVGPNFRVGKKIGCGNFGELRLGKNLYTNEYVAIKLEPIKSRAPQLHLEYRFYKQLSATEGVPQVYYFGPCGKYNAMVLELLGPSLEDLFDLCDRTFTLKTVLMIAIQLITRMEYVHTKSLIYRDVKPENFLVGRPGTKRQHAIHIIDFGLAKEYIDPETKKHIPYREHKSLTGTARYMSINTHLGKEQSRRDDLEALGHMFMYFLRGSLPWQGLKADTLKERYQKIGDTKRATPIEVLCENFPEEMATYLRYVRRLDFFEKPDYDYLRKLFTDLFDRSGFVFDYDRPPSAPSTPTCPPSLSSGTKPSRTAKTRR

SEQ ID NO: 891060 - protein, 179 aa, Homo sapiens
RPGRRAGTQGGSKADHRPPQADTLKERYQKIGDTKRATPIEVLCENFPEEMATYLRYVRRLDFFEKPDYDYLRKLFTDLFDRSGFVFDYEYDWAGKPLPTPIGTVHTDLPSQPQLRDKTQPHSKNQALNSTNGELNADDPTAGHSNAPITAPAEVEVADETKCCCFFKRRKRKSLQRHK

SEQ ID NO: 891061 - protein, 154 aa, Homo sapiens; identical to SEQ ID NO: 891052

SEQ ID NO: 891062 - protein, 415 aa, Homo sapiens; identical to SEQ ID NO: 891046

SEQ ID NO: 891063 - protein, 363 aa, Homo sapiens
MDFDKKGGKGETEEGRRMSKAGGGRSSHGIRSSGTSSGVLMVGPNFRVGKKIGCGNFGELRLGKNLYTNEYVAIKLEPIKSRAPQLHLEYRFYKQLSATEGVPQVYYFGPCGKYNAMVLELLGPSLEDLFDLCDRTFTLKTVLMIAIQLITRMEYVHTKSLIYRDVKPENFLVGRPGTKRQHAIHIIDFGLAKEYIDPETKKHIPYREHKSLTGTARYMSINTHLGKEQSRRDDLEALGHMFMYFLRGSLPWQGLKADTLKERYQKIGDTKRATPIEVLCENFPEEMATYLKNIGALPVDMVRLYFAETVLALEYLHNYGIVHRDLKPDNLLITSMGHIKLTDFGLSKIGLIQVRCQTHEANF

SEQ ID NO: 891064 - protein, 779 aa, Homo sapiens
SVSRPGRRLPPTLSAVASQLLRRGEDSGRHRSGAAPRSPGGSQARIPPDWDVASADPSEAEATPEAGQGHWLVVQKGNLKKKPKGLVGAQAERRESLKATSFEFKGKKESRRENQVDLPGHILDQAFLLKHHCVRKPSDLCTINVSGLKFSKAKENDFKHFHSVIYINASENLLPLEAFHTFPALKELDLAFNGIKTIYVKYGDFKLLEFLDLSFNSLTVEAICDLGILPHLRVLLLTGNGLTSLPPNLAVAEQEASVTSLTSKRYILRFPALETLMLDDNRLSNPSCFASLAGLRRLKKLSLDENRIIRIPYLQQVQLYDESVDWNGGRGSPHKEPQFMLQSKPRMLEDSDEQLDYTVLPMKKDVDRKIAKEDAVLPVALFPSLCEFVFHNNPLVAHTRGVPPLLKSFLQERLGIHLIRRKIVKPKHHVLMSRKESWKVKSEIPKVPKQPLVLHHPRMTTTKSPSKDMLEPEAELAEDLPTTKSTSVESEMPTENLEGHSPSCRTFVPLPPICSNSTVHSEETLSHLSDTTVRLSPERPSDEDSKSTESIFLTQVSELPSSVIHKDDLELKEKDQKKPPTAPREVKGTRRKLPTAFLPSKYHGYEELLTAKPDPAFIEPKGIQKNAQALQQMLKHPLLCHSSKPKLDTLQKPYVHKEKRAQRIPIPPPKKTRAQLLDDIFIRLRDPRNITEAPLGAVLHQWTERRLVNHKQYLEAKRLLKEFQARYRQLVSGSLRTVFGTTPLPMACPALSESQPKFGHFLEFMDEFCQEPTASDSQG

SEQ ID NO: 891065 - protein, 720 aa, Homo sapiens
MSQSQRSSQGHWLVVQKGNLKKKPKGLVGAQAERRESLKATSFEFKGKKESRRENQVDLPGHILDQAFLLKHHCVRKPSDLCTINVSGLKFSKAKENDFKHFHSVIYINASENLLPLEAFHTFPALKELDLAFNGIKTIYVKYGDFKLLEFLDLSFNSLTVEAICDLGILPHLRVLLLTGNGLTSLPPNLAVAEQEASVTSLTSKRYILRFPALETLMLDDNRLSNPSCFASLAGLRRLKKLSLDENRIIRIPYLQQVQLYDESVDWNGGRGSPHKEPQFMLQSKPRMLEDSDEQLDYTVLPMKKDVDRTDRKRGCCPTSSSLPISLEFVFHNNPLVAHTRGVPPLLKSFLQERLGIHLIRRKIVKPKHHVLMSRKESWKVKSEIPKVPKQPLVLHHPRMTTTKSPSKDMLEPEAELAEDLPTTKSTSVESEMPTENLEGHSPSCRTFVPLPPICSNSTVHSEETLSHLSDTTVRLSPERPSDEDSKSTESIFLTQVSELPSSVIHKDDLELKEKDQKKPPTAPREVKGTRRKLPTAFLPSKYHGYEELLTAKPDPAFIEPKGIQKNAQALQQMLKHPLLCHSSKPKLDTLQKPYVHKEKRAQRIPIPPPKKTRAQLLDDIFIRLRDPRNITEAPLGAVLHQWTERRLVNHKQYLEAKRLLKEFQARYRQLVSGSLRTVFGTTPLPMACPALSESQPKFGHFLEFMDEFCQEPTASDSQG

SEQ ID NO: 891066 - protein, 348 aa, Homo sapiens [sequence omitted]

SEQ ID NO: 891067 - protein, 382 aa, Homo sapiens
MAPGVPPLLKSFLQERLGIHLIRRKIVKPKHHVLMSRKESWKVKSEIPKVPKQPLVLHHPRMTTTKSPSKDMLEPEAELAEDLPTTKSTSVESEMPTENLEGHSPSCRTFVPLPPICSNSTVHSEETLSHLSDTTVRLSPERPSDEDSKSTESIFLTQVSELPSSVIHKDDLELKEKDQKKPPTAPREVKGTRRKLPTAFLPSKYHGYEELLTAKPDPAFIEPKGIQKNAQALQQMLKHPLLCHSSKPKLDTLQKPYVHKEKRAQRIPIPPPKKTRAQLLDDIFIRLRDPRNITEAPLGAVLHQWTERRLVNHKQYLEAKRLLKEFQARYRQLVSGSLRTVFGTTPLPMACPALSESQPKFGHFLEFMDEFCQEPTASDSQG

SEQ ID NO: 891068 - protein, 779 aa, Homo sapiens; identical to SEQ ID NO: 891064

SEQ ID NO: 891069 - protein, 779 aa, Homo sapiens; identical to SEQ ID NO: 891064

SEQ ID NO: 891070 - protein, 779 aa, Homo sapiens; identical to SEQ ID NO: 891064

SEQ ID NO: 891071 - protein, 386 aa, Homo sapiens
SVSRPGRRLPPTLSAVASQLLRRGEDSGRHRSGAAPRSPGGSQARIPPDWDVASADPSEAEATPEAGQGHWLVVQKGNLKKKPKGLVGAQAERRESLKATSFEFKGKKESRRENQVDLPGHILDQAFLLKHHCVRKPSDLCTINVSGLKFSKAKENDFKHFHSVIYINASENLLPLEAFHTFPALKELDLAFNGIKTIYVKYGDFKLLEFLDLSFNSLTVEAICDLGILPHLRVLLLTGNGLTSLPPNLAVAEQEASVTSLTSKRYILRFPALETLMLDDNRLSNPSCFASLAGLRRLKKLSLDENRIIRIPYLQQVQLYDESVDWNGGRGSPHKEPQFMLQSKPRMLEDSDEQLDYTVLPMKKDVDRTDRKRGCCPTSSSLPISL

SEQ ID NO: 891072 - protein, 182 aa, Homo sapiens
GTVTFEDVAVNFSQEEWSLLSEAQRCLYHDVMLENLTLISSLGCWYGAKDETPSKQTLSIQQESPLRTHWTGVCTKKVHLWGMCGPLLGDILHQGTQHNQKLNGFGAYEKKLDDDANHHQDQKQHIGEKSYRSNAKGTSFVKNCKFHMSHEPFIFHEVGKDFLSSLRLLQQEDIHTSGKSKL

SEQ ID NO: 891073 - protein, 131 aa, Homo sapiens
GTVTFEDVAVNFSQEEWSLLSEAQRCLYHDVMLENLTLISSLGCWYGAKDETPSKQTLSIQQESPLRTHWTGGNDVTLKLRLEYTGMVIPHCGLKLLGSSDPPASASRVPEISPGNLRIFYRDRVLLFYPD

SEQ ID NO: 891074 - protein, 370 aa, Homo sapiens
MAAERQEALREFVAVTGAEEDRARFFLESAGWDLQIALASFYEDGGDEDIVTISQATPSSVSRGTAPSDNRVTSFRDLIHDQDEDEEEEEGQRFYAGGSERSGQQIVGPPRKKSPNELVDDLFKGAKEHGAVAVERVTKSPGETSKPRPFAGGGYRLGAAPEEESAYVAGEKRQHSSQDVHVVLKLWKSGFSLDNGELRSYQDPSNAQFLESIRRGEVPAELRRLAHGGQVNLDMEDHRDEDFVKPKGAFKAFTGEGQKLGSTAPQVLSTSSPAQQAENEAKASSSILIDESEPTTNIQIRLADGGRLVQKFNHSHRISDIRLFIVDARPAMAATSFILMTTFPNKELADESQTLKEANLLNAVIVQRLT

SEQ ID NO: 891075 - protein, 75 aa, Homo sapiens
MEDHRDEDFVKPKGAFKAFTGEGQKLGSTAPQVLSTSSPAQQAENEAKASSSILIDESEPTTEQCVHLLSGTELI

SEQ ID NO: 891076 - protein, 370 aa, Homo sapiens; identical to SEQ ID NO: 891074

SEQ ID NO: 891077 - protein, 370 aa, Homo sapiens; identical to SEQ ID NO: 891074

SEQ ID NO: 891078 - protein, 423 aa, Homo sapiens
MAAERQEALREFVAVTGAEEDRARFFLESAGWDLQIALASFYEDGGDEDIVTISQATPSSVSRGTAPSDNRVTSFRDLIHDQDEDEEEEEGQRGHSVCHMNGKVEVRLGGAPGAVSHHLTCVHYSVLVLLHTSADLNLSGSDLRSRFYAGGSERSGQQIVGPPRKKSPNELVDDLFKGAKEHGAVAVERVTKSPGETSKPRPFAGGGYRLGAAPEEESAYVAGEKRQHSSQDVHVVLKLWKSGFSLDNGELRSYQDPSNAQFLESIRRGEVPAELRRLAHGGQVNLDMEDHRDEDFVKPKGAFKAFTGEGQKLGSTAPQVLSTSSPAQQAENEAKASSSILIDESEPTTNIQIRLADGGRLVQKFNHSHRISDIRLFIVDARPAMAATSFILMTTFPNKELADESQTLKEANLLNAVIVQRLT

SEQ ID NO: 891079 - protein, 256 aa, Homo sapiens
MKMRRKRKARGAKEHGAVAVERVTKSPGETSKPRPFAGGGYRLGAAPEEESAYVAGEKRQHSSQDVHVVLKLWKSGFSLDNGELRSYQDPSNAQFLESIRRGEVPAELRRLAHGGQVNLDMEDHRDEDFVKPKGAFKAFTGEGQKLGSTAPQVLSTSSPAQQAENEAKASSSILIDESEPTTNIQIRLADGGRLVQKFNHSHRISDIRLFIVDARPAMAATSFILMTTFPNKELADESQTLKEANLLNAVIVQRLT

SEQ ID NO: 891080 - protein, 411 aa, Homo sapiens
MAAERQEALREFVAVTGAEEDRARFFLESAGWDLQIALASFYEDGGDEDIVTISQATPSSVSRGTAPSDNRVTSFRDLIHDQDEDEEEEEGQRFYAGGSERSGQQIVGPPRKKSPNELVDDLFKGAKEHGAVAVERVTKSPGETSKPRPFAGGGYRLGAAPEEESAYVAGEKRQHSSQDVHVVLKLWKSGFSLDNGELRSYQDPSNAQFLESIRRGEVPAELRRLAHGGQVNLDMEDHRDEDFVKPKGAFKAFTGEGQKLGSTAPQVLSTSSPAQQAENEAKASSSILIDESEPTTNIQIRLADGGRLVDDLFKGAKEHGAVAVERVTKSPGETSKPAQCCHRAAVNITAQPAAWPPSCVSHGQWPCPMGIAPPAPLCTPSSPVQRLLHSSGFLDLGWTFVFSLVAFPGFL

SEQ ID NO: 891081 - protein, 278 aa, Homo sapiens
MFYAGGSERSGQQIVGPPRKKSPNELVDDLFKGAKEHGAVAVERVTKSPGETSKPRPFAGGGYRLGAAPEEESAYVAGEKRQHSSQDVHVVLKLWKSGFSLDNGELRSYQDPSNAQFLESIRRGEVPAELRRLAHGGQVNLDMEDHRDEDFVKPKGAFKAFTGEGQKLGSTAPQVLSTSSPAQQAENEAKASSSILIDESEPTTNIQIRLADGGRLVQKFNHSHRISDIRLFIVDARPAMAATSFILMTTFPNKELADESQTLKEANLLNAVIVQRLT

SEQ ID NO: 891082 - protein, 278 aa, Homo sapiens
MAAERQEALREFVAVTGAEEDRARFFLESAGWDLQIALASFYEDGGDEDIVTISQATPSSVSRGTAPSDNRVTSFRDLIHDQDEDEEEEEGQRFYAGGSERSGQQIVGPPRKKSPNELVDDLFKGAKEHGAVAVERVTKSPGETSKPRPFAGGGYRLGAAPEEESAYVAGEKRQHSSQDVHVVLKLWKSGFSLDNGELRSYQDPSNAQFLESIRRGEVPAELRRLAHGGQVNLDMEDHRDEDFVKPKGAFKAFTGEGQKLGSTAPQVLSTSSPAQQAE

SEQ ID NO: 891083 - protein, 274 aa, Homo sapiens
MAAERQEALREFVAVTGAEEDRARFFLESAGWDLQIALASFYEDGGDEDIVTISQATPSSVSRGTAPSDNRVTSFRDLIHDQDEDEEEEEGQRFYAGGSERSGQQIVGPPRKKSPNELVDDLFKGAKEHGAVAVERVTKSPGETSKPRPFAGGGYRLGAAPEEESAYVAGEKRQHSSQDVHVVLKLWKSGFSLDNGELRSYQDPSNAQFLESIRRGEVPAELRRLAHGGQVNLDMEDHRDEDFVKPKGAFKAFTGEGQKLGSVHTQQSSATSPP

SEQ ID NO: 891084 - protein, 137 aa, Homo sapiens
MLSNSPRRDSLLARGLVSACVLMPSSLLSTAPQVLSTSSPAQQAENEAKASSSILIDESEPTTNIQIRLADGGRLVQKFNHSHRISDIRLFIVDARPAMAATSFILMTTFPNKELADESQTLKEANLLNAVIVQRLT

SEQ ID NO: 891085 - protein, 164 aa, Homo sapiens
MKMRRKRKARGAKEHGAVAVERVTKSPGETSKPRPFAGGGYRLGAAPEEESAYVAGEKRQHSSQDVHVVLKLWKSGFSLDNGELRSYQDPSNAQFLESIRRGEVPAELRRLAHGGQVNLDMEDHRDEDFVKPKGAFKAFTGEGQKLGSTAPQVLSTSSPAQQAE

SEQ ID NO: 891086 - protein, 175 aa, Homo sapiens
MAAERQEALREFVAVTGAEEDRARFFLESAGWDLQIALASFYEDGGDEDIVTISQATPSSVSRGTAPSDNRVTSFRDLIHDQDEDEEEEEGQRFYAGGSERSGQQIVGPPRKKSPNELVDDLFKGAKEHGAVAVERVTKSLCTPSSPVQRLLHSSGFLDLGWTFVFSLVAFPGFL

SEQ ID NO: 891087 - protein, 339 aa, Homo sapiens
MAAERQEALREFVAVTGAEEDRARFFLESAGWDLQIALASFYEDGGDEDIVTISQATPSSVSRGTAPSDNRVTSFRDLIHDQDEDEEEEEGQRFYAGGSERSGQQIVGPPRKKSPNELVDDLFKGAKEHGAVAVERVTKSPGETSKPRVHVVLKLWKSGFSLDNGELRSYQDPSNAQFLESIRRGEVPAELRRLAHGGQVNLDMEDHRDEDFVKPKGAFKAFTGEGQKLGSTAPQVLSTSSPAQQAENEAKASSSILIDESEPTTNIQIRLADGGRLVQKFNHSHRISDIRLFIVDARPAMAATSFILMTTFPNKELADESQTLKEANLLNAVIVQRLT

SEQ ID NO: 891088 - protein, 120 aa, Homo sapiens
MAAERQEALREFVAVTGAEEDRARFFLESAGWDLQIALASFYEDGGDEDIVTISQQENGVNPGGGACSESRLRHCTPAWATEQDSVSKKKKKKWKVGKLFYFGHRGVNWGGFKGTFFQGA

SEQ ID NO: 891089 - protein, 370 aa, Homo sapiens; identical to SEQ ID NO: 891074

SEQ ID NO: 891090 - protein, 256 aa, Homo sapiens; identical to SEQ ID NO: 891079

SEQ ID NO: 891091 - protein, 352 aa, Homo sapiens
MAAERQEALREFVAVTGAEEDRARFFLESAGWDLQIALASFYEDGGDEDIVTISQATPSSVSRGTAPSDNRVTSFRDLIHDQDEDEEEEEGQRFYAGGSERSGQQIVGPPRKKSPNELVDDLFKGAKEHGAVAVERVTKSPGETSKPRPFAGGGYRLGAAPEEESAYVAGEKRQHSSQDVHVVLKLWKSGFSLDNGELRSYQDPSNAQFLESIRRGEVPAELRRLAHGGQVNLDMEDHRDEDFVKPKGAFKAFTGEGQKLGSTAPQVLSTSSPAQQAENIQIRLADGGRLVQKFNHSHRISDIRLFIVDARPAMAATSFILMTTFPNKELADESQTLKEANLLNAVIVQRLT

SEQ ID NO: 891092 - protein, 274 aa, Homo sapiens
MAAERQEALREFVAVTGAEEDRARFFLESAGWDLQIALASFYEDGGDEDIVTISQATPSSVSRGTAPSDNRVTSFRDLIHDQDEDEEEEEGQRFYAGGSERSGQQIVGPPRKKSPNELVDDLFKGAKEHGAVAVERVTKSPGETSKPRPFAGGGYRLGAAPEEESAYVAGEKRQHSSQDVHVVLKLWKSGFSLDNGELRSYQDPSNAQFLESIRRGEVPAELRRLAHGGQVNLDMEDHRDEDFVKPKGAFKAFTGEGQKLGRLSCFPPFKPLFS

SEQ ID NO: 891093 - protein, 361 aa, Homo sapiens
MAAERQEALREFVAVTGAEEDRARFFLESAGWDLQIALASFYEDGGDEDIVTISQATPSSVSRGTAPSDNRVTSFRDLIHDQDEDEEEEEGQRFYAGGSERSGQQIVGPPRKKSPNELVDDLFKGAKEHGAVAVERVTKSPGETSKPRPFAGGGYRLGAAPEEESAYVAGEKRQHSSQDSGFSLDNGELRSYQDPSNAQFLESIRRGEVPAELRRLAHGGQVNLDMEDHRDEDFVKPKGAFKAFTGEGQKLGSTAPQVLSTSSPAQQAENEAKASSSILIDESEPTTNIQIRLADGGRLVQKFNHSHRISDIRLFIVDARPAMAATSFILMTTFPNKELADESQTLKEANLLNAVIVQRLT

SEQ ID NO: 891094 - protein, 103 aa, Homo sapiens
MQDNWQVPGTARRARRLEQRKLADPLMRGRNWPISHGSCRQAMRLSFMRGEITRHGRVVSGGLACSRSEFLPLECKKHGSRDFVLLPAISTALEKRRAIDSSQ

SEQ ID NO: 891095 - protein, 106 aa, Homo sapiens
MARFYAGGSERSGQQIVGPPRKKSPNELVDDLFKGAKEHGAVAVERVTKSPGETSKPRPFAGGGYRLGAAPEEESAYVAGEKRQHSSQDCAHPAVQCNVSSIALGS

SEQ ID NO: 891096 - protein, 137 aa, Homo sapiens
MAAERQEALREFVAVTGAEEDRARFFLESAGWDLQIALASFYEDGGDEDIVTISHQSSLKWEVRATCTQCLQKVKINISLCSFYSTPGVSNLARSWPVEILFHLPAWPFPPLPSRLLASWGFSGAPLWLDLLHVQKS

SEQ ID NO: 891097 - protein, 222 aa, Homo sapiens
MPPRLPPMPAVLGKLPRTLGERPENLRRKPPGLLATCSVSLPAPLPSGIRKRAGPCAPSPLPRAANNTPPWGASFLLWKLRHWTEGTGLRGADRGPVLLGALRTRGRRGHGQEPQPRVLAFLLRRSPPKSTQRLEQPFLPFPRPPEAPTQFSVTSSGRKASRCPPELLWAQGWLRDHLMDVLGSMGSQGSIPSCSPTPPQLPGGWAHEGSGDTSIGKGPGTL

SEQ ID NO: 891098 - protein, 242 aa, Homo sapiens
MPPRLPPMPAVLGKLPRTLGERPENLRRKPPGLLATCSVSLPAPLPSGIRKRAGPCAPSPLPRAANNTPPWGASFLLWKLRHWTEGTGLRGADRGPVLLGALRTRGRRGHGQEPQPRVLAFLLRRSPPKSTQRLEQPSTQPEEGRAPPPALGGGVWPFLPFPRPPEAPTQFSVTSSGRKASRCPPELLWAQGWLRDHLMDVLGSMGSQGSIPSCSPTPPQLPGGWAHEGSGDTSIGKGPGTL

SEQ ID NO: 891099 - protein, 242 aa, Homo sapiens; identical to SEQ ID NO: 891098

SEQ ID NO: 891100 - protein, 310 aa, Homo sapiens
RGISSWDRPPGLRCDRRREVPWEPGGRRAELCGQTRGPCPPPVSPAVPVGAMKLNERSVAHYALSDSPADHMGFLRTWGGPGTPPTPSGTGRRCWFVLKGNLLFSFESREGRAPLSLVVLEGCTVELAEAPVPEEFAFAICFDAPGVRPHLLAAEGPAAQEAWVKVLSRASFGYMRLVVRELESQLQDARQSLALQRRSSWKSVASRCKPQAPNHRAAGLENGHCLSKDSSPVGLVEEAGSRSAGWGLAEWELQGPASLLLGKGQSPVSPETSCFSTLHDWYGQEIVELRQCWQKRAQGSHSKCEEQDRP

SEQ ID NO: 891101 - protein, 251 aa, Homo sapiens
LDWIGLDWIGLVDWIGLDWIGLDWWIGLDWIGLDWIGGLDWIGLDWIGLVDWIGLDWIGLDWWIGLDWIGLDWIGGLDWIGLDWIGLVDWIGLDWIGLDWWIGLDWIGLDWIGGLDWIGLDWIGLVDWIGLDWIGLDWWIGLDWIGLDWIGGLDWIGLDWIGLVDWIGLDWIGLDWWIGLDWIGLDWIGGLDWIGLDWIGLVDWIGLDWIGLDWWIGLDWIGLDWIGGLDWIGLDGIAFPVLKFSLLAGLR

SEQ ID NO: 891102 - protein, 1035 aa, Homo sapiens
RHRCRLAGNSWVASSLCQESPPHPHIAGLGWDVVAAKSSEATPAWDGLPQDGPENPERRLGPLGHLPPPADPAFQHHRGSRRRKRKGVWPAKAAERGGGARKSRMAARDSDSEEDLVSYGTGLEPLEEGERPKKPIPLQDQTVRDEKGRYKRFHGAFSGGFSAGYFNTVGSKEGWTPSTFVSSRQNRADKSVLGPEDFMDEEDLSEFGIAPKAIVTTDDFASKTKDRIREKARQLAAATAPIPGATLLDDLITPAKLSVGFELLRKMGWKEGQGVGPRVKRRPRRQKPDPGVKIYGCALPPGSSEGSEGEDDDYLPDNVTFAPKDVTPVDFTPKDNVHGLAYKGLDPHQALFGTSGEHFNLFSGGSERAGDLGEIGLNKGRKLGISGQAFGVGALEEEDDDIYATETLSKYDTVLKDEEPGDGLYGWTAPRQYKNQKESEKDLRYVGKILDGFSLASKPLSSKKIYPPPELPRDYRPVHYFRPMVAATSENSHLLQVLSESAGKATPDPGTHSKHQLNASKRAELLGETPIQGSATSVLEFLSQKDKERIKEMKQATDLKAAQLKARSLAQNAQSSRAQLSPAAAAGHCSWNMALGGGTATLKASNFKPFAKDPEKQKRYDEFLVHMKQGQKDALERCLDPSMTEWERGRERDEFARAALLYASSHSTLSSRFTHAKEEDDSDQVEVPRDQENDVGDKQSAVKMKMFGKLTRDTFEWHPDKLLCKRFNVPDPYPDSTLVGLPRVKRDKYSVFNFLTLPETASLPTTQASSEKVSQHRGPDKSRKPSRWDTSKHEKKEDSISEFLSLARSKAEPPKQQSSPLVNKEEEHAPELSANQTVNKDVDAQAEGEGSRPSMDLFRAIFASSSDEKSSSSEDEQGDSEDDQAGSGEANFQSSQDTDLGETSSVAHALVPAPQEPPPSFPIQKMQIDEREEFGPRLPPVFCPNARQTLEVPQKEKHKKNKDKHKAKKEHRRKKEKKKKHRKHKHKGKQKNKKPEKSSSSESSDSSDSQSDEETADVSPQELLRRLKSLPLRRQ

SEQ ID NO: 891103 - protein, 949 aa, Homo sapiens
RHRCRLAGNSWVASSLCQESPPHPHIAGLGWDVVAAKSSEATPAWDGLPQDGPENPERRLGPLGHLPPPADPAFQHHRGSRRRKRKGVWPAKAAERGGGARKSRMAARDSDSEEDLVSYGTGLEPLEEGERPKKPIPLQDQTVRDEKGRYKRFHGAFSGGFSAGYFNTVGSKEGWTPSTFVSSRQNRADKSVLGPEDFMDEEDPGVKIYGCALPPGSSEGSEGEDDDYLPDNVTFAPKDVTPVDFTPKDNVHGLAYKGLDPHQALFGTSGEHFNLFSGGSERAGDLGEIGLNKGRKLGISGQAFGVGALEEEDDDIYATETLSKYDTVLKDEEPGDGLYGWTAPRQYKNQKESEKDLRYVGKILDGFSLASKPLSSKKIYPPPELPRDYRPVHYFRPMVAATSENSHLLQVLSESAGKATPDPGTHSKHQLNASKRAELLGETPIQGSATSVLEFLSQKDKERIKEMKQATDLKAAQLKARSLAQNAQSSRAQLSPAAAAGHCSWNMALGGGTATLKASNFKPFAKDPEKQKRYDEFLVHMKQGQKDALERCLDPSMTEWERGRERDEFARAALLYASSHSTLSSRFTHAKEEDDSDQVEVPRDQENDVGDKQSAVKMKMFGKLTRDTFEWHPDKLLCKRFNVPDPYPDSTLVGLPRVKRDKYSVFNFLTLPETASLPTTQASSEKVSQHRGPDKSRKPSRWDTSKHEKKEDSISEFLSLARSKAEPPKQQSSPLVNKEEEHAPELSANQTVNKDVDAQAEGEGSRPSMDLFRAIFASSSDEKSSSSEDEQGDSEDDQAGSGEANFQSSQDTDLGETSSVAHALVPAPQEPPPSFPIQKMQIDEREEFGPRLPPVFCPNARQTLEVPQKEKHKKNKDKHKAKKEHRRKKEKKKKHRKHKHKGKQKNKKPEKSSSSESSDSSDSQSDEETADVSPQELLRRLKSLPLRRQ

SEQ ID NO: 891104 - protein, 735 aa, Homo sapiens
RHRCRLAGNSWVASSLCQESPPHPHIAGLGWDVVAAKSSEATPAWDGLPQDGPENPERRLGPLGHLPPPADPAFQHHRGSRRRKRKGVWPAKAAERGGGARKSRMAARDSDSEEDLVSYGTGLEPLEEGERPKKPIPLQDQTVRDEKGRYKRFHGAFSGGFSAGYFNTVGSKEGWTPSTFVSSRQNRADKSVLGPEDFMDEEDLSEFGIAPKAIVTTDDFASKTKDRIREKARQLAAATAPIPGATLLDDLITPAKLSVGFELLRKMGWKEGQGVGPRVKRRPRRQKPDPGVKIYGCALPPGSSEGSEGEDDDYLPDNVTFAPKDVTPVDFTPKDNVHGLAYKGLDPHQALFGTSGEHFNLFSGGSERAGDLGEIGLNKGRKLGISGQAFGVGALEEEDDDIYATETLSKYDTVLKDEEPGDGLYGWTAPRQYKNQKESEKDLRYVGKILDGFSLASKPLSSKKIYPPPELPRDYRPVHYFRPMVAATSENSHLLQVLSESAGKATPDPGTHSKHQLNASKRAELLGETPIQGSATSVLEFLSQKDKERIKEMKQATDLKAAQLKARSLAQNAQSSRAQLSPAAAAGHCSWNMALGGGTATLKASNFKPFAKDPEKQKRYDEFLVHMKQGQKDALERCLDPSMTEWERGRERDEFARAALLYASSHSTLSSRFTHAKEEDDSDQVEVPRDQENDVGDKQSAVKMKMFGKLTRDTFEWHPDKLLCKRFNVPDPYPE

SEQ ID NO: 891105 - protein, 308 aa, Homo sapiens
MILFSIPSSTLVGLPRVKRDKYSVFNFLTLPETASLPTTQASSEKVSQHRGPDKSRKPSRWDTSKHEKKEDSISEFLSLARSKAEPPKQQSSPLVNKEEEHAPELSANQTVNKDVDAQAEGEGSRPSMDLFRAIFASSSDEKSSSSEDEQGDSEDDQAGSGEANFQSSQDTDLGETSSVAHALVPAPQEPPPSFPIQKMQIDEREEFGPRLPPVFCPNARQTLEVPQKEKHKKNKDKHKAKKEHRRKKEKKKKHRKHKHKGKQKNKKPEKSSSSESSDSSDSQSDEETADVSPQELLRRLKSLPLRRQ

SEQ ID NO: 891106 - protein, 1995 aa, Homo sapiens
MGLGKTIQSITFLYEILLTGIRGPFLIIAPLSTIANWEREFRTWTDINVVVYHGSLISRQMIQQYEMYFRDSQGRIIRGAYRFQAIITTFEMILGGCGELNAIEWRCVIIDEAHRLKNKNCKLLEGLKLMNLEHKVLLTGTPLQNTVEELFSLLHFLEPLRFPSESTFMQEFGDLKTEEQVQKLQAILKPMMLRRLKEDVEKKLAPKEETIIEVELTNIQKKYYRAILEKNFSFLSKGAGQTNVPNLVNTMMELRKCCNHPYLIKGAEEKILGEFRDTYNPAASDFHLQAMIQSAGKLVLIDKLLPKMKAGGHKVLIFSQMVRCLDILEDYLIHKRYLYERIDGRVRGNLRQAAIDRFSKPDSDRFVFLLCTRAGGLGINLTAADTCIIFDSDWNPQNDLQAQARCHRIGQNKAVKVYRLVTRNSYEREMFDRASLKLGLDKAVLQSMSGRESNVGGIQQLSKKEIEDLLRRGAYGAIMEEEDEGSKFCEEDIDQILLRRTKTITIESEGRGSTFAKASFVASGNRTDISLDDPNFWQKWAKKAEIDIEAISGRNSLVIDTPRIRKQTRPFSATKDELAELSEAESEGDEKPKLRRPCDRSNGYGRTECFRVEKNLLVYGWGRWREILSHGRFKRQLNEHDVEIICRALLAYCLVHYRGDEKIKGFIWDLITPTEDGQTRELQNHLGLSAPVPRGRKGKKVKTQTSSFDIQKAEWLRKYNPEQLLQDEGYKKHIKHHCNKVLLRVRMLYYLKQEVIGNECQKVFDGVDASDIDVWVPEPDHSEVPAEWWDFDADKSLLIGVFKHGYEKYNTIRADPALCFLERVGKPDEKAVAAEQRANDYMDGDVEDPEYKPAPAIFKDDIEDDVSSPGDLVIADGDGQLMEGDKVYWPTQSALTTRLRRLITAYQRTNKNRQIQQIQPTFSVPTSVMQPIYEEATLNPKMAAKIERQQRWTRREEADFYRVVSTFGVVFDPDRGQFDWTKFRAMARLHKKTDDSLEKYLYAFMSMCRRVCRLPSKEELVDPNIFIQPITEERASRTLYRIELLRKVREQALRHPQLFERLKLCHPNPDLPVWWECGPHDRDLLIGAAKHGVSRTDYHILRDPELSFMAAQRNYSQSKMAHSRTSTPLLQQYQVALSASPLTSLPRLLDAKGIILEEMKVKSENLKEEPQSSEEESMSSVETRTLIKSEPVSPKNGVLPQATGDQKSGGKCETDRRMVAARTEPLTPNPASKKPRVHKRGSESSSDSDSDSERSSCSSRSSSSSSSSSCSHSRSGSSSSSSSSCSSASSSSSSSTSSSSSSSSSSSEESDSDEEEAQKRESTTHMKAYDEESVASLSTTQDETQDSFQMNNGTPESAYILQGGYMLAASYWPKDRVMINRLDSICQTVLKGKWPSARRSYDANTVASFYTTKLLDSPGAATEYSEPSVPTPPGAGVKEEHDQSTQMSKEGGLKLTFQKQGLAQKRPFDGEDGALGQQQYLTRLRELQSASETSLVNFPKSIPVSGTSIQPTLGANGVILDNQPIVKKRRGRRKNVEGVDIFFFNRNKPPNHVSLGLTSSQISTGINPALSYTQPQGIPDTESPVPVINLKDGTRLAGDDAPKRKDLEKWLKEHPGYVEDLGAFIPRMQLHEGRPKQKRHRCRNPNKLDVNSLTGEERVQLINRRNARKVGGAFAPPLKDLCRFLKENSEYGVAPEWGDVVKQSGFLPESMYERILTGPVVREEVSRRGRRPKSGIAKATAAAAAASATSVSGNPLLANGLLPGVDLTTLQALQQNLQNLQSLQVTAGLMGMPTGLPSGGEAKNMAAMFPMLLSGMAGLPNLLGMGGLLTKPTESGTEDKKGSDSKESEGKTERTESQSSENGGENSVSSSPSTSSTAALNTAAAANPLALNPLLLSNILYPGMLLTPGLNLHIPTLSQSNTFDVQNKNSDLGSSKSVEVKEEDSRIKDQEDKGGTEPSPLNENSTDEGSEKADASSGSDSTSSSSEDSDSSNED

SEQ ID NO: 891107 - protein, 1533 aa, Homo sapiens
MGLGKTIQSITFLYEILLTGIRGPFLIIAPLSTIANWEREFRTWTDINVVVYHGSLISRQMIQQYEMYFRDSQGRIIRGAYRFQAIITTFEMILGGCGELNAIEWRCVIIDEAHRLKNKNCKLLEGLKLMNLEHKVLLTGTPLQNTVEELFSLLHFLEPLRFPSESTFMQEFGDLKTEEQVQKLQAILKPMMLRRLKEDVEKKLAPKEETIIEVELTNIQKKYYRAILEKNFSFLSKGAGQTNVPNLVNTMMELRKCCNHPYLIKGAEEKILGEFRDTYNPAASDFHLQAMIQSAGKLVLIDKLLPKMKAGGHKVLIFSQMVRCLDILEDYLIHKRYLYERIDGRVRGNLRQAAIDRFSKPDSDRFVFLLCTRAGGLGINLTAADTCIIFDSDWNPQNDLQAQARCHRIGQNKAVKVYRLVTRNSYEREMFDRASLKLGLDKAVLQSMSGRESNVGGIQQLSKKEIEDLLRRGAYGAIMEEEDEGSKFCEEDIDQILLRRTKTITIESEGRGSTFAKASFVASGNRTDISLDDPNFWQKWAKKAEIDIEAISGRNSLVIDTPRIRKQTRPFSATKDELAELSEAESEGDEKPKLRRPCDRSNGYGRTECFRVEKNLLVYGWGRWREILSHGRFKRQLNEHDVEIICRALLAYCLVHYRGDEKIKGFIWDLITPTEDGQTRELQNHLGLSAPVPRGRKGKKVKTQTSSFDIQKAEWLRKYNPEQLLQDEGYKKHIKHHCNKVLLRVRMLYYLKQEVIGNECQKVFDGVDASDIDVWVPEPDHSEVPAEWWDFDADKSLLIGVFKHGYEKYNTIRADPALCFLERVGKPDEKAVAAEQRANDYMDGDVEDPEYKPAPAIFKDDIEDDVSSPGDLVIADGDGQLMEGDKVYWPTQSALTTRLRRLITAYQRTNKNRQIQQIQPTFSVPTSVMQPIYEEATLNPKMAAKIERQQRWTRREEADFYRVVSTFGVVFDPDRGQFDWTKFRAMARLHKKTDDSLEKYLYAFMSMCRRVCRLPSKEELVDPNIFIQPITEERASRTLYRIELLRKVREQALRHPQLFERLKLCHPNPDLPVWWECGPHDRDLLIGAAKHGVSRTDYHILRDPELSFMAAQRNYSQSKMAHSRTSTPLLQQYQVALSASPLTSLPRLLDAKGIILEEMKVKSENLKEEPQSSEEESMSSVETRTLIKSEPVSPKNGVLPQATGDQKSGGKCETDRRMVAARTEPLTPNPASKKPRVHKRGSESSSDSDSDSERSSCSSRSSSSSSSSSCSHSRSGSSSSSSSSCSSASSSSSSSTSSSSSSSSSSSEESDSDEEEAQKRESTTHMKAYDEESVASLSTTQDETQDSFQMNNGTPESAYILQGGYMLAASYWPKDRVMINRLDSICQTVLKGKWPSARRSYDANTVASFYTTKLLDSPGAATEYSEPSVPTPPGAGVKEEHDQSTQMSKVKKHVREKEFTVKIKDEGGLKLTFQKQGLAQKRPFDGEDGALGQQQYLTRLRELQSASSSSSSSTSSSSSSSSSSSEESDSDEE

SEQ ID NO: 891108 - protein, 407 aa, Homo sapiens
MGLGKTIQSITFLYEILLTGIRGPFLIIAPLSTIANWEREFRTWTDINVVVYHGSLISRQMIQQYEMYFRDSQGRIIRGAYRFQAIITTFEMILGGCGELNAIEWRCVIIDEAHRLKNKNCKLLEGLKLMNLEHKVLLTGTPLQNTVEELFSLLHFLEPLRFPSESTFMQEFGDLKTEEQVQKLQAILKPMMLRRLKEDVEKKLAPKEETIIEVELTNIQKKYYRAILEKNFSFLSKGAGQTNVPNLVNTMMELRKCCNHPYLIKGAEEKILGEFRDTYNPAASDFHLQAMIQSAGKLVLIDKLLPKMKAGGHKVLIFSQMVRCLDILEDYLIHKRYLYERIDGRVRGNLRQAAIDRFSKPDSDRFVFLLCTRAGGLGINLTAADTCIIFDSDWNPQNDLQVNNFLG

SEQ ID NO: 891109 - protein, 473 aa, Homo sapiens
MGLGKTIQSITFLYEILLTGIRGPFLIIAPLSTIANWEREFRTWTDINVVVYHGSLISRQMIQQYEMYFRDSQGRIIRGAYRFQAIITTFEMILGGCGELNAIEWRCVIIDEAHRLKNKNCKLLEGLKLMNLEHKVLLTGTPLQNTVEELFSLLHFLEPLRFPSESTFMQEFGDLKTEEQVQKLQAILKPMMLRRLKEDVEKKLAPKEETIIEVELTNIQKKYYRAILEKNFSFLSKGAGQTNVPNLVNTMMELRKCCNHPYLIKGAEEKILGEFRDTYNPAASDFHLQAMIQSAGKLVLIDKLLPKMKAGGHKVLIFSQMVRCLDILEDYLIHKRYLYERIDGRVRGNLRQAAIDRFSKPDSDRFVFLLCTRAGGLGINLTAADTCIIFDSDWNPQNDLQAQARCHRIGQNKAVKVYRLVTRNSYEREMFDRASLKLGLDKAVLQSMSGRESNVGGVCIVSFSLEIFVCFCI

SEQ ID NO: 891110 - protein, 336 aa, Homo sapiens
MGLGKTIQSITFLYEILLTGIRGPFLIIAPLSTIANWEREFRTWTDINVVVYHGSLISRQMIQQYEMYFRDSQGRIIRGAYRFQAIITTFEMILGGCGELNAIEWRCVIIDEAHRLKNKNCKLLEGLKLMNLEHKVLLTGTPLQNTVEELFSLLHFLEPLRFPSESTFMQEFGDLKTEEQVQKLQAILKPMMLRRLKEDVEKKLAPKEETIIEVELTNIQKKYYRAILEKNFSFLSKGAGQTNVPNLVNTMMELRKCCNHPYLIKGAEEKILGEFRDTYNPAASDFHLQAMIQSAGKLVLIDKLLPKMKAGGHKVLIFSQMVRCLDILEDYLIHKR

SEQ ID NO: 891111 - protein, 2011 aa, Homo sapiens
MGLGKTIQSITFLYEILLTGIRGPFLIIAPLSTIANWEREFRTWTDINVVVYHGSLISRQMIQQYEMYFRDSQGRIIRGAYRFQAIITTFEMILGGCGELNAIEWRCVIIDEAHRLKNKNCKLLEGLKLMNLEHKVLLTGTPLQNTVEELFSLLHFLEPLRFPSESTFMQEFGDLKTEEQVQKLQAILKPMMLRRLKEDVEKKLAPKEETIIEVELTNIQKKYYRAILEKNFSFLSKGAGQTNVPNLVNTMMELRKCCNHPYLIKGAEEKILGEFRDTYNPAASDFHLQAMIQSAGKLVLIDKLLPKMKAGGHKVLIFSQMVRCLDILEDYLIHKRYLYERIDGRVRGNLRQAAIDRFSKPDSDRFVFLLCTRAGGLGINLTAADTCIIFDSDWNPQNDLQAQARCHRIGQNKAVKVYRLVTRNSYEREMFDRASLKLGLDKAVLQSMSGRESNVGGIQQLSKKEIEDLLRRGAYGAIMEEEDEGSKFCEEDIDQILLRRTKTITIESEGRGSTFAKASFVASGNRTDISLDDPNFWQKWAKKAEIDIEAISGRNSLVIDTPRIRKQTRPFSATKDELAELSEAESEGDEKPKLRRPCDRSNGYGRTECFRVEKNLLVYGWGRWREILSHGRFKRQLNEHDVEIICRALLAYCLVHYRGDEKIKGFIWDLITPTEDGQTRELQNHLGLSAPVPRGRKGKKVKTQTSSFDIQKAEWLRKYNPEQLLQDEGYKKHIKHHCNKVLLRVRMLYYLKQEVIGNECQKVFDGVDASDIDVWVPEPDHSEVPAEWWDFDADKSLLIGVFKHGYEKYNTIRADPALCFLERVGKPDEKAVAAEQRANDYMDGDVEDPEYKPAPAIFKDDIEDDVSSPGDLVIADGDGQLMEGDKVYWPTQSALTTRLRRLITAYQRTNKNRQIQQIQPTFSVPTSVMQPIYEEATLNPKMAAKIERQQRWTRREEADFYRVVSTFGVVFDPDRGQFDWTKFRAMARLHKKTDDSLEKYLYAFMSMCRRVCRLPSKEELVDPNIFIQPITEERASRTLYRIELLRKVREQALRHPQLFERLKLCHPNPDLPVWWECGPHDRDLLIGAAKHGVSRTDYHILRDPELSFMAAQRNYSQSKMAHSRTSTPLLQQYQVALSASPLTSLPRLLDAKGIILEEMKVKSENLKEEPQSSEEESMSSVETRTLIKSEPVSPKNGVLPQATGDQKSGGKCETDRRMVAARTEPLTPNPASKKPRVHKRGSESSSDSDSDSERSSCSSRSSSSSSSSSCSHSRSGSSSSSSSSCSSASSSSSSSTSSSSSSSSSSSEESDSDEEEAQKRESTTHMKAYDEESVASLSTTQDETQDSFQMNNGTPESAYILQGGYMLAASYWPKDRVMINRLDSICQTVLKGKWPSARRSYDANTVASFYTTKLLDSPGAATEYSEPSVPTPPGAGVKEEHDQSTQMSKVKKHVREKEFTVKIKDEGGLKLTFQKQGLAQKRPFDGEDGALGQQQYLTRLRELQSASETSLVNFPKSIPVSGTSIQPTLGANGVILDNQPIVKKRRGRRKNVEGVDIFFFNRNKPPNHVSLGLTSSQISTGINPALSYTQPQGIPDTESPVPVINLKDGTRLAGDDAPKRKDLEKWLKEHPGYVEDLGAFIPRMQLHEGRPKQKRHRCRNPNKLDVNSLTGEERVQLINRRNARKVGGAFAPPLKDLCRFLKENSEYGVAPEWGDVVKQSGFLPESMYERILTGPVVREEVSRRGRRPKSGIAKATAAAAAASATSVSGNPLLANGLLPGVDLTTLQALQQNLQNLQSLQVTAGLMGMPTGLPSGGEAKNMAAMFPMLLSGMAGLPNLLGMGGLLTKPTESGTEDKKGSDSKESEGKTERTESQSSENGGENSVSSSPSTSSTAALNTAAAANPLALNPLLLSNILYPGMLLTPGLNLHIPTLSQSNTFDVQNKNSDLGSSKSVEVKEEDSRIKDQEDKGGTEPSPLNENSTDEGSEKADASSGSDSTSSSSEDSDSSNED

SEQ ID NO: 891112 - protein, 140 aa, Homo sapiens
RKPGFALRGAIGPREGRGGGRGYRRSSGRQPLVSWQRQARCGSGGAMSFCSFFGGEVFQNHFEPGVYVCAKCGYELFSSRSKYAHSSPWPAFTETIHADSVAKRPEHNRSEALKVSCGKCGNGLGHEFLNDGPKPGQSRF

SEQ ID NO: 891113 - protein, 141 aa, Homo sapiens
MPRHGAMRRIKEIIVKGDSPGLWHIYKRVYVCAKCGYELFSSRSKYAHSSPWPAFTETIHADSVAKRPEHNRSEALKLQGLRGVYSRPVASARELPPQAIGRAWPSGANVGNRTGFLYGLQDKGQPLMSAVSLGNRRVGRN

SEQ ID NO: 891114 - protein, 119 aa, Homo sapiens
LGKEHSLPSERGQRCLCLGWWIWELDPGKAGADDSTFASPSTTGVYVCAKCGYELFSSRSKYAHSSPWPAFTETIHADSVAKRPEHNRSEALKVSCGKCGNGLGHEFLNDGPKPGQSRF

SEQ ID NO: 891115 - protein, 89 aa, Homo sapiens
RGLWVTGFKMPKALITGVGMCGYELFSSRSKYAHSSPWPAFTETIHADSVAKRPEHNRSEALKVSCGKCGNGLGHEFLNDGPKPGQSRF

SEQ ID NO: 891116 - protein, 140 aa, Homo sapiens; identical to SEQ ID NO: 891112

SEQ ID NO: 891117 - protein, 145 aa, Homo sapiens
MNHQQMTVLFIHKKRKGLMFQSRGPWECPDVSTTAPCLPVSTPRVPTPRWNAQRNFCLPGSLGGQPTPTPDGHHTEATRWPFHLGVGTLGVETGRQGAVVETSGHSQGPGSEQDLFVSWKRDSFADGSCLLLGQAWAVQPHCRLT

SEQ ID NO: 891118 - protein, 116 aa, Homo sapiens
LGKEHSLPSERGQRCLCLGWWIWELDPGKAGADDSTFASPSTTGVYVCAKCGYELFSSRSKYAHSSPWPAFTETIHADSVAKRPEHNRSEALKAKKLLPPRVTRRAAHTHPRRPPH

SEQ ID NO: 891119 - protein, 140 aa, Homo sapiens; identical to SEQ ID NO: 891112

SEQ ID NO: 891120 - protein, 72 aa, Homo sapiens
DSVNRSRVNAGHRRRVCILRAAGEQLIATLGTHVKRQVHNRSEALKVSCGKCGNGLGHEFLNDGPKPGQSRF

SEQ ID NO: 891121 - protein, 522 aa, Homo sapiens
MDLEEAEEFKERCTQCAAVSWGLTDEGKYYCTSCHNVTERYQEVTNTDLIPNTQIKALNRGLKKKNNTEKGWDWYVCEGFQYILYQQAEALKNLGVGPELKNDVLHNFWKRYLQKSKQAYCKNPVYTTGRKPTVLEDNLSHSDWASEPELLSDVSCPPFLESGAESQSDIHTRKPFPVSKASQSETSVCSGSLDGVEYSQRKEKGIVKMTMPQTLAFCYLSLLWQREAITLSDLLRFVEEDHIPYINAFQHFPEQMKLYGRDRGIFGIESWPDYEDIYKKTIEVGTFLDLPRFPDITEDCYLHPNILCMKYLMEVNLPDEMHSLTCHVVKMTGMGEVDFLTFDPIAKMAKAVKYDVQAVAIIVVVLKLLFLLDDSFEWSLSNLAEKHNEKNKKDKPWFDFRKWYQIMKKAFDEKKQKWEEARAKYLWKSEKPLYYSFVDKPVAYKKREMVVNLQKQFSTLVESTATAGKKSPSSFQFNWTEEDTDRTCFHGHSLQGVLKEKGQSLLTKNSLYWLSTQKFCRW

SEQ ID NO: 891122 - protein, 106 aa, Homo sapiens
MDLEEAEEFKERCTQCAAVSWGLTDEGKYYCTSCHNVTERYQEVTNTDLIPNTQIKALNRGLKKKNNTEKGWDWYVCEGFQYILYQQAEALKNLGVGPELKERCFT

SEQ ID NO: 891123 - protein, 110 aa, Homo sapiens
MAHALMEEFKERCTQCAAVSWGLTDEGKYYCTSCHNVTERYQEVTNTDLIPNTQIKALNRGLKKKNNTEKGWDWYVCEGFQYILYQQAEALKNLGVGPELKGMSCVLFTI

SEQ ID NO: 891124 - protein, 588 aa, Homo sapiens
MDLEEAEEFKERCTQCAAVSWGLTDEGKYYCTSCHNVTERYQEVTNTDLIPNTQIKALNRGLKKKNNTEKGWDWYVCEGFQYILYQQAEALKNLGVGPELKNDVLHNFWKRYLQKSKQAYCKNPVYTTGRKPTVLEDNLSHSDWASEPELLSDVSCPPFLESGAESQSDIHTRKPFPVSKASQSETSVCSGSLDGVEYSQRKEKGIVKMTMPQTLAFCYLSLLWQREAITLSDLLRFVEEDHIPYINAFQHFPEQMKLYGRDRGIFGIESWPDYEDIYKKTIEVGTFLDLPRFPDITEDCYLHPNILCMKYLMEVNLPDEMHSLTCHVVKMTGMGEVDFLTFDPIAKMAKAVKYDVQAVAIIVVVLKLLFLLDDSFEWSLSNLAEKHNEKNKKDKPWFDFRKWYQIMKKAFDEKKQKWEEARAKYLWKSEKPLYYSFVDKPVAYKKREMVVNLQKQFSTLVESTATAGKKSPSSFQFNWTEEDTDRTCFHGHSLQGVLKEKGQSLLTKNSLYWLSTQKFCRCYCTHVTTYEESNYSLSYQFILNLFSFLLRIKTSLLHEEVSLVEKKLFEKKYSVKRKKSRSKKVRRH

SEQ ID NO: 891125 - protein, 588 aa, Homo sapiens; identical to SEQ ID NO: 891124

SEQ ID NO: 891126 - protein, 588 aa, Homo sapiens; identical to SEQ ID NO: 891124

SEQ ID NO: 891127 - protein, 537 aa, Homo sapiens
MDLEEAEEFKERCTQCAAVSWGLTDEGKYYCTSCHNVTERYQEVTNTDLIPNTQIKALNRGLKKKNNTEKGWDWYVCEGFQYILYQQAEALKNLGVGPELKNDVLHNFWKRYLQKSKQAYCKNPVYTTGRKPTVLEDNLSHSDWASEPELLSDVSCPPFLESGAESQSDIHTRKPFPVSKASQSGLLKRTIFLTSNAFQHFPEQMKLYGRDRGIFGIESWPDYEDIYKKTIEVGTFLDLPRFPDITEDCYLHPNILCMKYLMEVNLPDEMHSLTCHVVKMTGMGEVDFLTFDPIAKMAKAVKYDVQAVAIIVVVLKLLFLLDDSFEWSLSNLAEKHNEKNKKDKPWFDFRKWYQIMKKAFDEKKQKWEEARAKYLWKSEKPLYYSFVDKPVAYKKREMVVNLQKQFSTLVESTATAGKKSPSSFQFNWTEEDTDRTCFHGHSLQGVLKEKGQSLLTKNSLYWLSTQKFCRCYCTHVTTYEESNYSLSYQFILNLFSFLLRIKTSLLHEEVSLVEKKLFEKKYSVKRKKSRSKKVRRH

SEQ ID NO: 891128 - protein, 444 aa, Homo sapiens
MDLEEAEEFKERCTQCAAVSWGLTDEGKYYCTSCHNVTERYQEVTNTDLIPNTQIKALNRGLKKKNNTEKGWDWYVCEGFQYILYQQAEALKNLGVGPELKNDVLHNFWKRYLQKSKQAYCKNPVYTTGRKPTVLEDNLSHSDWASEPELLSDVSCPPFLESGAESQSDIHTRKPFPVSKASQSETSVCSGSLDGVEYSQRKEKGIVKMTMPQTLAFCYLSLLWQREAITLSDLLRFVEEDHIPYINAFQHFPEQMKLYGRDRGIFGIESWPDYEDIYKKTIEVGTFLDLPRFPDITEDCYLHPNILCMKYLMEVNLPDEMHSLTCHVVKMTGMGEVDFLTFDPIAKMAKAVKYDVQAVAIIVVVLKLLFLLDDSFEWSLSNLAEKHNEKNKKDKPWFDFRKWYQIMKKAFDEKKQKWEEARAKYVLLPGLDAPALLLCLLLYI

SEQ ID NO: 891129 - protein, 191 aa, Homo sapiens
ISDSASDNVFMSVSSPSCSSCFFTLYRYLWKSEKPLYYSFVDKPVAYKKREMVVNLQKQFSTLVESTATAGKKSPSSFQFNWTEEDTDRTCFHGHSLQGVLKEKGQSLLTKNSLYWLSTQKFCRCYCTHVTTYEESNYSLSYQFILNLFSFLLRIKTSLLHEEVSLVEKKLFEKKYSVKRKKSRSKKVRRH

SEQ ID NO: 891130 - protein, 140 aa, Homo sapiens [sequence omitted]

SEQ ID NO: 891131 - protein, 140 aa, Homo sapiens [sequence omitted]

SEQ ID NO: 891132 - protein, 167 aa, Homo sapiens
MASAEPLTALSRWYLYAIHGYFCEVMFTAAWEFVVNLNWKFPGVTSVWALFIYGTSILIVERMYLRLRGRCPLLLRCLIYTLWTYLWEFTTGFILRQFNACPWDYSQFDFDFMGLITLEYAVPWFCGALIMEQFIIRNTLRLRFDKDAEPGEPSGALALANGHVKTD

SEQ ID NO: 891133 - protein, 115 aa, Homo sapiens [sequence omitted]

SEQ ID NO: 891134 - protein, 167 aa, Homo sapiens; identical to SEQ ID NO: 891132

SEQ ID NO: 891135 - protein, 128 aa, Homo sapiens
MAYSEEHKGMPCGFIRQNSGNSISLDFEPSIEYQFVERLEERYKCAFCHSVLHNPHQTGCGHRFCQHCILSLREIEDSAIHGHVDKEVIKSKEGYKGASVAKTEKFLRVIMLRIGSKGSLDGNCQRII

SEQ ID NO: 891136 - protein, 557 aa, Homo sapiens
MAYSEEHKGMPCGFIRQNSGNSISLDFEPSIEYQFVERLEERYKCAFCHSVLHNPHQTGCGHRFCQHCILSLRELNTVPICPVDKEVIKSQEVFKDNCCKREVLNLYVYCSNAPGCNAKVILGRYQDHLQQCLFQPVQCSNEKCREPVLRKDLKEHLSASCQFRKEKCLYCKKDVVVINLQNHEENLCPEYPVFCPNNCAKIILKTEVDEHLAVCPEAEQDCPFKHYGCAVTDKRRNLQQHEHSALREHMRLVLEKNVQLEEQISDLHKSLEQKESKIQQLAETIKKLEKEFKQFAQLFGKNGSFLPNIQVFASHIDKSAWLEAQVHQLLQMVNQQQNKFDLRPLMEAVDTVKQKITLLENNDQRLAVLEEETNKHDTHINIHKAQLSKNEERFKLLEGTCYNGKLIWKVTDYKMKKREAVDGHTVSIFSQSFYTSRCGYRLCARAYLNGDGSGRGSHLSLYFVVMRGEFDSLLQWPFRQRVTLMLLDQSGKKNIMETFKPDPNSSSFKRPDGEMNIASGCPRFVAHSVLENAKNAYIKDDTLFLKVAVDLTDLEDL

SEQ ID NO: 891137 - protein, 226 aa, Homo sapiens
MVNQQQNKFDLRPLMEAVDTVKQKITLLENNDQRLAVLEEETNKHDTHINIHKAQLSKNEERFKLLEGTCYNGKLIWKVTDYKMKKREAVDGHTVSIFSQSFYTSRCGYRLCARAYLNGDGSGRGSHLSLYFVVMRGEFDSLLQWPFRQRVTLMLLDQSGKKNIMETFKPDPNSSSFKRPDGEMNIASGCPRFVAHSVLENAKNAYIKDDTLFLKVAVDLTDLEDL

SEQ ID NO: 891138 - protein, 508 aa, Homo sapiens
MAYSEEHKGMPCGFIRQNSGNSISLDFEPSIEYQFVERLEERYKCAFCHSVLHNPHQTGCGHRFCQHCILSLRELNTVPICPVDKEVIKSQEVFKDNCCKREVLNLYVYCSNAPGCNAKVILGRYQDHLQQCLFQPVQCSNEKCREPVLRKDLKEHLSASCQFRKEKCLYCKKDVVVINLQNHEENLCPEYPVFCPNNCAKIILKTEVDEHLAVCPEAEQDCPFKHYGCAVTDKRRNLQQHEHSALREHMRLVLEKNVQLEEQISDLHKSLEQKESKIQQLAETIKKLEKEFKQFAQLFGKNGSFLPNIQVFASHIDKSAWLEAQVHQLLQMVNQQQNKFDLRPLMEAVDTVKQKITLLENNDQRLAVLEEETNKHDTHINIHKAQLSKNEERFKLLEGTCYNGKLIWKVTDYKMKKREAVDGHTVSIFSQSFYTSRCGYRLCARAYLNGDGSGRGSHLSLYFVVMRGEFDSLLQWPFRQRVTLMLLDQSGKKNIMETFKPDPNEQQL

SEQ ID NO: 891139 - protein, 557 aa, Homo sapiens; identical to SEQ ID NO: 891136

SEQ ID NO: 891140 - protein, 557 aa, Homo sapiens; identical to SEQ ID NO: 891136

SEQ ID NO: 891141 - protein, 557 aa, Homo sapiens; identical to SEQ ID NO: 891136

SEQ ID NO: 891142 - protein, 1716 aa, Homo sapiens
MAQFPTPFGGSLDIWAITVEERAKHDQQFHSLKPISGFITGDQARNFFFQSGLPQPVLAQIWALADMNNDGRMDQVEFSIAMKLIKLKLQGYQLPSALPPVMKQQPVAISSAPAFGMGGIASMPPLTAVAPVPMGSIPVVGMSPTLVSSVPTAAVPPLANGAPPVIQPLPAFAHPAATLPKSSSFSRSGPGSQLNTKLQKAQSFDVASVPPVAEWAVPQSSRLKYRQLFNSHDKTMSGHLTGPQARTILMQSSLPQAQLASIWNLSDIDQDGKLTAEEFILAMHLIDVAMSGQPLPPVLPPEYIPPSFRRVRSGSGISVISSTSVDQRLPEEPVLEDEQQQLEKKLPVTFEDKKRENFERGNLELEKRRQALLEQQRKEQERLAQLERAEQERKERERQEQERKRQLELEKQLEKQRELERQREEERRKEIERREAAKRELERQRQLEWERNRRQELLNQRNKEQEDIVVLKAKKKTLEFELEALNDKKHQLEGKLQDIRCRLTTQRQEIESTNKSRELRIAEITHLQQQLQESQQMLGRLIPEKQILNDQLKQVQQNSLHRDSLVTLKRALEAKELARQHLRDQLDEVEKETRSKLQEIDIFNNQLKELREIHNKQQLQKQKSMEAERLKQKEQERKIIELEKQKEEAQRRAQERDKQWLEHVQQEDEHQRPRKLHEEEKLKREESVKKKDGEEKGKQEAQDKLGRLFHQHQEPAKPAVQAPWSTAEKGPLTISAQENVKVVYYRALYPFESRSHDEITIQPGDIVMVDESQTGEPGWLGGELKGKTGWFPANYAEKIPENEVPAPVKPVTDSTSAPAPKLALRETPAPLAVTSSEPSTTPNNWADFSSTWPTSTNEKPETDNWDAWAAQPSLTVPSAGQLRQRSAFTPATATGSSPSPVLGQGEKVEGLQAQALYPWRAKKDNHLNFNKNDVITVLEQQDMWWFGEVQGQKGWFPKSYVKLISGPIRKSTSMDSGSSESPASLKRVASPAAKPVVSGEEFIAMYTYESSEQGDLTFQQGDVILVTKKDGDWWTGTVGDKAGVFPSNYVRLKDSEGSGTAGKTGSLGKKPEIAQVIASYTATGPEQLTLAPGQLILIRKKNPGGWWEGELQARGKKRQIGWFPANYVKLLSPGTSKITPTEPPKSTALAAVCQVIGMYDYTAQNDDELAFNKGQIINVLNKEDPDWWKGEVNGQVGLFPSNYVKLTTDMDPSQQWCSDLHLLDMLTPTERKRQGYIHELIVTEENYVNDLQLVTEIFQKPLMESELLTEKEVAMIFVNWKELIMCNIKLLKALRVRKKMSGEKMPVKMIGDILSAQLPHMQPYIRFCSRQLNGAALIQQKTDEAPDFKEFVKRLAMDPRCKGMPLSSFILKPMQRVTRYPLIIKNILENTPENHPDHSHLKHALEKAEELCSQVNEGVREKENSDRLEWIQAHVQCEGLSEQLVFNSVTNCLGPRKFLHSGKLYKAKSNKELYGFLFNDFLLLTQITKPLGSSGTDKVFSPKSNLQYKMYKTPIFLNEVLVKLPTDPSGDEPIFHISHIDRVYTLRAESINERTAWVQKIKAASELYIETEKKKREKAYLVRSQRATGIGRLMVNVVEGIELKPCRSHGKSNPYCEVTMGSQCHITKTIQDTLNPKWNSNCQFFIRDLEQEVLCITVFERDQFSPDDFLGRTEIRVADIKKDQGSKGPVTKCLLLHEVPTGEIVVRLDLQLFDEP

SEQ ID NO: 891143 - protein, 1215 aa, Homo sapiens
MAQFPTPFGGSLDIWAITVEERAKHDQQFHSLKPISGFITGDQARNFFFQSGLPQPVLAQIWALADMNNDGRMDQVEFSIAMKLIKLKLQGYQLPSALPPVMKQQPVAISSAPAFGMGGIASMPPLTAVAPVPMGSIPVVGMSPTLVSSVPTAAVPPLANGAPPVIQPLPAFAHPAATLPKSSSFSRSGPGSQLNTKLQKAQSFDVASVPPVAEWAVPQSSRLKYRQLFNSHDKTMSGHLTGPQARTILMQSSLPQAQLASIWNLSDIDQDGKLTAEEFILAMHLIDVAMSGQPLPPVLPPEYIPPSFRRVRSGSGISVISSTSVDQRLPEEPVLEDEQQQLEKKLPVTFEDKKRENFERGNLELEKRRQALLEQQRKEQERLAQLERAEQERKERERQEQERKRQLELEKQLEKQRELERQREEERRKEIERREAAKRELERQRQLEWERNRRQELLNQRNKEQEDIVVLKAKKKTLEFELEALNDKKHQLEGKLQDIRCRLTTQRQEIESTNKSRELRIAEITHLQQQLQESQQMLGRLIPEKQILNDQLKQVQQNSLHRDSLVTLKRALEAKELARQHLRDQLDEVEKETRSKLQEIDIFNNQLKELREIHNKQQLQKQKSMEAERLKQKEQERKIIELEKQKEEAQRRAQERDKQWLEHVQQEDEHQRPRKLHEEEKLKREESVKKKDGEEKGKQEAQDKLGRLFHQHQEPAKPAVQAPWSTAEKGPLTISAQENVKVVYYRALYPFESRSHDEITIQPGDIVMVDESQTGEPGWLGGELKGKTGWFPANYAEKIPENEVPAPVKPVTDSTSAPAPKLALRETPAPLAVTSSEPSTTPNNWADFSSTWPTSTNEKPETDNWDAWAAQPSLTVPSAGQLRQRSAFTPATATGSSPSPVLGQGEKVEGLQAQALYPWRAKKDNHLNFNKNDVITVLEQQDMWWFGEVQGQKGWFPKSYVKLISGPIRKSTSMDSGSSESPASLKRVASPAAKPVVSGEEFIAMYTYESSEQGDLTFQQGDVILVTKKDGDWWTGTVGDKAGVFPSNYVRLKDSEGSGTAGKTGSLGKKPEIAQVIASYTATGPEQLTLAPGQLILIRKKNPGGWWEGELQARGKKRQIGWFPANYVKLLSPGTSKITPTEPPKSTALAAVCQVIGMYDYTAQNDDELAFNKGQIINVLNKEDPDWWKGEVNGQVGLFPSNYVKLTTDMDPSQQ

SEQ ID NO: 891144 - protein, 78 aa, Homo sapiens
ETESGSVTQARVRWRRLTVAGACAAGGRASETKKTPRRGKTEKGGECQKEGWRSGSMALWRAYQRACRSPVKARQPTA

SEQ ID NO: 891145 - protein, 1215 aa, Homo sapiens; identical to SEQ ID NO: 891143

SEQ ID NO: 891146 - protein, 1144 aa, Homo sapiens
MAQFPTPFGGSLDIWAITVEERAKHDQQFHSLKPISGFITGDQARNFFFQSGLPQPVLAQIWALADMNNDGRMDQVEFSIAMKLIKLKLQGYQLPSALPPVMKQQPVAISSAPAFGMGGIASMPPLTAVAPVPMGSIPVVGMSPTLVSSVPTAAVPPLANGAPPVIQPLPAFAHPAATLPKSSSFSRSGPGSQLNTKLQKAQSFDVASVPPVAEWAVPQSSRLKYRQLFNSHDKTMSGHLTGPQARTILMQSSLPQAQLASIWNLSDIDQDGKLTAEEFILAMHLIDVAMSGQPLPPVLPPEYIPPSFRRVRSGSGISVISSTSVDQRLPEEPVLEDEQQQLEKKLPVTFEDKKRENFERGNLELEKRRQALLEQQRKEQERLAQLERAEQERKERERQEQERKRQLELEKQLEKQRELERQREEERRKEIERREAAKRELERQRQLEWERNRRQELLNQRNKEQEDIVVLKAKKKTLEFELEALNDKKHQLEGKLQDIRCRLTTQRQEIESTNKSRELRIAEITHLQQQLQESQQMLGRLIPEKQILNDQLKQVQQNSLHRDSLVTLKRALEAKELARQHLRDQLDEVEKETRSKLQEIDIFNNQLKELREIHNKQQLQKQKSMEAERLKQKEQERKIIELEKQKEEAQRRAQERDKQWLEHVQQEDEHQRPRKLHEEEKLKREESVKKKDGEEKGKQEAQDKLGRLFHQHQEPAKPAVQAPWSTAEKGPLTISAQENVKVVYYRALYPFESRSHDEITIQPGDIVMVDESQTGEPGWLGGELKGKTGWFPANYAEKIPENEVPAPVKPVTDSTSAPAPKLALRETPAPLAVTSSEPSTTPNNWADFSSTWPTSTNEKPETDNWDAWAAQPSLTVPSAGQLRQRSAFTPATATGSSPSPVLGQGEKVEGLQAQALYPWRAKKDNHLNFNKNDVITVLEQQDMWWFGEVQGQKGWFPKSYVKLISGPIRKSTSMDSGSSESPASLKRVASPAAKPVVSGEEIAQVIASYTATGPEQLTLAPGQLILIRKKNPGGWWEGELQARGKKRQIGWFPANYVKLLSPGTSKITPTEPPKSTALAAVCQVIGMYDYTAQNDDELAFNKGQIINVLNKEDPDWWKGEVNGQVGLFPSNYVKLTTDMDPSQQ

SEQ ID NO: 891147 - protein, 1107 aa, Homo sapiens
MAQFPTPFGGSLDIWAITVEERAKHDQQFHSLKPISGFITGDQARNFFFQSGLPQPVLAQIWALADMNNDGRMDQVEFSIAMKLIKLKLQGYQLPSALPPVMKQQPVAISSAPAFAAVPPLANGAPPVIQPLPAFAHPAATLPKSSSFSRSGPGSQLNTKLQKAQSFDVASVPPVAEWAVPQSSRLKYRQLFNSHDKTMSGHLTGPQARTILMQSSLPQAQLASIWNLSDIDQDGKLTAEEFILAMHLIDVAMSGQPLPPVLPPEYIPPSFRRVRSGSGISVISSTSVDQRLPEEPVLEDEQQQLEKKLPVTFEDKKRENFERGNLELEKRRQALLEQQRKEQERLAQLERAEQERKERERQEQERKRQLELEKQLEKQRELERQREEERRKEIERREAAKRELERQRQLEWERNRRQELLNQRNKEQEDIVVLKAKKKTLEFELEALNDKKHQLEGKLQDIRCRLTTQRQEIESTNKSRELRIAEITHLQQQLQESQQMLGRLIPEKQILNDQLKQVQQNSLHRDSLVTLKRALEAKELARQHLRDQLDEVEKETRSKLQEIDIFNNQLKELREIHNKQQLQKQKSMEAERLKQKEQERKIIELEKQKEEAQRRAQERDKQWLEHVQQEDEHQRPRKLHEEEKLKREESVKKKDGEEKGKQEAQDKLGRLFHQHQEPAKPAVQAPWSTAEKGPLTISAQENVKVVYYRALYPFESRSHDEITIQPGDIVMVDESQTGEPGWLGGELKGKTGWFPANYAEKIPENEVPAPVKPVTDSTSAPAPKLALRETPAPLAVTSSEPSTTPNNWADFSSTWPTSTNEKPETDNWDAWAAQPSLTVPSAGQLRQRSAFTPATATGSSPSPVLGQGEKVEGLQAQALYPWRAKKDNHLNFNKNDVITVLEQQDMWWFGEVQGQKGWFPKSYVKLISGPIRKSTSMDSGSSESPASLKRVASPAAKPVVSGEEIAQVIASYTATGPEQLTLAPGQLILIRKKNPGGWWEGELQARGKKRQIGWFPANYVKLLSPGTSKITPTEPPKSTALAAVCQVIGMYDYTAQNDDELAFNKGQIINVLNKEDPDWWKGEVNGQVGLFPSNYVKLTTDMDPSQQ

SEQ ID NO: 891148 - protein, 1076 aa, Homo sapiens
MAQFPTPFGGSLDIWAITVEERAKHDQQFHSLKPISGFITGDQARNFFFQSGLPQPVLAQIWALADMNNDGRMDQVEFSIAMKLIKLKLQGYQLPSALPPVMKQQPVAISSAPAFGMGGIASMPPLTAVAPVPMGSIPVVGMSPTLVSSVPTAAVPPLANGAPPVIQPLPAFAHPAATLPKSSSFSRSGPGSQLNTKLQKAQSFDVASVPPVAEWAVPQSSRLKYRQLFNSHDKTMSGHLTGPQARTILMQSSLPQAQLASIWNLSDIDQDGKLTAEEFILAMHLIDVAMSGQPLPPVLPPEYIPPSFRRVRSGSGISVISSTSVDQRLPEEPVLEDEQQQLEKKLPVTFEDKKRENFERGNLELEKRRQALLEQQRKEQERLAQLERAEQERKERERQEQERKRQLELEKQLEKQRELERQREEERRKEIERREAAKRELERQRQLEWERNRRQELLNQRNKEQEDIVVLKAKKKTLEFELEALNDKKHQLEGKLQDIRCRLTTQRQEIESTNKSRELRIAEITHLQQQLQESQQMLGRLIPEKQILNDQLKQVQQNSLHRDSLVTLKRALEAKELARQHLRDQLDEVEKETRSKLQEDEHQRPRKLHEEEKLKREESVKKKDGEEKGKQEAQDKLGRLFHQHQEPAKPAVQAPWSTAEKGPLTISAQENVKVVYYRALYPFESRSHDEITIQPGDIVMVDESQTGEPGWLGGELKGKTGWFPANYAEKIPENEVPAPVKPVTDSTSAPAPKLALRETPAPLAVTSSEPSTTPNNWADFSSTWPTSTNEKPETDNWDAWAAQPSLTVPSAGQLRQRSAFTPATATGSSPSPVLGQGEKVEGLQAQALYPWRAKKDNHLNFNKNDVITVLEQQDMWWFGEVQGQKGWFPKSYVKLISGPIRKSTSMDSGSSESPASLKRVASPAAKPVVSGEEIAQVIASYTATGPEQLTLAPGQLILIRKKNPGGWWEGELQARGKKRQIGWFPANYVKLLSPGTSKITPTEPPKSTALAAVCQVIGMYDYTAQNDDELAFNKGQIINVLNKEDPDWWKGEVNGQVGLFPSNYVKLTTDMDPSQQ

SEQ ID NO: 891149 - protein, 1215 aa, Homo sapiens; identical to SEQ ID NO: 891143

SEQ ID NO: 891150 - protein, 1215 aa, Homo sapiens; identical to SEQ ID NO: 891143

SEQ ID NO: 891151 - protein, 1042 aa, Homo sapiens
QKYPQQNRSCVPPVAEWAVPQSSRLKYRQLFNSHDKTMSGHLTDGASLLLPRPECNGVISAHCNLHLLGSSESPASASQVAGITGMYHHAQANFVFLVETGFHHVAQAGLKLLTSGDPPTSASQSAGITGMSHHTRPTEGPQARTILMQSSLPQAQLASIWNLSDIDQDGKLTAEEFILAMHLIDVAMSGQPLPPVLPPEYIPPSFRRVRSGSGISVISSTSVDQRLPEEPVLEDEQQQLEKKLPVTFEDKKRENFERGNLELEKRRQALLEQQRKEQERLAQLERAEQERKERERQEQERKRQLELEKQLEKQRELERQREEERRKEIERREAAKRELERQRQLEWERNRRQELLNQRNKEQEDIVVLKAKKKTLEFELEALNDKKHQLEGKLQDIRCRLTTQRQEIESTNKSRELRIAEITHLQQQLQESQQMLGRLIPEKQILNDQLKQVQQNSLHRDSLVTLKRALEAKELARQHLRDQLDEVEKETRSKLQEIDIFNNQLKELREIHNKQQLQKQKSMEAERLKQKEQERKIIELEKQKEEAQRRAQERDKQWLEHVQQEDEHQRPRKLHEEEKLKREESVKKKDGEEKGKQEAQDKLGRLFHQHQEPAKPAVQAPWSTAEKGPLTISAQENVKVVYYRALYPFESRSHDEITIQPGDIVMVDESQTGEPGWLGGELKGKTGWFPANYAEKIPENEVPAPVKPVTDSTSAPAPKLALRETPAPLAVTSSEPSTTPNNWADFSSTWPTSTNEKPETDNWDAWAAQPSLTVPSAGQLRQRSAFTPATATGSSPSPVLGQGEKVEGLQAQALYPWRAKKDNHLNFNKNDVITVLEQQDMWWFGEVQGQKGWFPKSYVKLISGPIRKSTSMDSGSSESPASLKRVASPAAKPVVSGEEIAQVIASYTATGPEQLTLAPGQLILIRKKNPGGWWEGELQARGKKRQIGWFPANYVKLLSPGTSKITPTEPPKSTALAAVCQVIGMYDYTAQNDDELAFNKGQIINVLNKEDPDWWKGEVNGQVGLFPSNYVKLTTDMDPSQQ

SEQ ID NO: 891152 - protein, 1215 aa, Homo sapiens; identical to SEQ ID NO: 891143

SEQ ID NO: 891153 - protein, 273 aa, Homo sapiens [sequence omitted]

SEQ ID NO: 891154 - protein, 1020 aa, Homo sapiens
MAQFPTPFGGSLDIWAITVEERAKHDQQFHSLKPISGFITGDQARNFFFQSGLPQPVLAQIWALADMNNDGRMDQVEFSIAMKLIKLKLQGYQLPSALPPVMKQQPVAISSAPAFGMGGIASMPPLTAVAPVPMGSIPVVGMSPTLVSSVPTAAVPPLANGAPPVIQPLPAFAHPAATLPKSSSFSRSGPGSQLNTKLQKAQSFDVASVPPVAEWAVPQSSRLKYRQLFNSHDKTMSGHLTGPQARTILMQSSLPQAQLASIWNLSDIDQDGKLTAEEFILAMHLIDVAMSGQPLPPVLPPEYIPPSFRRVRSGSGISVISSTSVDQRLPEEPVLEDEQQQLEKKLPVTFEDKKRENFERGNLELEKRRQALLEQQRKEQERLAQLERAEQERKERERQEQERKRQLELEKQLEKQRELERQREEERRKEIERREAAKRELERQRQLEWERNRRQELLNQRNKEQEDIVVLKAKKKTLEFELEALNDKKHQLEGKLQDIRCRLTTQRQEIESTNKSRELRIAEITHLQQQLQESQQMLGRLIPEKQILNDQLKQVQQNSLHRDSLVTLKRALEAKELARQHLRDQLDEVEKETRSKLQEIDIFNNQLKELREIHNKQQLQKQKSMEAERLKQKEQERKIIELEKQKEEAQRRAQERDKQWLEHVQQEDEHQRPRKLHEEEKLKREESVKKKDGEEKGKQEAQDKLGRLFHQHQEPAKPAVQAPWSTAEKGPLTISAQENVKVVYYRALYPFESRSHDEITIQPGDIVMVDESQTGEPGWLGGELKGKTGWFPANYAEKIPENEVPAPVKPVTDSTSAPAPKLALRETPAPLAVTSSEPSTTPNNWADFSSTWPTSTNEKPETDNWDAWAAQPSLTVPSAGQLRQRSAFTPATATGSSPSPVLGQPDFLLHPSMRLGHMQPRIVLLFPDPLQCSTSRLLPMLRPRPGVPFLRSPSCQSPSHPSRPISDAAPSVKFTLMPPGRIHPCFLFIPAVNSRNSFLVYFILPGGTLGCFYLCLPHYL

SEQ ID NO: 891155 - protein, 770 aa, Homo sapiens
MAQFPTPFGGSLDIWAITVEERAKHDQQFHSLKPISGFITGDQARNFFFQSGLPQPVLAQIWALADMNNDGRMDQVEFSIAMKLIKLKLQGYQLPSALPPVMKQQPVAISSAPAFGMGGIASMPPLTAVAPVPMGSIPVVGMSPTLVSSVPTAAVPPLANGAPPVIQPLPAFAHPAATLPKSSSFSRSGPGSQLNTKLQKAQSFDVASVPPVAEWAVPQSSRLKYRQLFNSHDKTMSGHLTGPQARTILMQSSLPQAQLASIWNLSDIDQDGKLTAEEFILAMHLIDVAMSGQPLPPVLPPEYIPPSFRRVRSGSGISVISSTSVDQRLPEEPVLEDEQQQLEKKLPVTFEDKKRENFERGNLELEKRRQALLEQQRKEQERLAQLERAEQERKERERQEQERKRQLELEKQLEKQRELERQREEERRKEIERREAAKRELERQRQLEWERNRRQELLNQRNKEQEDIVVLKAKKKTLEFELEALNDKKHQLEGKLQDIRCRLTTQRQEIESTNKSRELRIAEITHLQQQLQESQQMLGRLIPEKQILNDQLKQVQQNSLHRDSLVTLKRALEAKELARQHLRDQLDEVEKETRSKLQEIDIFNNQLKELREIHNKQQLQKQKSMEAERLKQKEQERKIIELEKQKEEAQRRAQERDKQWLEHVQQEDEHQRPRKLHEEEKLKREESVKKKDGEEKGKQEAQDKLGRLFHQHQEPAKPAVQAPWSTAEKGPLTISAQENVKVVYYRALYPFESRSHDEITIQPGDIVNGG

SEQ ID NO: 891156 - protein, 696 aa, Homo sapiens
MAQFPTPFGGSLDIWAITVEERAKHDQQFHSLKPISGFITGDQARNFFFQSGLPQPVLAQIWALADMNNDGRMDQVEFSIAMKLIKLKLQGYQLPSALPPVMKQQPVAISSAPAFGMGGIASMPPLTAVAPVPMGSIPVVGMSPTLVSSVPTAAVPPLANGAPPVIQPLPAFAHPAATLPKSSSFSRSGPGSQLNTKLQKAQSFDVASVPPVAEWAVPQSSRLKYRQLFNSHDKTMSGHLTGPQARTILMQSSLPQAQLASIWNLSDIDQDGKLTAEEFILAMHLIDVAMSGQPLPPVLPPEYIPPSFRRVRSGSGISVISSTSVDQRLPEEPVLEDEQQQLEKKLPVTFEDKKRENFERGNLELEKRRQALLEQQRKEQERLAQLERAEQERKERERQEQERKRQLELEKQLEKQRELERQREEERRKEIERREAAKRELERQRQLEWERNRRQELLNQRNKEQEDIVVLKAKKKTLEFELEALNDKKHQLEGKLQDIRCRLTTQRQEIESTNKSRELRIAEITHLQQQLQESQQMLGRLIPEKQILNDQLKQVQQNSLHRDSLVTLKRALEAKELARQHLRDQLDEVEKETRSKLQEIDIFNNQLKELREIHNKQQLQKQKSMEAERLKQKEQERKIIELEKQKEEAQRFLILADDLCALAIVHRMAVGWRLLGPGCLGLKPMHVWLCDVDKSF

SEQ ID NO: 891157 - protein, 120 aa, Homo sapiens
MAQFPTPFGGSLDIWAITVEERAKHDQQFHSLKPISGFITGDQARNFFFQSGLPQPVLAQIWALADMNNDGRMDQVEFSIAMKLIKLKLQGYQLPSALPPVMKQQPVAISSAPAFGGNSV

SEQ ID NO: 891158 - protein, 115 aa, Homo sapiens [sequence omitted]

SEQ ID NO: 891159 - protein, 115 aa, Homo sapiens [sequence omitted]

SEQ ID NO: 891160 - protein, 115 aa, Homo sapiens [sequence omitted]

SEQ ID NO: 891161 - protein, 80 aa, Homo sapiens
FPILSQTKKRRNNGRAKKGRGHVQPIRCTNCARCVPKDKAIKKFVIRNIVEAAAVRDISEASVFDGKWVTGANCVRIPVS

SEQ ID NO: 891162 - protein, 634 aa, Homo sapiens
MELQTLQEALKVEIQVHQKLVAQMKQDPQNADLKKQLHELQAKITALSEKQKRVVEQLRKNLIVKQEQPDKFQIQPLPQSENKLQTAQQQPLQQLQQQQQYHHHHAQQSAAASPNLTASQKTVTTASMITTKTLPLVLKAATATMPASVVGQRPTIAMVTAINSQKAVLSTDVQNTPVNLQTSSKVTGPGAEAVQIVAKNTVTLQVQATPPQPIKVPQFIPPPRLTPRPNFLPQVRPKPVAQNNIPIAPAPPPMLAAPQLIQRPVMLTKFTPTTLPTSQNSIHPVRVVNGQTATIAKTFPMAQLTSIVIATPGTRLAGPQTVQLSKPSLEKQTVKSHTETDEKQTESRTITPPAAPKPKREENPQKLAFMVSLGLVTHDHLEEIQSKRQERKRRTTANPVYSGAVFEPERKKSAVTYLNSTMHPGTRKRANEEHWPKGDIHEDFCSVCRKSGQLLMCDTCSRVYHLDCLDPPLKTIPKGMWICPRCQDQMLKKEEAIPWPGTLAIVHSYIAYKAAKEEEKQKLLKWSSDLKQEREQLEQKVKQLSNSISKCMEMKNTILARQKEMHSSLEKVKQLIRLIHGIDLSKPVDSEATVGAISNGPDCTPPANAATSTPAPSPSSQSCTANCNQGEETK

SEQ ID NO: 891163 - protein, 634 aa, Homo sapiens; identical to SEQ ID NO: 891162

SEQ ID NO: 891164 - protein, 557 aa, Homo sapiens
KVLEITAPPRALVICRPRARQQQYHHHHAQQSAAASPNLTASQKTVTTASMITTKTLPLVLKAATATMPASVVGQRPTIAMVTAINSQKAVLSTDVQNTPVNLQTSSKVTGPGAEAVQIVAKNTVTLQVQATPPQPIKVPQFIPPPRLTPRPNFLPQVRPKPVAQNNIPIAPAPPPMLAAPQLIQRPVMLTKFTPTTLPTSQNSIHPVRVVNGQTATIAKTFPMAQLTSIVIATPGTRLAGPQTVQLSKPSLEKQTVKSHTETDEKQTESRTITPPAAPKPKREENPQKLAFMVSLGLVTHDHLEEIQSKRQERKRRTTANPVYSGAVFEPERKKSAVTYLNSTMHPGTRKRANEEHWPKGDIHEDFCSVCRKSGQLLMCDTCSRVYHLDCLDPPLKTIPKGMWICPRCQDQMLKKEEAIPWPGTLAIVHSYIAYKAAKEEEKQKLLKWSSDLKQEREQLEQKVKQLSNSISKCMEMKNTILARQKEMHSSLEKVKQLIRLIHGIDLSKPVDSEATVGAISNGPDCTPPANAATSTPAPSPSSQSCTANCNQGEETK

SEQ ID NO: 891165 - protein, 681 aa, Homo sapiens
MELQTLQEALKVEIQVHQKLVAQMKQDPQNADLKKQLHELQAKITALSEKQKRVVEQLRKNLIVKQEQPDKFQIQPLPQSENKLQTAQQQPLQQLQQQQQYHHHHAQQSAAASPNLTASQKTVTTASMITTKTLPLVLKAATATMPASVVGQRPTIAMVTAINSQKAVLSTDVQNTPVNLQTSSKVTGPGAEAVQIVAKNTVTLQVQATPPQPIKVPQFIPPPRLTPRPNFLPQVRPKPVAQNNIPIAPAPPPMLAAPQLIQRPVMLTKFTPTTLPTSQNSIHPVRVVNGQTATIAKTFPMAQLTSIVIATPGTRLAGPQTVQLSKPSLEKQTVKSHTETDEKQTESRTITPPAAPKPKREENPQKLAFMVSLGLVTHDHLEEIQSKRQERKRRTTANPVYSGAVFEPERKKSAVTYLNSTMHPGTRKRGRPPKYNAVLGFGALTPTSPQSSHPDSPENEKTETTFTFPAPVQPVSLPSPTSTDGDIHEDFCSVCRKSGQLLMCDTCSRVYHLDCLDPPLKTIPKGMWICPRCQDQMLKKEEAIPWPGTLAIVHSYIAYKAAKEEEKQKLLKWSSDLKQEREQLEQKVKQLSNSISKCMEMKNTILARQKEMHSSLEKVKQLIRLIHGIDLSKPVDSEATVGAISNGPDCTPPANAATSTPAPSPSSQSCTANCNQGEETK

SEQ ID NO: 891166 - protein, 693 aa, Homo sapiens
MELQTLQEALKVEIQVHQKLVAQMKQDPQNADLKKQLHELQAKITALSEKQKRVVEQLRKNLIVKQEQPDKFQIQPLPQSENKLQTAQQQPLQQLQQQQQYHHHHAQQSAAASPNLTASQKTVTTASMITTKTLPLVLKAATATMPASVVGQRPTIAMVTAINSQKAVLSTDVQNTPVNLQTSSKVTGPGAEAVQIVAKNTVTLQVQATPPQPIKVPQFIPPPRLTPRPNFLPQVRPKPVAQNNIPIAPAPPPMLAAPQLIQRPVMLTKFTPTTLPTSQNSIHPVRVVNGQTATIAKTFPMAQLTSIVIATPGTRLAGPQTVQLSKPSLEKQTVKSHTETDEKQTESRTITPPAAPKPKREENPQKLAFMVSLGLVTHDHLEEIQSKRQERKRRTTANPVYSGAVFEPERKKSAVTYLNSTMHPGTRKRGRPPKYNAVLGFGALTPTSPQSSHPDSPENEKTETTFTFPAPVQPVSLPSPTSTDGDIHEDFCSVCRKSGQLLMCDTCSRVYHLDCLDPPLKTIPKGMWICPRCQDQMLKKEEAIPWPGTLAIVHSYIAYKAAKEEEKQKLLKWSSDLKQEREQLEQKVKQLSNSISCEEAGFLETVLEKCMEMKNTILARQKEMHSSLEKVKQLIRLIHGIDLSKPVDSEATVGAISNGPDCTPPANAATSTPAPSPSSQSCTANCNQGEETK

SEQ ID NO: 891167 - protein, 723 aa, Homo sapiens
MELQTLQEALKVEIQVHQKLVAQMKQDPQNADLKKQLHELQAKITALSEKQKRVVEQLRKNLIVKQEQPDKFQIQPLPQSENKLQTAQQQPLQQLQQQQQYHHHHAQQSAAASPNLTASQKTVTTASMITTKTLPLVLKAATATMPASVVGQRPTIAMVTAINSQKAVLSTDVQNTPVNLQTSSKVTGPGAEAVQIVAKNTVTLQVQATPPQPIKVPQFIPPPRLTPRPNFLPQVRPKPVAQNNIPIAPAPPPMLAAPQLIQRPVMLTKFTPTTLPTSQNSIHPVRVVNGQTATIAKTFPMAQLTSIVIATPGTRLAGPQTVQLSKPSLEKQTVKSHTETDEKQTESRTITPPAAPKPKREENPQKLAFMVSLGLVTHDHLEEIQSKRQERKRRTTANPVYSGAVFEPERKKSAVTYLNSTMHPGTRKRGRPPKYNAVLGFGALTPTSPQSSHPDSPENEKTETTFTFPAPVQPVSLPSPTSTDGDIHEDFCSVCRKSGQLLMCDTCSRVYHLDCLDPPLKTIPKGMWICPRCQDQMLKKEEAIPWPGTLAIVHSYIAYKAAKEEEKQKLLKWSSDLKQEREQLEQKVKQLSNSISSPERVGPSVRPSLCSFFHTMLIAFPGFPDQCEEAGFLETVLEKCMEMKNTILARQKEMHSSLEKVKQLIRLIHGIDLSKPVDSEATVGAISNGPDCTPPANAATSTPAPSPSSQSCTANCNQGEETK

SEQ ID NO: 891168 - protein, 430 aa, Homo sapiens
MELQTLQEALKVEIQVHQKLVAQMKQDPQNADLKKQLHELQAKITALSEKQKRVVEQLRKNLIVKQEQPDKFQIQPLPQSENKLQTAQQQPLQQLQQQQQYHHHHAQQSAAASPNLTASQKTVTTASMITTKTLPLVLKAATATMPASVVGQRPTIAMVTAINSQKAVLSTDVQNTPVNLQTSSKVTGPGAEAVQIVAKNTVTLQVQATPPQPIKVPQFIPPPRLTPRPNFLPQVRPKPVAQNNIPIAPAPPPMLAAPQLIQRPVMLTKFTPTTLPTSQNSIHPVRVVNGQTATIAKTFPMAQLTSIVIATPGTRLAGPQTVQLSKPSLEKQTVKSHTETDEKQTESRTITPPAAPKPKREENPQKLAFMVSLGLVTHDHLEEIQSKRQERKRRTTANPVYSGAVFEPERKKSAVTYLNSTMHPGTRKRG

SEQ ID NO: 891169 - protein, 721 aa, Homo sapiens
MELQTLQEALKVEIQVHQKLVAQMKQDPQNADLKKQLHELQAKITALSEKQKRVVEQLRKNLIVKQEQPDKFQIQPLPQSENKLQTAQQQPLQQLQQQQQYHHHHAQQSAAASPNLTASQKTVTTASMITTKTLPLVLKAATATMPASVVGQRPTIAMVTAINSQKAVLSTDVQNTPVNLQTSSKVTGPGAEAVQIVAKNTVTLQVQATPPQPIKVPQFIPPPRLTPRPNFLPQVRPKPVAQNNIPIAPAPPPMLAAPQLIQRPVMLTKFTPTTLPTSQNSIHPVRVVNGQTATIAKTFPMAQLTSIVIATPGTRLAGPQTVQLSKPSLEKQTVKSHTETDEKQTESRTITPPAAPKPKREENPQKLAFMVSLGLVTHDHLEEIQSKRQERKRRTTANPVYSGAVFEPERKKSAVTYLNSTMHPGTRKRGRPPKYNAVLGFGALTPTSPQSSHPDSPENEKTETTFTFPAPVQPVSLPSPTSTDGDIHEDFCSVCRKSGQLLMCDTCSRVYHLDCLDPPLKTIPKGMWICPRCQDQMLKKEEAIPWPGTLAIVHSYIAYKAAKEEEKQKLLKWSSDLKQEREQLEQKVKQLSNSISKCMEMKNTILARQKEMHSSLEKVKQLIRLIHGIDLSKPVDSEATVGAISNGPDCTPPANAAGIPWLLPQFIPPPRLTPRPNFLPQVRPKPVAQNNIPIAPAPPPMLAAPQLIQRRVMLTSSPHNL

SEQ ID NO: 891170 - protein, 634 aa, Homo sapiens; identical to SEQ ID NO: 891162

SEQ ID NO: 891171 - protein, 634 aa, Homo sapiens; identical to SEQ ID NO: 891162

SEQ ID NO: 891172 - protein, 560 aa, Homo sapiens
YDLDFYRETVYILQSGTHLVSTTQQQYHHHHAQQSAAASPNLTASQKTVTTASMITTKTLPLVLKAATATMPASVVGQRPTIAMVTAINSQKAVLSTDVQNTPVNLQTSSKVTGPGAEAVQIVAKNTVTLQVQATPPQPIKVPQFIPPPRLTPRPNFLPQVRPKPVAQNNIPIAPAPPPMLAAPQLIQRPVMLTKFTPTTLPTSQNSIHPVRVVNGQTATIAKTFPMAQLTSIVIATPGTRLAGPQTVQLSKPSLEKQTVKSHTETDEKQTESRTITPPAAPKPKREENPQKLAFMVSLGLVTHDHLEEIQSKRQERKRRTTANPVYSGAVFEPERKKSAVTYLNSTMHPGTRKRANEEHWPKGDIHEDFCSVCRKSGQLLMCDTCSRVYHLDCLDPPLKTIPKGMWICPRCQDQMLKKEEAIPWPGTLAIVHSYIAYKAAKEEEKQKLLKWSSDLKQEREQLEQKVKQLSNSISKCMEMKNTILARQKEMHSSLEKVKQLIRLIHGIDLSKPVDSEATVGAISNGPDCTPPANAATSTPAPSPSSQSCTANCNQGEETK

SEQ ID NO: 891173 - protein, 681 aa, Homo sapiens; identical to SEQ ID NO: 891165

SEQ ID NO: 891174 - protein, 629 aa, Homo sapiens
MELQTLQEALKVEIQVHQKLVAQMKQDPQNADLKKQLHELQAKITALSEKQKRVVEQLRKNLIVKQEQPDKFQIQPLPQSENKLQTAQQQPLQQLQQQQQYHHHHAQQSAAASPNLTASQKTVTTASMITTKTLPLVLKAATATMPASVVGQRPTIAMVTAINSQKAVLSTDVQNTPVNLQTSSKVTGPGAEAVQIVAKNTVTLQVQATPPQPIKVPQFIPPPRLTPRPNFLPQVRPKPVAQNNIPIAPAPPPMLAAPQLIQRPVMLTKFTPTTLPTSQNSIHPVRVVNGQTATIAKTFPMAQLTSIVIATPGTRLAGPQTVQLSKPSLEKQTVKSHTETDEKQTESRTITPPAAPKPKREENPQKLAFMVSLGLVTHDHLEEIQSKRQERKRRTTANPVYSGAVFEPERKKSAVTYLNSTMHPGTRKRGRPPKYNAVLGFGALTPTSPQSSHPDSPENEKTETTFTFPAPVQPVSLPSPTSTDMLKKEEAIPWPGTLAIVHSYIAYKAAKEEEKQKLLKWSSDLKQEREQLEQKVKQLSNSISKCMEMKNTILARQKEMHSSLEKVKQLIRLIHGIDLSKPVDSEATVGAISNGPDCTPPANAATSTPAPSPSSQSCTANCNQGEETK

SEQ ID NO: 891175 - protein, 157 aa, Homo sapiens
MLKKEEAIPWPGTLAIVHSYIAYKAAKEEEKQKLLKWSSDLKQEREQLEQKVKQLSNSISCEEAGFLETVLEKCMEMKNTILARQKEMHSSLEKVKQLIRLIHGIDLSKPVDSEATVGAISNGPDCTPPANAATSTPAPSPSSQSCTANCNQGEETK

SEQ ID NO: 891176 - protein, 475 aa, Homo sapiens
MELQTLQEALKVEIQVHQKLVAQMKQDPQNADLKKQLHELQAKITALSEKQKRVVEQLRKNLIVKQEQPDKFQIQPLPQSENKLQTAQQQPLQQLQQQQQYHHHHAQQSAAASPNLTASQKTVTTASMITTKTLPLVLKAATATMPASVVGQRPTIAMVTAINSQKAVLSTDVQNTPVNLQTSSKVTGPGAEAVQIVAKNTVTLQVQATPPQPIKVPQFIPPPRLTPRPNFLPQVRPKPVAQNNIPIAPAPPPMLAAPQLIQRPVMLTKFTPTTLPTSQNSIHPVRVVNGQTATIAKTFPMAQLTSIVIATPGTRLAGPQTVQLSKPSLEKQTVKSHTETDEKQTESRTITPPAAPKPKREENPQKLAFMVSLGLVTHDHLEEIQSKRQERKRRTTANPVYSGAVFEPERKKSAVTYLNSTMHPGTRKRANEEHWPKGDIHEDFCSVCRKSGQLLMCDTCSRVYHLDCLDPLYPL

SEQ ID NO: 891177 - protein, 312 aa, Homo sapiens
MSDEDDLEDSEPDQDDSEKEEDEKETEEGEDYRKEGEEFPEEWLPTPLTEDMMKEGLSLLCKTGNGLAHAYVKLEVKERDLTDIYLLRSYIHLRYVDISENHLTDLSPLNYLTHLLWLKADGNRLRSAQMNELPYLQIASFAYNQITDTEGISHPRLETLNLKGNSIHMVTGLDPEKLISLHTVELRGNQLESTLGINLPKLKNLYLAQNMLKKVEGLEDLSNLTTLHLRDNQIDTLSGFSREMKSLQYLNLRRSKTLAFRPDQTPRGSHHMYDREQRMPVFAPKLEIHHNLRPRICSVPVLWAVWGAEWGA

SEQ ID NO: 891178 - protein, 261 aa, Homo sapiens
MILRKKRTRRRQRRGRTTEKRGKSSLRKDLTDIYLLRSYIHLRYVDISENHLTDLSPLNYLTHLLWLKADGNRLRSAQMNELPYLQIASFAYNQITDTEGISHPRLETLNLKGNSIHMVTGLDPEKLISLHTVELRGNQLESTLGINLPKLKNLYLAQNMLKKVEGLEDLSNLTTLHLRDNQIDTLSGFSREMKSLQYLNLRRSKTLAFRPDQTPRGSHHMYDREQRMPVFAPKLEIHHNLRPRICSVPVLWAVWGAEWGA

SEQ ID NO: 891179 - protein, 179 aa, Homo sapiens [sequence omitted]

SEQ ID NO: 891180 - protein, 159 aa, Homo sapiens
RLEDSLWMQVSDEWLPYLQIASFAYNQITDTEGISHPRLENPENHLTDLSPLNYLTHLLWLKADGNRLRSAQMNELPYLQIASFAYNQITDTEGISHPRLETLNLKGNSIHMVTGLDPEKLISLHTVELRGNQLESTLGINLPKLKNLYLEIKDAGLQT

SEQ ID NO: 891181 - protein, 292 aa, Homo sapiens [sequence omitted]

SEQ ID NO: 891182 - protein, 343 aa, Homo sapiens
MSDEDDLEDSEPDQDDSEKEEDEKETEEGEDYRKEGEEFPEEWLPTPLTEDMMKEGLSLLCKTGNGLAHAYVKLEVKERDLTDIYLLRSYIHLRYVDISENHLTDLSPLNYLTHLLWLKADGNRLRSAQMNELPYLQIASFAYNQITDTEGISHPRLETLNLKGNSIHMVTGLDPEKLISLHTVELRGNQLESTLGINLPKLKNLYLAQNMLKKVEGLEDLSNLTTLHLRDNQIDTLSGFSREMKSLQYLNLRGNMVANLGELAKLRDLPKLRALVLLDNPCTDETSYRQEALVQMPYLERLDKEFYEEEERAEADVIRQRLKEEKEQEPEPQRDLEPEQSLI

SEQ ID NO: 891183 - protein, 214 aa, Homo sapiens
MNELPYLQIASFAYNQITDTEGISHPRLETLNLKGNSIHMVTGLDPEKLISLHTVELRGNQLESTLGINLPKLKNLYLAQNMLKKVEGLEDLSNLTTLHLRDNQIDTLSGFSREMKSLQYLNLRGNMVANLGELAKLRDLPKLRALVLLDNPCTDETSYRQEALVQMPYLERLDKEFYEEEERAEADVIRQRLKEEKEQEPEPQRDLEPEQSLI

SEQ ID NO: 891184 - protein, 292 aa, Homo sapiens [sequence omitted]

SEQ ID NO: 891185 - protein, 286 aa, Homo sapiens
RLEDSLWMQVSDEWLPYLQIASFAYNQITDTEGISHPRLENPENHLTDLSPLNYLTHLLWLKADGNRLRSAQMNELPYLQIASFAYNQITDTEGISHPRLETLNLKGNSIHMVTGLDPEKLISLHTVELRGNQLESTLGINLPKLKNLYLAQNMLKKVEGLEDLSNLTTLHLRDNQIDTLSGFSREMKSLQYLNLRGNMVANLGELAKLRDLPKLRALVLLDNPCTDETSYRQEALVQMPYLERLDKEFYEEEERAEADVIRQRLKEEKEQEPEPQRDLEPEQSLI

SEQ ID NO: 891186 - protein, 220 aa, Homo sapiens [sequence omitted]

SEQ ID NO: 891187 - protein, 139 aa, Homo sapiens
MILRKKRTRRRQRRGRTTEKRGKSSLRKDLTDIYLLRSYIHLRYVDISENHLTDLSPLNYLTHLLWLKADGNRLRSAQMNELPYLQIASFAYNQITDTEGISHPRLETLNLKGGSLGWATQDSFLPSLRPTEVGSMVLG

SEQ ID NO: 891188 - protein, 343 aa, Homo sapiens; identical to SEQ ID NO: 891182

SEQ ID NO: 891189 - protein, 165 aa, Homo sapiens
MILRKKRTRRRQRRGRTTEKRGKSSLRKDLTDIYLLRSYIHLRYVDISENHLTDLSPLNYLTHLLWLKADGNRLRSAQMNELPYLQIASFAYNQITDTEGISHPRLETLNLKGNSIHMVTGLDPEKLISLHTVELRGNQLESTLGINLPKLKNLYLEIKDAGLQT

SEQ ID NO: 891190 - protein, 216 aa, Homo sapiens
MSDEDDLEDSEPDQDDSEKEEDEKETEEGEDYRKEGEEFPEEWLPTPLTEDMMKEGLSLLCKTGNGLAHAYVKLEVKERDLTDIYLLRSYIHLRYVDISENHLTDLSPLNYLTHLLWLKADGNRLRSAQMNELPYLQIASFAYNQITDTEGISHPRLETLNLKGNSIHMVTGLDPEKLISLHTVELRGNQLESTLGINLPKLKNLYLEIKDAGLQT

SEQ ID NO: 891191 - protein, 110 aa, Homo sapiens
KKSWGLSSGHPETMRPVIFLRYFFLQVRYLKSQRFEGGIKTFHFSWQRATRLLSRVLLCVSVRITAAVLLVCLLLCKPRMQKGVNKVIPISPEFKGLCLYKVCPYGARKI

SEQ ID NO: 891192 - protein, 202 aa, Homo sapiens
GELGLPGAPGIDGEKGPKGQKGDPGEPGPAGLKGEAGEMGLSGLPGADGLKGEKGESASDSLQESLAQLIVEPGPPGPPGPPGPMGLQGIQGPKGLDGAKGEKGASGERGPSGLPGPVGPPGLIGLPGTKGEKGRPGEPGLDGFPGPRGEKGDRSERGEKGERGVPGRKGVKGQKGEPGPPGLDQPCPVGPDGLPVPGCWHK

SEQ ID NO: 891193 - protein, 446 aa, Homo sapiens
MLLPQLCWLPLLAGLLPPVPAQKFSALTFLRVDQDKDKDCSLDCAGSPQKPLCASDGRTFLSRCEFQRAKCKDPQLEIAYRGNCKDVSRCVAERKYTQEQARKEFQQVFIPECNDDGTYSQVQCHSYTGYCWCVTPNGRPISGTAVAHKTPRCPGSVNEKLPQREGTGKTDDAAAPALETQPQGDEEDIASRYPTLWTEQVKSRQNKTNKNSVSSCDQEHQSALEEAKQPKNDNVVIPECAHGGLYKPVQCHPSTGYCWCVLVDTGRPIPGTSTRYEQPKCDNTARAHPAKARDLYKGRQLQGCPGAKKHEFLTSVLDALSTDMVHAASDPSSSSGRLSEPDPSHTLEERVVHWYFKLLDKNSSGDIGKKEIKPFKRFLRKKSKPKKCVKKFVEYCDVNNDKSISVQELMGCLGVAKEDGKADTKKRHTPRGHAESTSNRQPRKQG

SEQ ID NO: 891194 - protein, 434 aa, Homo sapiens
MLLPQLCWLPLLAGLLPPVPAQKFSALTFLRVDQDKDKDCSLDCAGSPQKPLCASDGRTFLSRCEFQRAKCKDPQLEIAYRGNCKDVSRCVAERKYTQEQARKEFQQVFIPECNDDGTYSQVQCHSYTGYCWCVTPNGRPISGTAVAHKTPRCPGSVNEKLPQREGTGKTDDAAAPALETQPQGDEEDIASRYPTLWTEQVKSRQNKTNKNSVSSCDQEHQSALEEAKQPKNDNVVIPECAHGGLYKPVQCHPSTGYCWCVLVDTGRPIPGTSTRYEQPKCDNTARAHPAKARDLYKGRQLQGCPGAKKHEFLTSVLDALSTDMVHAASDPSSSSGRLSEPDPSHTLEERVVHWYFKLLDKNSSGDIGKKEIKPFKRFLRKKSKPKKCVKKFVEYCDVNNDKSISVQELMGCLGVAKEDGKADTKKRHRSKRNL

SEQ ID NO: 891195 - protein, 170 aa, Homo sapiens
GVHTHNIVGRTESDSGQSCCWATADKGCPGAKKHEFLTSVLDALSTDMVHAASDPSSSSGRLSEPDPSHTLEERVVHWYFKLLDKNSSGDIGKKEIKPFKRFLRKKSKPKKCVKKFVEYCDVNNDKSISVQELMGCLGVAKEDGKADTKKRHTPRGHAESTSNRQPRKQG

SEQ ID NO: 891196 - protein, 446 aa, Homo sapiens; identical to SEQ ID NO: 891193

SEQ ID NO: 891197 - protein, 457 aa, Homo sapiens
MLLPQLCWLPLLAGLLPPVPAQKFSALTFLRVDQDKDKDCSLDCAGSPQKPLCASDGRTFLSRCEFQRAKCKDPQLEIAYRGNCKDVSRCVAERKYTQEQARKEFQQVFIPECNDDGTYSQVQCHSYTGYCWCVTPNGRPISGTAVAHKTPRCPGSVNEKLPQREGTGKTVSLQIFSVLNSDDAAAPALETQPQGDEEDIASRYPTLWTEQVKSRQNKTNKNSVSSCDQEHQSALEEAKQPKNDNVVIPECAHGGLYKPVQCHPSTGYCWCVLVDTGRPIPGTSTRYEQPKCDNTARAHPAKARDLYKGRQLQGCPGAKKHEFLTSVLDALSTDMVHAASDPSSSSGRLSEPDPSHTLEERVVHWYFKLLDKNSSGDIGKKEIKPFKRFLRKKSKPKKCVKKFVEYCDVNNDKSISVQELMGCLGVAKEDGKADTKKRHTPRGHAESTSNRQPRKQG

SEQ ID NO: 891198 - protein, 446 aa, Homo sapiens; identical to SEQ ID NO: 891193

SEQ ID NO: 891199 - protein, 592 aa, Homo sapiens
MASEIHMTGPMCLIENTNGRLMANPEALKILSAITQPMVVVAIVGLYRTGKSYLMNKLAGKKKGFSLGSTVQSHTKGIWMWCVPHPKKPGHILVLLDTEGLGDVEKGDNQNDSWIFALAVLLSSTFVYNSIGTINQQAMDQLYYVTELTHRIRSKSSPDENENEVEDSADFVSFFPDFVWTLRDFSLDLEADGQPLTPDEYLTYSLKLKKGTSQKDETFNLPRLCIRKFFPKKKCFVFDRPVHRRKLAQLEKLQDEELDPEFVQQVADFCSYIFSNSKTKTLSGGIQVNGPRLESLVLTYVNAISSGDLPCMENAVLALAQIENSAAVQKAIAHYEQQMGQKVQLPTESLQELLDLHRDSEREAIEVFIRSSFKDVDHLFQKELAAQLEKKRDDFCKQNQEASSDRCSGLLQVIFSPLEEEVKAGIYSKPGGYRLFVQKLQDLKKKYYEEPRKGIQAEEILQTYLKSKESMTDAILQTDQTLTEKEKEIEVERVKAESAQASAKMLQEMQRKNEQMMEQKERSYQEHLKQLTEKMENDRVQLLKEQERTLALKLQEQEQLLKEGFQKESRIMKNEIQDLQTKMRRRKACTIS

SEQ ID NO: 891200 - protein, 592 aa, Homo sapiens; identical to SEQ ID NO: 891199

SEQ ID NO: 891201 - protein, 453 aa, Homo sapiens
MLLSYVTELTHRIRSKSSPDENENEVEDSADFVSFFPDFVWTLRDFSLDLEADGQPLTPDEYLTYSLKLKKGTSQKDETFNLPRLCIRKFFPKKKCFVFDRPVHRRKLAQLEKLQDEELDPEFVQQVADFCSYIFSNSKTKTLSGGIQVNGPRLESLVLTYVNAISSGDLPCMENAVLALAQIENSAAVQKAIAHYEQQMGQKVQLPTESLQELLDLHRDSEREAIEVFIRSSFKDVDHLFQKELAAQLEKKRDDFCKQNQEASSDRCSGLLQVIFSPLEEEVKAGIYSKPGGYRLFVQKLQDLKKKYYEEPRKGIQAEEILQTYLKSKESMTDAILQTDQTLTEKEKEIEVERVKAESAQASAKMLQEMQRKNEQMMEQKERSYQEHLKQLTEKMENDRVQLLKEQERTLALKLQEQEQLLKEGFQKESRIMKNEIQDLQTKMRRRKACTIS

SEQ ID NO: 891202 - protein, 256 aa, Homo sapiens
MASEIHMTGPMCLIENTNGRLMANPEALKILSAITQPMVVVAIVGLYRTGKSYLMNKLAGKKKGFSLGSTVQSHTKGIWMWCVPHPKKPGHILVLLDTEGLGDVEKGDNQNDSWIFALAVLLSSTFVYNSIGTINQQAMDQLYYVTELTHRIRSKSSPDENENEVEDSADFVSFFPDFVWTLRDFSLDLEADGQPLTPDEYLTYSLKLKKGNRELQLINEDEKTQEIIIFQFTIASFPAFAVFYVFSWLFLEINTC

SEQ ID NO: 891203 - protein, 493 aa, Homo sapiens
MASEIHMTGPMCLIENTNGRLMANPEALKILSAITQPMVVVAIVGLYRTGKSYLMNKLAGKKKGFSLGSTVQSHTKGIWMWCVPHPKKPGHILVLLDTEGLGDVEKGDNQNDSWIFALAVLLSSTFVYNSIGTINQQAMDQLYYVTELTHRIRSKSSPDENENEVEDSADFVSFFPDFVWTLRDFSLDLEADGQPLTPDEYLTYSLKLKKGTSQKDETFNLPRLCIRKFFPKKKCFVFDRPVHRRKLAQLEKLQDEELDPEFVQQVADFCSYIFSNSKTKTLSGGIQVNGPRLESLVLTYVNAISSGDLPCMENAVLALAQIENSAAVQKAIAHYEQQMGQKVQLPTESLQELLDLHRDSEREAIEVFIRSSFKDVDHLFQKELAAQLEKKRDDFCKQNQEASSDRCSGLLQVIFSPLEEEVKAGIYSKPGGYRLFVQKLQDLKKKYYEEPRKGIQAEEILQTYLKSKESMTDAILQTDQTLTEKEKEIEGEE

SEQ ID NO: 891204 - protein, 161 aa, Homo sapiens [sequence omitted]

SEQ ID NO: 891205 - protein, 397 aa, Homo sapiens
MASEIHMTGPMCLIENTNGRLMANPEALKILSAITQPMVVVAIVGLYRTGKSYLMNKLAGKKKGFSLGSTVQSHTKGIWMWCVPHPKKPGHILVLLDTEGLGDVEKGDNQNDSWIFALAVLLSSTFVYNSIGTINQQAMDQLYYVTELTHRIRSKSSPDENENEVEDSADFVSFFPDFVWTLRDFSLDLEADGQPLTPDEYLTYSLKLKKGTSQKDETFNLPRLCIRKFFPKKKCFVFDRPVHRRKLAQLEKLQDEELDPEFVQQVADFCSYIFSNSKTKTLSGGIQVNGPRLESLVLTYVNAISSGDLPCMENAVLALAQIENSAAVQKAIAHYEQQMGQKVQLPTESLQELLDLHRDSEREAIEVFIRSSFKDVDHLFQKELAVIFVSNVYGLGS

SEQ ID NO: 891206 - protein, 592 aa, Homo sapiens; identical to SEQ ID NO: 891199

SEQ ID NO: 891207 - protein, 256 aa, Homo sapiens; identical to SEQ ID NO: 891202

SEQ ID NO: 891208 - protein, 453 aa, Homo sapiens; identical to SEQ ID NO: 891201

SEQ ID NO: 891209 - protein, 511 aa, Homo sapiens
MASEIHMTGPMCLIENTNGRLMANPEALKILSAITQPMVVVAIVGLYRTGKSYLMNKLAGKKKGFSLGSTVQSHTKGIWMWCVPHPKKPGHILVLLDTEGLGDVEKGDNQNDSWIFALAVLLSSTFVYNSIGTINQQAMDQLYYVTELTHRIRSKSSPDENENEVEDSADFVSFFPDFVWTLRDFSLDLEADGQPLTPDEYLTYSLKLKKGTSQKDETFNLPRLCIRKFFPKKKCFVFDRPVHRRKLAQLEKLQDEELDPEFVQQVADFCSYIFSNSKTKTLSGGIQVNGPRLESLVLTYVNAISSGDLPCMENAVLALAQIENSAAVQKAIAHYEQQMGQKVQLPTESLQELLDLHRDSEREAIEVFIRSSFKDVDHLFQKELAAQLEKKRDDFCKQNQEASSDRCSGLLQVIFSPLEEEVKAGIYSKPGGYRLFVQKLQDLKKKYYEEPRKGIQAEEILQTYLKSKESMTDAILQTDQTLTEKEKEIEVERVKAESAQASAKIGVIRNT

SEQ ID NO: 891210 - protein, 96 aa, Homo sapiens
IPDLQLAGELQEMQRKNEQMMEQKERSYQEHLKQLTEKMENDRVQLLKEQERTLALKLQEQEQLLKEGFQKESRIMKNEIQDLQTKMRRRKACTIS

SEQ ID NO: 891211 - protein, 200 aa, Homo sapiens
MASEIHMTGPMCLIENTNGRLMANPEALKILSAITQPMVVVAIVGLYRTGKSYLMNKLAGKKKGFSLGSTVQSHTKGIWMWCVPHPKKPGHILVLLDTEGLGDVEKGDNQNDSWIFALAVLLSSTFVYNSIGTINQQAMDQLYYVTELTHRIRSKSSPDENENEVEDSADFVSFFPDFVWTLRDFSITESAFEQYCNKIN

SEQ ID NO: 891212 - protein, 570 aa, Homo sapiens
LTLCGCRRRGIWVRTGAAMGKVNVAKLRYMSRDDFRVLTAVEMGMKNHEIVPGSLIASIASLKHGGCNKVLRELVKHKLIAWERTKTVQGYRLTNAGYDYLALKTLSSRQVVESVGNQMGVGKESDIYIVANEEGQQFALKLHRLGRTSFRNLKNKRDYHKHRHNVSWLYLSRLSAMKEFAYMKALYERKFPVPKPIDYNRHAVVMELINGYPLCQIHHVEDPASVYDEAMELIVKLANHGLIHGDFNEFNLILDESDHITMIDFPQMVSTSHPNAEWYFDRDVKCIKDFFMKRFSYESELFPTFKDIRREDTLDVEVSASGYTKEMQADDELLHPLGPDDKNIETKEGSEFSFSDGEVAEKAEVYRSENESERNCLEESEGCYCRSSGDPEQIKEDSLSEESADARSFEMTEFNQALEEIKGQVVENNSVTEFSEEKNRTENYNRQDGQRVQGGVPAGSDEYEDECPHLIALSSLNREFRPFRDEENVGAMNQYRTRTLSITSSGSAVSCSTIPPELVKQKVKRQLTKQQKSAVRRRLQKGEANIFTKQRRENMQNIKSSLEAASFWGE

SEQ ID NO: 891213 - protein, 121 aa, Homo sapiens
LTLCGCRRRGIWVRTGAAMGKVNVAKLRYMSRDDFRVLTAVEMGMKNHEIVPGSLIASIASLKHGGCNKVLRELVKHKLIAWERTKSKYFEAPFVIFQVIGFHQSKCSKSQEVEVARLVKH

SEQ ID NO: 891214 - protein, 312 aa, Homo sapiens
IRFDASPPQIVSTSHPNAEWYFDRDVKCIKDFFMKRFSYESELFPTFKDIRREDTLDVEVSASGYTKEMQADDELLHPLGPDDKNIETKEGSEFSFSDGEVAEKAEVYRSENESERNCLEESEGCYCRSSGDPEQIKEDSLSEESADARSFEMTEFNQALEEIKGQVVENNSVTEFSEEKNRTENYNRQDGQRVQGGVPAGSDEYEDECPHLIALSSLNREFRPFRDEENVGAMNQYRTRTLSITSSGSAVSCSTIPPELVKQKVKRQLTKQQKSAVRRRLQKGEANIFTKQRRENMQNIKSSLEAASFWGE

SEQ ID NO: 891215 - protein, 570 aa, Homo sapiens; identical to SEQ ID NO: 891212

SEQ ID NO: 891216 - protein, 335 aa, Homo sapiens
LVRSGVLGQCQGRGLTQGSCSSGGRPEPCTRPTTVQPLTGHPILRGSALAPTEAGDLTDSEPGWMLQACKMEGFPLVPPQPSEDLVPYDTDLYQRQTHEYYPYLSSDGESHSDHYWDFHPHHVHSEFESFAENNFTELQSVQPPQLQQLYRHMELEQMHVLDTPMVPPHPSLGHQVSYLPRMCLQYPSLSPAQPSSDEEEGERQSPPLEVSDGEADGLEPGPGLLPGETGSKKKIRLYQFLLDLLRSGDMKDSIWWVDKDKGTFQFSSKHKEALAHRWGIQKGNRKKMTYQKMARALRNYGKTGEVKKVKKKLTYQFSGEVLGRGGLAERRHPPH

SEQ ID NO: 891217 - protein, 335 aa, Homo sapiens
NQELVLALQCQGRGLTQGSCSSGGRPEPCTRPTTVQPLTGHPILRGSALAPTEAGDLTDSEPGWMLQACKMEGFPLVPPQPSEDLVPYDTDLYQRQTHEYYPYLSSDGESHSDHYWDFHPHHVHSEFESFAENNFTELQSVQPPQLQQLYRHMELEQMHVLDTPMVPPHPSLGHQVSYLPRMCLQYPSLSPAQPSSDEEEGERQSPPLEVSDGEADGLEPGPGLLPGETGSKKKIRLYQFLLDLLRSGDMKDSIWWVDKDKGTFQFSSKHKEALAHRWGIQKGNRKKMTYQKMARALRNYGKTGEVKKVKKKLTYQFSGEVLGRGGLAERRHPPH

SEQ ID NO: 891218 - protein, 354 aa, Homo sapiens
MEPHSSTMHLLTSCPDHGRHSIKTEGTHQRSLGQKNNNNNNNNKTKMPLLIPPPPRKDQELSEATWMELEDIIICETTQKQKVKYCLFSWGSWKPKLKQPSEDLVPYDTDLYQRQTHEYYPYLSSDGESHSDHYWDFHPHHVHSEFESFAENNFTELQSVQPPQLQQLYRHMELEQMHVLDTPMVPPHPSLGHQVSYLPRMCLQYPSLSPAQPSSDEEEGERQSPPLEVSDGEADGLEPGPGLLPGETGSKKKIRLYQFLLDLLRSGDMKDSIWWVDKDKGTFQFSSKHKEALAHRWGIQKGNRKKMTYQKMARALRNYGKTGEVKKVKKKLTYQFSGEVLGRGGLAERRHPPH

SEQ ID NO: 891219 - protein, 310 aa, Homo sapiens
NQELVLALQCQGRGLTQGSCSSGGRPEPCTRPTTVQPLTGHPILRGSALAPTEAGDLTDSEPGWMLQACKMEGFPLVPPQPSEDLVPYDTDLYQRQTHEYYPYLSSDGESHSDHYWDFHPHHVHSEFESFAENNFTELQSVQPPQLQQLYRHMELEQMHVLDTPMVPPHPSLGHQVSYLPRMCLQYPSLSPAQPSSDEEEGERQSPPLEVSDGEADGLEPGPGLLPGETGGAPGPPPWPRPWPCLCPDPTQPGQLTQQPRHRVACVCVCMFASVCVLWGCLWLSLCVCICCVVHTGISMKCARCVCLSVP

SEQ ID NO: 891220 - protein, 213 aa, Homo sapiens
NQELVLALQCQGRGLTQGSCSSGGRPEPCTRPTTVQPLTGHPILRGSALAPTEAGDLTDSEPGWMLQACKMEGFPLVPPQPSEDLVPYDTDLYQRQTHEYYPYLSSDGESHSDHYWDFHPHHVHSEFESFAENNFTELQSVQPPQLQQLYRHMELEQMHVLDTPMVPPHPSLGHQVSYLPRMCLQYPSLSPAQPSLYKMPCSRGVVERILYLE

SEQ ID NO: 891221 - protein, 335 aa, Homo sapiens; identical to SEQ ID NO: 891217

SEQ ID NO: 891222 - protein, 390 aa, Homo sapiens
TELQSVQPPQLQQLYRHMELEQMHVLDTPMVPPHPSLGHQVSYLPRMCLQYPSLSSSELGWLGQCQGRGLTQGSCSSGGRPEPCTRPTTVQPLTGHPILRGSALAPTEAGDLTDSEPGWMLQACKMEGFPLVPPQPSEDLVPYDTDLYQRQTHEYYPYLSSDGESHSDHYWDFHPHHVHSEFESFAENNFTELQSVQPPQLQQLYRHMELEQMHVLDTPMVPPHPSLGHQVSYLPRMCLQYPSLSPAQPSSDEEEGERQSPPLEVSDGEADGLEPGPGLLPGETGSKKKIRLYQFLLDLLRSGDMKDSIWWVDKDKGTFQFSSKHKEALAHRWGIQKGNRKKMTYQKMARALRNYGKTGEVKKVKKKLTYQFSGEVLGRGGLAERRHPPH

SEQ ID NO: 891223 - protein, 175 aa, Homo sapiens
MLQACKMEGFPLVPPVSYLPRMCLQYPSLSPAQPSSDEEEGERQSPPLEVSDGEADGLEPGPGLLPGETGSKKKIRLYQFLLDLLRSGDMKDSIWWVDKDKGTFQFSSKHKEALAHRWGIQKGNRKKMTYQKMARALRNYGKTGEVKKVKKKLTYQFSGEVLGRGGLAERRHPPH

SEQ ID NO: 891224 - protein, 224 aa, Homo sapiens
NQELVLALQCQGRGLTQGSCSSGGRPEPCTRPTTVQPLTGHPILRGSALAPTEAGDLTDSEPGWMLQACKMEGFPLVPPQPSEDLVPYDTDLYQRQTHEYYPYLSSDGESHSDHYWDFHPHHVHSEFESFAENNFTELQSVQPPQLQQLYRHMELEQMHVLDTPMVPPHPSLGHQVSYLPRMCLQYPSLSPAQPRRTRAPSSSRPSTRRRWRTAGASRRATARR

SEQ ID NO: 891225 - protein, 137 aa, Homo sapiens
LVRSGVLGQCQGRGLTQGSCSSGGRPEPCTRPTTVQPLTGHPILRGSALAPTEAGDLTDSEPGWMLQACKMEGFPLVPPQPSEDLVPYDTDLYQRQTHEYYPYLSSDGESHSGEYGACHAPIPQPSLGSWGLEREKE

SEQ ID NO: 891226 - protein, 234 aa, Homo sapiens
MPSGCHSSPPSGLRGDMASLVPLSPYLSPTVLLLVSCDLGFVRADRPPSPVNVTVTHLRANSATVSWDVPEGNIVIGYSISQQRQNGPGQRVIREVNTTTRACALWGLAEDSDYTVQVRSIGLRGESPPGPRVHFRTLKGSDRLPSNSSSPGDITVEGLDGERPLQTGEVVIIVVVLLMWAAVIGLFCRQYDIIKDNDSNNNPKEKGKGPEQSPQGRPVGTRQKKSPSINTIDV

SEQ ID NO: 891227 - protein, 234 aa, Homo sapiens; identical to SEQ ID NO: 891226

SEQ ID NO: 891228 - protein, 306 aa, Homo sapiens
MPSGCHSSPPSGLRGDMASLVPLSPYLSPTVLLLVSCDLGFVRADRPPSPVNVTVTHLRANSATVSWDVPEGNIVIGYSISQQVMNHPSAPPTCVLGFRHISSLKWGGSGSWRILAQAALFTLLPRSAWMLKSLWLSLVAWHWGEAVLLSLISLQRQNGPGQRVIREVNTTTRACALWGLAEDSDYTVQVRSIGLRGESPPGPRVHFRTLKGSDRLPSNSSSPGDITVEGLDGERPLQTGEVVIIVVVLLMWAAVIGLFCRQYDIIKDNDSNNNPKEKGKGPEQSPQGRPVGTRQKKSPSINTIDV

SEQ ID NO: 891229 - protein, 234 aa, Homo sapiens; identical to SEQ ID NO: 891226

SEQ ID NO: 891230 - protein, 158 aa, Homo sapiens
ARASRPGCGGASGASAAEGGGWLSGTVTSRCRGGRRPPHCLPHRGPRPASGQRPLLPDRLRGPLEPWGLRRPAPAPPAARPRAARVAGPAPGWGRGSATESGDGPPSGHRAAPRGLTNREDRRRSPAWMSSGCQADATVPPPADSVGTWLRWCPFPHI

SEQ ID NO: 891231 - protein, 181 aa, Homo sapiens
MPSGCHSSPPSGLRGDMASLVPLSPYLSPTVLLLVSCDLGFVRADRPPSPVNVTVTHLRANSATVSWDVPEGNIVIGYSISQQRQNGPGQRVIREVNTTTRACALWGLAEDSDYTVQVRSIGLRGESPPGPRVHFRTLKGSDRLPSNSSSPGDITVEGLDGERPNLRPGTHPLSTVSRARR

SEQ ID NO: 891232 - protein, 234 aa, Homo sapiens; identical to SEQ ID NO: 891226

SEQ ID NO: 891233 - protein, 105 aa, Homo sapiens
PTPLGPKWGPHFTCIRTLSIPSCPTSCLWPSERGVSVGTPLTPANKRNCLTLEADAALHYSNVFHGASGAPPLTWQPLQLLVISLVGHFSNKGSWTNCLGQTGAD

SEQ ID NO: 891234 - protein, 347 aa, Homo sapiens
ARASRPGCGGASGASAAEGGGWLSGTVTSRCRGGRRPPHCLPHRGPRPASGQRPLLPDRLRGPLEPWGLRRPAPAPPARHRVGRWAALWAPSSPPRPDQPRGPAEEPRLDVKRMPSGCHSSPPSGLRGDMASLVPLSPYLSPTVLLLVSCDLGFVRADRPPSPVNVTVTHLRANSATVSWDVPEGNIVIGYSISQQRQNGPGQRVIREVNTTTRACALWGLAEDSDYTVQVRSIGLRGESPPGPRVHFRTLKGSDRLPSNSSSPGDITVEGLDGERPLQTGEVVIIVVVLLMWAAVIGLFCRQYDIIKDNDSNNNPKEKGKGPEQSPQGRPVGTRQKKSPSINTIDV

SEQ ID NO: 891235 - protein, 141 aa, Homo sapiens
MPSGCHSSPPSGLRGDMASLVPLSPYLSPTVLLLVSCDLGFVRADRPPSPVNVTVTHLRANSATVSWLKTVTTQCRSGASAFGERVPQGPGCTSELSRVLTGYLQTVQAQVTSQWKVWMESGHCRLGKWSSLWWCCSCGLL

SEQ ID NO: 891236 - protein, 158 aa, Homo sapiens; identical to SEQ ID NO: 891230

SEQ ID NO: 891237 - protein, 234 aa, Homo sapiens; identical to SEQ ID NO: 891226

SEQ ID NO: 891238 - protein, 269 aa, Homo sapiens
MPSGCHSSPPSGLRGDMASLVPLSPYLSPTVLLLVSCDLGFVRADRPPSPVNVTVTHLRANSATVSWDVPEGNIVIGYSISQQRQNGPGQRVIREVNTTTRACALWGLAEDSDYTVQVRSIGLRGESPPGPRVHFRTLKGSDRLPSNSSSPGDITVEGLDGERPLQTGEVVIIVVVLLMWAAVIGLFCRQYDIIKDNDSNNNPKEKGKGPEQSPQGRPVGTRQVMWGPVRAERVILPLRGSQGKEEGQRGAEKDGEWKIWDGGSLANTV

SEQ ID NO: 891239 - protein, 221 aa, Homo sapiens
MSMYVLGMAEEFKGEIAVNALWPKTAIHTAAMDMLGGPGIESQCRKVDIIADAAYSIFQKPKSFTGNFVIDENILKEEGIENFDVYAIKPAVFPMKEENPYQHNLKKKMNEKRGHPLQPDFFLDEYPEAVSKKVESTGRLSINPSRIGAMAKFWANITTCAGNELRQSNWAATQQLTKLVRSLKTLKGLEFFLGSLNLGSEQFGTGQTVALGAAKAGIYGK

SEQ ID NO: 891240 - protein, 418 aa, Homo sapiens
MLPNTGRLAGCTVFITGASRGIGKAIALKAAKDGANIVIAAKTAQPHPKLLGTIYTAAEEIEAVGGKALPCIVDVRDEQQISAAVEKAIKKFGGIDILVNNASAISLTNTLDTPTKRLDLMMNVNTRGTYLASKACIPYLKKSKVAHILNISPPLNLNPVWFKQHCAYTIAKYGMSMYVLGMAEEFKGEIAVNALWPKTAIHTAAMDMLGGPGIESQCRKVDIIADAAYSIFQKPKSFTGNFVIDENILKEEGIENFDVYAIKPGHPLQPDFFLDEYPEAVSKKVESTGAVPEFKEEKLQLQPKPRSGAVEETFRIVKDSLSDDVVKATQAIYLFELSGEDGGTWFLDLKSKGGNVGYGEPSDQADVVMSMTTDDFVKMFSGKLKPTMAFMSGKLKIKGNMALAIKLEKLMNQMNARL

SEQ ID NO: 891241 - protein, 418 aa, Homo sapiens; identical to SEQ ID NO: 891240

SEQ ID NO: 891242 - protein, 418 aa, Homo sapiens; identical to SEQ ID NO: 891240

SEQ ID NO: 891243 - protein, 418 aa, Homo sapiens; identical to SEQ ID NO: 891240

SEQ ID NO: 891244 - protein, 418 aa, Homo sapiens; identical to SEQ ID NO: 891240

SEQ ID NO: 891245 - protein, 82 aa, Homo sapiens
GALGDPGFSARSSRTGIGGGRGGAGAGINAEGRSSFSSLLAAAAVAATSSDLRKSCYPTPGGWQDVQFLSQVQAVALAKLLH

SEQ ID NO: 891246 - protein, 345 aa, Homo sapiens
MLPNTGRLAGCTVFITGASRGIGKAIALKAAKDGANIVIAAKTAQPHPKLLGTIYTAAEEIEAVGGKALPCIVDVRDEQQISAAVEKAIKKFGAYTIAKYGMSMYVLGMAEEFKGEIAVNALWPKTAIHTAAMDMLGGPGIESQCRKVDIIADAAYSIFQKPKSFTGNFVIDENILKEEGIENFDVYAIKPGHPLQPDFFLDEYPEAVSKKVESTGAVPEFKEEKLQLQPKPRSGAVEETFRIVKDSLSDDVVKATQAIYLFELSGEDGGTWFLDLKSKGGNVGYGEPSDQADVVMSMTTDDFVKMFSGKLKPTMAFMSGKLKIKGNMALAIKLEKLMNQMNARL

SEQ ID NO: 891247 - protein, 418 aa, Homo sapiens; identical to SEQ ID NO: 891240

SEQ ID NO: 891248 - protein, 418 aa, Homo sapiens; identical to SEQ ID NO: 891240

SEQ ID NO: 891249 - protein, 418 aa, Homo sapiens; identical to SEQ ID NO: 891240

SEQ ID NO: 891250 - protein, 418 aa, Homo sapiens; identical to SEQ ID NO: 891240

SEQ ID NO: 891251 - protein, 169 aa, Homo sapiens
MLPNTGRLAGCTVFITGASRGIGKAIALKAAKDGANIVIAAKTAQPHPKLLGTIYTAAEEIEAVGGKALPCIVDVRDEQQISAAVEKAIKKFGGIDILVNNASAISLTNTLDTPTKRLDLMMNVNTRGTYLASKACIPYLKKSKVAHILNISPPLNLNPVWFKQHCGRW

SEQ ID NO: 891252 - protein, 173 aa, Homo sapiens
MVFLAPHLMLRAHCEPLVPLLDSVLPSLPQTFPSSNESRQCPNARCQFAFYGGESGYHRALLGLQIFNAFMFFWLANFVLALGQVTLYGPGSGELPGSVFCWRGQDNKSWLGPLAGDTGERYRERETAQSRGPGVQGSGKHIQKDTGRIGRSAEKEGAAGNREEQDPVHVVAR

SEQ ID NO: 891253 - protein, 74 aa, Homo sapiens
TPAPRVLIRVAVLDKVTDFLFLLGKLLIVGSVGECRPPSLSGCGSLISVFCDECHLLRRLFPISRTLRHLAFFS

SEQ ID NO: 891254 - protein, 706 aa, Homo sapiens [sequence omitted]

SEQ ID NO: 891255 - protein, 703 aa, Homo sapiens
MKREKNGAYGTPQKYDPTFKGPIYNRGCTDIICCVFLLLAIVGYVAVGIIAWTHGDPRKVIYPTDSRGEFCGQKGTKNENKPYLFYFNIVKCASPLVLLEFQCPTPQICVEKCPDRYLTYLNARSSRDFEYYKQFCVPGFKNNKGVAEVLRDGDCPAVLIPSKPLARRCFPAIHAYKGVLMVGNETTYEDGHGSRKNITDLVEGAKKANGVLEARQLAMRIFEDYTVSWYWIIIGLVIAMAMSLLFIILLRFLAGIMVWVMIIMVILVLGYGIFHCYMEYSRLRGEAGSDVSLVDLGFQTDFRVYLHLRQTWLAFMIILSILEVIIILLLIFLRKRILIAIALIKEASRAVGYVMCSLLYPLVTFFLLCLCIAYWASTAVFLSTSNEAVYKIFDDSPCPFTAKTCNPETFPSSNESRQCPNARCQFAFYGGESGYHRALLGLQIFNAFMFFWLANFVLALGQVTLAGAFASYYWALRKPDDLPAFPLFSAFGRALRYHTGSLAFGALILAIVQIIRVILEYLDQRLKAAENKFAKCLMTCLKCCFWCLEKFIKFLNRNAYIMIAIYGTNFCTSARNAFFLLMRNIIRVAVLDKVTDFLFLLGKLLIVGSVGILAFFFFTHRIRIVQDTAPPLNYYWVPILTVIVGSYLIAHGFFSVYGMCVDTLFLCFLEDLERNDGSAERPYFMSSTLKKLLNKTNKKAAES

SEQ ID NO: 891256 - protein, 733 aa, Homo sapiens
MEDERKNGAYGTPQKYDPTFKGPIYNRGCTDIICCVFLLLAIVGYVAVGIIAWTHGDPRKVIYPTDSRGEFCGQKGTKNENKPYLFYFNIVKCASPLVLLEFQCPTPQICVEKCPDRYLTYLNARSSRDFEYYKQFCVPGFKNNKGVAEVLRDGDCPAVLIPSKPLARRCFPAIHAYKGVLMVGNETTYEDGHGSRKNITDLVEGAKKANGVLEARQLAMRIFEDYTVSWYWIIIGLVIAMAMSLLFIILLRFLAGIMVWVMIIMVILVLGYGIFHCYMEYSRLRGEAGSDVSLVDLGFQTDFRVYLHLRQTWLAFSESQSPIPAPNMRPWREWGAQPAQPLPFAVIILSILEVIIILLLIFLRKRILIAIALIKEASRAVGYVMCSLLYPLVTFFLLCLCIAYWASTAVFLSTSNEAVYKIFDDSPCPFTAKTCNPETFPSSNESRQCPNARCQFAFYGGESGYHRALLGLQIFNAFMFFWLANFVLALGQVTLAGAFASYYWALRKPDDLPAFPLFSAFGRALRYHTGSLAFGALILAIVQIIRVILEYLDQRLKAAENKFAKCLMTCLKCCFWCLEKFIKFLNRNAYIMIAIYGTNFCTSARNAFFLLMRNIIRVAVLDKVTDFLFLLGKLLIVGSVGILAFFFFTHRIRIVQDTAPPLNYYWVPILTVIVGSYLIAHGFFSVYGMCVDTLFLCFLEDLERNDGSAERPYFMSSTLKKLLNKTNKKAAES

SEQ ID NO: 891257 - protein, 706 aa, Homo sapiens [sequence omitted]

SEQ ID NO: 891258 - protein, 706 aa, Homo sapiens [sequence omitted]

SEQ ID NO: 891259 - protein, 518 aa, Homo sapiens
MEDERKNGAYGTPQKYDPTFKGPIYNRGCTDIICCVFLLLAIVGYVAVGIIAWTHGDPRKVIYPTDSRGEFCGQKGTKNENKPYLFYFNIVKCASPLVLLEFQCPTPQICVEKCPDRYLTYLNARSSRDFEYYKQFCVPGFKNNKGVAEVLRDGDCPAVLIPSKPLARRCFPAIHAYKGVLMVGNETTYEDGHGSRKNITDLVEGAKKANGVLEARQLAMRIFEDYTVSWYWIIIGLVIAMAMSLLFIILLRFLAGIMVWVMIIMVILVLGYGIFHCYMEYSRLRGEAGSDVSLVDLGFQTDFRVYLHLRQTWLAFMIILSILEVIIILLLIFLRKRILIAIALIKEASRAVGYVMCSLLYPLEKFIKFLNRNAYIMIAIYGTNFCTSARNAFFLLMRNIIRVAVLDKVTDFLFLLGKLLIVGSVGILAFFFFTHRIRIVQDTAPPLNYYWVPILTVIVGSYLIAHGFFSVYGMCVDTLFLCFLEDLERNDGSAERPYFMSSTLKKLLNKTNKKAAES

SEQ ID NO: 891260 - protein, 738 aa, Homo sapiens
GRGVQPAEPPARPGWGRAGSDSAPRPAAAMEDERKNGAYGTPQKYDPTFKGPIYNRGCTDIICCVFLLLAIVGYVAVGIIAWTHGDPRKVIYPTDSRGEFCGQKGTKNENKPYLFYFNIVKCASPLVLLEFQCPTPQICVEKCPDRYLTYLNARSSRDFEYYKQFCVPGFKNNKGVAEVLRDGDCPAVLIPSKPLARRCFPAIHAYKGVLMVGNETTYEDGHGSRKNITDLVEGAKKANGVLEARQLAMRIFEDYTVSWYWIIIGLVIAMAMSLLFIILLRFLAGIMVWVMIIMVILVLGYGIFHCYMEYSRLRGEAGSDVSLVDLGFQTDFRVYLHLRQTWLAFMIILSILEVIIILLLIFLRKRILIAIALIKEASRAVGYVMCSLLYPLVTFFLLCLCIAYWASTAVFLSTSNEAVYKIFDDSPCPFTAKTCNPETFPSSNESRQCPNARCQFAFYGGESGYHRALLGLQIFNAFMFFWLANFVLALGQVTLAGAFASYYWALRKPDDLPAFPLFSAFGRALRYHTGSLAFGALILAIVQIIRVILEYLDQRLKAAENKFAKCLMTCLKCCFWCLEKFIKFLNRNAYIMIAIYGTNFCTSARNAFFLLMRNIIRVAVLDKVTDFLFLLGKLLIVGSVGILAFFFFTHRIRIVQDTAPPLNYYWVPILTVIVGSYLIAHGFFSVYGMCVDTLFLCFCEDLERNDGSQERPYFMSPELRDILLKGSAEEGKRAEAEE

SEQ ID NO: 891261 - protein, 738 aa, Homo sapiens; identical to SEQ ID NO: 891260

SEQ ID NO: 891262 - protein, 180 aa, Homo sapiens
FETGHEALGTRSCLMTCLQAPEAALEKFIKFLNRNAYIMIAIYGTNFCTSARNAFFLLMRNIIRVAVLDKVTDFLFLLGKLLIVGSVGILAFFFFTHRIRIVQDTAPPLNYYWVPILTVIVGSYLIAHGFFSVYGMCVDTLFLCFLEDLERNDGSAERPYFMSSTLKKLLNKTNKKAAES

SEQ ID NO: 891263 - protein, 706 aa, Homo sapiens [sequence omitted]

SEQ ID NO: 891264 - protein, 706 aa, Homo sapiens [sequence omitted]

SEQ ID NO: 891265 - protein, 706 aa, Homo sapiens [sequence omitted]

SEQ ID NO: 891266 - protein, 706 aa, Homo sapiens [sequence omitted]

SEQ ID NO: 891267 - protein, 706 aa, Homo sapiens [sequence omitted]

SEQ ID NO: 891268 - protein, 706 aa, Homo sapiens [sequence omitted]

SEQ ID NO: 891269 - protein, 706 aa, Homo sapiens [sequence omitted]

SEQ ID NO: 891270 - protein, 653 aa, Homo sapiens
MEDERKNGAYGTPQKYDPTFKGPIYNRGCTDIICCVFLLLAIVGYVAVGIIAWTHGDPRKVIYPTDSRGEFCGQKGTKNENKPYLFYFNIVKCASPLVLLEFQCPTPQICVEKCPDRYLTYLNARSSRDFEYYKQFCVPGFKNNKGVAEVLRDGDCPAVLIPSKPLARRCFPAIHAYKGVLMVGNETTYEDGHGSRKNITDLVEGAKKANGVLEARQLAMRIFEDYTVSWYWIIIGLVIAMAMSLLFIILLRFLAGIMVWVMIIMVILVLGYGIFHCYMEYSRLRGEAGSDVSLVDLGFQTDFRVYLHLRQTWLAFMIILSILEVIIILLLIFLRKRILIAIALIKEASRAVGYVMCSLLYPLVTFFLLCLCIAYWASTAVFLSTSNEAVYKIFDDSPCPFTAKTCNPETFPSSNESRQCPNARCQFAFYGGESGYHRALLGLQIFNAFMFFWLANFVLALGQVTLAGAFASYYWALRKPDDLPAFPLFSAFGRALRYHTGSLAFGALILAIVQIIRVILEYLDQRLKAAENKFAKCLMTCLKCCFWCLEKFIKFLNRNAYIMIAIYGTNFCTSARNAFFLLMRNIIRVAVLDKVTDFLFLLGKLLIVGSVGECRPPSLSGCGSLISVFCDECHLLRRLFPISRTLRHLAFFS

SEQ ID NO: 891271 - protein, 559 aa, Homo sapiens
MEDERKNGAYGTPQKYDPTFKGPIYNRGCTDIICCVFLLLAIVGYVAVGIIAWTHGDPRKVIYPTDSRGEFCGQKGTKNENKPYLFYFNIVKCASPLVLLEFQCPTPQICVEKCPDRYLTYLNARSSRDFEYYKQFCVPGFKNNKGVAEVLRDGDCPAVLIPSKPLARRCFPAIHAYKGVLMVGNETTYEDGHGSRKNITDLVEGAKKANGVLEARQLAMRIFEDYTVSWYWIIIGLVIAMAMSLLFIILLRFLAGIMVWVMIIMVILVLGYGIFHCYMEYSRLRGEAGSDVSLVDLGFQTDFRVYLHLRQTWLAFMIILSILEVIIILLLIFLRKRILIAIALIKEASRAVGYVMCSLLYPLVTFFLLCLCIAYWASTAVFLSTSNEAVYKIFDDSPCPFTAKTCNPETFPSSNESRQCPNARCQFAFYGGESGYHRALLGLQIFNAFMFFWLANFVLALGQVTLAGAFASYMGPGSGELPGSVFCWRGQDNKSWLGPLAGDTGERYRERETAQSRGPGVQGSGKHIQKDTGRIGRSAEKEGAAGNREEQDPVHVVAR

SEQ ID NO: 891272 - protein, 733 aa, Homo sapiens
GRGVQPAEPPARPGWGRAGSDSAPRPAAAMEDERKNGAYGTPQKYDPTFKGPIYNRGCTDIICCVFLLLAIVGYVAVGIIAWTHGDPRKVIYPTDSRGEFCGQKGTKNENKPYLFYFNIVKCASPLVLLEFQCPTPQICVEKCPDRYLTYLNARSSRDFEYYKQFCVPGFKNNKGVAEVLRDGDCPAVLIPSKPLARRCFPAIHAYKGVLMVGNETTYEDGHGSRKNITDLVEGAKKANGVLEARQLAMRIFEDYTVSWYWIIIGLVIAMAMSLLFIILLRFLAGIMVWVMIIMVILVLGYGIFHCYMEYSRLRGEAGSDVSLVDLGFQTDFRVYLHLRQTWLAFMIILSILEVIIILLLIFLRKRILIAIALIKEASRAVGYVMCSLLYPLVTFFLLCLCIAYWASTAVFLSTSNEAVYKIFDDSPCPFTAKTCNPETFPSSNESRQCPNARCQFAFYGGESGYHRALLGLQIFNAFMFFWLANFVLALGQVTLAGAFASYYWALRKPDDLPAFPLFSAFGRALRYHTGSLAFGALILAIVQIIRVILEYLDQRLKAAENKFAKCLMTCLKCCFWCLEKFIKFLNRNAYIMIAIYGTNFCTSARNAFFLLMRNIIRVAVLDKVTDFLFLLGKLLIVGSVGILAFFFFTHRIRIVQDTAPPLNYYWVPILTVIVGSYLIAHGFFSVYGMCVDTLFLCFLEDLERNDGSAERPYFMSSTLKKLLNKTNKKAAES

SEQ ID NO: 891273 - protein, 706 aa, Homo sapiens [sequence omitted]

SEQ ID NO: 891274 - protein, 664 aa, Homo sapiens
MIPLSKDPFTIAWTHGDPRKVIYPTDSRGEFCGQKGTKNENKPYLFYFNIVKCASPLVLLEFQCPTPQICVEKCPDRYLTYLNARSSRDFEYYKQFCVPGFKNNKGVAEVLRDGDCPAVLIPSKPLARRCFPAIHAYKGVLMVGNETTYEDGHGSRKNITDLVEGAKKANGVLEARQLAMRIFEDYTVSWYWIIIGLVIAMAMSLLFIILLRFLAGIMVWVMIIMVILVLGYGIFHCYMEYSRLRGEAGSDVSLVDLGFQTDFRVYLHLRQTWLAFMIILSILEVIIILLLIFLRKRILIAIALIKEASRAVGYVMCSLLYPLVTFFLLCLCIAYWASTAVFLSTSNEAVYKIFDDSPCPFTAKTCNPETFPSSNESRQCPNARCQFAFYGGESGYHRALLGLQIFNAFMFFWLANFVLALGQVTLAGAFASYYWALRKPDDLPAFPLFSAFGRALRYHTGSLAFGALILAIVQIIRVILEYLDQRLKAAENKFAKCLMTCLKCCFWCLEKFIKFLNRNAYIMIAIYGTNFCTSARNAFFLLMRNIIRVAVLDKVTDFLFLLGKLLIVGSVGILAFFFFTHRIRIVQDTAPPLNYYWVPILTVIVGSYLIAHGFFSVYGMCVDTLFLCFLEDLERNDGSAERPYFMSSTLKKLLNKTNKKAAES

SEQ ID NO: 891275 - protein, 763 aa, Homo sapiens
MEDERKNGAYGTPQKYDPTFKGPIYNRGCTDIICCVFLLLAIVGYVAVGIIAWTHGDPRKVIYPTDSRGEFCGQKGTKNENKPYLFYFNIVKCASPLVLLEFQCPTPQICVEKCPDRYLTYLNARSSRDFEYYKQFCVPGFKNNKGVAEVLRDGDCPAVLIPSKPLARRCFPAIHAYKGVLMVGNETTYEDGHGSRKNITDLVEGAKKANGVLEARQLAMRIFEDYTVSWYWIIIGLVIAMAMSLLFIILLRFLAGIMVWVMIIMVILVLGYGIFHCYMEYSRLRGEAGSDVSLVDLGFQTDFRVYLHLRQTWLAFMIILSILEVIIILLLIFLRKRILIAIALIKEASRAVGYVMCSLLYPLVTFFLLCLCIAYWASTAVYLPPDTDLLTPGMAKDQLCLEVTCSLGIGLETGGRMDSFPQKSLGSSVLDLCFLNEPPGFLSTSNEAVYKIFDDSPCPFTAKTCNPETFPSSNESRQCPNARCQFAFYGGESGYHRALLGLQIFNAFMFFWLANFVLALGQVTLAGAFASYYWALRKPDDLPAFPLFSAFGRALRYHTGSLAFGALILAIVQIIRVILEYLDQRLKAAENKFAKCLMTCLKCCFWCLEKFIKFLNRNAYIMIAIYGTNFCTSARNAFFLLMRNIIRVAVLDKVTDFLFLLGKLLIVGSVGILAFFFFTHRIRIVQDTAPPLNYYWVPILTVIVGSYLIAHGFFSVYGMCVDTLFLCFLEDLERNDGSAERPYFMSSTLKKLLNKTNKKAAES

SEQ ID NO: 891276 - protein, 578 aa, Homo sapiens
MEDERKNGAYGTPQKYDPTFKGPIYNRGCTDIICCVFLLLAIVGYVAVGIIAWTHGDPRKVIYPTDSRGEFCGQKGTKNENKPYLFYFNIVKCASPLVLLEFQCPTPQICVEKCPDRYLTYLNARSSRDFEYYKQFCVPGFKNNKGVAEVLRDGDCPAVLIPSKPLARRCFPAIHAYKGVLMVGNETTYEDGHGSRKNITDLVEGAKKANGVLEARQLAMRIFEDYTVSWYWIIIGLVIAMAMSLLFIILLRFLAGIMVWVMIIMVILVLGYGIFHCYMEYSRLRGEAGSDVSLVDLGFQTDFRVYLHLRQTWLAFMIILSILEVIIILLLIFLRKRILIAIALIKEASRAVGYVMCSLLYPLVTFFLLCLCIAYWASTAVFLSTSNEAVYKIFDDSPCPFTAKTCNPETFPSSNESRQCPNARCQFAFYGGESGYHRALLGLQIFNAFMFFWLANFVLALGQVTLAGAFASYYWALRKPDDLPAFPLFSAFGRALRYHTGSLAFGALILAIVQIIRVILEYLDQRLKAAENKFAKCLMTCLKCCFWCLEKFIKFLNRNAYIMLLPAHEKHHQSGCPG

SEQ ID NO: 891277 - protein, 406 aa, Homo sapiens [sequence omitted]

SEQ ID NO: 891278 - protein, 166 aa, Homo sapiens [sequence omitted]

SEQ ID NO: 891279 - protein, 146 aa, Homo sapiens
PTLLQIAIYGTNFCTSARNAFFLLMRNIIRVAVLDKVTDFLFLLGKLLIVGSVGILAFFFFTHRIRIVQDTAPPLNYYWVPILTVIVGSYLIAHGFFSVYGMCVDTLFLCFLEDLERNDGSAERPYFMSSTLKKLLNKTNKKAAES

SEQ ID NO: 891280 - protein, 125 aa, Homo sapiens
TPAPRVLIRVAVLDKVTDFLFLLGKLLIVGSVGILAFFFFTHRIRIVQDTAPPLNYYWVPILTVIVGSYLIAHGFFSVYGMCVDTLFLCFLEDLERNDGSAERPYFMSSTLKKLLNKTNKKAAES

SEQ ID NO: 891281 - protein, 81 aa, Homo sapiens
RIVLNLGHTFILTCKPMLTVIVGSYLIAHGFFSVYGMCVDTLFLCFLEDLERNDGSAERPYFMSSTLKKLLNKTNKKAAES

SEQ ID NO: 891282 - protein, 73 aa, Homo sapiens
SRDSSFLLAQTVIVGSYLIAHGFFSVYGMCVDTLFLCFLEDLERNDGSAERPYFMSSTLKKLLNKTNKKAAES

SEQ ID NO: 891283 - protein, 738 aa, Homo sapiens; identical to SEQ ID NO: 891260

SEQ ID NO: 891284 - protein, 666 aa, Homo sapiens
MEDERKNGAYGTPQKYDPTFKGPIYNRGCTDIICCVFLLLAIVGYVAVGIIAWTHGDPRKVIYPTDSRGEFCGQKGTKNENKPYLFYFNIVKCASPLVLLEFQCPTPQICVEKCPDRYLTYLNARSSRDFEYYKQFCVPGFKNNKGVAEVLRDGDCPAVLIPSKPLARRCFPAIHAYKGVLMVGNETTYEDGHGSRKNITDLVEGAKKANGVLEARQLAMRIFEDYTVSWYWIIIGLVIAMAMSLLFIILLRFLAGIMVWVMIIMVILVLGYGIFHCYMEYSRLRGEAGSDVSLVDLGFQTDFRVYLHLRQTWLAFMIILSILEVIIILLLIFLRKRILIAIALIKEASRAVGYVMCSLLYPLVTFFLLCLCIAYWASTAVFLSTSNEAVYKIFDDSPCPFTAKTCNPETFPSSNESRQCPNARCQFAFYGGESGYHRALLGLQIFNAFMFFWLANFVLALGQVTLAGAFASYYWALRKPDDLPAFPLFSAFGRALRYHTGSLAFGALILAIVQIIRVILEYLDQRLKAAENKFAKCLMTCLKCCFWCLEKFIKFLNRNAYIMIAIYGTNFCTSARNAFFLLMRNIIRVAVLDKVTDFLFLLGKLLIVGSVGILAFFFFTHRIRIVQDTAPPLNYYWVPILVWTSGERWGFGKKEVLGFAWSSLTR

SEQ ID NO: 891285 - protein, 507 aa, Homo sapiens
MEDERKNGAYGTPQKYDPTFKGPIYNRGCTDIICCVFLLLAIVGYVAVGIIAWTHGDPRKVIYPTDSRGEFCGQKGTKNENKPYLFYFNIVKCASPLVLLEFQCPTPQICVEKCPDRYLTYLNARSSRDFEYYKQFCVPGFKNNKGVAEVLRDGDCPAVLIPSKPLARRCFPAIHAYKGVLMVGNETTYEDGHGSRKNITDLVEGAKKANGVLEARQLAMRIFEDYTVSWYWIIIGLVIAMAMSLLFIILLRFLAGIMVWVMIIMVILVLGYGIFHCYMEYSRLRGEAGSDVSLVDLGFQTDFRVYLHLRQTWLAFMIILSILEVIIILLLIFLRKRILIAIALIKEASRAVGYVMCSLLYPLVTFFLLCLCIAYWASTAVFLSTSNEAVYKIFDDSPCPFTAKTCNPETFPSSNESRQCPNARCQFAFYGGESGYHRALLGLQIFNAFMFFWLANFVLALGQVTLAGAFASYYWALRKPDDLPAFPLFSAFGRALRYHTTTTNSGT

SEQ ID NO: 891286 - protein, 389 aa, Homo sapiens
MEDERKNGAYGTPQKYDPTFKGPIYNRGCTDIICCVFLLLAIVGYVAVGIIAWTHGDPRKVIYPTDSRGEFCGQKGTKNENKPYLFYFNIVKCASPLVLLEFQCPTPQICVEKCPDRYLTYLNARSSRDFEYYKQFCVPGFKNNKGVAEVLRDGDCPAVLIPSKPLARRCFPAIHAYKGVLMVGNETTYEDGHGSRKNITDLVEGAKKANGVLEARQLAMRIFEDYTVSWYWIIIGLVIAMAMSLLFIILLRFLAGIMVWVMIIMVILVLGYGIFHCYMEYSRLRGEAGSDVSLVDLGFQTDFRVYLHLRQTWLAFMIILSILEVIIILLLIFLRKRILIAIALIKEASRAVGYVMCSLLYPLVTFFLLCLCIAYWASTAVYLPPDTDL

SEQ ID NO: 891287 - protein, 274 aa, Homo sapiens
MGAGNLPPITQEEALHILGFQPPFEDIRFGPFTGNTTLMRWFRQINDHFHVKGCSYVLYKPHGKNKTAGETASGALSKLTRGLKDESLAYIYHCQNHYFCPIGFEATPVKANKAFSRGPLSPQEVEYWILIGESSRKHPAIHCKKWADIVTDLNTQNPEYLDIRHLERGLQYRKTKKVGGNLHCIIAFQRLNWQRFGLWNFPFGTIRQESQPPTHAQGIAKSESEDNISKKQHGRLGRSFSASFHQDSAWKKMSSIHERRNSGYQGYSDYDGND

SEQ ID NO: 891288 - protein, 503 aa, Homo sapiens
MPNVAETERSNDSGNGEHKSERKSPEENLQGAVKSFCTSASGAPLGPKGDGHYPWSCPVTHTREKIYAICSDYAFLNQATSIYKTPNPSRSPCLPDSTSLSAGNNSSRYIGIPTSTSEIIYNEENSLENLSNSLGKLPLAWEIDKSEFDGVTTNSKHKSGNAKKQVSKRKTSDKKGRYQKECPQHSPLEDIKQRKVLDLRRWYCISRPQYKTSCGISSLISCWNFLYSTMGAGNLPPITQEEALHILGFQPPFEDIRFGPFTGNTTLMRWFRQINDHFHVKGCSYVLYKPHGKNKTAGETASGALSKLTRGLKDESLAYIYHCQNHYFCPIGFEATPVKANKAFSRGPLSPQEVEYWILIGESSRKHPAIHCKKWADIVTDLNTQNPEYLDIRHLERGLQYRKTKKVGGNLHCIIAFQRLNWQRFGLWNFPFGTIRQESQPPTHAQGIAKSESEDNISKKQHGRLGRSFSASFHQDSAWKKMSSIHERRNSGYQGYSDYDGND

SEQ ID NO: 891289 - protein, 503 aa, Homo sapiens; identical to SEQ ID NO: 891288

SEQ ID NO: 891290 - protein, 485 aa, Homo sapiens
MPNVAETERSNDSGNGEHKSERKSPEENLQGAVKSFCTSASGAPLGPKGDGHYPWSCPVTHTREKIYAICSDYAFLNQATSIYKTPNPSRSPCLPDSTSLSAGNNSSRYIGIPTSTSEIIYNEENSLENLSNSLGKLPLAWEIDKSEFDGVTTNSKHKSGNAKKQVSKRKTSDKKRKVLDLRRWYCISRPQYKTSCGISSLISCWNFLYSTMGAGNLPPITQEEALHILGFQPPFEDIRFGPFTGNTTLMRWFRQINDHFHVKGCSYVLYKPHGKNKTAGETASGALSKLTRGLKDESLAYIYHCQNHYFCPIGFEATPVKANKAFSRGPLSPQEVEYWILIGESSRKHPAIHCKKWADIVTDLNTQNPEYLDIRHLERGLQYRKTKKVGGNLHCIIAFQRLNWQRFGLWNFPFGTIRQESQPPTHAQGIAKSESEDNISKKQHGRLGRSFSASFHQDSAWKKMSSIHERRNSGYQGYSDYDGND

SEQ ID NO: 891291 - protein, 274 aa, Homo sapiens; identical to SEQ ID NO: 891287

SEQ ID NO: 891292 - protein, 503 aa, Homo sapiens; identical to SEQ ID NO: 891288

SEQ ID NO: 891293 - protein, 491 aa, Homo sapiens
MPNVAETERSNDSGNGEHKSERKSPEENLQGAVKSFCTSASGAPLGPKGDGHYPWSCPVTHTREKIYAICSDYAFLNQATSIYKTPNPSRSPCLPDSTSLSAGNNSSRYIGIPTSTSEIIYNEENSLENLSNSLGKLPLAWEIDKSEFDGVTTNSKHKSGNAKKQVSKRKTSDKKGRYQKECPQHSPLEDIKQRKVLDLRRWYCISRPQYKTSCGISSLISCWNFLYSTMGAGNLPPITQEEALHILGFQPPFEDIRFGPFTGNTTLMRWFRQINDHFHVKGCSYVLYKPHGKNKTAGETASGALSKLTRGLKDESLAYIYHCQNHYFCPIGFEATPVKANKAFSRGPLSPQEVEYWILIGESSRKHPAIHCKKWADIVTDLNTQNPEYLDIRHLERGLQYRKTKKVGGNLHCIIAFQRLNWQRFGLWNFPFGTIRQESQPPTHAQGIAKSESEDNISKKQHGRLGRSFSASFHQDSAWMITMGMIDYACY

SEQ ID NO: 891294 - protein, 503 aa, Homo sapiens; identical to SEQ ID NO: 891288

SEQ ID NO: 891295 - protein, 503 aa, Homo sapiens; identical to SEQ ID NO: 891288

SEQ ID NO: 891296 - protein, 274 aa, Homo sapiens; identical to SEQ ID NO: 891287

SEQ ID NO: 891297 - protein, 202 aa, Homo sapiens
MPNVAETERSNDSGNGEHKSERKSPEENLQGAVKSFCTSASGAPLGPKGDGHYPWSCPVTHTREKIYAICSDYAFLNQATSIYKTPNPSRSPCLPDSTSLSAGNNSSRYIGIPTSTSEIIYNEENSLENLSNSLGKLPLAWEIDKSEFDGVTTNSKHKSGNAKKQVSKRKTSDKKGRYQKECPQHSPLEDIKQRKVLDLRRW

SEQ ID NO: 891298 - protein, 647 aa, Homo sapiens
MAEEEAPKKSRAAGGGASWELCAGALSARLAEEGSGDAGGRRRPPVDPRRLARQLLLLLWLLEAPLLLGVRAQAAGQGPGQGPGPGQQPPPPPQQQQSGQQYNGERGISVPDHGYCQPISIPLCTDIAYNQTIMPNLLGHTNQEDAGLEVHQFYPLVKVQCSAELKFFLCSMYAPVCTVLEQALPPCRSLCERARQGCEALMNKFGFQWPDTLKCEKFPVHGAGELCVGQNTSDKGTPTPSLLPEFWTSNPQHGGGGHRGGFPGGAGASERGKFSCPRALKVPSYLNYHFLGEKDCGAPCEPTKVYGLMYFGPEELRFSRTWIGIWSVLCCASTLFTVLTYLVDMRRFSYPERPIIFLSGCYTAVAVAYIAGFLLEDRVVCNDKFAEDGARTVAQGTKKEGCTILFMMLYFFSMASSIWWVILSLTWFLAAGMKWGHEAIEANSQYFHLAAWAVPAIKTITILALGQVDGDVLSGVCFVGLNNVDALRGFVLAPLFVYLFIGTSFLLAGFVSLFRIRTIMKHDGTKTEKLEKLMVRIGVFSVLYTVPATIVIACYFYEQAFRDQWERSWVAQSCKSYAIPCPHLQAGGGAPPHPPMSPDFTVFMIKYLMTLIVGITSGFWIWSGKTLNSWRKFYTRLTNSKQGETTV

SEQ ID NO: 891299 - protein, 647 aa, Homo sapiens; identical to SEQ ID NO: 891298

SEQ ID NO: 891300 - protein, 647 aa, Homo sapiens; identical to SEQ ID NO: 891298

SEQ ID NO: 891301 - protein, 647 aa, Homo sapiens; identical to SEQ ID NO: 891298

SEQ ID NO: 891302 - protein, 111 aa, Homo sapiens
MAEEEAPKKSLATIVIACYFYEQAFRDQWERSWVAQSCKSYAIPCPHLQAGGGAPPHPPMSPDFTVFMIKYLMTLIVGITSGFWIWSGKTLNSWRKFYTRLTNSKQGETTV

SEQ ID NO: 891303 - protein, 84 aa, Homo sapiens
LKVQNSTNLPNLGGGPPYITIPPLLGGGLRRPMSPDFTVFMIKYLMTLIVGITSGFWIWSGKTLNSWRKFYTRLTNSKQGETTV

SEQ ID NO: 891304 - protein, 647 aa, Homo sapiens; identical to SEQ ID NO: 891298

SEQ ID NO: 891305 - protein, 1004 aa, Homo sapiens
MLSATPLYGNVHSWMNSERVRMCGASEDRKILVNDGDASKARLELREENPLNHNVVDASTAHRIDGLAALSMDRTGLIREGLRVPGNIVYSSLCGLGSEKGREAATSTLGGLGFSSERNPEMQFKPNTPETVEASAVSGKPPNGFSAIYKTPPGIQKSAVATAEALGLDRPASDKQSPLNINGASYLRLPWVNPYMEGATPAIYPFLDSPNKYSLNMYKALLPQQSYSLAQPLYSPVCTNGERFLYLPPPHYVGPHIPSSLASPMRLSTPSASPAIPPLVHCADKSLPWKMGVSPGNPVDSHAYPHIQNSKQPRVPSAKAVTSGLPGDTALLLPPSPRPSPRVHLPTQPAADTYSEFHKHYARISTSPSVALSKPYMTVSSEFPAARLSNGKYPKAPEGGEGAQPVPGHARKTAVQDRKDGSSPPLLEKQTVTKDVTDKPLDLSSKVVDVDASKADHMKKMAPTVLVHSRAGSGLVLSGSEIPKETLSPPGNGCAIYRSEIISTAPSSWVVPGPSPNEENNGKSMSLKNKALDWAIPQQRSSSCPRMGGTDAVITNVSGSVSSAGRPASASPAPNANADGTKTSRSSVETTPSVIQHVGQPPATPAKHSSSTSSKGAKASNPEPSFKANENGLPPSSIFLSPNEAFRSPPIPYPRSYLPYPAPEGIAVSPLSLHGKGPVYPHPVLLPNGSLFPGHLAPKPGLPYGLPTGRPEFVTYQDALGLGMVHPMLIPHTPIEITKEEKPERRSRSHERARYEDPTLRNRFSEILETSSTKLHPDVPTDKNLKPNPNWNQGKTVVKSDKLVYVDLLREEPDAKTDTNVSKPSFAAESVGQSAEPPKPSVEPALQQHRDFIALREELGRISDFHETYTFKQPVFTVSKDSVLAGTNKENLGLPVSTPFLEPPLGSDGPAVTFGKTQEDPKPFCVGSAPPSVDVTPTYTKDGADEAESNDGKVLKPKPSKLAKRIANSAGYVGDRFKCVTTELYADSSQLSREQRALQVSPPT

SEQ ID NO: 891306 - protein, 1721 aa, Homo sapiens
MLSATPLYGNVHSWMNSERVRMCGASEDRKILVNDGDASKARLELREENPLNHNVVDASTAHRIDGLAALSMDRTGLIREGLRVPGNIVYSSLCGLGSEKGREAATSTLGGLGFSSERNPEMQFKPNTPETVEASAVSGKPPNGFSAIYKTPPGIQKSAVATAEALGLDRPASDKQSPLNINGASYLRLPWVNPYMEGATPAIYPFLDSPNKYSLNMYKALLPQQSYSLAQPLYSPVCTNGERFLYLPPPHYVGPHIPSSLASPMRLSTPSASPAIPPLVHCADKSLPWKMGVSPGNPVDSHAYPHIQNSKQPRVPSAKAVTSGLPGDTALLLPPSPRPSPRVHLPTQPAADTYSEFHKHYARISTSPSVALSKPYMTVSSEFPAARLSNGKYPKAPEGGEGAQPVPGHARKTAVQDRKDGSSPPLLEKQTVTKDVTDKPLDLSSKVVDVDASKADHMKKMAPTVLVHSRAGSGLVLSGSEIPKETLSPPGNGCAIYRSEIISTAPSSWVVPGPSPNEENNGKSMSLKNKALDWAIPQQRSSSCPRMGGTDAVITNVSGSVSSAGRPASASPAPNANADGTKTSRSSVETTPSVIQHVGQPPATPAKHSSSTSSKGAKASNPEPSFKANENGLPPSSIFLSPNEAFRSPPIPYPRSYLPYPAPEGIAVSPLSLHGKGPVYPHPVLLPNGSLFPGHLAPKPGLPYGLPTGRPEFVTYQDALGLGMVHPMLIPHTPIEITKEEKPERRSRSHERARYEDPTLRNRFSEILETSSTKLHPDVPTDKNLKPNPNWNQGKTVVKSDKLVYVDLLREEPDAKTDTNVSKPSFAAESVGQSAEPPKPSVEPALQQHRDFIALREELGRISDFHETYTFKQPVFTVSKDSVLAGTNKENLGLPVSTPFLEPPLGSDGPAVTFGKTQEDPKPFCVGSAPPSVDVTPTYTKDGADEAESNDGKVLKPKPSKLAKRIANSAGYVGDRFKCVTTELYADSSQLSREQRALQMEGLQEDSILCLPAAYCERAMMRFSELEMKEREGGHPATKDSEMCKFSPADWERLKGNQDKKPKSVTLEEAIAEQNESERCEYSVGNKHRDPFEAPEDKDLPVEKYFVERQPVSEPPADQVASDMPHSPTLRVDRKRKVSGDSSHTETTAEEVPEDPLLKAKRRRVSKGLHPKKQRHLLHLRERWEQQVSAADGKPGRQSRKEVTQATQPEAIPQGTNITEEKPGRKRAEAKGNRSWSEESLKPSDNEQGLPVFSGSPPMKSLSSTSAGGKKQAQPSCAPASRPPAKQQKIKENQKTDVLCADEEEDCQAASLLQKYTDNSEKPSGKRLCKTKHLIPQESRRGLPLTGEYYVENADGKVTVRRFRKRPEPSSDYDLSPAKQEPKPFDRLQQLLPASQSTQLPCSSSPQETTQSRPMPPEARRLIVNKNAGETLLQRAARLGYEEVVLYCLENKICDVNHRDNAGYCALHEACARGWLNIVRHLLEYGADVNCSAQDGTRPLHDAVENDHLEIVRLLLSYGADPTLATYSGRTIMKMTHSELMEKFLTDYLNDLQGRNDDDASGTWDFYGSSVCEPDDESGYDVLANPPGPEDQDDDDDAYSDVFEFEFSETPLLPCYNIQVSVAQGPRNWLLLSDVLKKLKMSSRIFRCNFPNVEIVTIAEAEFYRQVSASLLFSCSKDLEAFNPESKELLDLVEFTNEIQTLLGSSVEWLHPSDLASDNYW

SEQ ID NO: 891307 - protein, 1625 aa, Homo sapiens
MLSATPLYGNVHSWMNSERVRMCGASEDRKILVNDGDASKARLELREENPLNHNVVDASTAHRIDGLAALSMDRTGLIREGLRVPGNIVYSSLCGLGSEKGREAATSTLGGLGFSSERNPEMQFKPNTPETVEASAVSGKPPNGFSAIYKTPPGIQKSAVATAEALGLDRPASDKQSPLNINGASYLRLPWVNPYMEGATPAIYPFLDSPNKYSLNMYKALLPQQSYSLAQPLYSPVCTNGERFLYLPPPHYVGPHIPSSLASPMRLSTPSASPAIPPLVHCADKSLPWKMGVSPGNPVDSHAYPHIQNSKQPRVPSAKAVTSGLPGDTALLLPPSPRPSPRVHLPTQPAADTYSEFHKHYARISTSPSVALSKPYMTVSSEFPAARLSNGKYPKAPEGGEGAQPVPGHARKTAVQDRKDGSSPPLLEKQTVTKDVTDKPLDLSSKVVDVDASKADHMKKMAPTVLVHSRAGSGLVLSGSEIPKETLSPPGNGCAIYRSEIISTAPSSWVVPGPSPNEENNGKSMSLKNKALDWAIPQQRSSSCPRMGGTDAVITNVSGSVSSAGRPASASPAPNANADGTKTSRSSVETTPSVIQHVGQPPATPAKHSSSTSSKGAKASNPEPSFKANENGLPPSSIFLSPNEAFRSPPIPYPRSYLPYPAPEGIAVSPLSLHGKGPVYPHPVLLPNGSLFPGHLAPKPGLPYGLPTGRPEFVTYQDALGLGMVHPMLIPHTPIEITKEEKPERRSRSHERARYEDPTLRNRFSEILETSSTKLHPDVPTDKNLKPNPNWNQGKTVVKSDKLVYVDLLREEPDAKTDTNVSKPSFAAESVGQSAEPPKPSVEPALQQHRDFIALREELGRISDFHETYTFKQPVFTVSKDSVLAGTNKENLGLPVSTPFLEPPLGSDGPAVTFGKTQEDPKPFCVGSAPPSVDVTPTYTKDGADEAESNDGKVLKPKPSKLAKRIANSAGYVGDRFKCVTTELYADSSQLSREQRALQMEGLQEDSILCLPAAYCERAMMRFSELEMKEREGGHPATKDSEMCKFSPADWERLKGNQDKKPKSVTLEEAIAEQNESERCEYSVGNKHRDPFEAPEDKDLPVEKYFVERQPVSEPPADQVASDMPHSPTLRVDRKRKVSGDSSHTETTAEEVPEDPLLKAKRRRVSKGLHPKKQRHLLHLRERWEQQVSAADGKPGRQSRKEVTQATQPEAIPQGTNITEEKPGRKRAEAKGNRSWSEESLKPSDNEQGLPVFSGSPPMKSLSSTSAGGKKQAQPSCAPASRPPAKQQKIKENQKTDVLCADEEEDCQAASLLQKYTDNSEKPSGKRLCKTKHLIPQESRRGLPLTGEYYVENADGKVTVRRFRKRPEPSSDYDLSPAKQEPKPFDRLQQLLPASQSTQLPCSSSPQETTQSRPMPPEARRLIVNKNAGETLLQRAARLGYEEVVLYCLENKICDVNHRDNAGYCALHEACARGWLNIVRHLLEYGADVNCSAQDGTRPLHDAVENDHLEIVRLLLSYGADPTLATYSGRTIMKMTHSELMEKFLTDYLNDLQGRNDDDASGTWDFYGSSVCEPDDESGYDVLANPPGPEDQDDDDDAYSDVFEFEFSETPLLPCYNIQVSVAQG

SEQ ID NO: 891308 - protein, 1607 aa, Homo sapiens
MLSATPLYGNVHSWMNSERVRMCGASEDRKILVNDGDASKARLELREENPLNHNVVDASTAHRIDGLAALSMDRTGLIREGLRVPGNIVYSSLCGLGSEKGREAATSTLGGLGFSSERNPEMQFKPNTPETVEASAVSGKPPNGFSAIYKTPPGIQKSAVATAEALGLDRPASDKQSPLNINGASYLRLPWVNPYMEGATPAIYPFLDSPNKYSLNMYKALLPQQSYSLAQPLYSPVCTNGERFLYLPPPHYVGPHIPSSLASPMRLSTPSASPAIPPLVHCADKSLPWKMGVSPGNPVDSHAYPHIQNSKQPRVPSAKAVTSGLPGDTALLLPPSPRPSPRVHLPTQPAADTYSEFHKHYARISTSPSVALSKPYMTVSSEFPAARLSNGKYPKAPEGGEGAQPVPGHARKTAVQDRKDGSSPPLLEKQTVTKDVTDKPLDLSSKVVDVDASKADHMKKMAPTVLVHSRAGSGLVLSGSEIPKETLSPPGNGCAIYRSEIISTAPSSWVVPGPSPNEENNGKSMSLKNKALDWAIPQQRSSSCPRMGGTDAVITNVSGSVSSAGRPASASPAPNANADGTKTSRSSVETTPSVIQHVGQPPATPAKHSSSTSSKGAKASNPEPSFKANENGLPPSSIFLSPNEAFRSPPIPYPRSYLPYPAPEGIAVSPLSLHGKGPVYPHPVLLPNGSLFPGHLAPKPGLPYGLPTGRPEFVTYQDALGLGMVHPMLIPHTPIEITKEEKPERRSRSHERARYEDPTLRNRFSEILETSSTKLHPDVPTDKNLKPNPNWNQGKTVVKSDKLVYVDLLREEPDAKTDTNVSKPSFAAESVGQSAEPPKPSVEPALQQHRDFIALREELGRISDFHETYTFKQPVFTVSKDSVLAGTNKENLGLPVSTPFLEPPLGSDGPAVTFGKTQEDPKPFCVGSAPPSVDVTPTYTKDGADEAESNDGKVLKPKPSKLAKRIANSAGYVGDRFKCVTTELYADSSQLSREQRALQRAMMRFSELEMKEREGGHPATKDSEMCKFSPADWERLKGNQDKKPKSVTLEEAIAEQNESERCEYSVGNKHRDPFEAPEDKDLPVEKYFVERQPVSEPPADQVASDMPHSPTLRVDRKRKVSGDSSHTETTAEEVPEDPLLKAKRRRVSKGLHPKKQRHLLHLRERWEQQVSAADGKPGRQSRKEVTQATQPEAIPQGTNITEEKPGRKRAEAKGNRSWSEESLKPSDNEQGLPVFSGSPPMKSLSSTSAGGKKQAQPSCAPASRPPAKQQKIKENQKTDVLCADEEEDCQAASLLQKYTDNSEKPSGKRLCKTKHLIPQESRRGLPLTGEYYVENADGKVTVRRFRKRPEPSSDYDLSPAKQEPKPFDRLQQLLPASQSTQLPCSSSPQETTQSRPMPPEARRLIVNKNAGETLLQRAARLGYEEVVLYCLENKICDVNHRDNAGYCALHEACARGWLNIVRHLLEYGADVNCSAQDGTRPLHDAVENDHLEIVRLLLSYGADPTLATYSGRTIMKMTHSELMEKFLTDYLNDLQGRNDDDASGTWDFYGSSVCEPDDESGYDVLANPPGPEDQDDDDDAYSDVFEFEFSETPLLPCYNIQVSVAQG

SEQ ID NO: 891309 - protein, 214 aa, Homo sapiens
REKKSDNFQVIVLNSIVQRPGSRTIMKMTHSELMEKFLTDYLNDLQGRNDDDASGTWDFYGSSVCEPDDESGYDVLANPPGPEDQDDDDDAYSDVFEFEFSETPLLPCYNIQVSVAQGPRNWLLLSDVLKKLKMSSRIFRCNFPNVEIVTIAEAEFYRQVSASLLFSCSKDLEAFNPESKELLDLVEFTNEIQTLLGSSVEWLHPSDLASDNYW

SEQ ID NO: 891310 - protein, 1744 aa, Homo sapiens
MLSATPLYGNVHSWMNSERVRMCGASEDRKILVNDGDASKARLELREENPLNHNVVDASTAHRIDGLAALSMDRTGLIREGLRVPGNIVYSSLCGLGSEKGREAATSTLGGLGFSSERNPEMQFKPNTPETVEASAVSGKPPNGFSAIYKTPPGIQKSAVATAEALGLDRPASDKQSPLNINGASYLRLPWVNPYMEGATPAIYPFLDSPNKYSLNMYKALLPQQSYSLAQPLYSPVCTNGERFLYLPPPHYVGPHIPSSLASPMRLSTPSASPAIPPLVHCADKSLPWKMGVSPGNPVDSHAYPHIQNSKQPRVPSAKAVTSGLPGDTALLLPPSPRPSPRVHLPTQPAADTYSEFHKHYARISTSPSVALSKPYMTVSSEFPAARLSNGKYPKAPEGGEGAQPVPGHARKTAVQDRKDGSSPPLLEKQTVTKDVTDKPLDLSSKVVDVDASKADHMKKMAPTVLVHSRAGSGLVLSGSEIPKETLSPPGNGCAIYRSEIISTAPSSWVVPGPSPNEENNGKSMSLKNKALDWAIPQQRSSSCPRMGGTDAVITNVSGSVSSAGRPASASPAPNANADGTKTSRSSVETTPSVIQHVGQPPATPAKHSSSTSSKGAKASNPEPSFKANENGLPPSSIFLSPNEAFRSPPIPYPRSYLPYPAPEGIAVSPLSLHGKGPVYPHPVLLPNGSLFPGHLAPKPGLPYGLPTGRPEFVTYQDALGLGMVHPMLIPHTPIEITKEEKPERRSRSHERARYEDPTLRNRFSEILETSSTKLHPDVPTDKNLKPNPNWNQGKTVVKSDKLVYVDLLREEPDAKTDTNVSKPSFAAESVGQSAEPPKPSVEPALQQHRDFIALREELGRISDFHETYTFKQPVFTVSKDSVLAGTNKENLGLPVSTPFLEPPLGSDGPAVTFGKTQEDPKPFCVGSAPPSVDVTPTYTKDGADEAESNDGKVLKPKPSKLAKRIANSAGYVGDRFKCVTTELYADSSQLSREQRALQMEGLQEDSILCLPAAYCERAMMRFSELEMKEREGGHPATKDSEMCKFSPADWERLKGNQDKKPKSVTLEEAIAEQNESERCEYSVGNKHRDPFEAPEDKDLPVEKYFVERQPVSEPPADQVASDMPHSPTLRVDRKRKVSGDSSHTETTAEEVPEDPLLKAKRRRVSKGLHPKKQRHLLHLRERWEQQVSAADGKPGRQSRKEVTQATQPEAIPQGTNITEEKPGRKRAEAKGNRSWSEESLKPSDNEQGLPVFSGSPPMKSLSSTSAGGKKQAQPSCAPASRPPAKQQKIKENQKTDVLCADEEEDCQAASLLQKYTDNSEKPSGKRLCKTKHLIPQESRRGLPLTGEYYVENADGKVTVRRFRKRPEPSSDYDLSPAKQEPKPFDRLQQLLPASQSTQLPCSSSPQETTQSRPMPPEARRLIVNKNAGETLLQRAARLGYEEVVLYCLENKICDVNHRDNAGYCALHEACARGWLNIVRHLLEYGADVNCSAQDGTRPLHDAVENDHLEIVRLLLSYGADPTLATYSGRTIMKMTHSELMEKFLTDYLNDLQGRNDDDASGTWDFYGSSVCEPDDESGYDVLANPPGPEDQDDDDDAYSDVFEFEFSETPLLPCYNIQVSVAQGPRNWLLLSDVLKKLKMSSRIFRCNFPNVEIVTIAEAEFYRLWMQKVSEDEEEEDVKLLSISGKAAAPGGGSKVPQKKVKLAADDDDDDDDKGDDDQDDDDDDFDAEEAEEQAPVKKSIR

SEQ ID NO: 891311 - protein, 1721 aa, Homo sapiens; identical to SEQ ID NO: 891306

SEQ ID NO: 891312 - protein, 1721 aa, Homo sapiens; identical to SEQ ID NO: 891306

SEQ ID NO: 891313 - protein, 469 aa, Homo sapiens
LTNLKVCIELTGLHPKKQRHLLHLRERWEQQVSAADGKPGRQSRKEVTQATQPEAIPQGTNITEEKPGRKRAEAKGNRSWSEESLKPSDNEQGLPVFSGSPPMKSLSSTSAGGKKQAQPSCAPASRPPAKQQKIKENQKTDVLCADEEEDCQAASLLQKYTDNSEKPSGKRLCKTKHLIPQESRRGLPLTGEYYVENADGKVTVRRFRKRPEPSSDYDLSPAKQEPKPFDRLQQLLPASQSTQLPCSSSPQETTQSRPMPPEARRLIVNKNAGETLLQRAARLGYEEVVLYCLENKICDVNHRDNAGYCALHEACARGWLNIVRHLLEYGADVNCSAQDGTRPLHDAVENDHLEIVRLLLSYGADPTLATYSGRTIMKMTHSELMEKFLTDYLNDLQGRNDDDASGTWDFYGSSVCEPDDESGYDVLANPPGPEDQDDDDDAYSDVFEFEFSETPLLPCYNIQVSVAQG

SEQ ID NO: 891314 - protein, 1625 aa, Homo sapiens; identical to SEQ ID NO: 891307

SEQ ID NO: 891315 - protein, 437 aa, Homo sapiens
MAEAEEDCHSDTVRADDDEENESPAETDLQAQLQMFRAQWMFELAPGVSSSNLENRPCRAARGSLQKTSADTKGKQEQAKEEKARELFLKAVEEEQNGALYEAIKFYRRAMQLVPDIEFKITYTRSPDGDGVGNSYIEDNDDDSKMADLLSYFQQQLTFQESVLKLCQPELESSQIHISVLPMEVLMYIFRWVVSSDLDLRSLEQLSLVCRGFYICARDPEIWRLACLKVWGRSCIKLVPYTSWREMFLERPRVRFDGVYISKTTYIRQGEQSLDGFYRAWHQVEYYRYIRFFPDGHVMMLTTPEEPQSIVPRLRTRNTRTDAILLGHYRLSQDTDNQTKVFAVITKKKEEKPLDYKYRYFRRVPVQEADQSFHVGLQLCSSGHQRFNKLIWIHHSCHITYKSTGETAVSAFEIDKMYTPLFFARVRSYTAFSERPL

SEQ ID NO: 891316 - protein, 778 aa, Homo sapiens
MAEAEEDCHSDTVRADDDEENESPAETDLQAQLQMFRAQWMFELAPGVSSSNLENRPCRAARGSLQKTSADTKGKQEQAKEEKARELFLKAVEEEQNGALYEAIKFYRRAMQLVPDIEFKITYTRSPDGDGVGNSYIEDNDDDSKMADLLSYFQQQLTFQESVLKLCQPELESSQIHISVLPMEVLMYIFRWVVSSDLDLRSLEQLSLVCRGFYICARDPEIWRLACLKVWGRSCIKLVPYTSWREMFLERPRVRFDGVYISKTTYIRQGEQSLDGFYRAWHQVEYYRYIRFFPDGHVMMLTTPEEPQSIVPRLRTRNTRTDAILLGHYRLSQDTDNQTKVFAVITKKKEEKKKLETSSQRNMNLLYQLEWGKRRRKQRDQMLPANCQLVTPHTQCRLKLLKLERIKDYLLMEEEFIRNQEQMKPLEEKQEEERSKVDDLRGTPMSVGTLEEIIDDNHAIVSTSVGSEHYVSILSFVDKDLLEPGCSVLLNHKVHAVIGVLMDDTDPLVTVMKVEKAPQETYADIGGLDNQIQEIKESVELPLTHPEYYEEMGIKPPKGVILYGPPGTGKTLLAKAVANQTSATFLRVVGSELIQKYLGDGPKLVRELFRVAEEHAPSIVFIDEIDAIGTKRYDSNSGGEREIQRTMLELLNQLDGFDSRGDVKVIMATNRIETLDPALIRPGRIDRKIEFPLPDEKTKKRIFQIHTSRMTLADDVTLDDLIMAKDDLSGADIKAICTEAGLMALRERRMKVTNEDFKKSKENVLYKKQEGTPEGLYL

SEQ ID NO: 891317 - protein, 403 aa, Homo sapiens
MFRAQWMFELAPGVSSSNLENRPCRAARGSLQKTSADTKGKQEQAKEEKARELFLKAVEEEQNGALYEAIKFYRRAMQLVPDIEFKITYTRSPDGDGVGNSYIEDNDDDSKMADLLSYFQQQLTFQESVLKLCQPELESSQIHISVLPMEVLMYIFRWVVSSDLDLRSLEQLSLVCRGFYICARDPEIWRLACLKVWGRSCIKLVPYTSWREMFLERPRVRFDGVYISKTTYIRQGEQSLDGFYRAWHQVEYYRYIRFFPDGHVMMLTTPEEPQSIVPRLRTRNTRTDAILLGHYRLSQDTDNQTKVFAVITKKKEEKPLDYKYRYFRRVPVQEADQSFHVGLQLCSSGHQRFNKLIWIHHSCHITYKSTGETAVSAFEIDKMYTPLFFARVRSYTAFSERPL

SEQ ID NO: 891318 - protein, 128 aa, Homo sapiens
LSPCWPRKNWRLHFPLMGSWSLGSSSLRDRESCFDCDCRFPEKPLDYKYRYFRRVPVQEADQSFHVGLQLCSSGHQRFNKLIWIHHSCHITYKSTGETAVSAFEIDKMYTPLFFARVRSYTAFSERPL

SEQ ID NO: 891319 - protein, 127 aa, Homo sapiens
MPDIIWVFPPQAEAEEDCHSDTVRADDDEENESPAETDLQAQLQMFRAQWMFELAPGVSSSNLENRPCRAARGSLQKTSADTKGKQEQAKEEKLSIIDIVTNYIFFFWHMEIFTDTVSRHYNQTFGT

SEQ ID NO: 891320 - protein, 437 aa, Homo sapiens; identical to SEQ ID NO: 891315

SEQ ID NO: 891321 - protein, 437 aa, Homo sapiens; identical to SEQ ID NO: 891315

SEQ ID NO: 891322 - protein, 437 aa, Homo sapiens; identical to SEQ ID NO: 891315

SEQ ID NO: 891323 - protein, 447 aa, Homo sapiens
MPDIIWVFPPQAEAEEDCHSDTVRADDDEENESPAETDLQAQLQMFRAQWMFELAPGVSSSNLENRPCRAARGSLQKTSADTKGKQEQAKEEKARELFLKAVEEEQNGALYEAIKFYRRAMQLVPDIEFKITYTRSPDGDGVGNSYIEDNDDDSKMADLLSYFQQQLTFQESVLKLCQPELESSQIHISVLPMEVLMYIFRWVVSSDLDLRSLEQLSLVCRGFYICARDPEIWRLACLKVWGRSCIKLVPYTSWREMFLERPRVRFDGVYISKTTYIRQGEQSLDGFYRAWHQVEYYRYIRFFPDGHVMMLTTPEEPQSIVPRLRTRNTRTDAILLGHYRLSQDTDNQTKVFAVITKKKEEKPLDYKYRYFRRVPVQEADQSFHVGLQLCSSGHQRFNKLIWIHHSCHITYKSTGETAVSAFEIDKMYTPLFFARVRSYTAFSERPL

SEQ ID NO: 891324 - protein, 437 aa, Homo sapiens; identical to SEQ ID NO: 891315

SEQ ID NO: 891325 - protein, 587 aa, Homo sapiens
GVVRHVRAADGAGSVKGATGDHPCRRRTASVVSSQLSASGHFRALDNTERQRPAQVTPVAPWKHRSHECELLAAVIRWHLIRQRDRECELEINSYCTPPLPGALLRPRTLLSSAAETGRSRHPDTQHPSSGGRCRGGTESPSSAAGRPASMAEAEEDCHSDTVRADDDEENESPAETDLQAQLQMFRAQWMFELAPGVSSSNLENRPCRAARGSLQKTSADTKGKQEQAKEEKARELFLKAVEEEQNGALYEAIKFYRRAMQLVPDIEFKITYTRSPDGDGVGNSYIEDNDDDSKMADLLSYFQQQLTFQESVLKLCQPELESSQIHISVLPMEVLMYIFRWVVSSDLDLRSLEQLSLVCRGFYICARDPEIWRLACLKVWGRSCIKLVPYTSWREMFLERPRVRFDGVYISKTTYIRQGEQSLDGFYRAWHQVEYYRYIRFFPDGHVMMLTTPEEPQSIVPRLRTRNTRTDAILLGHYRLSQDTDNQTKVFAVITKKKEEKPLDYKYRYFRRVPVQEADQSFHVGLQLCSSGHQRFNKLIWIHHSCHITYKSTGETAVSAFEIDKMYTPLFFARVRSYTAFSERPL

SEQ ID NO: 891326 - protein, 403 aa, Homo sapiens; identical to SEQ ID NO: 891317

SEQ ID NO: 891327 - protein, 444 aa, Homo sapiens
QTSRCVSAGLSFSSSSSALTVSDDDEENESPAETDLQAQLQMFRAQWMFELAPGVSSSNLENRPCRAARGSLQKTSADTKGKQEQAKEEKARELFLKAVEEEQNGALYEAIKFYRRAMQLVPDIEFKITYTRSPDGDGVGNSYIEDNDDDSKMADLLSYFQQQLTFQESVLKLCQPELESSQIHISVLPMEVLMYIFRWVVSSDLDLRSLEQLSLVCRGFYICARDPEIWRLACLKVWGRSCIKLVPYTSWREMFLERPRVRFDGVYISKTTYIRQGEQSLDGFYRAWHQVEYYRYIRFFPDGHVMMLTTPEEPQSIVPRLRTRNTRTDAILLGHYRLSQDTDNQTKVFAVITKKKEEKPLDYKYRYFRRVPVQEADQSFHVGLQLCSSGHQRFNKLIWIHHSCHITYKSTGETAVSAFEIDKMYTPLFFARVRSYTAFSERPL

SEQ ID NO: 891328 - protein, 315 aa, Homo sapiens [sequence omitted]

SEQ ID NO: 891329 - protein, 437 aa, Homo sapiens; identical to SEQ ID NO: 891315

SEQ ID NO: 891330 - protein, 392 aa, Homo sapiens
CNSYIEYSDKNTEGHFAGSLQKTSADTKGKQEQAKEEKARELFLKAVEEEQNGALYEAIKFYRRAMQLVPDIEFKITYTRSPDGDGVGNSYIEDNDDDSKMADLLSYFQQQLTFQESVLKLCQPELESSQIHISVLPMEVLMYIFRWVVSSDLDLRSLEQLSLVCRGFYICARDPEIWRLACLKVWGRSCIKLVPYTSWREMFLERPRVRFDGVYISKTTYIRQGEQSLDGFYRAWHQVEYYRYIRFFPDGHVMMLTTPEEPQSIVPRLRTRNTRTDAILLGHYRLSQDTDNQTKVFAVITKKKEEKPLDYKYRYFRRVPVQEADQSFHVGLQLCSSGHQRFNKLIWIHHSCHITYKSTGETAVSAFEIDKMYTPLFFARVRSYTAFSERPL

SEQ ID NO: 891331 - protein, 463 aa, Homo sapiens
MAEAEEDCHSDTVRADDDEENESPAETDLQAQLQMFRAQWMFELAPGVSSSNLENRPCRAARGSLQKTSADTKGKQEQAKEEKARELFLKAVEEEQNGALYEAIKFYRRAMQLVPDIEFKITYTRSPDGDGVGNSYIEDNDDDSKMADLLSYFQQQLTFQESVLKLCQPELESSQIHISVLPMEVLMYIFRWVVSSDLDLRSLEQLSLVCRGFYICASWRVVVQSWRKLGEFIKQSGVRVDNNRDPEIWRLACLKVWGRSCIKLVPYTSWREMFLERPRVRFDGVYISKTTYIRQGEQSLDGFYRAWHQVEYYRYIRFFPDGHVMMLTTPEEPQSIVPRLRTRNTRTDAILLGHYRLSQDTDNQTKVFAVITKKKEEKPLDYKYRYFRRVPVQEADQSFHVGLQLCSSGHQRFNKLIWIHHSCHITYKSTGETAVSAFEIDKMYTPLFFARVRSYTAFSERPL

SEQ ID NO: 891332 - protein, 437 aa, Homo sapiens; identical to SEQ ID NO: 891315

SEQ ID NO: 891333 - protein, 437 aa, Homo sapiens; identical to SEQ ID NO: 891315

SEQ ID NO: 891334 - protein, 264 aa, Homo sapiens
MIFLLPVLPMEVLMYIFRWVVSSDLDLRSLEQLSLVCRGFYICARDPEIWRLACLKVWGRSCIKLVPYTSWREMFLERPRVRFDGVYISKTTYIRQGEQSLDGFYRAWHQVEYYRYIRFFPDGHVMMLTTPEEPQSIVPRLRTRNTRTDAILLGHYRLSQDTDNQTKVFAVITKKKEEKPLDYKYRYFRRVPVQEADQSFHVGLQLCSSGHQRFNKLIWIHHSCHITYKSTGETAVSAFEIDKMYTPLFFARVRSYTAFSERPL

SEQ ID NO: 891335 - protein, 389 aa, Homo sapiens
MAEAEEDCHSDTVRADDDEENESPAETDLQAQLQMFRAQWMFELAPGVSSSNLENRPCRAARGSLQKTSADTKGKQEQAKEEKARELFLKAVEEEQNGALYEAIKFYRRAMQLVPDIEFKITYTRSPDGDGVGNSYIEDNDDDSKMADLLSYFQQQLTFQESVLKLCQPELESSQIHISVLPMEVLMYIFRWVVSSDLDLRSLEQLSLVCRGFYICARDPEIWRLACLKVWGRSCIKLVPYTSWREMFLERPRVRFDGVYISKTTYIRQGEQSLDGFYRAWHQVEYYRYIRFFPDGHVMMLTTPEEPQSIVPRLRTRNTRTDAILLGHYRLSQDTDNQTKVFAVITKKKEEKPLDYKYRYFRRVPVQEADQSFHVGLQPFRYSHLGTAI

SEQ ID NO: 891336 - protein, 315 aa, Homo sapiens [sequence omitted]

SEQ ID NO: 891337 - protein, 239 aa, Homo sapiens
RRFTRAEKASRGSRVLRALKDPEIWRLACLKVWGRSCIKLVPYTSWREMFLERPRVRFDGVYISKTTYIRQGEQSLDGFYRAWHQVEYYRYIRFFPDGHVMMLTTPEEPQSIVPRLRTRNTRTDAILLGHYRLSQDTDNQTKVFAVITKKKEEKPLDYKYRYFRRVPVQEADQSFHVGLQLCSSGHQRFNKLIWIHHSCHITYKSTGETAVSAFEIDKMYTPLFFARVRSYTAFSERPL

SEQ ID NO: 891338 - protein, 181 aa, Homo sapiens
MGVYISKTTYIRQGEQSLDGFYRAWHQVEYYRYIRFFPDGHVMMLTTPEEPQSIVPRLRTRNTRTDAILLGHYRLSQDTDNQTKVFAVITKKKEEKPLDYKYRYFRRVPVQEADQSFHVGLQLCSSGHQRFNKLIWIHHSCHITYKSTGETAVSAFEIDKMYTPLFFARVRSYTAFSERPL

SEQ ID NO: 891339 - protein, 315 aa, Homo sapiens [sequence omitted]

SEQ ID NO: 891340 - protein, 271 aa, Homo sapiens
MAEAEEDCHSDTVRADDDEENESPAETDLQAQLQMFRAQWMFELAPGVSSSNLENRPCRAARGSLQKTSADTKGKQEQAKEEKARELFLKAVEEEQNGALYEAIKFYRRAMQLVPDIEFKITYTRSPDGDGVGNSYIEDNDDDSKMADLLSYFQQQLTFQESVLKLCQPELESSQIHISVLPMEVLMYIFRWVVSSDLDLRSLEQLSLVCRGFYICARDPEIWRLACLKVWGRSCIKLVPYTSWREMFLERPRVRFDGKLDSVELSRNTDL

SEQ ID NO: 891341 - protein, 117 aa, Homo sapiens [sequence omitted]

SEQ ID NO: 891342 - protein, 111 aa, Homo sapiens
SNFGRGRGYDCCHMAHEHGHEHGHHKMELPDYRQWKIEGTPLETIQKKLAAKGLRDPWGRNEAWRYMGGFAKSVSFSDVFFKGFKWGFAAFVVAVGAEYYLESLNKDKKHH

SEQ ID NO: 891343 - protein, 111 aa, Homo sapiens; identical to SEQ ID NO: 891342

SEQ ID NO: 891344 - protein, 112 aa, Homo sapiens
MAQVECPERSDCCHMAHEHGHEHGHHKMELPDYRQWKIEGTPLETIQKKLAAKGLRDPWGRNEAWRYMGGFAKSVSFSDVFFKGFKWGFAAFVVAVGAEYYLESLNKDKKHH

SEQ ID NO: 891345 - protein, 96 aa, Homo sapiens
MGGGPRVVTGPGVPRKPGQGTGVGSPHKKRAGTRGSDNPSGFGPPVHTRAQEAHTPPRGGERQRRKRKKNTRRGKNNGKKERREQKAKKTQHKRHT

SEQ ID NO: 891346 - protein, 269 aa, Homo sapiens
MARASSGNGSEEAWGALRAPQQQLRELCPGVNNQPYLCESGHCCGETGCCTYYYELWWFWLLWTVLILFSCCCAFRHRRAKLRLQQQQRQREINLLAYHGACHGAGPFPTGSLLDLRFLSTFKPPAYEDVVHRPGTPPPPYTVAPGRPLTASSEQTCCSSSSSCPAHFEGTNVEGVSSHQSAPPHQEGEPGAGVTPASTPPSCRYRRLTGDSGIELCPCPASGEGEPVKEVRVSATLPDLEDYSPCALPPESVPQIFPMGLSSSEGDIP

SEQ ID NO: 891347 - protein, 128 aa, Homo sapiens [sequence omitted]

SEQ ID NO: 891348 - protein, 128 aa, Homo sapiens [sequence omitted]

SEQ ID NO: 891349 - protein, 128 aa, Homo sapiens [sequence omitted]

SEQ ID NO: 891350 - protein, 325 aa, Homo sapiens
MCLLSQQSPAASSLEGAIWRRAGTQTRALDAILYHPQQSHLTDSCYSKSSSTLTAFRYFNTPLSILHFPHLSKLNLVHRLRELCPGVNNQPYLCESGHCCGETGCCTYYYELWWFWLLWTVLILFSCCCAFRHRRAKLRLQQQQRQREINLLAYHGACHGAGPFPTGSLLDLRFLSTFKPPAYEDVVHRPGTPPPPYTVAPGRPLTASSEQTCCSSSSSCPAHFEGTNVEGVSSHQSAPPHQEGEPGAGVTPASTPPSCRYRRLTGDSGIELCPCPASGEGEPVKEVRVSATLPDLEDYSPCALPPESVPQIFPMGLSSSEGDIP

SEQ ID NO: 891351 - protein, 128 aa, Homo sapiens [sequence omitted]

SEQ ID NO: 891352 - protein, 325 aa, Homo sapiens
MVASAKMGRAGTMAVAAESPAASSLEGAIWRRAGTQTRALDAILYHPQQSHLCQPFRYFNTPLSILHFPHLSKLNLVHRLRELCPGVNNQPYLCESGHCCGETGCCTYYYELWWFWLLWTVLILFSCCCAFRHRRAKLRLQQQQRQREINLLAYHGACHGAGPFPTGSLLDLRFLSTFKPPAYEDVVHRPGTPPPPYTVAPGRPLTASSEQTCCSSSSSCPAHFEGTNVEGVSSHQSAPPHQEGEPGAGVTPASTPPSCRYRRLTGDSGIELCPCPASGEGEPVKEVRVSATLPDLEDYSPCALPPESVPQIFPMGLSSSEGDIP

SEQ ID NO: 891353 - protein, 303 aa, Homo sapiens
MARASSGNGSEEAWGALRAPQQQSPAASSLEGAIWRRAGTQTRALDAILYHPQQSHLLRELCPGVNNQPYLCESGHCCGETGCCTYYYELWWFWLLWTVLILFSCCCAFRHRRAKLRLQQQQRQREINLLAYHGACHGAGPFPTGSLLDLRFLSTFKPPAYEDVVHRPGTPPPPYTVAPGRPLTASSEQTCCSSSSSCPAHFEGTNVEGVSSHQSAPPHQEGEPGAGVTPASTPPSCRYRRLTGDSGIELCPCPASGEGEPVKEVRVSATLPDLEDYSPCALPPESVPQIFPMGLSSSEGDIP

SEQ ID NO: 891354 - protein, 264 aa, Homo sapiens
MVASAKMGRAGTMAVAAELRELCPGVNNQPYLCESGHCCGETGCCTYYYELWWFWLLWTVLILFSCCCAFRHRRAKLRLQQQQRQREINLLAYHGACHGAGPFPTGSLLDLRFLSTFKPPAYEDVVHRPGTPPPPYTVAPGRPLTASSEQTCCSSSSSCPAHFEGTNVEGVSSHQSAPPHQEGEPGAGVTPASTPPSCRYRRLTGDSGIELCPCPASGEGEPVKEVRVSATLPDLEDYSPCALPPESVPQIFPMGLSSSEGDIP

SEQ ID NO: 891355 - protein, 126 aa, Homo sapiens
MPIFSPAASSEQTCCSSSSSCPAHFEGTNVEGVSSHQSAPPHQEGEPGAGVTPASTPPSCRYRRLTGDSGIELCPCPASGEGEPVKEVRVSATLPDLEDYSPCALPPESVPQIFPMGLSSSEGDIP

SEQ ID NO: 891356 - protein, 262 aa, Homo sapiens
MAAVEACGGSPVTRGILRELCPGVNNQPYLCESGHCCGETGCCTYYYELWWFWLLWTVLILFSCCCAFRHRRAKLRLQQQQRQREINLLAYHGACHGAGPFPTGSLLDLRFLSTFKPPAYEDVVHRPGTPPPPYTVAPGRPLTASSEQTCCSSSSSCPAHFEGTNVEGVSSHQSAPPHQEGEPGAGVTPASTPPSCRYRRLTGDSGIELCPCPASGEGEPVKEVRVSATLPDLEDYSPCALPPESVPQIFPMGLSSSEGDIP

SEQ ID NO: 891357 - protein, 273 aa, Homo sapiens
MSSGGSGCSGLSSSSLAAVAPSATDELNSGCNNSSGSVKSTCWPIMGHAMGLVLSLPVHCLTFVSDLMPWVSYQWPSPNQNPKSSHIPFSTHFKVFFPNIKTSTLYLVVFNQSCQFSPLQGFLSTFKPPAYEDVVHRPGTPPPPYTVAPGRPLTASSEQTCCSSSSSCPAHFEGTNVEGVSSHQSAPPHQEGEPGAGVTPASTPPSCRYRRLTGDSGIELCPCPASGEGEPVKEVRVSATLPDLEDYSPCALPPESVPQIFPMGLSSSEGDIP

SEQ ID NO: 891358 - protein, 269 aa, Homo sapiens; identical to SEQ ID NO: 891346

SEQ ID NO: 891359 - protein, 269 aa, Homo sapiens; identical to SEQ ID NO: 891346

SEQ ID NO: 891360 - protein, 128 aa, Homo sapiens [sequence omitted]

SEQ ID NO: 891361 - protein, 128 aa, Homo sapiens [sequence omitted]

SEQ ID NO: 891362 - protein, 128 aa, Homo sapiens [sequence omitted]

SEQ ID NO: 891363 - protein, 128 aa, Homo sapiens [sequence omitted]

SEQ ID NO: 891364 - protein, 128 aa, Homo sapiens [sequence omitted]

SEQ ID NO: 891365 - protein, 110 aa, Homo sapiens
PVRKFPGRLTTTKLTAASTPDSWKTLDQQQFFTEEELKEYENIIALQENELKKKADELQKQKEELQRQHDQLEAQKLEYHQVIQQMEQKKLQQGIPPSGPAGELKFEPHI

SEQ ID NO: 891366 - protein, 420 aa, Homo sapiens
MRWRTILLQYCFLLITCLLTALEAVPIDIDKTKVQNIHPVESAKIEPPDTGLYYDEYLKQVIDVLETDKHFREKLQKADIEEIKSGRLSKELDLVSHHVRTKLDELKRQEVGRLRMLIKAKLDSLQDIGMDHQALLKQFDHLNHLNPDKFESTDLDMLIKAATSDLEHYDKTRHEEFKKYEMMKEHERREYLKTLNEEKRKEEESKFEEMKKKHENHPKVNHPGSKDQLKEVWEETDGLDPNDFDPKTFFKLHDVNSDGFLDEQELEALFTKELEKVYDPKNEEDDMVEMEEERLRMREHVMNEVDTNKDRLVTLEEFLKATEKKEFLEPDSWETLDQQQFFTEEELKEYENIIALQENELKKKADELQKQKEELQRQHDQLEAQKLEYHQVIQQMEQKKLQQGIPPSGPAGELKFEPHI

SEQ ID NO: 891367 - protein, 421 aa, Homo sapiens
MMRWRTILLQYCFLLITCLLTALEAVPIDIDKTKVQNIHPVESAKIEPPDTGLYYDEYLKQVIDVLETDKHFREKLQKADIEEIKSGRLSKELDLVSHHVRTKLDELKRQEVGRLRMLIKAKLDSLQDIGMDHQALLKQFDHLNHLNPDKFESTDLDMLIKAATSDLEHYDKTRHEEFKKYEMMKEHERREYLKTLNEEKRKEEESKFEEMKKKHENHPKVNHPGSKDQLKEVWEETDGLDPNDFDPKTFFKLHDVNSDGFLDEQELEALFTKELEKVYDPKNEEDDMVEMEEERLRMREHVMNEVDTNKDRLVTLEEFLKATEKKEFLEPDSWETLDQQQFFTEEELKEYENIIALQENELKKKADELQKQKEELQRQHDQLEAQKLEYHQVIQQMEQKKLQQGIPPSGPAGELKFEPHI

SEQ ID NO: 891368 - protein, 424 aa, Homo sapiens
MRWRTILLQYCFLLITCLLTALEAVPIDIDKTKVQNIHPVESAKIEPPDTGLYYDEYLKQVIDVLETDKHFREKLQKADIEEIKSGRLSKELDLVSHHVRTKLDELKRQEVGRLRMLIKAKLDSLQDIGMDHQALLKQFDHLNHLNPDKFESTDLDMLIKAATSDLEHYDKTRHEEFKKYEMMKEHERREYLKTLNEEKRKEEESKFEEMKKKHENHPKVNHPGSKDQLKEVWEETDGLDPNDFDPKTFFKLHDVNSDGFLDEQELEALFTKELEKVYDPKNEEDDMVEMEEERLRMREHVMNEVDTNKDRLVTLEEFLKATEKKEFLEPDSWETLDQQQFFTEEELKEYENIIALQENELKKKADELQKQKEELQRQHDQLEAQKLEYHQVIQQMEQKKLQQGIPPSGPAGELKFEPRPEVSF

SEQ ID NO: 891369 - protein, 420 aa, Homo sapiens
MRWRTILLQYCFLLITCLLTALEAVPIDIDKTKVQNIHPVESAKIEPPDTGLYYDEYLKQVIDVLETDKHFREKLQKADIEEIKSGRLSKELDLVSHHVRTKLDELKRQEVGRLRMLIKAKLDSLQDIGMDHQALLKQFDHLNHLNPDKFESTDLDMLIKAATSDLEHYDKTRHEEFKKYEMMKEHERREYLKTLNEEKRKEEESKFEEMKKKHENHPKVNHPGSKDQLKEVWEETDGLDPNDFDPKTFFKLHDVNSDGFLDEQELEALFTKELEKVYDPKNEEDDMVEMEEERLRMREHVMNEVDTNKDRLVTLEEFLKATEKKEFLEPDSWETLDQQQFFTEEELKEYENIIALQENELKKKADELQKQKEELQRQHDQLEAQKLEYHQVIQQMEQKKLQQGIPPSGPAGELKFEPRV

SEQ ID NO: 891370 - protein, 373 aa, Homo sapiens
SCSEDPRLKESKQVIDVLETDKHFREKLQKADIEEIKSGRLSKELDLVSHHVRTKLDELKRQEVGRLRMLIKAKLDSLQDIGMDHQALLKQFDHLNHLNPDKFESTDLDMLIKAATSDLEHYDKTRHEEFKKYEMMKEHERREYLKTLNEEKRKEEESKFEEMKKKHENHPKVNHPGSKDQLKEVWEETDGLDPNDFDPKTFFKLHDVNSDGFLDEQELEALFTKELEKVYDPKNEEDDMVEMEEERLRMREHVMNEVDTNKDRLVTLEEFLKATEKKEFLEPDSWETLDQQQFFTEEELKEYENIIALQENELKKKADELQKQKEELQRQHDQLEAQKLEYHQVIQQMEQKKLQQGIPPSGPAGELKFEPHI

SEQ ID NO: 891371 - protein, 257 aa, Homo sapiens
PTSHFFTFSRHEEFKKYEMMKEHERREYLKTLNEEKRKEEESKFEEMKKKHENHPKVNHPGSKDQLKEVWEETDGLDPNDFDPKTFFKLHDVNSDGFLDEQELEALFTKELEKVYDPKNEEDDMVEMEEERLRMREHVMNEVDTNKDRLVTLEEFLKATEKKEFLEPDSWETLDQQQFFTEEELKEYENIIALQENELKKKADELQKQKEELQRQHDQLEAQKLEYHQVIQQMEQKKLQQGIPPSGPAGELKFEPHI

SEQ ID NO: 891372 - protein, 227 aa, Homo sapiens
NSRSRRRKEEESKFEEMKKKHENHPKVNHPGSKDQLKEVWEETDGLDPNDFDPKTFFKLHDVNSDGFLDEQELEALFTKELEKVYDPKNEEDDMVEMEEERLRMREHVMNEVDTNKDRLVTLEEFLKATEKKEFLEPDSWETLDQQQFFTEEELKEYENIIALQENELKKKADELQKQKEELQRQHDQLEAQKLEYHQVIQQMEQKKLQQGIPPSGPAGELKFEPHI

SEQ ID NO: 891373 - protein, 390 aa, Homo sapiens
MRWRTILLQYCFLLITCLLTALEAVPIDIDKTKVQNIHPVESAKIEPPDTGLYYDEYLKQVIDVLETDKHFREKLQKADIEEIKSGRLSKELDLVSHHVRTKLDELKRQEVGRLRMLIKAKLDSLQDIGMDHQALLKQFDHLNHLNPDKFESTDLDMLIKAATSDLEHYDKTRHEEFKKYEMMKEHERREYLKTLNEEKRKEEESKFEEMKKKHENHPKVNHPGSKDQLKEVWEETDGLDPNDFDPKTFFKLHDVNSDGFLDEQELEALFTKELEKVYDPKNEEDDMVEMEEERLRMREHVMNETLDQQQFFTEEELKEYENIIALQENELKKKADELQKQKEELQRQHDQLEAQKLEYHQVIQQMEQKKLQQGIPPSGPAGELKFEPHI

SEQ ID NO: 891374 - protein, 341 aa, Homo sapiens
MRWRTILLQYCFLLITCLLTALEAVPIDIDKTKVQNIHPVESAKIEPPDTGLYYDEYLKQVIDVLETDKHFREKLQKADIEEIKSGRLSKELDLVSHHVRTKLDELKRQEVGRLRMLIKAKLDSLQDIGMDHQALLKQFDHLNHLNPDKFESTDLDMLIKAATSDLEHYDKTRHEEFKKYEMMKEHERREYLKTLNEEKRKEEESKFEEMKKKHENHPKVNHPGSKDQLKEVWEETDGLDPNDFDPKTFFKLHDVNSDGFLDEQELEALFTKELEKVYDPKNEEDDMVEMEEERLRMREHVMNESWVPIYIDSNSSMRCVHVALPDLAQGHRIVSAQSHVI

SEQ ID NO: 891375 - protein, 420 aa, Homo sapiens; identical to SEQ ID NO: 891366

SEQ ID NO: 891376 - protein, 420 aa, Homo sapiens; identical to SEQ ID NO: 891366

SEQ ID NO: 891377 - protein, 420 aa, Homo sapiens; identical to SEQ ID NO: 891366

SEQ ID NO: 891378 - protein, 424 aa, Homo sapiens; identical to SEQ ID NO: 891368

SEQ ID NO: 891379 - protein, 347 aa, Homo sapiens
MVQEAEIEEIKSGRLSKELDLVSHHVRTKLDELKRQEVGRLRMLIKAKLDSLQDIGMDHQALLKQFDHLNHLNPDKFESTDLDMLIKAATSDLEHYDKTRHEEFKKYEMMKEHERREYLKTLNEEKRKEEESKFEEMKKKHENHPKVNHPGSKDQLKEVWEETDGLDPNDFDPKTFFKLHDVNSDGFLDEQELEALFTKELEKVYDPKNEEDDMVEMEEERLRMREHVMNEVDTNKDRLVTLEEFLKATEKKEFLEPDSWETLDQQQFFTEEELKEYENIIALQENELKKKADELQKQKEELQRQHDQLEAQKLEYHQVIQQMEQKKLQQGIPPSGPAGELKFEPHI

SEQ ID NO: 891380 - protein, 390 aa, Homo sapiens; identical to SEQ ID NO: 891373

SEQ ID NO: 891381 - protein, 363 aa, Homo sapiens
MRWRTILLQYCFLLITCLLTALEAVPIDIDKTKVQNIHPVESAKIEPPDTGLYYDEYLKQVIDVLETDKHFREKLQKADIEEIKSGRLSKELDLVSHHVRTKLDELKRQEVGRLRMLIKAKLDSLQDIGMDHQALLKQFDHLNHLNPDKFESTDLDMLIKAATSDLEHYDKTRHEEFKKYEMMKEHERREYLKTLNEEKRKEEESKFEEMKKKHENHPKVNHPGSKDQLKEVWEETDGLDPNDFDPKTFFKLHDVNSDGFLDEQELEALFTKELEKVYDPKNEEDDMVEMEEERLRMREHVMNEVDTNKDRLVTLEEFLKATEKKEFLEPDSWEVIQQMEQKKLQQGIPPSGPAGELKFEPHI

SEQ ID NO: 891382 - protein, 385 aa, Homo sapiens
MRWRTILLQYCFLLITCLLTALEAVPIDIDKTKVQNIHPVESAKIEPPDTGLYYDEYLKQVIDVLETDKHFREKLQKADIEEIKSGRLSKELDLVSHHVRTKLDELKRQEVGRLRMLIKAKLDSLQDIGMDHQALLKQFDHLNHLNPDKFESTDLDMLIKAATSDLEHYDKTRHEEFKKYEMMKEHERREYLKTLNEEKRKEEESKFEEMKKKHENHPKVNHPGSKDQLKEVWEETDGLDPNDFDPKTFFKLHDVNSDGFLDEQELEALFTKELDTTYIERLKIDDRWYWVRTLAASKRLRNARDLRMNRRVDTQPKDRNCGNPWTETFGKGPETQKKFLGPQLLGNTLADRECFLKGKNLYDTLTMYCCVYETRVHNNRHWMFS

SEQ ID NO: 891383 - protein, 1182 aa, Homo sapiens
MCSTNPGKWVTFDDDPAVQSSQKSKNFPLENQGVCRPNGLKLNLPGLREFPSGSSSTSSTPLSSPIVDFYFSPGPPSNSPLSTPTKDFPGFPGIPKAGTHVLYPIPESSSDSPLAISGGESSLLPTRPTCLSHALLPSDHSCTHPTPKVGLPDEVNPQQAESLGFQSDDLPQFQYFREDCAFSSPFRKDEGSDSHFTLDPPGSKKMFSSRNKEMPIDQKSLNKCSLNYICEKLEHLQSAENQDSLRSLSMHCLCAEENASSFVPHTLFRSQPKSGWSFMLRIPEKKNMMSSRQWGPIFLKVLPGGILQMYYEQGLEKPFKEIQLDPYCRLSEPKVENFSVAGKIHTVKIEHVSYTEKRKYHSKTEVVHEPDIEQMLKLGSTSYHDFLDFLTTVEEELMKLPAVSKPKKNYEEQEISLEIVDNFWGKVTKEGKFVESAVITQIYCLCFVNGNLECFLTLNDLELPKRDESYYEKDSEKKGIDILDYHFHKCVNVQEFEQSRIIKFVPLDACRFELMRFKTLYNGDNLPFSLKSVVVVQGAYVELQAFVNMASLAQRSSYAGSLRSCDNIRIHFPVPSQWIKALWTMNLQRQKSLKAKMNRRACLGSLQELESEPVIQVTVGSAKYESAYQAVVWKIDRLPDKNSSLDHPHCLSYKLELGSDQEIPSDWYPFATVQFSVPDTCASRTEVRSLGVESDVQPQKHVQQRACYNIQPKLYRSVIEDVIEGVRNLFAEEGIEEQVLKDLKQLWETKVLQSKATEDFFRNSIQSPLFTLQLPHSLHQTLQSSTASLVIPAGRTLPSFTTAELGTSNSSANFTFPGYPIHVPAGVTLQTVSGHLYKVNVPIMVTETSGRAGILQHPIQQVFQQLGQPSVIQTSVPQLNPWSLQATTEKSQRIETVLQQPAILPSGPVDRKHLENATSDILVSPGNEHKIVPEALLCHQESSHYISLPGVVFSPQVSQTNSDVESVLSGSASMAQNLHDESLSTSPHGALHQHVTDIQLHILKNRMYGCDSVKQPRNIEEPSNIPVSEKDSNSQVDLSIRVTDDDIGEIIQVDGSGDTSSNEEIGSTRDADENEFLGNIDGGDLKVPEEEADSISNEDSATNSSDNEDPQVNIVEEDPLNSGDDVSEQDVPDLFDTDNVIVCQYDKIHRSKNKWKFYLKDGVMCFGGRDYVFAKAIGDAEW

SEQ ID NO: 891384 - protein, 501 aa, Homo sapiens
PSVSLRGHCVPRRRKGPGAGGAVMACLNPVPKLYRSVIEDVIEGVRNLFAEEGIEEQVLKDLKQLWETKVLQSKATEDFFRNSIQSPLFTLQLPHSLHQTLQSSTASLVIPAGRTLPSFTTAELGTSNSSANFTFPGYPIHVPAGVTLQTVSGHLYKVNVPIMVTETSGRAGILQHPIQQVFQQLGQPSVIQTSVPQLNPWSLQATTEKSQRIETVLQQPAILPSGPVDRKHLENATSDILVSPGNEHKIVPEALLCHQESSHYISLPGVVFSPQVSQTNSDVESVLSGSASMAQNLHDESLSTSPHGALHQHVTDIQLHILKNRMYGCDSVKQPRNIEEPSNIPVSEKDSNSQVDLSIRVTDDDIGEIIQVDGSGDTSSNEEIGSTRDADENEFLGNIDGGDLKVPEEEADSISNEDSATNSSDNEDPQVNIVEEDPLNSGDDVSEQDVPDLFDTDNVIVCQYDKIHRSKNKWKFYLKDGVMCFGGRDYVFAKAIGDAEW

SEQ ID NO: 891385 - protein, 735 aa, Homo sapiens
MCSTNPGKWVTFDDDPAVQSSQKSKNFPLENQGVCRPNGLKLNLPGLREFPSGSSSTSSTPLSSPIVDFYFSPGPPSNSPLSTPTKDFPGFPGIPKAGTHVLYPIPESSSDSPLAISGGESSLLPTRPTCLSHALLPSDHSCTHPTPKVGLPDEVNPQQAESLGFQSDDLPQFQYFREDCAFSSPFRKDEGSDSHFTLDPPGSKKMFSSRNKEMPIDQKSLNKCSLNYICEKLEHLQSAENQDSLRSLSMHCLCAEENASSFVPHTLFRSQPKSGWSFMLRIPEKKNMMSSRQWGPIFLKVLPGGILQMYYEQGLEKPFKEIQLDPYCRLSEPKVENFSVAGKIHTVKIEHVSYTEKRKYHSKTEVVHEPDIEQMLKLGSTSYHDFLDFLTTVEEELMKLPAVSKPKKNYEEQEISLEIVDNFWGKVTKEGKFVESAVITQIYCLCFVNGNLECFLTLNDLELPKRDESYYEKDSEKKGIDILDYHFHKCVNVQEFEQSRIIKFVPLDACRFELMRFKTLYNGDNLPFSLKSVVVVQGAYVELQAFVNMASLAQRSSYAGSLRSCDNIRIHFPVPSQWIKALWTMNLQRQKSLKAKMNRRACLGSLQELESEPVIQVTVGSAKYESAYQAVVWKIDRLPDKNSSLDHPHCLSYKLELGSDQEIPSDWYPFATVQFSVPDTCASRTEVRSLGVESDVQPQKHVQQRACYNIQVEIEKKWIKIDGEDPDKIGDCITQ

SEQ ID NO: 891386 - protein, 735 aa, Homo sapiens; identical to SEQ ID NO: 891385

SEQ ID NO: 891387 - protein, 735 aa, Homo sapiens; identical to SEQ ID NO: 891385

SEQ ID NO: 891388 - protein, 476 aa, Homo sapiens
PSVSLRGHCVPRRRKGPGAGGAVMACLNPVPKLYRSVIEDVIEGVRNLFAEEGIEEQVLKDLKQLWETKVLQSKATEDFFRNSIQSPLFTLQLPHSLHQTLQSSTASLVIPAGRTLPSFTTAELGTSNSSANFTFPGYPIHVPAGVTLQTVSGHLYKVNVPIMVTETSGRAGILQHPIQQVFQQLGQPSVIQTSVPQLNPWSLQATTEKSQRIETVLQQPAILPSGPVDRKHLENATSDILVSPGNEHKIVPEALLCHQESSHYISLPGVVFSPQVSQTNSDVESVLSGSASMAQNLHDESLSTSPHGALHQHVTDIQLHILKNRMYGCDSVKQPRNIEEPSNIPVSEKDSNSQVDLSIRVTDDDIGEIIQVDGSGDTSSNEEIGSTRDADENEFLGNIDGGDLKVPEEEADSISNEDSATNSSDNEDPQVNIVEEDPLNSGDDVSEQDVPDLFDTDNVIVCQYDKAFPRRTSFNT

SEQ ID NO: 891389 - protein, 129 aa, Homo sapiens
MCSTNPGKWVTFDDDPAVQSSQKSKNFPLENQGVCRPNGLKLNLPGLREFPSGSSSTSSTPLSSPIVDFYFSPGPPSNSPLSTPTKDFPGFPGIPKAGTHVLYPIPESSSDSTSTPAPARIPLAPARIP

SEQ ID NO: 891390 - protein, 437 aa, Homo sapiens
MPKFKAARGVGGQEKHAPLADQILAGNAVRAGVREKRRGRGTGEAEEEYVGPRLSRRILQQARQQQEELEAEHGTGDKPAAPRERTTRLGPRMPQDGSDDEDEEWPTLEKAATMTAAGHHAEVVVDPEDERAIEMFMNKNPPARRTLADIIMEKLTEKQTEVETVMSEVSGFPMPQLDPRVLEVYRGVREVLSKYRSGKLPKAFKIIPALSNWEQILYVTEPEAWTAAAMYQATRIFASNLKERMAQRFYNLVLLPRVRDDVAEYKRLNFHLYMALKKALFKPGAWFKGILIPLCESGTCTLREAIIVGSIITKCSIPVLHSSAAMLKIAEMEYSGANSIFLRLLLDKKYALPYRVLDALVFHFLGFRTEKRELPVLWHQCLLTLVQRYKADLATDQKEALLELLRLQPHPQLSPEIRRELQSAVPRDVEDVPITVE

SEQ ID NO: 891391 - protein, 437 aa, Homo sapiens; identical to SEQ ID NO: 891390

SEQ ID NO: 891392 - protein, 437 aa, Homo sapiens; identical to SEQ ID NO: 891390

SEQ ID NO: 891393 - protein, 437 aa, Homo sapiens; identical to SEQ ID NO: 891390

SEQ ID NO: 891394 - protein, 32 aa, Homo sapiens
MPKFKAARGVGGQEKHAPLADQILAGNAVRAG

SEQ ID NO: 891395 - protein, 437 aa, Homo sapiens; identical to SEQ ID NO: 891390

SEQ ID NO: 891396 - protein, 445 aa, Homo sapiens
MPKFKAARGVGGQEKHAPLADQILAGNAVRAGVREKRRGRGTGEAEEEYVGPRLSRRILQQARQQQEELEAEHGTGDKPAAPRERTTRLGPRMPQDGSDDEDEEWPTLEKAATMTAAGHHAEVVVDPEDERAIEMFMNKNPPARRTLADIIMEKLTEKQTEVETVMSEVSGFPMPQLDPRVLEVYRGVREVLSKYRSGKLPKAFKIIPALSNWEQILYVTEPEAWTAAAMYQATRIFASNLKERMAQRFYNLVLLPRVRDDVAEYKRLNFHLYMALKKALFKPGAWFKVAALCLSLGILIPLCESGTCTLREAIIVGSIITKCSIPVLHSSAAMLKIAEMEYSGANSIFLRLLLDKKYALPYRVLDALVFHFLGFRTEKRELPVLWHQCLLTLVQRYKADLATDQKEALLELLRLQPHPQLSPEIRRELQSAVPRDVEDVPITVE

SEQ ID NO: 891397 - protein, 391 aa, Homo sapiens
MTDGVSTRSDAKRIGHELTAWGLRACMPQRYILGAETRAAITCTERRADTLGAGEQKTAWADQTEETQATTGVRSEGMPSRMASTSDRRDAGTLATPEDSSMRNTIEQLSRGSISADQSLALGHSQGMSRASRDGSGTKEPSCQVLSKYRSGKLPKAFKIIPALSNWEQILYVTEPEAWTAAAMYQATRIFASNLKERMAQRFYNLVLLPRVRDDVAEYKRLNFHLYMALKKALFKPGAWFKGILIPLCESGTCTLREAIIVGSIITKCSIPVLHSSAAMLKIAEMEYSGANSIFLRLLLDKKYALPYRVLDALVFHFLGFRTEKRELPVLWHQCLLTLVQRYKADLATDQKEALLELLRLQPHPQLSPEIRRELQSAVPRDVEDVPITVE

SEQ ID NO: 891398 - protein, 424 aa, Homo sapiens
MASDDFDIVIEAMLEAPYKKEEDEQQRKEVKKDYPSNTTSSTSNSGNETSGSSTIGETSNRSRDRDRYRRRNSRSRSPGRQCRHRSRSWDRRHGSESRSRDHRREDRVHYRSPPLATGYRYGHSKSPHFREKSPVREPVDNLSPEERDARTVFCMQLAARIRPRDLEDFFSAVGKVRDVRIISDRNSRRSKGIAYVEFCEIQSVPLAIGLTGQRLLGVPIIVQASQAEKNRLAAMANNLQKGNGGPMRLYVGSLHFNITEDMLRGIFEPFGKIDNIVLMKDSDTGRSKGYGFITFSDSECARRALEQLNGFELAGRPMRVGHVTERLDGGTDITFPDGDQELDLGSAGGRFQLMAKLAEGAGIQLPSTAAAAAAAAAAQAAALQLNGAVPLGALNPAALTALSPALNLASQCFQLSSLFTPQTM

SEQ ID NO: 891399 - protein, 406 aa, Homo sapiens
MASDDFDIVIEAMLEAPYKKEEDEQQRKEVKKDYPSNTTSSTSNSGNETSGSSTIGETSNRSRDRDRYRRRNSRSRSPGRQCRHRSRSWDRRHGSESRSRDHRREDRVHYRSPPLATGEPVDNLSPEERDARTVFCMQLAARIRPRDLEDFFSAVGKVRDVRIISDRNSRRSKGIAYVEFCEIQSVPLAIGLTGQRLLGVPIIVQASQAEKNRLAAMANNLQKGNGGPMRLYVGSLHFNITEDMLRGIFEPFGKIDNIVLMKDSDTGRSKGYGFITFSDSECARRALEQLNGFELAGRPMRVGHVTERLDGGTDITFPDGDQELDLGSAGGRFQLMAKLAEGAGIQLPSTAAAAAAAAAAQAAALQLNGAVPLGALNPAALTALSPALNLASQCFQLSSLFTPQTM

SEQ ID NO: 891400 - protein, 424 aa, Homo sapiens; identical to SEQ ID NO: 891398

SEQ ID NO: 891401 - protein, 424 aa, Homo sapiens; identical to SEQ ID NO: 891398

SEQ ID NO: 891402 - protein, 424 aa, Homo sapiens; identical to SEQ ID NO: 891398

SEQ ID NO: 891403 - protein, 440 aa, Homo sapiens
MASDDFDIVIEAMLEAPYKKEEDEQQRKEVKKDYPSNTTSSTSNSGNETSGSSTIGETSKKKRSRSHNKSRDRKRSRSRDRDRYRRRNSRSRSPGRQCRHRSRSWDRRHGSESRSRDHRREDRVHYRSPPLATGYRYGHSKSPHFREKSPVREPVDNLSPEERDARTVFCMQLAARIRPRDLEDFFSAVGKVRDVRIISDRNSRRSKGIAYVEFCEIQSVPLAIGLTGQRLLGVPIIVQASQAEKNRLAAMANNLQKGNGGPMRLYVGSLHFNITEDMLRGIFEPFGKIDNIVLMKDSDTGRSKGYGFITFSDSECARRALEQLNGFELAGRPMRVGHVTERLDGGTDITFPDGDQELDLGSAGGRFQLMAKLAEGAGIQLPSTAAAAAAAAAAQAAALQLNGAVPLGALNPAALTALSPALNLASQCFQLSSLFTPQTM

SEQ ID NO: 891404 - protein, 424 aa, Homo sapiens; identical to SEQ ID NO: 891398

SEQ ID NO: 891405 - protein, 424 aa, Homo sapiens; identical to SEQ ID NO: 891398

SEQ ID NO: 891406 - protein, 270 aa, Homo sapiens
MQLAARIRPRDLEDFFSAVGKVRDVRIISDRNSRRSKGIAYVEFCEIQSVPLAIGLTGQRLLGVPIIVQASQAEKNRLAAMANNLQKGNGGPMRLYVGSLHFNITEDMLRGIFEPFGKIDNIVLMKDSDTGRSKGYGFITFSDSECARRALEQLNGFELAGRPMRVGHVTERLDGGTDITFPDGDQELDLGSAGGRFQLMAKLAEGAGIQLPSTAAAAAAAAAAQAAALQLNGAVPLGALNPAALTALSPALNLASQCFQLSSLFTPQTM

SEQ ID NO: 891407 - protein, 542 aa, Homo sapiens
RAWSNFVFLVETEFLHVGQAGLELSTSGDLPALASQSAGITGVSHRAQPWVLFFLLNDIFVSIHLLLFIPPTAAILPSFHPSQPLVNTSLSIFMRFTLYIMDVLYFYTTGSAVGNEFGLHQYHHKHISNTLRHYSGCNITRLYELLSTVIILWDHCVYALGCWPKHDVGMTVVVSLCSRSRDRDRYRRRNSRSRSPGRQCRHRSRSWDRRHGSESRSRDHRREDRVHYRSPPLATGYRYGHSKSPHFREKSPVREPVDNLSPEERDARTVFCMQLAARIRPRDLEDFFSAVGKVRDVRIISDRNSRRSKGIAYVEFCEIQSVPLAIGLTGQRLLGVPIIVQASQAEKNRLAAMANNLQKGNGGPMRLYVGSLHFNITEDMLRGIFEPFGKIDNIVLMKDSDTGRSKGYGFITFSDSECARRALEQLNGFELAGRPMRVGHVTERLDGGTDITFPDGDQELDLGSAGGRFQLMAKLAEGAGIQLPSTAAAAAAAAAAQAAALQLNGAVPLGALNPAALTALSPALNLASQCFQLSSLFTPQTM

SEQ ID NO: 891408 - protein, 270 aa, Homo sapiens; identical to SEQ ID NO: 891406

SEQ ID NO: 891409 - protein, 422 aa, Homo sapiens
MASDDFDIVIEAMLEAPYKKEEDEQQRKEVKKDYPSNTTSSTSNSGNETSGSSTIGETSKKKRSRSHNKSRDRKRSRSRDRDRYRRRNSRSRSPGRQCRHRSRSWDRRHGSESRSRDHRREDRVHYRSPPLATGEPVDNLSPEERDARTVFCMQLAARIRPRDLEDFFSAVGKVRDVRIISDRNSRRSKGIAYVEFCEIQSVPLAIGLTGQRLLGVPIIVQASQAEKNRLAAMANNLQKGNGGPMRLYVGSLHFNITEDMLRGIFEPFGKIDNIVLMKDSDTGRSKGYGFITFSDSECARRALEQLNGFELAGRPMRVGHVTERLDGGTDITFPDGDQELDLGSAGGRFQLMAKLAEGAGIQLPSTAAAAAAAAAAQAAALQLNGAVPLGALNPAALTALSPALNLASQCFQLSSLFTPQTM

SEQ ID NO: 891410 - protein, 270 aa, Homo sapiens; identical to SEQ ID NO: 891406

SEQ ID NO: 891411 - protein, 270 aa, Homo sapiens; identical to SEQ ID NO: 891406

SEQ ID NO: 891412 - protein, 270 aa, Homo sapiens; identical to SEQ ID NO: 891406

SEQ ID NO: 891413 - protein, 304 aa, Homo sapiens
MTRYWEGWSQHISLFREPVDNLSPEERDARTVFCMQLAARIRPRDLEDFFSAVGKVRDVRIISDRNSRRSKGIAYVEFCEIQSVPLAIGLTGQRLLGVPIIVQASQAEKNRLAAMANNLQKGNGGPMRLYVGSLHFNITEDMLRGIFEPFGKIDNIVLMKDSDTGRSKGYGFITFSDSECARRALEQLNGFELAGRPMRVGHVTERLDGGTDITFPDGDQELDLGSAGGRFQLMAKLAEGAGIQLPSTAAAAAAAAAAQAAALQLNGAVPLGALNPAALTALSPALNLASQCFQLSSLFTPQTM

SEQ ID NO: 891414 - protein, 250 aa, Homo sapiens
MVRDVRIISDRNSRRSKGIAYVEFCEIQSVPLAIGLTGQRLLGVPIIVQASQAEKNRLAAMANNLQKGNGGPMRLYVGSLHFNITEDMLRGIFEPFGKIDNIVLMKDSDTGRSKGYGFITFSDSECARRALEQLNGFELAGRPMRVGHVTERLDGGTDITFPDGDQELDLGSAGGRFQLMAKLAEGAGIQLPSTAAAAAAAAAAQAAALQLNGAVPLGALNPAALTALSPALNLASQCFQLSSLFTPQTM

SEQ ID NO: 891415 - protein, 227 aa, Homo sapiens
NRLGRGRVLNRHRGGQRLLGVPIIVQASQAEKNRLAAMANNLQKGNGGPMRLYVGSLHFNITEDMLRGIFEPFGKIDNIVLMKDSDTGRSKGYGFITFSDSECARRALEQLNGFELAGRPMRVGHVTERLDGGTDITFPDGDQELDLGSAGGRFQLMAKLAEGAGIQLPSTAAAAAAAAAAQAAALQLNGAVPLGALNPAALTALSPALNLASQCFQLSSLFTPQTM

SEQ ID NO: 891416 - protein, 424 aa, Homo sapiens; identical to SEQ ID NO: 891398

SEQ ID NO: 891417 - protein, 116 aa, Homo sapiens
SVLGDLEDPGIEWHVTERLDGGTDITFPDGDQELDLGSAGGRFQLMAKLAEGAGIQLPSTAAAAAAAAAAQAAALQLNGAVPLGALNPAALTALSPALNLASQCFQLSSLFTPQTM

SEQ ID NO: 891418 - protein, 424 aa, Homo sapiens; identical to SEQ ID NO: 891398

SEQ ID NO: 891419 - protein, 130 aa, Homo sapiens
SQQLPASSLGGVTVRHECWVTGPQRRCTGWFEYLGSSNPSAVAAGPVLDLGSAGGRFQLMAKLAEGAGIQLPSTAAAAAAAAAAQAAALQLNGAVPLGALNPAALTALSPALNLASQCFQLSSLFTPQTM

SEQ ID NO: 891420 - protein, 101 aa, Homo sapiens
MVTRDELEARTSVLARPVLDLGSAGGRFQLMAKLAEGAGIQLPSTAAAAAAAAAAQAAALQLNGAVPLGALNPAALTALSPALNLASQCFQLSSLFTPQTM

SEQ ID NO: 891421 - protein, 194 aa, Homo sapiens
MASDDFDIVIEAMLEAPYKKEEDEQQRKEVKKDYPSNTTSSTSNSGNETSGSSTIGETSNRSRDRDRYRRRNSRSRSPGRQCRHRSRSWDRRHGSESRSRDHRREDRVHYRSPPLATGYRYGHSKSPHFREKSPVSSESSPEPCLPVFPALQPLYPPDHVNQWHSILPPCASGSCHFTSTLPWPHFSILWTKPS

SEQ ID NO: 891422 - protein, 424 aa, Homo sapiens; identical to SEQ ID NO: 891398

SEQ ID NO: 891423 - protein, 424 aa, Homo sapiens; identical to SEQ ID NO: 891398

SEQ ID NO: 891424 - protein, 424 aa, Homo sapiens; identical to SEQ ID NO: 891398

SEQ ID NO: 891425 - protein, 424 aa, Homo sapiens; identical to SEQ ID NO: 891398

SEQ ID NO: 891426 - protein, 122 aa, Homo sapiens
MASDDFDIVIEAMLEAPYKKEEDEQQRKEVKKDYPSNTTSSTSNSGNETSGSSTIGETSKKKRSRSHNKSRDRKRRSVILGQAQWLVSLILALWKPRREDHFRPGVQNQPGQHSKILSLQKI

SEQ ID NO: 891427 - protein, 280 aa, Homo sapiens
MASDDFDIVIEAMLEAPYKKEEDEQQRKEVKKDYPSNTTSSTSNSGNETSGSSTIGETSNRSRDRDRYRRRNSRSRSPGRQCRHRSRSWDRRHGSESRSRDHRREDRVHYRSPPLATGYRYGHSKSPHFREKSPVREPVDNLSPEERDARTVFCMQLAARIRPRDLEDFFSAVGKVRDVRIISDRNSRRSKGIAYVEFCEIQSVPLAIGLTGQRLLGVPIIVQASQAEKNRLAAMANNLQKGNGGPMRLYVGSLHFNITEDMLRGIFEPFGKVSRSERNL

SEQ ID NO: 891428 - protein, 43 aa, Homo sapiens
MANNLQKGNGGPMRLYVGSLHFNITEDMLRGIFEPFGKVSRSE

SEQ ID NO: 891429 - protein, 105 aa, Homo sapiens
SHAQAPGWCGGHRSHASAEVPPPEPRQPEGRPEDNGGEADPGCGNLQESSALDAPDRPLGSNNDKVSSGSGFILTCGFIFQHLSTLIQAQLVGFVTPQRTPSQMP

SEQ ID NO: 891430 - protein, 212 aa, Homo sapiens
AAAADSAQWLSVKEETIFLHDGLIRVTDLAELPSEILGAPEAADTDLEILTFETKNPSELAERLRSVCGNQSNAYARLLEYRLNALRGLWNAQRQLALEEQHERESSGGFKFFFSPQTERNRDIIRRSGLLLWQLLMAPKDQICPEIQKEVCLAISSGLNILYPGETEINNLLKLVLTEGERNSGLSQLRDVILTNLAEQLQNNRFGSDEDD

SEQ ID NO: 891431 - protein, 482 aa, Homo sapiens
RRAAADSAQWLSVKEETIFLHDGLIRVTDLAELPSEILGAPEAADTDLEILTFETKNPSELAERLRSVCGNQSNAYARLLEYRLNALRGLWNAQRQLALEEQHERESSGDEETLALLKRQGLLQQPEQAPFTSRMGLLLVFPLIQSQSRTDPSLCNITAEVLLNCLRDCQPLSLTKEPADCLNGIETLLCSWLEETSDTGRHIPHKQKENAAAALVALACARGSLKTFVHTVHLLQKQTDLGSLPVADVLYRLLLLEGGPGSPSCLLGGKHIVSWGYEDMLPAPDSNTGSSSENKDADLGRCLTADGLYLYTTNSVGRGVSKLGSGLHGTLRGFVYCRNEELEPGWVAFGSGSLLHRPVSFDNKPHSLFQVIDQNTLQVCQVVPMPANHLPIGSTMSTVHLSSDGTYFYWIWSPASLNEKTPKGHSVFMDIFELVVENGVFVANPLQERTILMRKEGESAKSINEMLLSRLSRYRASPSATL

SEQ ID NO: 891432 - protein, 476 aa, Homo sapiens
RRAAADSAQWLSVKEETIFLHDGLIRVTDLAELPSEILGAPEAADTDLEILTFETKNPSELAERLRSVCGNQSNAYARLLEYRLNALRGLWNAQRQLALEEQHERESSGDEETLALLKRQGLLQQPEQAPFTSRMGLLLVFPLIQSQSRTDPSLCNITAEVLLNCLRDCQPLSLTKEPADCLNGIETLLCSWLEETSDTGRHIPHKQKENAAAALVALACARGSLKTFVHTVHLLQKQTDLGSLPVADVLYRLLLLEGGPGSPSCLLGGKHIVSWGYEDMLPAPDSNTGSSSENKDADLGRCLTADGLYLYTTNSVGRGVSKLGSGLHGTLRGFVYCRNEELEPGWVAFGSGSLLHRPVSFDNKPHSLFQVIDQNTLQVCQVVPMPANHLPIGSTMSTVHLSSDGTYFYWIWSPASLNEKTPKGHSVFMDIFELVTGFRYVASASLELLDSSSPACLVFPKCCGCRYEPLRPPVLE

SEQ ID NO: 891433 - protein, 221 aa, Homo sapiens
MLWTCSNDYIDQWCNPGNQAFHYVCQRLGVSHIITEPKEEAITTNEVINQLLHHVGAMCIHQLNLLATNPNLPITSVLGKQHPIEAHHLSSICDIMEKAMVNGDTCIIRCILVVFQVVFKFFFSPQTERNRDIIRRSGLLLWQLLMAPKDQICPEIQKEVCLAISSGLNILYPGETEINNLLKLVLTEGERNSGLSQLRDVILTNLAEQLQNNRFGSDEDD

SEQ ID NO: 891434 - protein, 1188 aa, Homo sapiens
MQFETLRQVCNSVLSHFHGVFSSPPNILQNELFGQTLNNARKRSPSVSRDQNRRYDQREEREEYSQYATSDTAMPRSPSDYADRRSQHEPQFYEDSDHLSYRDSNRRSHRHSKEYIVDDEDVESRDEYERQRREEEYQSRYRSDPNLARYPVKPQPYEEQMRIHAEVSRARHERRHSDVSLANADLEDSRISMLRMDRPSRQRSISERRAAMENQRSYSMERTREAQGPSSYAQRTTNHSPPTPRRSPLPIDRPDLRRTDSLRKQHHLDPSSAVRKTKREKMETMLRNDSLSSDQSESVRPPPPKPHKSKKGGKMRQISLSSSEEELASTPEYTSCDDVEIESESVSEKGDSQKGKRKTSEQAVLSDSNTRSERQKEMMYFGGHSLEEDLEWSEPQIKDSGVDTCSSTTLNEEHSHSDKHPVTWQPSKDGDRLIGRILLNKRLKDGSVPRDSGAMLGLKVVGGKMTESGRLCAFITKVKKGSLADTVGHLRPGDEVLEWNGRLLQGATFEEVYNIILESKPEPQVELVVSRPIGDIPRIPDSTHAQLESSSSSFESQKMDRPSISVTSPMSPGMLRDVPQFLSGQLSIKLWFDKVGHQLIVTILGAKDLPSREDGRPRNPYVKIYFLPDRSDKNKRRTKTVKKTLEPKWNQTFIYSPVHRREFRERMLEITLWDQARVREEESEFLGEILIELETALLDDEPHWYKLQTHDVSSLPLPHPSPYMPRRQLHGESPTRRLQRSKRISDSEVSDYDCDDGIGVVSDYRHDGRDLQSSTLSVPEQVMSSNHCSPSGSPHRVDVIGRTRSWSPSVPPPQSRNVEQGLRGTRTMTGHYNTISRMDRHRVMDDHYSPDRDRIVKQQIDSHITDPDQQNNGLSLRRTTTRSRSTERPDTNLMRSMPSLMTGRSAPPSPALSRSHPRTGSVQTSPSSTPVAGRRGRQLPQLPPKGTLDRKAGGKKLRSTVQRSTETGLAVEMRNWMTRQASRESTDGSMNSYSSEGNLIFPGVRLASDSQFSDFLDGLGPAQLVGRQTLATPAMGDIQVGMMDKKGQLEVEIIRARGLVVKPGSKTLPAPYVKVYLLDNGVCIAKKKTKVARKTLEPLYQQLLSFEESPQGKVLQIIVWGDYGRMDHKSFMGVAQILLDELELSNMVIGWFKLFPPSSLVDPTLAPLTRRASQSSLESSTGPSYSRS

SEQ ID NO: 891435 - protein, 1188 aa, Homo sapiens; identical to SEQ ID NO: 891434

SEQ ID NO: 891436 - protein, 1210 aa, Homo sapiens
MQFETLRQVCNSVLSHFHGVFSSPPNILQNELFGQTLNNARKRSPSVSRDQNRRYDQREEREEYSQYATSDTAMPRSPSDYADRRSQHEPQFYEDSDHLSYRDSNRRSHRHSKEYIVDDEDVESRDEYERQRREEEYQSRYRSDPNLARYPVKPQPYEEQMRIHAEVSRARHERRHSDVSLANADLEDSRISMLRMDRPSRQRSISERRAAMENQRSYSMERTREAQGPSSYAQRTTNHSPPTPRRSPLPIDRPDLRRTDSLRKQHHLDPSSAVRKTKREKMETMLRNDSLSSDQSESVRPPPPKPHKSKKGGKMRQISLSSSEEELASTPEYTSCDDVEIESESVSEKGDSQKGKRKTSEQAVLSDSNTRSERQKEMMYFGGHSLEEDLEWSEPQIKDSGVDTCSSTTLNEEHSHSDKHPVTWQPSKDGDRLIGRILLNKRLKDGSVPRDSGAMLGLKVVGGKMTESGRLCAFITKVKKGSLADTVGHLRPGDEVLEWNGRLLQGATFEEVYNIILESKPEPQVELVVSRPIGDIPRIPDSTHAQLESSSSSFESQKMDRPSISVTSPMSPGMLRDVPQFLSGQLSIKLWFDKVGHQLIVTILGAKDLPSREDGRPRNPYVKIYFLPDRSDKNKRRTKTVKKTLEPKWNQTFIYSPVHRREFRERMLEITLWDQARVREEESEFLGEILIELETALLDDEPHWYKLQTHDVSSLPLPHPSPYMPRRQLHGESPTRRLQRSKRISDSEVSDYDCDDGIGVVSDYRHDGRDLQSSTLSVPEQVMSSNHCSPSGSPHRVDVIGRTRSWSPSVPPPQSRNVEQGLRGTRTMTGHYNTISRMDRHRVMDDHYSPDRDSHFLTLPRSRYSQTIDHHHRDGRDCEAADRQPYHRSRSTEQRPLLERTTTRSRSTERPDTNLMRSMPSLMTGRSAPPSPALSRSHPRTGSVQTSPSSTPVAGRRGRQLPQLPPKGTLDRKAGGKKLRSTVQRSTETGLAVEMRNWMTRQASRESTDGSMNSYSSEGNLIFPGVRLASDSQFSDFLDGLGPAQLVGRQTLATPAMGDIQVGMMDKKGQLEVEIIRARGLVVKPGSKTLPAPYVKVYLLDNGVCIAKKKTKVARKTLEPLYQQLLSFEESPQGKVLQIIVWGDYGRMDHKSFMGVAQILLDELELSNMVIGWFKLFPPSSLVDPTLAPLTRRASQSSLESSTGPSYSRS

SEQ ID NO: 891437 - protein, 314 aa, Homo sapiens
MQSRQMGISGKNMTKSTSISGDMCSLEKNDGSQSDTAVGTLGTSGKKRRSSLGAKMVAIVGLSRKSRSASQLSQTGKAGGKKLRSTVQRSTETGLAVEMRNWMTRQASRESTDGSMNSYSSEGNLIFPGVRLASDSQFSDFLDGLGPAQLVGRQTLATPAMGDIQVGMMDKKGQLEVEIIRARGLVVKPGSKTLPAPYVKVYLLDNGVCIAKKKTKVARKTLEPLYQQLLSFEESPQGKVLQIIVWGDYGRMDHKSFMGVAQILLDELELSNMVIGWFKLFPPSSLVDPTLAPLTRRASQSSLESSTGPSYSRS

SEQ ID NO: 891438 - protein, 144 aa, Homo sapiens
MQSRQMGISGKNMTKSTSISGDMCSLEKNDGSQSDTAVGTLGTSGKKRRSSLGAKMVAIVGLSRKSRSASQLSQTGTGSDPRLEQDYHSKYRSGWDPHRGADNVSTSSDSDVSDISAVQGLVVLLVSAAQATCLSNQNAQDRSA

SEQ ID NO: 891439 - protein, 1188 aa, Homo sapiens; identical to SEQ ID NO: 891434

SEQ ID NO: 891440 - protein, 815 aa, Homo sapiens
MQFETLRQVCNSVLSHFHGVFSSPPNILQNELFGQTLNNARKRSPSVSRDQNRRYDQREEREEYSQYATSDTAMPRSPSDYADRRSQHEPQFYEDSDHLSYRDSNRRSHRHSKEYIVDDEDVESRDEYERQRREEEYQSRYRSDPNLARYPVKPQPYEEQMRIHAEVSRARHERRHSDVSLANADLEDSRISMLRMDRPSRQRSISERRAAMENQRSYSMERTREAQGPSSYAQRTTNHSPPTPRRSPLPIDRPDLRRTDSLRKQHHLDPSSAVRKTKREKMETMLRNDSLSSDQSESVRPPPPKPHKSKKGGKMRQISLSSSEEELASTPEYTSCDDVEIESESVSEKGDSQKGKRKTSEQAVLSDSNTRSERQKEMMYFGGHSLEEDLEWSEPQIKDSGVDTCSSTTLNEEHSHSDKHPVTWQPSKDGDRLIGRILLNKRLKDGSVPRDSGAMLGLKVVGGKMTESGRLCAFITKVKKGSLADTVGHLRPGDEVLEWNGRLLQGATFEEVYNIILESKPEPQVELVVSRPIGDIPRIPDSTHAQLESSSSSFESQKMDRPSISVTSPMSPGMLRDVPQFLSGQLSIKLWFDKVGHQLIVTILGAKDLPSREDGRPRNPYVKIYFLPDRSDKNKRRTKTVKKTLEPKWNQTFIYSPVHRREFRERMLEITLWDQARVREEESEFLGEILIELETALLDDEPHWYKLQTHDVSSLPLPHPSPYMPRRQLHGESPTRRLQRSKRISDSEVSDYDCDDGIGVVSDYRHDGRDLQSSTLSVPEQVMSSNHCSPSGSPHRVDVIGRTRSWSPSVPPPQR

SEQ ID NO: 891441 - protein, 814 aa, Homo sapiens
MQDAENVAVPEAAEERAEPGQQQPAAEPPPAEGLLRPAGPGAPEAAGTEASSEEVGIAEAGPEPEVRTEPAAEAEAASGPSESPSPPAAEELPGSHAEPPVPAQGEAPGEQARDERSDSRAQAVSEDAGGNEGRAAEAEPRALENGDADEPSFSDPEDFVDDVSEEELLGDVLKDRPQEADGIDSVIVVDNVPQVGPDRLEKLKNVIHKIFSKFGKITNDFYPEEDGKTKGYIFLEYASPAHAVDAVKNADGYKLDKQHTFRVNLFTDFDKYMTISDEWDIPEKQPFKDLGNLRYWLEEAECRDQYSVIFESGDRTSIFWNDVKDPVSIEERARWTETYVRWSPKGTYLATFHQRGIALWGGEKFKQIQRFSHQGVQLIDFSPCERYLVTFSPLMDTQDDPQAIIIWDILTGHKKRGFHCESSAHWPIFKWSHDGKFFARMTLDTLSIYETPSMGLLDKKSLKISGIKDFSWSPGGNIIAFWVPEDKDIPARVTLMQLPTRQEIRVRNLFNVVDCKLHWQKNGDYLCVKVDRTPKGTQGVVTNFEIFRMREKQVPVDVVEMKETIIAFAWEPNGSKFAVLHGEAPRISVSFYHVKNNGKIELIKMFDKQQANTIFWSPQGQFVVLAGLRSMNGALAFVDTSDCTVMNIAEHYMASDVEWDPTGRYVVTSVSWWSHKVDNAYWLWTFQGRLLQKNNKDRFCQLLWRPRPPTLLSQEQIKQIKKDLKKYSKIFEQKDRLSQSKASKELVERRRTMMEDFRKYRKMAQELYMEQKNERLELRGGVDTDELDSNVDDWEEETIEFFVTEEIIPLGNQE

SEQ ID NO: 891442 - protein, 102 aa, Homo sapiens
VERRRTNSFEALELTQTILLFKDRLSQSKASKELVERRRTMMEDFRKYRKMAQELYMEQKNERLELRGGVDTDELDSNVDDWEEETIEFFVTEEIIPLGNQE

SEQ ID NO: 891443 - protein, 104 aa, Homo sapiens
MEKRRKEGLKIGEKMGNMAALPGRETGGQDPTVGAHWVRGKRHPQLLTMSGSCGPAVGVLLSGREQFHVGHSTQVEAAVSETPGMCTFPAVACSPVLLMNFYTS

SEQ ID NO: 891444 - protein, 775 aa, Homo sapiens
MQDAENVAVPEAAEERAEPGQQQPAAEPPPAEGLLRPAGPGAPEAAGTEASSEEVGIAEAGPEPEGEAPGEQARDERSDSRAQAVSEDAGGNEGRAAEAEPRALENGDADEPSFSDPEDFVDDVSEEELLGDVLKDRPQEADGIDSVIVVDNVPQVGPDRLEKLKNVIHKIFSKFGKITNDFYPEEDGKTKGYIFLEYASPAHAVDAVKNADGYKLDKQHTFRVNLFTDFDKYMTISDEWDIPEKQPFKDLGNLRYWLEEAECRDQYSVIFESGDRTSIFWNDVKDPVSIEERARWTETYVRWSPKGTYLATFHQRGIALWGGEKFKQIQRFSHQGVQLIDFSPCERYLVTFSPLMDTQDDPQAIIIWDILTGHKKRGFHCESSAHWPIFKWSHDGKFFARMTLDTLSIYETPSMGLLDKKSLKISGIKDFSWSPGGNIIAFWVPEDKDIPARVTLMQLPTRQEIRVRNLFNVVDCKLHWQKNGDYLCVKVDRTPKGTQGVVTNFEIFRMREKQVPVDVVEMKETIIAFAWEPNGSKFAVLHGEAPRISVSFYHVKNNGKIELIKMFDKQQANTIFWSPQGQFVVLAGLRSMNGALAFVDTSDCTVMNIAEHYMASDVEWDPTGRYVVTSVSWWSHKVDNAYWLWTFQGRLLQKNNKDRFCQLLWRPRPPTLLSQEQIKQIKKDLKKYSKIFEQKDRLSQSKASKELVERRRTMMEDFRKYRKMAQELYMEQKNERLELRGGVDTDELDSNVDDWEEETIEFFVTEEIIPLGNQE

SEQ ID NO: 891445 - protein, 586 aa, Homo sapiens
SPVPEAHDGASPAHAVDAVKNADGYKLDKQHTFRVNLFTDFDKYMTISDEWDIPEKQPFKDLGNLRYWLEEAECRDQYSVIFESGDRTSIFWNDVKDPVSIEERARWTETYVRWSPKGTYLATFHQRGIALWGGEKFKQIQRFSHQGVQLIDFSPCERYLVTFSPLMDTQDDPQAIIIWDILTGHKKRGFHCESSAHWPIFKWSHDGKFFARMTLDTLSIYETPSMGLLDKKSLKISGIKDFSWSPGGNIIAFWVPEDKDIPARVTLMQLPTRQEIRVRNLFNVVDCKLHWQKNGDYLCVKVDRTPKGTQGVVTNFEIFRMREKQVPVDVVEMKETIIAFAWEPNGSKFAVLHGEAPRISVSFYHVKNNGKIELIKMFDKQQANTIFWSPQGQFVVLAGLRSMNGALAFVDTSDCTVMNIAEHYMASDVEWDPTGRYVVTSVSWWSHKVDNAYWLWTFQGRLLQKNNKDRFCQLLWRPRPPTLLSQEQIKQIKKDLKKYSKIFEQKDRLSQSKASKELVERRRTMMEDFRKYRKMAQELYMEQKNERLELRGGVDTDELDSNVDDWEEETIEFFVTEEIIPLGNQE

SEQ ID NO: 891446 - protein, 814 aa, Homo sapiens; identical to SEQ ID NO: 891441

SEQ ID NO: 891447 - protein, 814 aa, Homo sapiens; identical to SEQ ID NO: 891441

SEQ ID NO: 891448 - protein, 443 aa, Homo sapiens
LSIVRGWVWFHLVNRYLVTFSPLMDTQDDPQAIIIWDILTGHKKRGFHCESSAHWPIFKWSHDGKFFARMTLDTLSIYETPSMGLLDKKSLKISGIKDFSWSPGGNIIAFWVPEDKDIPARVTLMQLPTRQEIRVRNLFNVVDCKLHWQKNGDYLCVKVDRTPKGTQGVVTNFEIFRMREKQVPVDVVEMKETIIAFAWEPNGSKFAVLHGEAPRISVSFYHVKNNGKIELIKMFDKQQANTIFWSPQGQFVVLAGLRSMNGALAFVDTSDCTVMNIAEHYMASDVEWDPTGRYVVTSVSWWSHKVDNAYWLWTFQGRLLQKNNKDRFCQLLWRPRPPTLLSQEQIKQIKKDLKKYSKIFEQKDRLSQSKASKELVERRRTMMEDFRKYRKMAQELYMEQKNERLELRGGVDTDELDSNVDDWEEETIEFFVTEEIIPLGNQE

SEQ ID NO: 891449 - protein, 733 aa, Homo sapiens
MQDAENVAVPEAAEERAEPGQQQPAAEPPPAEGLLRPAGPGAPEAAGTEASSEEVGIAEAGPEPEVRTEPAAEAEAASGPSESPSPPAAEELPGSHAEPPVPAQGEAPGEQARDERSDSRAQAVSEDAGGNEGRAAEAEPRALENGDADEPSFSDPEDFVDDVSEEELLGDVLKDRPQEADGIDSVIVVDNVPQVGPDRLEKLKNVIHKIFSKFGKITNDFYPEEDGKTKGYIFLEYASPAHAVDAVKNADGYKLDKQHTFRVNLFTDFDKYMTISDEWDIPEKQPFKDLGNLRYWLEEAECRDQYSVIFESGDRTSIFWNDVKDPVSIEERAKRGFHCESSAHWPIFKWSHDGKFFARMTLDTLSIYETPSMGLLDKKSLKISGIKDFSWSPGGNIIAFWVPEDKDIPARVTLMQLPTRQEIRVRNLFNVVDCKLHWQKNGDYLCVKVDRTPKGTQGVVTNFEIFRMREKQVPVDVVEMKETIIAFAWEPNGSKFAVLHGEAPRISVSFYHVKNNGKIELIKMFDKQQANTIFWSPQGQFVVLAGLRSMNGALAFVDTSDCTVMNIAEHYMASDVEWDPTGRYVVTSVSWWSHKVDNAYWLWTFQGRLLQKNNKDRFCQLLWRPRPPTLLSQEQIKQIKKDLKKYSKIFEQKDRLSQSKASKELVERRRTMMEDFRKYRKMAQELYMEQKNERLELRGGVDTDELDSNVDDWEEETIEFFVTEEIIPLGNQE

SEQ ID NO: 891450 - protein, 814 aa, Homo sapiens; identical to SEQ ID NO: 891441

SEQ ID NO: 891451 - protein, 791 aa, Homo sapiens
MQDAENVAVPEAAEERAEPGQQQPAAEPPPAEGLLRPAGPGAPEAAGTEASSEEVGIAEAGPEPEVRTEPAAEAEAASGPSESPSPPAAEELPGSHAEPPVPAQGEAPGEQARDERSDSRAQAVSEDAGGNEGRAAEAEPRALENGDADEPSFSDPEDFVDDVSEEELLGDVLKDRPQEADGIDSVIVVDNVPQVGPDRLEKLKNVIHKIFSKFGKITNDFYPEEDGKTKGYIFLEYASPAHAVDAVKNADGYKLDKQHTFRVNLFTDFDKYMTISDEWDIPEKQPFKDLGNLRYWLEEAECRDQYSVIFESGDRTSIFWNDVKDPVSIEERARWTETYVRWSPKGTYLATFHQRGIALWGGEKFKQIQRFSHQGVQLIDFSPCERYLVTFSPLMDTQDDPQAIIIWDILTGHKKRGFHCESSAHWPIFKWSHDGKFFARMTLDTLSIYETPSMGLLDKKSLKISGIKDFSWSPGGNIIAFWVPEDKDIPARVTLMQLPTRQEIRVRNLFNVVDCKLHWQKNGDYLCVKVDRTPKGTQGVVTNFEIFRMREKQVPVDVVEMKETIIAFAWEPNGSKFAVLHGEAPRISVSFYHVKNNGKIELIKMFDKQQANTIFWSPQGQFVVLAGLRSMNGALAFVDTSDCTVMNIAEHYMASDVEWDPTGRYVVTSVSWWSHKVDNAYWLWTFQGRLLQKNNKDRFCQLLWRPRPPTLLSQEQIKQIKKDLKKYSKIFEQKDRLSQSKASKELVERRRTMMEDFRKYRKMAQELYMEQKNERLELRGGVDTDELDTKT

SEQ ID NO: 891452 - protein, 319 aa, Homo sapiens [sequence omitted]

SEQ ID NO: 891453 - protein, 299 aa, Homo sapiens
MCVGLLRAPTWLPFIKEALLYGGERNSSKFRDSATKGFSLLTSHLVKETIIAFAWEPNGSKFAVLHGEAPRISVSFYHVKNNGKIELIKMFDKQQANTIFWSPQGQFVVLAGLRSMNGALAFVDTSDCTVMNIAEHYMASDVEWDPTGRYVVTSVSWWSHKVDNAYWLWTFQGRLLQKNNKDRFCQLLWRPRPPTLLSQEQIKQIKKDLKKYSKIFEQKDRLSQSKASKELVERRRTMMEDFRKYRKMAQELYMEQKNERLELRGGVDTDELDSNVDDWEEETIEFFVTEEIIPLGNQE

SEQ ID NO: 891454 - protein, 489 aa, Homo sapiens
MQDAENVAVPEAAEERAEPGQQQPAAEPPPAEGLLRPAGPGAPEAAGTEASSEEVGIAEAGPEPEVRTEPAAEAEAASGPSESPSPPAAEELPGSHAEPPVPAQGEAPGEQARDERSDSRAQAVSEDAGGNEGRAAEAEPRALENGDADEPSFSDPEDFVDDVSEEELLGDVLKDRPQEADGIDSVIVVDNVPQVGPDRLEKLKNVIHKIFSKFGKITNDFYPEEDGKTKGYIFLEYASPAHAVDAVKNADGYKLDKQHTFRVNLFTDFDKYMTISDEWDIPEKQPFKDLGNLRYWLEEAECRDQYSVIFESGDRTSIFWNDVKDPVSIEERARWTETYVRWSPKGTYLATFHQRGIALWGGEKFKQIQRFSHQGVQLIDFSPCERYLVTFSPLMDTQDDPQAIIIWDILTGHKKRGFHCESSAHWPIFKWSHDGKFFARMTLDTLSIYETPSTTSKTTGRLNSSRCSTSSRRTPSSGAPKDSSWCWRA

SEQ ID NO: 891455 - protein, 360 aa, Homo sapiens
DDFPLIVTPDWRIALPRAWILLDVEDVSKSSSVSSKCLKEHQSYQINTIVCEPWTWRSGVACPWLLSKDCEKRRIDCEDTRGKRDGMQVADNRIDRSTRYVLLLVVIEDAERHGLDARVRAEECRRELVVSVVLLHSQNCEMSKDGTPVQMFDKQQANTIFWSPQGQFVVLAGLRSMNGALAFVDTSDCTVMNIAEHYMASDVEWDPTGRYVVTSVSWWSHKVDNAYWLWTFQGRLLQKNNKDRFCQLLWRPRPPTLLSQEQIKQIKKDLKKYSKIFEQKDRLSQSKASKELVERRRTMMEDFRKYRKMAQELYMEQKNERLELRGGVDTDELDSNVDDWEEETIEFFVTEEIIPLGNQE

SEQ ID NO: 891456 - protein, 195 aa, Homo sapiens
MKPDGPVCLCSMNGALAFVDTSDCTVMNIAEHYMASDVEWDPTGRYVVTSVSWWSHKVDNAYWLWTFQGRLLQKNNKDRFCQLLWRPRPPTLLSQEQIKQIKKDLKKYSKIFEQKDRLSQSKASKELVERRRTMMEDFRKYRKMAQELYMEQKNERLELRGGVDTDELDSNVDDWEEETIEFFVTEEIIPLGNQE

SEQ ID NO: 891457 - protein, 218 aa, Homo sapiens
MDFVKLFSEVVQHYQLCPHGQHEHGQSPPALAAPALWKPSQLVTGALFPFRDVRQAAGEHHLLEPPRTVRGVGGPEEYERCLSVCGHFGLHGHEHRRNNKDRFCQLLWRPRPPTLLSQEQIKQIKKDLKKYSKIFEQKDRLSQSKASKELVERRRTMMEDFRKYRKMAQELYMEQKNERLELRGGVDTDELDSNVDDWEEETIEFFVTEEIIPLGNQE

SEQ ID NO: 891458 - protein, 121 aa, Homo sapiens
TSDRVPTSDRVPTSDRVPTSDRVPKQIKKDLKKYSKIFEQKDRLSQSKASKELVERRRTMMEDFRKYRKMAQELYMEQKNERLELRGGVDTDELDSNVDDWEEETIEFFVTEEIIPLGNQE

SEQ ID NO: 891459 - protein, 583 aa, Homo sapiens
MQDAENVAVPEAAEERAEPGQQQPAAEPPPAEGLLRPAGPGAPEAAGTEASSEEVGIAEAGPEPEVRTEPAAEAEAASGPSESPSPPAAEELPGSHAEPPVPAQGEAPGEQARDERSDSRAQAVSEDAGGNEGRAAEAEPRALENGDADEPSFSDPEDFVDDVSEEELLGDVLKDRPQEADGIDSVIVVDNVPQVGPDRLEKLKNVIHKIFSKFGKITNDFYPEEDGKTKGYIFLEYASPAHAVDAVKNADGYKLDKQHTFRVNLFTDFDKYMTISDEWDIPEKQPFKDLGNLRYWLEEAECRDQYSVIFESGDRTSIFWNDVKDPVSIEERARWTETYVRWSPKGTYLATFHQRGIALWGGEKFKQIQRFSHQGVQLIDFSPCERYLVTFSPLMDTQDDPQAIIIWDILTGHKKRGFHCESSAHWPIFKWSHDGKFFARMTLDTLSIYETPSMGLLDKKSLKISGIKDFSWSPGGNIIAFWVPEDKDIPARVTLMQLPTRQEIRVRNLFNVVDCKLHWQKNGDYLCVKVDRTPKGTQGVVTNFEIFRMREKQVPVDVVEMKGKLYFSHFEANGAYVLFYSWL

SEQ ID NO: 891460 - protein, 430 aa, Homo sapiens [sequence omitted]

SEQ ID NO: 891461 - protein, 468 aa, Homo sapiens
MQDAENVAVPEAAEERAEPGQQQPAAEPPPAEGLLRPAGPGAPEAAGTEASSEEVGIAEAGPEPEVRTEPAAEAEAASGPSESPSPPAAEELPGSHAEPPVPAQGEAPGEQARDERSDSRAQAVSEDAGGNEGRAAEAEPRALENGDADEPSFSDPEDFVDDVSEEELLGDVLKDRPQEADGIDSVIVVDNVPQVGPDRLEKLKNVIHKIFSKFGKITNDFYPEEDGKTKGYIFLEYASPAHAVDAVKNADGYKLDKQHTFRVNLFTDFDKYMTISDEWDIPEKQPFKDLGNLRYWLEEAECRDQYSVIFESGDRTSIFWNDVKDPVSIEERARWTETYVRWSPKGTYLATFHQRGIALWGGEKFKQIQRFSHQGVQLIDFSPCERYLVTFSPLMDTQDDPQAIIIWDILTGHKKRGFHCESSAHWPIFKWSHDGKFFARMTLDTLSIYETPSMGLLDKKSLKISGIK

SEQ ID NO: 891462 - protein, 814 aa, Homo sapiens; identical to SEQ ID NO: 891441

SEQ ID NO: 891463 - protein, 814 aa, Homo sapiens; identical to SEQ ID NO: 891441

SEQ ID NO: 891464 - protein, 106 aa, Homo sapiens
VKLGARLGGEQIKKDLKKYSKIFEQKDRLSQSKASKELVERRRTMMEDFRKYRKMAQELYMEQKNERLELRGGVDTDELDSNVDDWEEETIEFFVTEEIIPLGNQE

SEQ ID NO: 891465 - protein, 814 aa, Homo sapiens; identical to SEQ ID NO: 891441

SEQ ID NO: 891466 - protein, 492 aa, Homo sapiens
MILEDKTRSKARWTETYVRWSPKGTYLATFHQRGIALWGGEKFKQIQRFSHQGVQLIDFSPCERYLVTFSPLMDTQDDPQAIIIWDILTGHKKRGFHCESSAHWPIFKWSHDGKFFARMTLDTLSIYETPSMGLLDKKSLKISGIKDFSWSPGGNIIAFWVPEDKDIPARVTLMQLPTRQEIRVRNLFNVVDCKLHWQKNGDYLCVKVDRTPKGTQGVVTNFEIFRMREKQVPVDVVEMKETIIAFAWEPNGSKFAVLHGEAPRISVSFYHVKNNGKIELIKMFDKQQANTIFWSPQGQFVVLAGLRSMNGALAFVDTSDCTVMNIAEHYMASDVEWDPTGRYVVTSVSWWSHKVDNAYWLWTFQGRLLQKNNKDRFCQLLWRPRPPTLLSQEQIKQIKKDLKKYSKIFEQKDRLSQSKASKELVERRRTMMEDFRKYRKMAQELYMEQKNERLELRGGVDTDELDSNVDDWEEETIEFFVTEEIIPLGNQE

SEQ ID NO: 891467 - protein, 820 aa, Homo sapiens
MQDAENVAVPEAAEERAEPGQQQPAAEPPPAEGLLRPAGPGAPEAAGTEASSEEVGIAEAGPEPEVRTEPAAEAEAASGPSESPSPPAAEELPGSHAEPPVPAQGEAPGEQARDERSDSRAQAVSEDAGGNEGRAAEAEPRALENGDADEPSFSDPEDFVDDVSEEELLGDVLKDRPQEADGIDSVIVVDNVPQVGPDRLEKLKNVIHKIFSKFGKITNDFYPEEDGKTKGYIFLEYASPAHAVDAVKNADGYKLDKQHTFRVNLFTDFDKYMTISDEWDIPEKQPFKDLGNLRYWLEEAECRDQYSVIFESGDRTSIFWNDVKDPVSIEERARWTETYVRWSPKGTYLATFHQRGIALWGGEKFKQIQRFSHQGVQLIDFSPCESVALLFWYLVTFSPLMDTQDDPQAIIIWDILTGHKKRGFHCESSAHWPIFKWSHDGKFFARMTLDTLSIYETPSMGLLDKKSLKISGIKDFSWSPGGNIIAFWVPEDKDIPARVTLMQLPTRQEIRVRNLFNVVDCKLHWQKNGDYLCVKVDRTPKGTQGVVTNFEIFRMREKQVPVDVVEMKETIIAFAWEPNGSKFAVLHGEAPRISVSFYHVKNNGKIELIKMFDKQQANTIFWSPQGQFVVLAGLRSMNGALAFVDTSDCTVMNIAEHYMASDVEWDPTGRYVVTSVSWWSHKVDNAYWLWTFQGRLLQKNNKDRFCQLLWRPRPPTLLSQEQIKQIKKDLKKYSKIFEQKDRLSQSKASKELVERRRTMMEDFRKYRKMAQELYMEQKNERLELRGGVDTDELDSNVDDWEEETIEFFVTEEIIPLGNQE

SEQ ID NO: 891468 - protein, 361 aa, Homo sapiens [sequence omitted]

SEQ ID NO: 891469 - protein, 814 aa, Homo sapiens; identical to SEQ ID NO: 891441

SEQ ID NO: 891470 - protein, 367 aa, Homo sapiens
MLAGALKSAEADRVEESLGLKDFSWSPGGNIIAFWVPEDKDIPARVTLMQLPTRQEIRVRNLFNVVDCKLHWQKNGDYLCVKVDRTPKGTQGVVTNFEIFRMREKQVPVDVVEMKETIIAFAWEPNGSKFAVLHGEAPRISVSFYHVKNNGKIELIKMFDKQQANTIFWSPQGQFVVLAGLRSMNGALAFVDTSDCTVMNIAEHYMASDVEWDPTGRYVVTSVSWWSHKVDNAYWLWTFQGRLLQKNNKDRFCQLLWRPRPPTLLSQEQIKQIKKDLKKYSKIFEQKDRLSQSKASKELVERRRTMMEDFRKYRKMAQELYMEQKNERLELRGGVDTDELDSNVDDWEEETIEFFVTEEIIPLGNQE

SEQ ID NO: 891471 - protein, 401 aa, Homo sapiens
ETEEEETIEFFVTEEIIPPGLPTLLSQEQIKQIKKDLKKYSKIFEQKDRLSQSKASKELVERRRTMMEDFRKYRKMAQELYMEQKNERLELRGGVDTDELDSNVDDWEEGDYLCVKVDRTPKGTQGVVTNFEIFRMREKQVPVDVVEMKETIIAFAWEPNGSKFAVLHGEAPRISVSFYHVKNNGKIELIKMFDKQQANTIFWSPQGQFVVLAGLRSMNGALAFVDTSDCTVMNIAEHYMASDVEWDPTGRYVVTSVSWWSHKVDNAYWLWTFQGRLLQKNNKDRFCQLLWRPRPPTLLSQEQIKQIKKDLKKYSKIFEQKDRLSQSKASKELVERRRTMMEDFRKYRKMAQELYMEQKNERLELRGGVDTDELDSNVDDWEEETIEFFVTEEIIPLGNQE

SEQ ID NO: 891472 - protein, 735 aa, Homo sapiens
MQDAENVAVPEAAEERAEPGQQQPAAEPPPAEGLLRPAGPGAPEAAGTEASSEEVGIAEAGPEPEVRTEPAAEAEAASGPSESPSPPAAEELPGSHAEPPVPAQGEAPGEQARDERSDSRAQAVSEDAGGNEGRAAEAEPRALENGDADEPSFSDPEDFVDDVSEEELLGDVLKDRPQEADGIDSVIVVDNVPQVGPDRLEKLKNVIHKIFSKFGKITNDFYPEEDGKTKGYIFLEYASPAHAVDAVKNADGYKLDKQHTFRVNLFTDFDKYMTISDEWDIPEKQPFKDLGNLRYWLEEAECRDQYSVIFESGDRTSIFWNDVKDPVSIEERARWTETYVRWSPKGTYLATFHQRGIALWGGEKFKQIQRFSHQGVQLIDFSPCERYLVTFSPLMDTQDDPQAIIIWDILTGHKKRGFHCESSAHWPIFKWSHDGKFFARMTLDTLSIYETPSMGLLDKKSLKISGIKDFSWSPGGNIIAFWVPEDKDIPARVTLMQLPTRQEIRVRNLFNVVDCKLHWQKNGDYLCVKVDRTPKGTQGVVTNFEIFRMREKQVPVDVVEMKETIIAFAWEPNGSKFAVLHGEAPRISVSFYHVKNNGKIELIKMFDKQQANTIFWSPQGQFVVLAGLRSMNGALAFVDTSDCTVMNIAEHYMASDVEWDPTGRYVVTSVSWWSHKVDNAYWLWTFQGRLLQKNNKDRFCQLLWRPRPPTLLSQEQIKVSMPPPPGAGHMEAIVA

SEQ ID NO: 891473 - protein, 106 aa, Homo sapiens; identical to SEQ ID NO: 891464

SEQ ID NO: 891474 - protein, 601 aa, Homo sapiens
MQDAENVAVPEAAEERAEPGQQQPAAEPPPAEGLLRPAGPGAPEAAGTEASSEEVGIAEAGPEPEVRTEPAAEAEAASGPSESPSPPAAEELPGSHAEPPVPAQGEAPGEQARDERSDSRAQAVSEDAGGNEGRAAEAEPRALENGDADEPSFSDPEDFVDDVSEEELLGDVLKDRPQEADGIDSVIVVDNVPQVGPDRLEKLKNVIHKIFSKFGKITNDFYPEEDGKTKGYIFLEYASPAHAVDAVKNADGYKLDKQHTFRVNLFTDFDKYMTISDEWDIPEKQPFKDLGNLRYWLEEAECRDQYSVIFESGDRTSIFWNDVKDPVSIEERARWTETYVRWSPKGTYLATFHQRGIALWGGEKFKQIQRFSHQGVQLIDFSPCERYLVTFSPLMDTQDDPQAIIIWDILTGHKKRGFHCESSAHWPIFKWSHDGKFFARMTLDTLSIYETPSMGLLDKKSLKISGIKDFSWSPGGNIIAFWVPEDKDIPARVTLMQLPTRQEIRVRNLFNVVDCKLHWQKNGDYLCVKVDRTPKGTQGVVTNFEIFRMREKQVPVDVVEMKETIIAFAWEPNGSKFAVLLVEHLDEFNLPVVFDVVERHR

SEQ ID NO: 891475 - protein, 580 aa, Homo sapiens
MQDAENVAVPEAAEERAEPGQQQPAAEPPPAEGLLRPAGPGAPEAAGTEASSEEVGIAEAGPEPEVRTEPAAEAEAASGPSESPSPPAAEELPGSHAEPPVPAQGEAPGEQARDERSDSRAQAVSEDAGGNEGRAAEAEPRALENGDADEPSFSDPEDFVDDVSEEELLGDVLKDRPQEADGIDSVIVVDNVPQVGPDRLEKLKNVIHKIFSKFGKITNDFYPEEDGKTKGYIFLEYASPAHAVDAVKNADGYKLDKQHTFRVNLFTDFDKYMTISDEWDIPEKQPFKDLGNLRYWLEEAECRDQYSVIFESGDRTSIFWNDVKDPVSIEERARWTETYVRWSPKGTYLATFHQRGIALWGGEKFKQIQRFSHQGVQLIDFSPCERYLVTFSPLMDTQDDPQAIIIWDILTGHKKRGFHCESSAHWPIFKWSHDGKFFARMTLDTLSIYETPSMGLLDKKSLKISGIKDFSWSPGGNIIAFWVPEDKDIPARVTLMQLPTRQEIRVRNLFNVVDCKLHWQKNGDYLCVKVDRTPKGTQAVVTDFEKGFIMAEVMKYEDFKEEGSENAVRLLESTRQQGGH

SEQ ID NO: 891476 - protein, 104 aa, Homo sapiens; identical to SEQ ID NO: 891443

SEQ ID NO: 891477 - protein, 769 aa, Homo sapiens
SVISPSSPWTTIYINVSYLLGVGVFPSQDPAQPRMPPWIYNESLVPDAYKKILETTMTPTGIDTAKLYPILMSSGLPRETLGQIWALANRTTPGKLTKEELYTVLAMIAVTQRGVPAMSPDALNQFPAAPIPTLSGFSMTLPTPVSQPTVIPSGPAGSMPLSLGQPVMGINLVGPVGGAAAQASSGFIPTYPANQVVKPEEDDFQDFQDASKSGSLDDSFSDFQELPASSKTSNSQHGNSAPSLLMPLPGTKALPSMDKYAVFKGIAADKSSENTVPPGDPGDKYSAFRELEQTAENKPLGESFAEFRSAGTDDGFTDFKTADSVSPLEPPTKDKTFPPSFPSGTIQQKQQTQVKNPLNLADLDMFSSVNCSSEKPLSFSAVFSTSKSVSTPQSTGSAATMTALAATKTSSLADDFGEFSLFGEYSGLAPVGEQDDFADFMAFSNSSISSEQKPDDKYDALKEEASPVPLTSNVGSTVKGGQNSTAASTKYDVFRQLSLEGSGLGVEDLKDNTPSGKSDDDFADFHSSKFSSINSDKSLGEKAVAFRHTKEDSASVKSLDLPSIGGSSVGKEDSEDALSVQFDMKLADVGGDLKHVMSDSSLDLPTVSGQHPPAAGSGSPSATSILQKKETSFGSSENITMTSLSKVTTFVSEDALPETTFPALASFKDTIPQTSEQKEYENRDYKDFTKQDLPTAERSQEATCPSPASSGASQETPNECSDDFGEFQSEKPKISKFDFLVATSQSKMKSSEEMIKSELATFDLSVQGE

SEQ ID NO: 891478 - protein, 1328 aa, Homo sapiens
IRWRRRRQRQVGSKMALRPGAGSGGGGAAGAGAGSAGGGGFMFPVAGGIRPPQAGLMPMQQQGFPMVSVMQPNMQGIMGMNYSSQMSQGPIAMQAGIPMGPMPAAGMPYLGQAPFLGMRPPGPQYTPDMQKQFAEEQQKRFEQQQKLLEEERKRRQFEEQKQKLRLLSSVKPKTGEKSRDDALEAIKGNLDGFSRDAKMHPTPASHPKKPGPSLEEKFLVSCDISTSGQEQIKLNTSEVGHKALGPGSSKKYPSLMASNGVAVDGCVSGTTTAEAENTSDQNLSIEESGVGVFPSQDPAQPRMPPWIYNESLVPDAYKKILETTMTPTGIDTAKLYPILMSSGLPRETLGQIWALANRTTPGKLTKEELYTVLAMIAVTQRGVPAMSPDALNQFPAAPIPTLSGFSMTLPTPVSQPTVIPSGPAGSMPLSLGQPVMGINLVGPVGGAAAQASSGFIPTYPANQVVKPEEDDFQDFQDASKSGSLDDSFSDFQELPASSKTSNSQHGNSAPSLLMPLPGTKALPSMDKYAVFKGIAADKSSENTVPPGDPGDKYSAFRELEQTAENKPLGESFAEFRSAGTDDGFTDFKTADSVSPLEPPTKDKTFPPSFPSGTIQQKQQTQVKNPLNLADLDMFSSVNCSSEKPLSFSAVFSTSKSVSTPQSTGSAATMTALAATKTSSLADDFGEFSLFGEYSGLAPVGEQDDFADFMAFSNSSISSEQKPDDKYDALKEEASPVPLTSNVGSTVKGGQNSTAASTKYDVFRQLSLEGSGLGVEDLKDNTPSGKSDDDFADFHSSKFSSINSDKSLGEKAVAFRHTKEDSASVKSLDLPSIGGSSVGKEDSEDALSVQFDMKLADVGGDLKHVMSDSSLDLPTVSGQHPPAADIEDLKYAAFGSYSSNFAVSTLTSYDWSDRDDATQGRKLSPFVLSAGSGSPSATSILQKKETSFGSSENITMTSLSKVTTFVSEDALPETTFPALASFKDTIPQTSEQKEYENRDYKDFTKQDLPTAERSQEATCPSPASSGASQETPNECSDDFGEFQSEKPKISKFDFLVATSQSKMKSSEEMIKSELATFDLSVQGSHKRSLSLGDKEISRSSPSPALEQPFRDRSNTLNEKPALPVIRDKYKDLTGEVEENERYAYEWQRCLGSALNVIKKANDTLNGISSSSVCTEVIQSAQGMEYLLGVVEVYRVTKRVELGIKATAVCSEKLQQLLKDIDKVWNNLIGFMSLATLTPDENSLDFSSCMLRPGIKNAQELACGVCLLNVDSRSRKEEKPAEEHPKKAFNSETDSFKLAYGGHQYHASCANFWINCVEPKPPGLVLPDLL

SEQ ID NO: 891479 - protein, 1328 aa, Homo sapiens; identical to SEQ ID NO: 891478

SEQ ID NO: 891480 - protein, 1328 aa, Homo sapiens; identical to SEQ ID NO: 891478

SEQ ID NO: 891481 - protein, 1107 aa, Homo sapiens
MSKKLLLCRAGIPMGPMPAAGMPYLGQAPFLGMRPPGPQYTPDMQKQFAEEQQKRFEQQQKLLEEERKRRQFEEQKQKLRLLSSVKPKTGEKSRDDALEAIKGNLDGFSRDAKMHPTPASHPKKPGVGVFPSQDPAQPRMPPWIYNESLVPDAYKKILETTMTPTGIDTAKLYPILMSSGLPRETLGQIWALANRTTPGKLTKEELYTVLAMIAVTQRGVPAMSPDALNQFPAAPIPTLSGFSMTLPTPVSQPTVIPSGPAGSMPLSLGQPVMGINLVGPVGGAAAQASSGFIPTYPANQVVKPEEDDFQDFQDASKSGSLDDSFSDFQELPASSKTSNSQHGNSAPSLLMPLPGTKALPSMDKYAVFKGIAADKSSENTVPPGDPGDKYSAFRELEQTAENKPLGESFAEFRSAGTDDGFTDFKTADSVSPLEPPTKDKTFPPSFPSGTIQQKQQTQVKNPLNLADLDMFSSVNCSSEKPLSFSAVFSTSKSVSTPQSTGSAATMTALAATKTSSLADDFGEFSLFGEYSGLAPVGEQDDFADFMAFSNSSISSEQKPDDKYDALKEEASPVPLTSNVGSTVKGGQNSTAASTKYDVFRQLSLEGSGLGVEDLKDNTPSGKSDDDFADFHSSKFSSINSDKSLGEKAVAFRHTKEDSASVKSLDLPSIGGSSVGKEDSEDALSVQFDMKLADVGGDLKHVMSDSSLDLPTVSGQHPPAAGSGSPSATSILQKKETSFGSSENITMTSLSKVTTFVSEDALPETTFPALASFKDTIPQTSEQKEYENRDYKDFTKQDLPTAERSQEATCPSPASSGASQETPNECSDDFGEFQSEKPKISKFDFLVATSQSKMKSSEEMIKSELATFDLSVQGSHKRSLSLGDKEISRSSPSPALEQPFRDRSNTLNEKPALPVIRDKYKDLTGEVEENERYAYEWQRCLGSALNVIKKANDTLNGISSSSVCTEVIQSAQGMEYLLGVVEVYRVTKRVELGIKATAVCSEKLQQLLKDIDKVWNNLIGFMSLATLTPDENSLDFSSCMLRPGIKNAQELACGVCLLNVDSRSRAFNSETDSFKLAYGGHQYHASCANFWINCVEPKPPGLVLPDLL

SEQ ID NO: 891482 - protein, 549 aa, Homo sapiens
MARKYDALKEEASPVPLTSNVGSTVKGGQNSTAASTKYDVFRQLSLEGSGLGVEDLKDNTPSGKSDDDFADFHSSKFSSINSDKSLGEKAVAFRHTKEDSASVKSLDLPSIGGSSVGKEDSEDALSVQFDMKLADVGGDLKHVMSDSSLDLPTVSGQHPPAAGSGSPSATSILQKKETSFGSSENITMTSLSKVTTFVSEDALPETTFPALASFKDTIPQTSEQKEYENRDYKDFTKQDLPTAERSQEATCPSPASSGASQETPNECSDDFGEFQSEKPKISKFDFLVATSQSKMKSSEEMIKSELATFDLSVQGSHKRSLSLGDKEISRSSPSPALEQPFRDRSNTLNEKPALPVIRDKYKDLTGEVEENERYAYEWQRCLGSALNVIKKANDTLNGISSSSVCTEVIQSAQGMEYLLGVVEVYRVTKRVELGIKATAVCSEKLQQLLKDIDKVWNNLIGFMSLATLTPDENSLDFSSCMLRPGIKNAQELACGVCLLNVDSRSRAFNSETDSFKLAYGGHQYHASCANFWINCVEPKPPGLVLPDLL

SEQ ID NO: 891483 - protein, 1016 aa, Homo sapiens
IRWRRRRQRQVGSKMALRPGAGSGGGGAAGAGAGSAGGGGFMFPVAGGIRPPQAGLMPMQQQGFPMVSVMQPNMQGIMGMNYSSQMSQGPIAMQAGIPMGPMPAAGMPYLGQAPFLGMRPPGPQYTPDMQKQFAEEQQKRFEQQQKLLEEERKRRQFEEQKQKLRLLSSVKPKTGEKSRDDALEAIKGNLDGFSRDAKMHPTPASHPKKPGPSLEEKFLVSCDISTSGQEQIKLNTSEVGHKALGPGSSKKYPSLMASNGVAVDGCVSGTTTAEAENTSDQNLSIEESGVGVFPSQDPAQPRMPPWIYNESLVPDAYKKILETTMTPTGIDTAKLYPILMSSGLPRETLGQIWALANRTTPGKLTKEELYTVLAMIAVTQRGVPAMSPDALNQFPAAPIPTLSGFSMTLPTPVSQPTVIPSGPAGSMPLSLGQPVMGINLVGPVGGAAAQASSGFIPTYPANQVVKPEEDDFQDFQDASKSGSLDDSFSDFQELPASSKTSNSQHGNSAPSLLMPLPGTKALPSMDKYAVFKGIAADKSSENTVPPGDPGDKYSAFRELEQTAENKPLGESFAEFRSAGTDDGFTDFKTADSVSPLEPPTKDKTFPPSFPSGTIQQKQQTQVKNPLNLADLDMFSSVNCSSEKPLSFSAVFSTSKSVSTPQSTGSAATMTALAATKTSSLADDFGEFSLFGEYSGLAPVGEQDDFADFMAFSNSSISSEQKPDDKYDALKEEASPVPLTSNVGSTVKGGQNSTAASTKYDVFRQLSLEGSGLGVEDLKDNTPSGKSDDDFADFHSSKFSSINSDKSLGEKAVAFRHTKEDSASVKSLDLPSIGGSSVGKEDSEDALSVQFDMKLADVGGDLKHVMSDSSLDLPTVSGQHPPAADIEDLKYAAFGSYSSNFAVSTLTSYDWSDRDDATQGRKLSPFVLSAGSGSPSATSILQKKETSFGSSENITMTSLSKVTTFVSEDALPETTFPALASFKDTIPQTSELAASGELPVVSSLRVVSSLRVVSSLR

SEQ ID NO: 891484 - protein, 821 aa, Homo sapiens
IRWRRRRQRQVGSKMALRPGAGSGGGGAAGAGAGSAGGGGFMFPVAGGIRPPQAGLMPMQQQGFPMVSVMQPNMQGIMGMNYSSQMSQGPIAMQAGIPMGPMPAAGMPYLGQAPFLGMRPPGPQYTPDMQKQFAEEQQKRFEQQQKLLEEERKRRQFEEQKQKLRLLSSVKPKTGEKSRDDALEAIKGNLDGFSRDAKMHPTPASHPKKPGPSLEEKFLVSCDISTSGQEQIKLNTSEVGHKALGPGSSKKYPSLMASNGVAVDGCVSGTTTAEAENTSDQNLSIEESGVGVFPSQDPAQPRMPPWIYNESLVPDAYKKILETTMTPTGIDTAKLYPILMSSGLPRETLGQIWALANRTTPGKLTKEELYTVLAMIAVTQRGVPAMSPDALNQFPAAPIPTLSGFSMTLPTPVSQPTVIPSGPAGSMPLSLGQPVMGINLVGPVGGAAAQASSGFIPTYPANQVVKPEEDDFQDFQDASKSGSLDDSFSDFQELPASSKTSNSQHGNSAPSLLMPLPGTKALPSMDKYAVFKGIAADKSSENTVPPGDPGDKYSAFRELEQTAENKPLGESFAEFRSAGTDDGFTDFKTADSVSPLEPPTKDKTFPPSFPSGTIQQKQQTQVKNPLNLADLDMFSSVNCSSEKPLSFSAVFSTSKSVSTPQSTGSAATMTALAATKTSSLADDFGEFSLFGEYSGLAPVGEQDDFADFMAFSNSSISSEQKPDDKYDALKEEASPVPLTSNVGSTVKGGFSGDKKFKQQGYSVSYQSNRTLRNEVSKAKKQDELPGFSKMGVSQDPLMTQFSDTKRCLIHRYNEVTRMHGT

SEQ ID NO: 891485 - protein, 1328 aa, Homo sapiens; identical to SEQ ID NO: 891478

SEQ ID NO: 891486 - protein, 1328 aa, Homo sapiens; identical to SEQ ID NO: 891478

SEQ ID NO: 891487 - protein, 1270 aa, Homo sapiens
IRWRRRRQRQVGSKMALRPGAGSGGGGAAGAGAGSAGGGGFMFPVAGGIRPPQAGLMPMQQQGFPMVSVMQPNMQGIMGMNYSSQMSQGPIAMQAGIPMGPMPAAGMPYLGQAPFLGMRPPGPQYTPDMQKQFAEEQQKRFEQQQKLLEEERKRRQFEEQKQKLRLLSSVKPKTGEKSRDDALEAIKGNLDGFSRDAKMHPTPASHPKKPGPSLEEKFLVSCDISTSGQEQIKLNTSEVGHKALGPGSSKKYPSLMASNGVAVDGCVSGTTTAEAENTSDQNLSIEESGVGVFPSQDPAQPRMPPWIYNESLVPDAYKKILETTMTPTGIDTAKLYPILMSSGLPRETLGQIWALANRTTPGKLTKEELYTVLAMIAVTQRGVPAMSPDALNQFPAAPIPTLSGFSMTLPTPVSQPTVIPSGPAGSMPLSLGQPVMGINLVGPVGGAAAQASSGFIPTYPANQVVKPEEDDFQDFQDASKSGSLDDSFSDFQELPASSKTSNSQHGNSAPSLLMPLPGTKALPSMDKYAVFKGIAADKSSENTVPPGDPGDKYSAFRELEQTAENKPLGESFAEFRSAGTDDGFTDFKTADSVSPLEPPTKDKTFPPSFPSGTIQQKQQTQVKNPLNLADLDMFSSVNCSSEKPLSFSAVFSTSKSVSTPQSTGSAATMTALAATKTSSLADDFGEFSLFGEYSGLAPVGEQDDFADFMAFSNSSISSEQKPDDKYDALKEEASPVPLTSNVGSTVKGGQNSTAASTKYDVFRQLSLEGSGLGVEDLKDNTPSGKSDDDFADFHSSKFSSINSDKSLGEKAVAFRHTKEDSASVKSLDLPSIGGSSVGKEDSEDALSVQFDMKLADVGGDLKHVMSDSSLDLPTVSGQHPPAAGSGSPSATSILQKKETSFGSSENITMTSLSKVTTFVSEDALPETTFPALASFKDTIPQTSEQKEYENRDYKDFTKQDLPTAERSQEATCPSPASSGASQETPNECSDDFGEFQSEKPKISKFDFLVATSQSKMKSSEEMIKSELATFDLSVQGSHKRSLSLGDKEISRSSPSPALEQPFRDRSNTLNEKPALPVIRDKYKDLTGEVEENERYAYEWQRCLGSALNVIKKANDTLNGISSSSVCTEVIQSAQGMEYLLGVVEVYRVTKRVELGIKATAVCSEKLQQLLKDIDKVWNNLIGFMSLATLTPDENSLDFSSCMLRPGIKNAQELACGVCLLNVDSRSRAFNSETDSFKLAYGGHQYHASCANFWINCVEPKPPGLVLPDLL

SEQ ID NO: 891488 - protein, 1097 aa, Homo sapiens
TQPLPPSQSPVPFALHGVPGQIPYFSTASASHSVPEAGPSLEEKFLVSCDISTSGQEQIKLNTSEVGHKALGPGSSKKYPSLMASNGVAVDGCVSGTTTAEAENTSDQNLSIEESGVGVFPSQDPAQPRMPPWIYNESLVPDAYKKILETTMTPTGIDTAKLYPILMSSGLPRETLGQIWALANRTTPGKLTKEELYTVLAMIAVTQRGVPAMSPDALNQFPAAPIPTLSGFSMTLPTPVSQPTVIPSGPAGSMPLSLGQPVMGINLVGPVGGAAAQASSGFIPTYPANQVVKPEEDDFQDFQDASKSGSLDDSFSDFQELPASSKTSNSQHGNSAPSLLMPLPGTKALPSMDKYAVFKGIAADKSSENTVPPGDPGDKYSAFRELEQTAENKPLGESFAEFRSAGTDDGFTDFKTADSVSPLEPPTKDKTFPPSFPSGTIQQKQQTQVKNPLNLADLDMFSSVNCSSEKPLSFSAVFSTSKSVSTPQSTGSAATMTALAATKTSSLADDFGEFSLFGEYSGLAPVGEQDDFADFMAFSNSSISSEQKPDDKYDALKEEASPVPLTSNVGSTVKGGQNSTAASTKYDVFRQLSLEGSGLGVEDLKDNTPSGKSDDDFADFHSSKFSSINSDKSLGEKAVAFRHTKEDSASVKSLDLPSIGGSSVGKEDSEDALSVQFDMKLADVGGDLKHVMSDSSLDLPTVSGQHPPAAGSGSPSATSILQKKETSFGSSENITMTSLSKVTTFVSEDALPETTFPALASFKDTIPQTSEQKEYENRDYKDFTKQDLPTAERSQEATCPSPASSGASQETPNECSDDFGEFQSEKPKISKFDFLVATSQSKMKSSEEMIKSELATFDLSVQGSHKRSLSLGDKEISRSSPSPALEQPFRDRSNTLNEKPALPVIRDKYKDLTGEVEENERYAYEWQRCLGSALNVIKKANDTLNGISSSSVCTEVIQSAQGMEYLLGVVEVYRVTKRVELGIKATAVCSEKLQQLLKDIDKVWNNLIGFMSLATLTPDENSLDFSSCMLRPGIKNAQELACGVCLLNVDSRSRAFNSETDSFKLAYGGHQYHASCANFWINCVEPKPPGLVLPDLL

SEQ ID NO: 891489 - protein, 1316 aa, Homo sapiens
IRWRRRRQRQVGSKMALRPGAGSGGGGAAGAGAGSAGGGGFMFPVAGGIRPPQAGLMPMQQQGFPMVSVMQPNMQGIMGMNYSSQMSQGPIAMQAGIPMGPMPAAGMPYLGQAPFLGMRPPGPQYTPDMQKQFAEEQQKRFEQQQKLLEEERKRRQFEEQKQKLRLLSSVKPKTGEKSRDDALEAIKGNLDGFSRDAKMHPTPASHPKKPGPSLEEKFLVSCDISTSGQEQIKLNTSEVGHKALGPGSSKKYPSLMASNGVAVDGCVSGTTTAEAENTSDQNLSIEESGVGVFPSQDPAQPRMPPWIYNESLVPDAYKKILETTMTPTGIDTAKLYPILMSSGLPRETLGQIWALANRTTPGKLTKEELYTVLAMIAVTQRGVPAMSPDALNQFPAAPIPTLSGFSMTLPTPVSQPTVIPSGPAGSMPLSLGQPVMGINLVGPVGGAAAQASSGFIPTYPANQVVKPEEDDFQDFQDASKSGSLDDSFSDFQELPASSKTSNSQHGNSAPSLLMPLPGTKALPSMDKYAVFKGIAADKSSENTVPPGDPGDKYSAFRELEQTAENKPLGESFAEFRSAGTDDGFTDFKTADSVSPLEPPTKDKTFPPSFPSGTIQQKQQTQVKNPLNLADLDMFSSVNCSSEKPLSFSAVFSTSKSVSTPQSTGSAATMTALAATKTSSLADDFGEFSLFGEYSGLAPVGEQDDFADFMAFSNSSISSEQKPDDKYDALKEEASPVPLTSNVGSTVKGGQNSTAASTKYDVFRQLSLEGSGLGVEDLKDNTPSGKSDDDFADFHSSKFSSINSDKSLGEKAVAFRHTKEDSASVKSLDLPSIGGSSVGKEDSEDALSVQFDMKLADVGGDLKHVMSDSSLDLPTVSGQHPPAADIEDLKYAAFGSYSSNFAVSTLTSYDWSDRDDATQGRKLSPFVLSAGSGSPSATSILQKKETSFGSSENITMTSLSKVTTFVSEDALPETTFPALASFKDTIPQTSEQKEYENRDYKDFTKQDLPTAERSQEATCPSPASSGASQETPNECSDDFGEFQSEKPKISKFDFLVATSQSKMKSSEEMIKSELATFDLSVQGSHKRSLSLGDKEISRSSPSPALEQPFRDRSNTLNEKPALPVIRDKYKDLTGEVEENERYAYEWQRCLGSALNVIKKANDTLNGISSSSVCTEVIQSAQGMEYLLGVVEVYRVTKRVELGIKATAVCSEKLQQLLKDIDKVWNNLIGFMSLATLTPDENSLDFSSCMLRPGIKNAQELACGVCLLNVDSRSRAFNSETDSFKLAYGGHQYHASCANFWINCVEPKPPGLVLPDLL

SEQ ID NO: 891490 - protein, 250 aa, Homo sapiens
IRWRRRRQRQVGSKMALRPGAGSGGGGAAGAGAGSAGGGGFMFPVAGGIRPPQAGLMPMQQQGFPMVSVMQPNMQGIMGMNYSSQMSQGPIAMQAGIPMGPMPAAGMPYLGQAPFLGMRPPGPQYTPDMQKQFAEEQQKRFEQQQKLLEEERKRRQFEEQKQKLRLLSSVKPKTGEKSRDDALEAIKGNLDGFSRDAKMHPTPASHPKKPGSFKRHYIFLFWEGDLCSPCFFTSPLYVCVKSQCRTLPSS

SEQ ID NO: 891491 - protein, 483 aa, Homo sapiens
MTMPVNGAHKDADLWSSHDKMLAQPLKDSDVEVYNIIKKESNRQRVGLELIASENFASRAVLEALGSCLNNKYSEGYPGQRYYGGTEFIDELETLCQKRALQAYKLDPQCWGVNVQPYSGSPANFAVYTALVEPHGRIMGLDLPDGGHLTHGFMTDKKKISATSIFFESMPYKVNPDTGYINYDQLEENARLFHPKLIIAGTSCYSRNLEYARLRKIADENGAYLMADMAHISGLVAAGVVPSPFEHCHVVTTTTHKTLRGCRAGMIFYRKGVKSVDPKTGKEILYNLESLINSAVFPGLQGGPHNHAIAGVAVALKQAMTLEFKVYQHQVVANCRALSEALTELGYKIVTGGSDNHLILVDLRSKGTDGGRAEKVLEACSIACNKNTCPGDRSALRPSGLRLGTPALTSRGLLEKDFQKVAHFIHRGIELTLQIQSDTGVRATLKEFKERLAGDKYQAAVQALREEVESFASLFPLPGLPDF

SEQ ID NO: 891492 - protein, 483 aa, Homo sapiens; identical to SEQ ID NO: 891491

SEQ ID NO: 891493 - protein, 483 aa, Homo sapiens; identical to SEQ ID NO: 891491

SEQ ID NO: 891494 - protein, 444 aa, Homo sapiens
MTMPVNGAHKDADLWSSHDKMLAQPLKDSDVEVYNIIKKESNRQRVGLELIASENFASRAVLEALGSCLNNKYSEGYPGQRYYGGTEFIDELETLCQKRALQAYKLDPQCWGVNVQPYSGSPANFAVYTALVEPHGRIMGLDLPDGGHLTHGFMTDKKKISATSIFFESMPYKVNPDTGYINYDQLEENARLFHPKLIIAGTSCYSRNLEYARLRKIADENGAYLMADMAHISGLVAAGVVPSPFEHCHVVTTTTHKTLRGCRAGMIFYRKGVAVALKQAMTLEFKVYQHQVVANCRALSEALTELGYKIVTGGSDNHLILVDLRSKGTDGGRAEKVLEACSIACNKNTCPGDRSALRPSGLRLGTPALTSRGLLEKDFQKVAHFIHRGIELTLQIQSDTGVRATLKEFKERLAGDKYQAAVQALREEVESFASLFPLPGLPDF

SEQ ID NO: 891495 - protein, 483 aa, Homo sapiens; identical to SEQ ID NO: 891491

SEQ ID NO: 891496 - protein, 127 aa, Homo sapiens
ALRPSGLRLGTPALTSRGLLEKDFQKEPTLFTEGGPHNHAIAGVAVALKQAMTLEFKVYQHQVVANCRALSEALTELGYKIVTGVRATLKEFKERLAGDKYQAAVQALREEVESFASLFPLPGLPDF

SEQ ID NO: 891497 - protein, 483 aa, Homo sapiens; identical to SEQ ID NO: 891491

SEQ ID NO: 891498 - protein, 443 aa, Homo sapiens
MPFVSFSCLIILGIEVVLAGILVLFLKVTILVSIVWSRHICFILQVLFGSFSAGSAPAAGLTTTLGLLRDSWVCEPYLVEQAEHTSIHPVSPSSPHLGHHSSCHGGWSQFKWEDRRQVWLEEAARTCLPDIPQVNPDTGYINYDQLEENARLFHPKLIIAGTSCYSRNLEYARLRKIADENGAYLMADMAHISGLVAAGVVPSPFEHCHVVTTTTHKTLRGCRAGMIFYRKGVKSVDPKTGKEILYNLESLINSAVFPGLQGGPHNHAIAGVAVALKQAMTLEFKVYQHQVVANCRALSEALTELGYKIVTGGSDNHLILVDLRSKGTDGGRAEKVLEACSIACNKNTCPGDRSALRPSGLRLGTPALTSRGLLEKDFQKVAHFIHRGIELTLQIQSDTGVRATLKEFKERLAGDKYQAAVQALREEVESFASLFPLPGLPDF

SEQ ID NO: 891499 - protein, 483 aa, Homo sapiens; identical to SEQ ID NO: 891491

SEQ ID NO: 891500 - protein, 483 aa, Homo sapiens; identical to SEQ ID NO: 891491

SEQ ID NO: 891501 - protein, 434 aa, Homo sapiens
MTMPVNGAHKDADLWSSHDKMLAQPLKDSDVEVYNIIKKESNRQRVGLELIASENFASRAVLEALGSCLNNKYSEGYPGQRYYGGTEFIDELETLCQKRALQAYKLDPQCWGVNVQPYSGSPANFAVYTALVEPHGRIMGLDLPDGGHLTHGFMTDKKKISATSIFFESMPYKVNPDTGYINYDQLEENARLFHPKLIIAGTSCYSRNLEYARLRKIADENGAYLMADMAHISGLVAAGVVPSPFEHCHVVTTTTHKTLRGCRAGMIFYRKGVKSVDPKTGKEILYNLESLINSAVFPGLQGGPHNHAIAGVAVALKQAMTLEFKVYQHQVVANCRALSEALTELGYKIVTGGSDNHLILVDLRSKGTDGGRAEKVLEACSIACNKNTCPGDRSALRPSGLRLGTPALTSRGLLEKDFQCQSHPERVQGETGRG

SEQ ID NO: 891502 - protein, 483 aa, Homo sapiens; identical to SEQ ID NO: 891491

SEQ ID NO: 891503 - protein, 180 aa, Homo sapiens
MFFCDVDIYFSAEFLNSCRLNAEPGKKVFYPVVFSLYNPAIVYANQEVPPPVEQQLVHKKDSGFWRDFGFGMTCQYRSDFLTIGGFDMEVKGWGGEDVHLYRKYLHGDLIVIRTPVPGLFHLWHEKRCADELTPEQYRMCIQSKAMNEASHSHLGMLVFREEIETHLHKQAYRTNSEAVG

SEQ ID NO: 891504 - protein, 109 aa, Homo sapiens
MTCQYRSDFLTIGGFDMEVKGWGGEDVHLYRKYLHGDLIVIRTPVPGLFHLWHEKRCADELTPEQYRMCIQSKAMNEASHSHLGMLVFREEIETHLHKQAYRTNSEAVG

SEQ ID NO: 891505 - protein, 478 aa, Homo sapiens
MPVIQHWEAKAGGPPEVGSLSPATVWVLPAIGPRSLGLSYRSEYHAVLQRPAARVPGRWSRPHQRPRGMEAENAGSYSLQQAQAFYTFPFQQLMAEAPNMAVVNEQQMPEEVPAPAPAQEPVQEAPKGRKRKPRTTEPKQPVEPKKPVESKKSGKSAKSKEKQEKITDTFKVKRKVDRFNGVSEAELLTKTLPDILTFNLDIVIIGINPGLMAAYKGHHYPGPGNHFWKCLFMSGLSEVQLNHMDDHTLPGKYGIGFTNMVERTTPGSKDLSSKEFREGGRILVQKLQKYQPRIAVFNGKCIYEIFSKEVFGVKVKNLEFGLQPHKIPDTETLCYVMPSSSARCAQFPRAQDKVHYYIKLKDLRDQLKGIERNMDVQEVQYTFDLQLAQEDAKKMAVKEEKYDPGYEAAYGGAYGENPCSSEPCGFSSNGLIESVELRGESAFSGIPNGQWMTQSFTDQIPSFSNHCGTQEQEEESHA

SEQ ID NO: 891506 - protein, 477 aa, Homo sapiens
SAAQKGGPWGTVEAWRRSLSPATVWVLPAIGPRSLGLSYRSEYHAVLQRPAARVPGRWSRPHQRPRGMEAENAGSYSLQQAQAFYTFPFQQLMAEAPNMAVVNEQQMPEEVPAPAPAQEPVQEAPKGRKRKPRTTEPKQPVEPKKPVESKKSGKSAKSKEKQEKITDTFKVKRKVDRFNGVSEAELLTKTLPDILTFNLDIVIIGINPGLMAAYKGHHYPGPGNHFWKCLFMSGLSEVQLNHMDDHTLPGKYGIGFTNMVERTTPGSKDLSSKEFREGGRILVQKLQKYQPRIAVFNGKCIYEIFSKEVFGVKVKNLEFGLQPHKIPDTETLCYVMPSSSARCAQFPRAQDKVHYYIKLKDLRDQLKGIERNMDVQEVQYTFDLQLAQEDAKKMAVKEEKYDPGYEAAYGGAYGENPCSSEPCGFSSNGLIESVELRGESAFSGIPNGQWMTQSFTDQIPSFSNHCGTQEQEEESHA

SEQ ID NO: 891507 - protein, 477 aa, Homo sapiens; identical to SEQ ID NO: 891506

SEQ ID NO: 891508 - protein, 267 aa, Homo sapiens
MAAYKGHHYPGPGNHFWKCLFMSGLSEVQLNHMDDHTLPGKYGIGFTNMVERTTPGSKDLSSKEFREGGRILVQKLQKYQPRIAVFNGKCIYEIFSKEVFGVKVKNLEFGLQPHKIPDTETLCYVMPSSSARCAQFPRAQDKVHYYIKLKDLRDQLKGIERNMDVQEVQYTFDLQLAQEDAKKMAVKEEKYDPGYEAAYGGAYGENPCSSEPCGFSSNGLIESVELRGESAFSGIPNGQWMTQSFTDQIPSFSNHCGTQEQEEESHA

SEQ ID NO: 891509 - protein, 477 aa, Homo sapiens; identical to SEQ ID NO: 891506

SEQ ID NO: 891510 - protein, 154 aa, Homo sapiens
MPVIQHWEAKAGGPPEVGSLSPATVWVLPAIGPRSLGLSYRSEYHAVLQRPAARVPGRWSRPHQRPRGMEAENAGSYSLQQAQAFYTFPFQQLMAEAPNMAVVNEQQMPEEVPAPAPAQEPVQVEAPYGLNCGPWSPGPELTGGTLNTWNFKVI

SEQ ID NO: 891511 - protein, 477 aa, Homo sapiens; identical to SEQ ID NO: 891506

SEQ ID NO: 891512 - protein, 459 aa, Homo sapiens
SAAQKGGPWGTVEAWRRSLSPATVWVLPAIGPRSLGLSYRSEYHAVLQRPAARVPGRWSRPHQRPRGMEAENAGSYSLQQAQAFYTFPFQQLMAEAPNMAVVNEQQMPEEVPAPAPAQEPVQEAPKGRKRKPRTTEPKQPVEPKKPVESKKSGKSAKSKEKQEKITDTFKVKSPDILTFNLDIVIIGINPGLMAAYKGHHYPGPGNHFWKCLFMSGLSEVQLNHMDDHTLPGKYGIGFTNMVERTTPGSKDLSSKEFREGGRILVQKLQKYQPRIAVFNGKCIYEIFSKEVFGVKVKNLEFGLQPHKIPDTETLCYVMPSSSARCAQFPRAQDKVHYYIKLKDLRDQLKGIERNMDVQEVQYTFDLQLAQEDAKKMAVKEEKYDPGYEAAYGGAYGENPCSSEPCGFSSNGLIESVELRGESAFSGIPNGQWMTQSFTDQIPSFSNHCGTQEQEEESHA

SEQ ID NO: 891513 - protein, 509 aa, Homo sapiens
MPVIQHWEAKAGGPPEVGSLSPATVWVLPAIGPRSLGLSYRSEYHAVLQRPAARVPGRWSRPHQRPRGMEAENAGSYSLQQAQAFYTFPFQQLMAEAPNMAVVNEQQMPEEVPAPAPAQEPVQVGLKLLMMAVVNEQQMPEEVPAPAPAQEPVQEAPKGRKRKPRTTEPKQPVEPKKPVESKKSGKSAKSKEKQEKITDTFKVKRKVDRFNGVSEAELLTKTLPDILTFNLDIVIIGINPGLMAAYKGHHYPGPGNHFWKCLFMSGLSEVQLNHMDDHTLPGKYGIGFTNMVERTTPGSKDLSSKEFREGGRILVQKLQKYQPRIAVFNGKCIYEIFSKEVFGVKVKNLEFGLQPHKIPDTETLCYVMPSSSARCAQFPRAQDKVHYYIKLKDLRDQLKGIERNMDVQEVQYTFDLQLAQEDAKKMAVKEEKYDPGYEAAYGGAYGENPCSSEPCGFSSNGLIESVELRGESAFSGIPNGQWMTQSFTDQIPSFSNHCGTQEQEEESHA

SEQ ID NO: 891514 - protein, 477 aa, Homo sapiens; identical to SEQ ID NO: 891506

SEQ ID NO: 891515 - protein, 237 aa, Homo sapiens
PVACDPVIASVMSWVQAASLIQGPGDKGDVFDEEADESLLAQREWQSNMQRRVKEGYRDGIDAGKAVTLQQGFNQGYKKGAEVILNYGRLRGTLSALLSWCHLHNNNSTLINKINNLLDAVGQCEEYVLKHLKSITPPSHVVDLLDSIEDMDLCHVVPAEKKIDEAKDERLCENNAEFNKNCSKSHSGIDCSYVECCRTQEHAHSENPSPTWILEQTASLVKQLGLSVDVLQHLKQL

SEQ ID NO: 891516 - protein, 98 aa, Homo sapiens
PVACDPVIASVMSWVQAASLIQGPGDKGDVFDEEADESLLAQREWQSNMQRRVKEGYRDGIDAGKAVTLQQGFNQGYKKGAEVILNYGRLRGTLSWPV

SEQ ID NO: 891517 - protein, 237 aa, Homo sapiens; identical to SEQ ID NO: 891515

SEQ ID NO: 891518 - protein, 219 aa, Homo sapiens
PVACDPVIASVMSWVQAASLIQGPGDKGDVFDEEADESLLAQREWQSNMQRRVKEGYRDGIDAGKAVTLQQGFNQGYKKGAEVILNYGRLRGTLSALLSWCHLHNNNSTLINNLKSITPPSHVVDLLDSIEDMDLCHVVPAEKKIDEAKDERLCENNAEFNKNCSKSHSGIDCSYVECCRTQEHAHSENPSPTWILEQTASLVKQLGLSVDVLQHLKQL

SEQ ID NO: 891519 - protein, 393 aa, Homo sapiens
MEYTIDIIFSQTWYDERLCYNDTFESLVLNGNVVSQLWIPDTFFRNSKRTHEHEITMPNQMVRIYKDGKVLYTIRMTIDAGCSLHMLRFPMDSHSCPLSFSSFSYPENEMIYKWENFKLEINEKNSWKLFQFDFTGVSNKTEIITTPVGDFMVMTIFFNVSRRFGYVAFQNYVPSSVTTMLSWVSFWIKTESAPARTSLGITSVLTMTTLGTFSRKNFPRVSYITALDFYIAICFVFCFCALLEFAVLNFLIYNQTKAHASPKLRHPRINSRAHARTRARSRACARQHQEAFVCQIVTTEGSDGEERPSCSAQQPPSPGSPEGPRSLCSKLACCEWCKRFKKYFCMVPDCEGSTWQQGRLCIHVYRLDNYSRVVFPVTFFFFNVLYWLVCLNL

SEQ ID NO: 891520 - protein, 361 aa, Homo sapiens
MEYTIDIIFSQTWNSKRTHEHEITMPNQMVRIYKDGKVLYTIRMTIDAGCSLHMLRFPMDSHSCPLSFSSFSYPENEMIYKWENFKLEINEKNSWKLFQFDFTGVSNKTEIITTPVGDFMVMTIFFNVSRRFGYVAFQNYVPSSVTTMLSWVSFWIKTESAPARTSLGITSVLTMTTLGTFSRKNFPRVSYITALDFYIAICFVFCFCALLEFAVLNFLIYNQTKAHASPKLRHPRINSRAHARTRARSRACARQHQEAFVCQIVTTEGSDGEERPSCSAQQPPSPGSPEGPRSLCSKLACCEWCKRFKKYFCMVPDCEGSTWQQGRLCIHVYRLDNYSRVVFPVTFFFFNVLYWLVCLNL

SEQ ID NO: 891521 - protein, 154 aa, Homo sapiens [sequence omitted]

SEQ ID NO: 891522 - protein, 361 aa, Homo sapiens
MMSWAQRKAHTSLGVMIAAECLGRVCQSIKQHECYKRRCQLEIEVVIRSRRSHDRLAESHDQGHNVQVTVRTSVCPVDVYATDLTSGGLTEMFILSFFFSFPEDTQFGLGVIDYRPKSPGLESWCKIAGHLRKSVSRWDWLWVRCVWKMSVGAGSWWAFSIRFQSADVCIAHVKQGATKTLGSRLVPVLTTCGAVLTHEGILPSHECAEKEAKSILCFSTTAQTSLVSFAESRHSEGQQCRCDVPQRVMKPLVSHLDISCVGMISRRLIDFFLSPDSLANLQRQTLGVGQWTEKEAIKILALAELSTGHWSCSKSFFWASSGPICMYCIVTSCLYPREYCELKNETLTVHVLLRGTVVSAL

SEQ ID NO: 891523 - protein, 240 aa, Homo sapiens
MTIFFNVSRRFGYVAFQNYVPSSVTTMLSWVSFWIKTESAPARTSLGITSVLTMTTLGTFSRKNFPRVSYITALDFYIAICFVFCFCALLEFAVLNFLIYNQTKAHASPKLRHPRINSRAHARTRARSRACARQHQEAFVCQIVTTEGSDGEERPSCSAQQPPSPGSPEGPRSLCSKLACCEWCKRFKKYFCMVPDCEGSTWQQGRLCIHVYRLDNYSRVVFPVTFFFFNVLYWLVCLNL

SEQ ID NO: 891524 - protein, 72 aa, Homo sapiens
QSPNSAQSPNRAQSPNSAQSPNSAQRPNSAQSPNSAQSPNKTMPKYRRISYLPTMLTTRQLLHFSRSPLLPL

SEQ ID NO: 891525 - protein, 71 aa, Homo sapiens
AQSVSRDLRAGGRAGLRGNVVQSSSSPPRHLIDPPVENMYTEKCSNHKCTADELSENDHSGVKKAKSRTRM

SEQ ID NO: 891526 - protein, 506 aa, Homo sapiens
MLSKVLPVLLGILLILQSRVEGPQTESKNEASSRDVVYGPQPQPLENQLLSEETKSTETETGSRVGKLPEASRILNTILSNYDHKLRPGIGEKPTVVTVEISVNSLGPLSILDMEYTIDIIFSQTWYDERLCYNDTFESLVLNGNVVSQLWIPDTFFRNSKRTHEHEITMPNQMVRIYKDGKVLYTIRMTIDAGCSLHMLRFPMDSHSCPLSFSSFSYPENEMIYKWENFKLEINEKNSWKLFQFDFTGVSNKTEIITTPVGDFMVMTIFFNVSRRFGYVAFQNYVPSSVTTMLSWVSFWIKTESAPARTSLGITSVLTMTTLGTFSRKNFPRVSYITALDFYIAICFVFCFCALLEFAVLNFLIYNQTKAHASPKLRHPRINSRAHARTRARSRACARQHQEAFVCQIVTTEGSDGEERPSCSAQQPPSPGSPEGPRSLCSKLACCEWCKRFKKYFCMVPDCEGSTWQQGRLCIHVYRLDNYSRVVFPVTFFFFNVLYWLVCLNL

SEQ ID NO: 891527 - protein, 393 aa, Homo sapiens; identical to SEQ ID NO: 891519

SEQ ID NO: 891528 - protein, 85 aa, Homo sapiens
PPFLQPLLTSPRHSRSGTTCLFSPSSPSPLHLHWHYLGLGLCYLPPGLLPHLHFETAHVQNEIHCLLQTSTTKTSVLLLGSHLSH

SEQ ID NO: 891529 - protein, 557 aa, Homo sapiens
MMSWAQRKAHTSLGVMIAAECLGRVCQSIKQHECYKRRCQLEIEVVIRSRRSHDRLAESHDQGHNVQVTVRTSVCPVDVYATDLTSGGLTEMFILSFFFSFPEDTQFGLGVIDYRPKSPGLESWCKIAGHLRKSVSRWDWLWVRCVWKMSVGAGSWWAFSIRFQSADVCIAHVKQGATKTLGSRLVPVLTTCGAVLTHEGILPSHECAEKEAKSILCFSTTAQTSLVSFAESRHSEGQQCRCDVPQRVMKPLVSHLDISCVGMISRRLIDFFLSPDSLANLQRQTLGVGQWTEKEAIKILALAELSTGHWSCSDFMVMTIFFNVSRRFGYVAFQNYVPSSVTTMLSWVSFWIKTESAPARTSLGITSVLTMTTLGTFSRKNFPRVSYITALDFYIAICFVFCFCALLEFAVLNFLIYNQTKAHASPKLRHPRINSRAHARTRARSRACARQHQEAFVCQIVTTEGSDGEERPSCSAQQPPSPGSPEGPRSLCSKLACCEWCKRFKKYFCMVPDCEGSTWQQGRLCIHVYRLDNYSRVVFPVTFFFFNVLYWLVCLNL

SEQ ID NO: 891530 - protein, 313 aa, Homo sapiens
MRSPCPTRWSASTRMARCCTQLVSYPENEMIYKWENFKLEINEKNSWKLFQFDFTGVSNKTEIITTPVGDFMVMTIFFNVSRRFGYVAFQNYVPSSVTTMLSWVSFWIKTESAPARTSLGITSVLTMTTLGTFSRKNFPRVSYITALDFYIAICFVFCFCALLEFAVLNFLIYNQTKAHASPKLRHPRINSRAHARTRARSRACARQHQEAFVCQIVTTEGSDGEERPSCSAQQPPSPGSPEGPRSLCSKLACCEWCKRFKKYFCMVPDCEGSTWQQGRLCIHVYRLDNYSRVVFPVTFFFFNVLYWLVCLNL

SEQ ID NO: 891531 - protein, 135 aa, Homo sapiens
MEYTIDIIFSQTWYDERLCYNDTFESLVLNGNVVSQLWIPDTFFRNSKRTHEHEITMPNQMVRIYKDGKVLYTIRMTIDAGCSLHMLRFPMDSHSCPLSFSSCEYLLKFLGPQKHAGLLLFLILAIYIFLPLLFF

SEQ ID NO: 891532 - protein, 124 aa, Homo sapiens
MWHNENPSPVQVAPRPGPRLSSAPCPIFGKILLLWSSPLALKNKGLVRGPSHCCFPKKAWIQGRGLPRATPLTPSQRPEQPLSGWFGAGAAWRKDSEGGPSRLHPLAPLPSPSPPVASENLRDR

SEQ ID NO: 891533 - protein, 204 aa, Homo sapiens
GPMFTELRSKLSPPRGRAGAVRAGFGERRDVDATAHFSFCRTLLEHTVSAESIPCHLPRTPGTSLTWHDSRSQRAASSRPIKLLQQPGTDTPQGRLYSDHYGLYHTSPSLGGLTRPVVLWSQQDVCKWLKKHCPHNYLVYVEAFSQHAITGRALLRLNAEKLQRMGLAQEAQRQEVLQQVLRLQVREEGRSLQLLSQASFGKMS

SEQ ID NO: 891534 - protein, 262 aa, Homo sapiens
RTTLMFTVGWAVSKSQAGFSGEAGAYLKASKDVGDRGKCVGGVDLPLVLAPALFTCRYHTEPSFIHSLTMNVGCPSVNQTWIKTPASPDSATAHFSFCRTLLEHTVSAESIPCHLPRTPGTSLTWHDSRSQRAASSRPIKLLQQPGTDTPQGRLYSDHYGLYHTSPSLGGLTRPVVLWSQQDVCKWLKKHCPHNYLVYVEAFSQHAITGRALLRLNAEKLQRMGLAQEAQRQEVLQQVLRLQVREEGRSLQLLSQASFGKMS

SEQ ID NO: 891535 - protein, 124 aa, Homo sapiens; identical to SEQ ID NO: 891532

SEQ ID NO: 891536 - protein, 223 aa, Homo sapiens
RTTLMFTVGWAVSKSQAGFSGEAGAYLKASKDVGDRGKCVGGVDLPLVLAAATAHFSFCRTLLEHTVSAESIPCHLPRTPGTSLTWHDSRSQRAASSRPIKLLQQPGTDTPQGRLYSDHYGLYHTSPSLGGLTRPVVLWSQQDVCKWLKKHCPHNYLVYVEAFSQHAITGRALLRLNAEKLQRMGLAQEAQRQEVLQQVLRLQVREEGRSLQLLSQASFGKMS

SEQ ID NO: 891537 - protein, 221 aa, Homo sapiens
NLDNWPGRSHPVSPHHGETLIPAPVWLRKYSARLPPSAFAQGALLPLLPSLLLCLALAHARLSRLPCFAALTFLYSDKKKKSEIKLVPKCWRCWVCEERASGQPRPPGGSGVTPWRGVWATPRRGWKQGSSHACGRSPVLDTTPDTLEGTAQTAREGPAAAVTEDHGGVLRTADIHSLWSSGGRSPKSSSLRASWGDSSPLQLPVAAGGTRAHGHYPSPPL

SEQ ID NO: 891538 - protein, 765 aa, Homo sapiens
QASRACVIGRGRGRFLELQPRLRDVSARQSWPVELVQTKPRRDGLEPGPGFAQAAFEADPAGSSWGLPAFELRWRAGARSPVRPRLGAAISMATAVSRPCAGRSRDILWRVLGWRIVASIVWSVLFLPICTTVFIIFSRIDLFHPIQWLSDSFSDLYSSYVIFYFLLLSVVIIIISIFNVEFYAVVPSIPCSRLALIGKIIHPQQLMHSFIHAAMGMVMAWCAAVITQGQYSFLVVPCTGTNSFGSPAAQTCLNEYHLFFLLTGAFMGYSYSLLYFVNNMNYLPFPIIQQYKFLRFRRSLLLLVKHSCVESLFLVRNFCILYYFLGYIPKAWISTAMNLHIDEQVHRPLDTVSGLLNLSLLYHVWLCGVFLLTTWYVSWILFKIYATEAHVFPVQPPFAEGSDECLPKVLNSNPPPIIKYLALQDLMLLSQYSPSRRQEVFSLSQPGGHPHNWTAISRECLNLLNGMTQKLILYQEAAATNGRVSSSYPVEPKKLNSPEETAFQTPKSSQMPRPSVPPLVKTSLFSSKLSTPDVVSPFGTPFGSSVMNRMAGIFDVNTCYGSPQSPQLIRRGPRLWTSASDQQMTEFSNPSPSTSISAEGKTMRQPSVIYSWIQNKREQIKNFLSKRVLIMYFFSKHPEASIQAVFSDAQMHIWALEGLSHLVAASFTEDRFGVVQTTLPAILNTLLTLQEAVDKYFKLPHASSKPPRISGSLVDTSYKTLRFAFRASLKTAIYRITTTFGEHLNAVQASAEHQKRLQQFLEFKE

SEQ ID NO: 891539 - protein, 633 aa, Homo sapiens
QASRACVIGRGRGRFLELQPRLRDVSARQSWPVELVQTKPRRDGLEPGPGFAQAAFEADPAGSSWGLPAFELRWRAGARSPVRPRLGAAISMATAVSRPCAGRSRDILWRVLGWRIVASIVWSVLFLPICTTVFIIFSRIDLFHPIQWLSDSFSDLYSSYVIFYFLLLSVVIIIISIFNVEFYAVVPSIPCSRLALIGKIIHPQQLMHSFIHAAMGMVMAWCAAVITQGQYSFLVVPCTGTNSFGSPAAQTCLNEYHLFFLLTGAFMGYSYSLLYFVNNMNYLPFPIIQQYKFLRFRRSLLLLVKHSCVESLFLVRNFCILYYFLGYIPKAWISTAMNLHIDEQVHRPLDTVSGLLNLSLLYHVWLCGVFLLTTWYVSWILFKIYATEAHVFPVQPPFAEGSDECLPKVLNSNPPPIIKYLALQDLMLLSQYSPSRRQEVFSLSQPGGHPHNWTAISRECLNLLNGMTQKLILYQEAAATNGRVSSSYPVEPKKLNSPEETAFQTPKSSQMPRPSVPPLVKTSLFSSKLSTPDVVSPFGTPFGSSVMNRMAGIFDVNTCYGSPQSPQLIRRGPRLWTSASDQQMTEFSNPSPSTSISAEAPRGLHSGCFFRCPNAYLGIRRSVALSSSIIYRG

SEQ ID NO: 891540 - protein, 131 aa, Homo sapiens
MQRRHLLLAPRWTLLRRDRLVARGRFLELQPRLRDVSARQSWPVELVQTKPRRDGLEPGPGFAQAAFEADPAGSSWGLPAFELRWRAGARSPVRPRLGAAISMATAVSRPCAGRSRDILWRILSVTCIVPM

SEQ ID NO: 891541 - protein, 504 aa, Homo sapiens
QASRACVIGRGRGRFLELQPRLRDVSARQSWPVELVQTKPRRDGLEPGPGFAQAAFEADPAGSSWGLPAFELRWRAGARSPVRPRLGAAISMATAVSRPCAGRSRDILWRVLGWRIVASIVWSVLFLPICTTVFIIFSRIDLFHPIQWLSDSFSDLYSSYVIFYFLLLSVVIIIISIFNVEFYAVVPSIPCSRLALIGKIIHPQQLMHSFIHAAMGMVMAWCAAVITQGQYSFLVVPCTGTNSFGSPAAQTCLNEYHLFFLLTGAFMGYSYSLLYFVNNMNYLPFPIIQQYKFLRFRRSLLLLVKHSCVESLFLVRNFCILYYFLGYIPKAWISTAMNLHIDEQVHRPLDTVSGLLNLSLLYHVWLCGVFLLTTWYVSWILFKIYATEAHVFPVQPPFAEGSDECLPKVLNSNPPPIIKYLALQDLMLLSQYSPSRRQEVFSLSQPGGHPHNWTAISRECLNLLNGMTQKLILYQEAAATNGRVSSSYPVEPKKLNSPGSRQVL

SEQ ID NO: 891542 - protein, 793 aa, Homo sapiens
QASRACVIGRGRGRFLELQPRLRDVSARQSWPVELVQTKPRRDGLEPGPGFAQAAFEADPAGSSWGLPAFELRWRAGARSPVRPRLGAAISMATAVSRPCAGRSRDILWRVLGWRIVASIVWSVLFLPICTTVFIIFSRIDLFHPIQWLSDSFSDLYSSYVIFYFLLLSVVIIIISIFNVEFYAVVPSIPCSRLALIGKIIHPQQLMHSFIHAAMGMVMAWCAAVITQGQYSFLVVPCTGTNSFGSPAAQTCLNEYHLFFLLTGAFMGYSYSLLYFVNNMNYLPFPIIQQYKFLRFRRSLLLLVKHSCVESLFLVRNFCILYYFLGYIPKAWISTAMNLHIDEQVHRPLDTVSGLLNLSLLYHVWLCGVFLLTTWYVSWILFKIYATEAHVFPVQPPFAEGSDECLPKVLNSNPPPIIKYLALQDLMLLSQYSPSRRQEVFSLSQPGGHPHNWTAISRECLNLLNGMTQKLILYQEAAATNGRVSSSYPVEPKKLNSPEETAFQTPKSSQMPRPSVPPLVKTSLFSSKLSTPDVVSPFGTPFGSSVMNRMAGIFDVNTCYGSPQSPQLIRRGPRLWTSASDQQMTEFSNPSPSTSISAEGKTMRQPSVIYSWIQNKREQIKNFLSKRVLIMYFFSKHPEASIQAVFSDAQMHIWALEGLSHLVAASFTEDRFGVVQTTLPAILNTLLTLQEAVDKYFKLPHASSKPPRISGSLVDTSYKTLRFAFRASLKTAIYRITTTFGEHLNKLKTWGEQSIPEMNPWCFVIHAGKTPTDHNTLRNRTREKTTNAKPVYI

SEQ ID NO: 891543 - protein, 494 aa, Homo sapiens
QASRACVIGRGRGRFLELQPRLRDVSARQSWPVELVQTKPRRDGLEPGPGFAQAAFEADPAGSSWGLPAFELRWRAGARSPVRPRLGAAISMATAVSRPCAGRSRDILWRVLGWRIVASIVWSVLFLPICTTVFIIFSRIDLFHPIQWLSDSFSDLYSSYVIFYFLLLSVVIIIISIFNVEFYAVVPSIPCSRLALIGKIIHPQQLMHSFIHAAMGMVMAWCAAVITQGQYSFLVVPCTGTNSFGSPAAQTCLNEYHLFFLLTGAFMGYSYSLLYFVNNMNYLPFPIIQQYKFLRFRRSLLLLVKHSCVESLFLVRNFCILYYFLGYIPKAWISTAMNLHIDEQVHRPLDTVSGLLNLSLLYHVWLCGVFLLTTWYVSWILFKIYATEAHVFPVQPPFAEGSDECLPKVLNSNPPPIIKYLALQDLMLLSQYSPSRRQEVFSLSQPAPCIGIPMNYDFSFCFIRVHICPTSGKVKQSFRKKVNLYPKHFNKKLK

SEQ ID NO: 891544 - protein, 776 aa, Homo sapiens
MQRRHLLLAPRWTLLRRDRLVARGRFLELQPRLRDVSARQSWPVELVQTKPRRDGLEPGPGFAQAAFEADPAGSSWGLPAFELRWRAGARSPVRPRLGAAISMATAVSRPCAGRSRDILWRVLGWRIVASIVWSVLFLPICTTVFIIFSRIDLFHPIQWLSDSFSDLYSSYVIFYFLLLSVVIIIISIFNVEFYAVVPSIPCSRLALIGKIIHPQQLMHSFIHAAMGMVMAWCAAVITQGQYSFLVVPCTGTNSFGSPAAQTCLNEYHLFFLLTGAFMGYSYSLLYFVNNMNYLPFPIIQQYKFLRFRRSLLLLVKHSCVESLFLVRNFCILYYFLGYIPKAWISTAMNLHIDEQVHRPLDTVSGLLNLSLLYHVWLCGVFLLTTWYVSWILFKIYATEAHVFPVQPPFAEGSDECLPKVLNSNPPPIIKYLALQDLMLLSQYSPSRRQEVFSLSQPGGHPHNWTAISRECLNLLNGMTQKLILYQEAAATNGRVSSSYPVEPKKLNSPEETAFQTPKSSQMPRPSVPPLVKTSLFSSKLSTPDVVSPFGTPFGSSVMNRMAGIFDVNTCYGSPQSPQLIRRGPRLWTSASDQQMTEFSNPSPSTSISAEGKTMRQPSVIYSWIQNKREQIKNFLSKRVLIMYFFSKHPEASIQAVFSDAQMHIWALEGLSHLVAASFTEDRFGVVQTTLPAILNTLLTLQEAVDKYFKLPHASSKPPRISGSLVDTSYKTLRFAFRASLKTAIYRITTTFGEHLNAVQASAEHQKRLQQFLEFKE

SEQ ID NO: 891545 - protein, 765 aa, Homo sapiens; identical to SEQ ID NO: 891538

SEQ ID NO: 891546 - protein, 765 aa, Homo sapiens; identical to SEQ ID NO: 891538

SEQ ID NO: 891547 - protein, 363 aa, Homo sapiens
QASRACVIGRGRGRFLELQPRLRDVSARQSWPVELVQTKPRRDGLEPGPGFAQAAFEADPAGSSWGLPAFELRWRAGARSPVRPRLGAAISMATAVSRPCAGRSRDILWRVLGWRIVASIVWSVLFLPICTTVFIIFSRIDLFHPIQWLSDSFSDLYSSYVIFYFLLLSVVIIIISIFNVEFYAVVPSIPCSRLALIGKIIHPQQLMHSFIHAAMGMVMAWCAAVITQGQYSFLVVPCTGTNSFGSPAAQTCLNEYHLFFLLTGAFMGYSYSLLYFVNNMNYLPFPIIQAVDKYFKLPHASSKPPRISGSLVDTSYKTLRFAFRASLKTAIYRITTTFGEHLNAVQASAEHQKRLQQFLEFKE

SEQ ID NO: 891548 - protein, 374 aa, Homo sapiens
MEPGGEPTGAKESSTLMESLAAVKAAFLAQAPSGSRSAEVQAAQSTEPAAEAGAPEGEGHRGGPPRALGSLGLCENQEARERPGGSPRGPVTSEKTGGQSGLESDVPPNAGPGAEGGGSWKGRPFPCGACGRSFKCSSDAAKHRSIHSGEKPYECSDCGKAFIHSSHVVRHQRAHSGERPYACAECGKAFGQSFNLLRHQRVHTGEKPYACADCGKAFGQRSDAAKHRRTHTGERLYACGECGKRFLHSSNVVRHRRTHHGENPYECRECGQAFSQSSNLLQHQRVHTGERPFACQDCGRAFSRSSFLREHCRIHTGEKPHQCGHCGRAFRALSGFFRHQRLHTGEKPFRCTECGRAFRLSFHLIQHRRVHGAE

SEQ ID NO: 891549 - protein, 124 aa, Homo sapiens
YIKFFYVVEFVRHLMSGLEKSFLIPKLYHSNKLFFSSGLTFLYSNPYNYQENFKTHGNFSRHLKTAGGRGLPQHGARKLWPRPPVLCVSPGWRGTRRAWTRVPGHPTEQNTRFWECLLSQDLDC

SEQ ID NO: 891550 - protein, 954 aa, Homo sapiens
PSRTREMEEKEILRRQIRLLQGLIDDYKTLHGNAPAPGTPAASGWQPPTYHSGRAFSARYPRPSRRGYSSHHGPSWRKKYSLVNRPPGPSDPPADHAVRPLHGARGGQPPVPQQHVLERQVQLSQGQNVVIKVKPPSKSGSASASGAQRGSLEEFEDTPWSDQRPREGEGEPPRGQLQPSRPTRARGTCSVEDPLLVCQKEPGKPRMVKSVGSVGDSPREPRRTVSESVIAVKASFPSSALPPRTGVALGRKLGSHSVASCAPQLLGDRRVDAGHTDQPVPSGSVGGPARPASGPRQAREASLVVTCRTNKFRKNNYKWVAASSKSPRVARRALSPRVAAENVCKASAGMANKVEKPQLIADPEPKPRKPATSSKPGSAPSKYKWKASSPSASSSSSFRWQSEASSKDHASQLSPVLSRSPSGDRPAVGHSGLKPLSGETPLSAYKVKSRTKIIRRRGSTSLPGDKKSGTSPAATAKSHLSLRRRQALRGKSSPVLKKTPNKGLVQVTTHRLCRLPPSRAHLPTKEASSLHAVRTAPTSKVIKTRYRIVKKTPASPLSAPPFPLSLPSWRARRLSLSRSLVLNRLRPVASGGGKAQPGSPWWRSKGYRCIGGVLYKVSANKLSKTSGQPSDAGSRPLLRTGRLDPAGSCSRSLASRAVQRSLAIIRQARQRREKRKEYCMYYNRFGRCNRGERCPYIHDPEKVAVCTRFVRGTCKKTDGTCPFSHHVSKEKMPVCSYFLKGICSNSNCPYSHVYVSRKAEVCSDFLKGYCPLGAKCKKKHTLLCPDFARRGACPRGAQCQLLHRTQKRHSRRAATSPAPGPSDATARSRVSASHGPRKPSASQRPTRQTPSSAALTAAAVAAPPHCPGGSASPSSSKASSSSSSSSSPPASLDHEAPSLQEAALAAACSNRLCKLPSFISLQSSPSPGAQPRVRAPRAPLTKDSGKPLHIKPRL

SEQ ID NO: 891551 - protein, 677 aa, Homo sapiens
PPPAPPPARVNIRLGSRALGSREASLVVTCRTNKFRKNNYKWVAASSKSPRVARRALSPRVAAENVCKASAGMANKVEKPQLIADPEPKPRKPATSSKPGSAPSKYKWKASSPSASSSSSFRWQSEASSKDHASQLSPVLSRSPSGDRPAVGHSGLKPLSGETPLSAYKVKSRTKIIRRRGSTSLPGDKKSGTSPAATAKSHLSLRRRQALRGKSSPVLKKTPNKGLVQVTTHRLCRLPPSRAHLPTKEASSLHAVRTAPTSKVIKTRYRIVKKTPASPLSAPPFPLSLPSWRARRLSLSRSLVLNRLRPVASGGGKAQPGSPWWRSKGYRCIGGVLYKVSANKLSKTSGQPSDAGSRPLLRTGRLDPAGSCSRSLASRAVQRSLAIIRQARQRREKRKEYCMYYNRFGRCNRGERCPYIHDPEKVAVCTRFVRGTCKKTDGTCPFSHHVSKEKMPVCSYFLKGICSNSNCPYSHVYVSRKAEVCSDFLKGYCPLGAKCKKKHTLLCPDFARRGACPRGAQCQLLHRTQKRHSRRAATSPAPGPSDATARSRVSASHGPRKPSASQRPTRQTPSSAALTAAAVAAPPHCPGGSASPSSSKASSSSSSSSSPPASLDHEAPSLQEAALAAACSNRLCKLPSFISLQSSPSPGAQPRVRAPRAPLTKDSGKPLHIKPRL

SEQ ID NO: 891552 - protein, 1002 aa, Homo sapiens
PSRTREMEEKEILRRQIRLLQGLIDDYKTLHGNAPAPGTPAASGWQPPTYHSGRAFSARYPRPSRRGYSSHHGPSWRKKYSLVNRPPGPSDPPADHAVRPLHGARGGQPPVPQQHVLERQVQLSQGQNVVIKVKPPSKSGSASASGAQRGSLEEFEDTPWSDQRPREGEGEPPRGQLQPSRPTRARGTCSVEDPLLVCQKEPGKPRMVKSVGSVGDSPREPRRTVSESVIAVKASFPSSALPPRTGVALGRKLGSHSVASCAPQLLGDRRVDAGHTDQPVPSGSVGGPARPASGPRQAREASLVVTCRTNKFRKNNYKWVAASSKSPRVARRALSPRVAAENVCKASAGMANKVEKPQLIADPEPKPRKPATSSKPGSAPSKYKWKASSPSASSSSSFRWQSEASSKDHASQLSPVLSRSPSGDRPAVGHSGLKPLSGETPLSAYKVKSRTKIIRRRGSTSLPGDKKSGTSPAATAKSHLSLRRRQALRGKSSPVLKKTPNKGLVQVTTHRLCRLPPSRAHLPTKEASSLHAVRTAPTSKVIKTRYRIVKKTPASPLSAPPFPLSLPSWRARRLSLSRSLVLNRLRPVASGGGKAQPGSPWWRSKGYRCIGGVLYKVSANKLSKTSGQPSDAGSRPLLRTGRLDPAGSCSRSLASRAVQRSLAIIRQARQRREKRKEYCMYYNRFGRCNRGERCPYIHDPEKVAVCTRFVRGTCKKTDGTCPFSHHVSKEKMPVCSYFLKGICSNSNCPYSHVYVSRKAEVCSDFLKGYCPLGAKCKKKHTLLCPDFARRGACPRGAQCQLLHRTQKRHSRRAATSPAPGPSDATARSRVSASHGPRKPSASQRPTRQTPSSAALTAAAVAAPPHCPGGSASPSSSKASSSSSSSSSPPTAPNKNVKTKKKKKKKKKKKKNLDGGQKQRRRAQKTTTATHTTQARGHITVVHDAPTSVDTGGETNAGPPKRRATNYFATTTVPSAYALRHNSTQHTRPNNQTHTHSHTTAPK

SEQ ID NO: 891553 - protein, 625 aa, Homo sapiens
PSRTREMEEKEILRRQIRLLQGLIDDYKTLHGNAPAPGTPAASGWQPPTYHSGRAFSARYPRPSRRGYSSHHGPSWRKKYSLVNRPPGPSDPPADHAVRPLHGARGGQPPVPQQHVLERQVQLSQGQNVVIKVKPPSKSGSASASGAQRGSLEEFEDTPWSDQRPREGEGEPPRGQLQPSRPTRARGTCSVEDPLLVCQKEPGKPRMVKSVGSVGDSPREPRRTVSESVIAVKASFPSSALPPRTGVALGRKLGSHSVASCAPQLLGDRRVDAGHTDQPVPSGSVGGPARPASGPRQAREASLVVTCRTNKFRKNNYKWVAASSKSPRVARRALSPRVAAENVCKASAGMANKVEKPQLIADPEPKPRKPATSSKPGSAPSKYKWKASSPSASSSSSFRWQSEASSKDHASQLSPVLSRSPSGDRPAVGHSGLKPLSGETPLSAYKVKSRTKIIRRRGSTSLPGDKKSGTSPAATAKSHLSLRRRQALRGKSSPVLKKTPNKGLVQVTTHRLCRLPPSRAHLPTKEASSLHAVRTAPTSKVIKTRYRIVKKTPASPLSAPPFPLSLPSWRARRLSLSRYHCPCKGRMKFAEVTTPFQGAEPDLLCGLRRGCPRAWEWGDVCCESL

SEQ ID NO: 891554 - protein, 374 aa, Homo sapiens; identical to SEQ ID NO: 891548

SEQ ID NO: 891555 - protein, 363 aa, Homo sapiens
PSRTREMEEKEILRRQIRLLQGLIDDYKTLHGNAPAPGTPAASGWQPPTYHSGRAFSARYPRPSRRGYSSHHGPSWRKKYSLVNRPPGPSDPPADHAVRPLHGARGGQPPVPQQHVLERQVQLSQGQNVVIKVKPPSKSGSASASGAQRGSLEEFEDTPWSDQRPREGEGEPPRGQLQPSRPTRARGTCSVEDPLLVCQKEPGKPRMVKSVGSVGDSPREPRRTVSESVIAVKASFPSSALPPRTGVALGRKLGSHSVASCAPQLLGDRRVDAGHTDQPVPSGSVGGPARPASGPRQGRCFMFSNKGSIRKKKKKKKRAAARRVLYSCITSKSVFTVFCVAIMFKLRKTQFLNYLGRVWILYF

SEQ ID NO: 891556 - protein, 335 aa, Homo sapiens
MEPGGEPTGAKESSTLMESLAGRLDPAGSCSRSLASRAVQRSLAIIRQARQRREKRKEYCMYYNRFGRCNRGERCPYIHDPEKVAVCTRFVRGTCKKTDGTCPFSHHVSKEKMPVCSYFLKGICSNSNCPYSHVYVSRKAEVCSDFLKGYCPLGAKCKKKHTLLCPDFARRGACPRGAQCQLLHRTQKRHSRRAATSPAPGPSDATARSRVSASHGPRKPSASQRPTRQTPSSAALTAAAVAAPPHCPGGSASPSSSKASSSSSSSSSPPASLDHEAPSLQEAALAAACSNRLCKLPSFISLQSSPSPGAQPRVRAPRAPLTKDSGKPLHIKPRL

SEQ ID NO: 891557 - protein, 177 aa, Homo sapiens
SGSKSSLFDTEICQHLILGQPSELYIIEQGVCDLVLCEAAFPKTLAFAYLEDLHSEFDEQHGKKVPTVSRPYSFIEFDTFIQKTKKLYIDSCARRNLGSINTELQDVQRIMVANIEEVLQRGEALSALDSKANNLSSLSKKYRQDAKYLNMHSTYAKLAAVAVFFIMLIVYVRFWWL

SEQ ID NO: 891558 - protein, 177 aa, Homo sapiens; identical to SEQ ID NO: 891557

SEQ ID NO: 891559 - protein, 237 aa, Homo sapiens
MTPDHFPSLFCKEMSVGYANGIRVMSMTHTGEPGFMLYIPIEYALHVYNEVMSVGQKYGIRNAGYYALRSLRIEKFFAFWGQDINNLTTPLECGRESRVKLEKGMDFIGRDALLQQKQNGVYKRLTMFILDDHDSDLDLWPWWGEPIYRNGQYVGKTTSSAYSYSLERHVCLGFVHNFSEDTGEEQVVTADFINRGEYEIDIAGYRFQAKAKLYPVASLFTQKRRKDDMELSDLHGK

SEQ ID NO: 891560 - protein, 141 aa, Homo sapiens
MTPDHFPSLFCKEMSVGYANGIRVMSMTHTGEPGFMLYIPIEYALHVYNEVMSVGQKYGIRNAGYYALRSLRIEKFFAFWGQDINNLTTPLECGRESRVKLEKGMDFIGRDALLQQKQNGVYKRLTMFILDSSSINTVTAK

SEQ ID NO: 891561 - protein, 191 aa, Homo sapiens
MTPDHFPSLFCKEMSVGYANGIRVMSMTHTGEPGFMLYIPIEYALHVYNEVMSVGQKYGIRNAGYYALRSLRIEKFFAFWGQDINNLTTPLECGRESRVKLEKGMDFIGRDALLQQKQNGVYKRLTMFILDDHDSDLDLWPWWGEPIYRNGQYVGKTTSSAYSYSLERHVCLGFVLLELKTAAESGGRSHL

SEQ ID NO: 891562 - protein, 122 aa, Homo sapiens
MTPDHFPSLFCKEMSVGYANGIRVMSMTHTGEPGFMLYIPIEYALHVYNEVMSVGQKYGIRNAGYYALRSLRIEKFFAFWGQDINNLTTPLECGRESRVKLEKVLCLPRLHFHSASRVVNLH

SEQ ID NO: 891563 - protein, 265 aa, Homo sapiens
MRFIAGGAMWPSQVLSRSLSLFHSLTLQSTGDQALEVLQYLFSNDLDVPVGHIVHTGMLNEGGGYENDCSIARLNKRSFFMISPTDQQVHCWAWLKKHMPKDSNLLLEDVTWKYTALNLIGPRAVDVLSELSYAPMTPDHFPSLFCKEMSVGYANGIRVMSMTHTGEPGFMLYIPIEGMDFIGRDALLQQKQNGVYKRLTMFILDDHDSDLDLWPWWGEPIYRNGQYVGKTTSSAYSYSLERHVCLGFVLLELKTAAESGGRSHL

SEQ ID NO: 891564 - protein, 107 aa, Homo sapiens [sequence omitted]

SEQ ID NO: 891565 - protein, 407 aa, Homo sapiens
MVNEYKKILLLKGFELMDDYHFTSIKSLLAYDLGLTTKMQEEYNRIKITDLMEKKFQGVACLDKLIELAKDMPSLKNLVNNLRKEKSKVAKKIKTQEKAPVKKINQEEVGLAAPAPTARNKLTSEARGRIPVAQKRKTPNKEKTEAKRNKVSQEQSKPPGPSGASTSAAVDHPPLPQTSSSTPSNTSFTPNQETQAQRQVDARRNVPQNDPVTVVVLKATAPFKYESPENGKSTMFHATVASKTQYFHVKVFDINLKEKFVRKKVITISDYSECKGVMEIKEASSVSDFNQNFEVPNRIIEIANKTPKISQLYKQASGTMVYGLFMLQKKSVHKKNTIYEIQDNTGSMDVVGSGKWHNIKCEKGDKLRLFCLQLRTVDRKLKLVCGSHSFIKVIKAKKNKEGPMNVN

SEQ ID NO: 891566 - protein, 389 aa, Homo sapiens
MVNEYKKILLLKGFELMDDYHFTSIKSLLAYDLGLTTKMQEEYNRIKITDLMEKKFQGVACLDKLIELAKDMPSLKNLVNNLRKEKSKVAKKIKTQEKAPVKKINQEEVGLAAPAPTARNKLTSEARGRIPVAQKRKTPNKEKTGASTSAAVDHPPLPQTSSSTPSNTSFTPNQETQAQRQVDARRNVPQNDPVTVVVLKATAPFKYESPENGKSTMFHATVASKTQYFHVKVFDINLKEKFVRKKVITISDYSECKGVMEIKEASSVSDFNQNFEVPNRIIEIANKTPKISQLYKQASGTMVYGLFMLQKKSVHKKNTIYEIQDNTGSMDVVGSGKWHNIKCEKGDKLRLFCLQLRTVDRKLKLVCGSHSFIKVIKAKKNKEGPMNVN

SEQ ID NO: 891567 - protein, 407 aa, Homo sapiens; identical to SEQ ID NO: 891565

SEQ ID NO: 891568 - protein, 398 aa, Homo sapiens
MVNEYKKILLLKGFELMDDYHFTSIKSLLAYDLGLTTKMQEEYNRIKITDLMEKKFQGVACLDKLIELAKDMPSLKNLVNNLRKEKSKVAKKIKTQEKAPVKKINQEEVGLAAPAPTARNKLTSEARGRIPVAQKRKTPNKEKTEAKRNKVSQEQSKPPGPSGASTSAAVDHPPLPQTSSSTPSNTSFTPNQETQAQRQVDARRNVPQNDPVTVVVLKATAPFKYESPENGKSTMFHATVASKTQYFHVKVFDINLKEKFVRKKVITISDYSECKGVMEIKEASSVSDFNQNFEVPNRIIEIANKTPKISQLYKQASGTMVYGLFMLQKKSVHKKNTIYEIQDNTGSMDVVGSGKWHNIKCEKGDKLRLFCLQLRTVDRKLKLVIKAKKNKEGPMNVN

SEQ ID NO: 891569 - protein, 335 aa, Homo sapiens
MVNEYKKILLLKGFELMDDYHFTSIKSLLAYDLGLTTKMQEEYNRIKITDLMEKKFQGVACLDKLIELAKDMPSLKNLVNNLRKEKSKVAKKIKTQEKAPVKKINQEEVGLAAPAPTARNKLTSEARGRIPVAQKRKTPNKEKTEAKRNKVSQEQSKPPGPSGASTSAAVDHPPLPQTSSSTPSNTSFTPNQETQAQRQVDARRNVPQNDPVTVVVLKATAPFKYESPENGKSTMFHATVASKTQYFHVKVFDINLKEKFVRKKVITISDYSECKGVMEIKEASSVSDFNQNFEVPNRIIEIANKTPKISQLYKQASGSDVAIWVRCCHLGQMLP

SEQ ID NO: 891570 - protein, 228 aa, Homo sapiens
MPVKGGTKCIKYLLFGFNFIFWLAGIAVLAIGLWLRFDSQTKSIFEQETNNNNSSFYTGVYILIGAGALMMLVGFLGCCGAVQESQCMLGLFFGFLLVIFAIEIAAAIWGYSHKDEVIKEVQEFYKDTYNKLKTKDEPQRETLKAIHYALNCCGLAGGVEQFISDICPKKDVLETFTVKSCPDAIKEVFDNKFHIIGAVGIGIAVVMIFGMIFSMILCCAIRRNREMV

SEQ ID NO: 891571 - protein, 228 aa, Homo sapiens; identical to SEQ ID NO: 891570

SEQ ID NO: 891572 - protein, 228 aa, Homo sapiens; identical to SEQ ID NO: 891570

SEQ ID NO: 891573 - protein, 228 aa, Homo sapiens; identical to SEQ ID NO: 891570

SEQ ID NO: 891574 - protein, 228 aa, Homo sapiens; identical to SEQ ID NO: 891570

SEQ ID NO: 891575 - protein, 228 aa, Homo sapiens; identical to SEQ ID NO: 891570

SEQ ID NO: 891576 - protein, 228 aa, Homo sapiens; identical to SEQ ID NO: 891570

SEQ ID NO: 891577 - protein, 228 aa, Homo sapiens; identical to SEQ ID NO: 891570

SEQ ID NO: 891578 - protein, 73 aa, Homo sapiens
TEEEEEEEGGEERRGNEEKKRREGSCPDAIKEVFDNKFHIIGAVGIGIAVVMIFGMIFSMILCCAIRRNREMV

SEQ ID NO: 891579 - protein, 68 aa, Homo sapiens
MASGQDFTVKVSSTSFLGQSCPDAIKEVFDNKFHIIGAVGIGIAVVMIFGMIFSMILCCAIRRNREMV

SEQ ID NO: 891580 - protein, 121 aa, Homo sapiens
PSPPSAHQFSRVRRGPWEGGGALGGRIVCDPGLGLSPQVSCPDAIKEVFDNKFHIIGAVGIGIAVVMEPRDGLESAYIPEQESLPMKIGGIFCLFVLFCLLFVVCFFATNFSIHSALLDKS

SEQ ID NO: 891581 - protein, 123 aa, Homo sapiens
MPVKGGTKCIKYLLFGFNFIFWLAGIAVLAIGLWLRFDSQTKSIFEQETNNNNSSFYTGVYILIGAGALMMLVGFLGCCGAVQESQCMLGLFFGFLLVIFAIEIAAAIWGYSHKDEVIFFQVS

SEQ ID NO: 891582 - protein, 228 aa, Homo sapiens; identical to SEQ ID NO: 891570

SEQ ID NO: 891583 - protein, 228 aa, Homo sapiens; identical to SEQ ID NO: 891570

SEQ ID NO: 891584 - protein, 228 aa, Homo sapiens; identical to SEQ ID NO: 891570

SEQ ID NO: 891585 - protein, 158 aa, Homo sapiens
MLVGFLGCCGAVQESQCMLGLFFGFLLVIFAIEIAAAIWGYSHKDEVIKEVQEFYKDTYNKLKTKDEPQRETLKAIHYALNCCGLAGGVEQFISDICPKKDVLETFTVKSCPDAIKEVFDNKFHIIGAVGIGIAVVMIFGMIFSMILCCAIRRNREMV

SEQ ID NO: 891586 - protein, 232 aa, Homo sapiens
DLVALFDRHGEGKLSLGERVLGLLSQRPQQSRKHTSIMRAPDSDQNIDSCVEAGIIIISFLLEDALGLRVESEPESNGKDSNPGKPEDEVKSEQQFFGFLLVIFAIEIAAAIWGYSHKDEVIKEVQEFYKDTYNKLKTKDEPQRETLKAIHYALNCCGLAGGVEQFISDICPKKDVLETFTVKSCPDAIKEVFDNKFHIIGAVGIGIAVVMIFGMIFSMILCCAIRRNREMV

SEQ ID NO: 891587 - protein, 228 aa, Homo sapiens; identical to SEQ ID NO: 891570

SEQ ID NO: 891588 - protein, 96 aa, Homo sapiens
RLDLVSRLYLCSRLYRVSRLYLVSRLYLVSRLYLVFGSTLVSRLYLVSCPDAIKEVFDNKFHIIGAVGIGIAVVMIFGMIFSMILCCAIRRNREMV

SEQ ID NO: 891589 - protein, 216 aa, Homo sapiens
MPVKGGTKCIKYLLFGFNFIFWLAGIAVLAIGLWLRFDSQTKSIFEQETNNNNSSFYTGVYILIGAGALMMLVGFLGCCGAVQESQCMLGLFFGFLLVIFAIEIAAAIWGYSHKDEVIKEVQEFYKDTYNKLKTKDEPQRETLKAIHYALNCCGLAGGVEQFISDICPKKDVLETFTVKVNSDQDPGVPAPIALDKPCKHESDSSQVLLQQDPFCL

SEQ ID NO: 891590 - protein, 107 aa, Homo sapiens
MERITFVRGGRCENAVSAPLSSAHCEVIKEVQEFYKDTYNKLKTKDEPQRETLKAIHYAVCRLGKDTLLRFLRIVSAHRVLTAPDQCKHSNRLLTICFSHPHPCLLA

SEQ ID NO: 891591 - protein, 316 aa, Homo sapiens
LQEREEQQLHRQERDRKFLEEEPQLRRQEREQQLRHDRDRKFREEEQLLQEGEEQQLRRQERDRKFREEEQQLRRQERERKFLQEEQQLRRQELERKFREEEQLRQETEQEQLRRQERYRKILEEEQLRPEREEQQLRRQERDRKFREEEQLRQEREEQQLRSQESDRKFREEEQLRQEREEQQLRPQQRDGKYRWEEEQLQLEEQEQRLRQERDRQYRAEEQFATQEKSRREEQELWQEEEQKRRQERERKLREEHIRRQQKEEQRHRQVGEIQSQEGKGHGRLLEPGTHQFASVPVRSSPLYEYIQEQRSQYRP

SEQ ID NO: 891592 - protein, 103 aa, Homo sapiens
VDPRGSPVILRTCTSAFYSSSSSSLLQDVFLCSLMRMWIVQSTSAASRRRNRGTAKSGRYNPKKGRAMGGFWSPALISLPVSQCAPALSMSTSKSRDLNTALK

SEQ ID NO: 891593 - protein, 316 aa, Homo sapiens; identical to SEQ ID NO: 891591

SEQ ID NO: 891594 - protein, 316 aa, Homo sapiens; identical to SEQ ID NO: 891591

SEQ ID NO: 891595 - protein, 77 aa, Homo sapiens
SESYLVIVVPRGIPQSTSAASRRRNRGTAKSGRYNPKKGRAMGGFWSPALISLPVSQCAPALSMSTSKSRDLNTALK

SEQ ID NO: 891596 - protein, 132 aa, Homo sapiens
MAAATLTSKLYSLLFRRPPPSPSPSSWASCSSSAPSIKARTLSTTTSTRGSCGNTSSTSMRTSSSLEAPIQARRTRSTQQLFAQSWSLSLKMMLKVLFMDHHSLLARNGFTYKTDSLPSAVFEVCLVSMLRK

SEQ ID NO: 891597 - protein, 132 aa, Homo sapiens; identical to SEQ ID NO: 891596

SEQ ID NO: 891598 - protein, 132 aa, Homo sapiens; identical to SEQ ID NO: 891596

SEQ ID NO: 891599 - protein, 132 aa, Homo sapiens; identical to SEQ ID NO: 891596

SEQ ID NO: 891600 - protein, 132 aa, Homo sapiens; identical to SEQ ID NO: 891596

SEQ ID NO: 891601 - protein, 132 aa, Homo sapiens; identical to SEQ ID NO: 891596

SEQ ID NO: 891602 - protein, 132 aa, Homo sapiens; identical to SEQ ID NO: 891596

SEQ ID NO: 891603 - protein, 132 aa, Homo sapiens; identical to SEQ ID NO: 891596

SEQ ID NO: 891604 - protein, 83 aa, Homo sapiens [sequence omitted]

SEQ ID NO: 891605 - protein, 83 aa, Homo sapiens [sequence omitted]

SEQ ID NO: 891606 - protein, 132 aa, Homo sapiens; identical to SEQ ID NO: 891596

SEQ ID NO: 891607 - protein, 132 aa, Homo sapiens; identical to SEQ ID NO: 891596

SEQ ID NO: 891608 - protein, 83 aa, Homo sapiens [sequence omitted]

SEQ ID NO: 891609 - protein, 83 aa, Homo sapiens [sequence omitted]

SEQ ID NO: 891610 - protein, 132 aa, Homo sapiens; identical to SEQ ID NO: 891596

SEQ ID NO: 891611 - protein, 132 aa, Homo sapiens; identical to SEQ ID NO: 891596

SEQ ID NO: 891612 - protein, 352 aa, Homo sapiens
MVLASLSTLSEAAWIEFMMGDARTILEENIQDQDVLLLIKKRAPSPLPKMADVSAEEKKKQDQKAPDKEAILRATANLPSYNMDRAAVQTNMRDFQTELRKILVSLIEVAQKLLALNPDAVELFKKANAMLDEDEDERVDEAALRQLTEMGFPENRATKALQLNHMSVPQAMEWLIEHAEDPTIDTPLPGQAPPEAEGATAAASEAAAGASATDEEARDELTEIFKKIRRKREFRADARAVISLMEMGFDEKEVIDALRVNNNQQNAACEWLLGDRKPSPEELDKGIDPDSPLFQAILDNPVVQLGLTNPKTLLAFEDMLENPLNSTQWMNDPETGPVMLQISRIFQTLNRT

SEQ ID NO: 891613 - protein, 434 aa, Homo sapiens
TVRETIGWVRGPGGFRARVAGAGPCGGGGMFVQEEKIFAGKVLRLHICASDGAEWLEEATEDTSVEKLKERCLKHCAHGSLEDPKSITHHKLIHAASERVLSDARTILEENIQDQDVLLLIKKRAPSPLPKMADVSAEEKKKQDQKAPDKEAILRATANLPSYNMDRAAVQTNMRDFQTELRKILVSLIEVAQKLLALNPDAVELFKKANAMLDEDEDERVDEAALRQLTEMGFPENRATKALQLNHMSVPQAMEWLIEHAEDPTIDTPLPGQAPPEAEGATAAASEAAAGASATDEEARDELTEIFKKIRRKREFRADARAVISLMEMGFDEKEVIDALRVNNNQQNAACEWLLGDRKPSPEELDKGIDPDSPLFQAILDNPVVQLGLTNPKTLLAFEDMLENPLNSTQWMNDPETGPVMLQISRIFQTLNRT

SEQ ID NO: 891614 - protein, 405 aa, Homo sapiens
MFVQEEKIFAGKVLRLHICASDGAEWLEEATEDTSVEKLKERCLKHCAHGSLEDPKSITHHKLIHAASERVLSDARTILEENIQDQDVLLLIKKRAPSPLPKMADVSAEEKKKQDQKAPDKEAILRATANLPSYNMDRAAVQTNMRDFQTELRKILVSLIEVAQKLLALNPDAVELFKKANAMLDEDEDERVDEAALRQLTEMGFPENRATKALQLNHMSVPQAMEWLIEHAEDPTIDTPLPGQAPPEAEGATAAASEAAAGASATDEEARDELTEIFKKIRRKREFRADARAVISLMEMGFDEKEVIDALRVNNNQQNAACEWLLGDRKPSPEELDKGIDPDSPLFQAILDNPVVQLGLTNPKTLLAFEDMLENPLNSTQWMNDPETGPVMLQISRIFQTLNRT

SEQ ID NO: 891615 - protein, 448 aa, Homo sapiens
MFVQEEKIFAGKVLRLHICASDGAEWLEEATEDTSVEKLKERCLKHCAHGSLEDPKSITHHKLIHAASERVLSDARTILEENIQDQDVLLLIKKRAPSPLPKMADVSAEEKKKQDQKAPDKEAILRATANLPSYNMDRAAVQTNMRDFQTELRKILVSLIEVAQKLLALNPDAVELFKKANAMLDEDEDERVDEAALRQLTEMGFPENRATKALQLNHMSVPQAMEWLIEHAEDPTIDTPLPGQAPPEAEGATAAASEAAAGASATDEEARDELTEIFKKIRRKREFRADARGAKFTSDPGSLSKLEQSLSSWVPCALRLDFALSCVVVLHGLLEAVISLMEMGFDEKEVIDALRVNNNQQNAACEWLLGDRKPSPEELDKGIDPDSPLFQAILDNPVVQLGLTNPKTLLAFEDMLENPLNSTQWMNDPETGPVMLQISRIFQTLNRT

SEQ ID NO: 891616 - protein, 378 aa, Homo sapiens
MFVQEEKIFAGKVLRLHICASDGAEWLEEATEDTSVEKLKERCLKHCAHGSLEDPKSITHHKLIHAASERVLSDARTILEENIQDQDVLLLIKKRAPSPLPKMADVSAEEKKKQDQKAPDKEAILRATANLPSYNMDRAAVQTNMRDFQTELRKILVSLIEVAQKLLALNPDAVELFKKANAMLDEDEDERVDEAALRQLTEMGFPENRATKALQLNHMSVPQAMEWLIEHAEDPTIDTPLPGQAPPEAEGATAAASEAAAGASATDEEARDELTEIFKKIRRKREFRADARAVISLMEMGFDEKEVIDALRVNNNQQNAAAILDNPVVQLGLTNPKTLLAFEDMLENPLNSTQWMNDPETGPVMLQISRIFQTLNRT

SEQ ID NO: 891617 - protein, 303 aa, Homo sapiens
MADVSAEEKKKQDQKAPDKEAILRATANLPSYNMDRAAVQTNMRDFQTELRKILVSLIEVAQKLLALNPDAVELFKKANAMLDEDEDERVDEAALRQLTEMGFPENRATKALQLNHMSVPQAMEWLIEHAEDPTIDTPLPGQAPPEAEGATAAASEAAAGASATDEEARDELTEIFKKIRRKREFRADARAVISLMEMGFDEKEVIDALRVNNNQQNAACEWLLGDRKPSPEELDKGIDPDSPLFQAILDNPVVQLGLTNPKTLLAFEDMLENPLNSTQWMNDPETGPVMLQISRIFQTLNRT

SEQ ID NO: 891618 - protein, 330 aa, Homo sapiens
MFVQEEKIFAGKVLRLHICASDGAEWLEEATEDTSVEKLKERCLKHCAHGSLEDPKSITHHKLIHAASERVLSDARTILEENIQDQDVLLLIKKRAPSPLPKMADVSAEEKKKQDQKAPDKEAILRATANLPSYNMDRAAVQTNMRDFQTELRKILVSLIEVAQKLLALNPDAVELFKKANAMLDEDEDERVDEAALRQLTEMGFPENRATKALQLNHMSVPQAMEWLIEHAEDPTIDTPLPGQAPPEAEGATAAASEAAAGASATDEEARDELTEIFKKIRRKREFRADARAVISLMEMGFDEKEVILWEDLGKPVSGYVGLHYFAFFL

SEQ ID NO: 891619 - protein, 187 aa, Homo sapiens [sequence omitted]

SEQ ID NO: 891620 - protein, 230 aa, Homo sapiens
MSVPQAMEWLIEHAEDPTIDTPLPGQAPPEAEGATAAASEAAAGASATDEEARDELTEIFKKIRRKREFRADARGAKFTSDPGSLSKLEQSLSSWVPCALRLDFALSCVVVLHGLLEAVISLMEMGFDEKEVIDALRVNNNQQNAACEWLLGDRKPSPEELDKGIDPDSPLFQAILDNPVVQLGLTNPKTLLAFEDMLENPLNSTQWMNDPETGPVMLQISRIFQTLNRT

SEQ ID NO: 891621 - protein, 215 aa, Homo sapiens
MFVQEEKIFAGKVLRLHICASDGAEWLEEATEDTSVEKLKERCLKHCAHGSLEDPKSITHHKLIHAASERVLSDARTILEENIQDQDVLLLIKKRAPSPLPKMADVSAEEKKKQDQKAPDKEAILRATANLPSYNMDRAAVQTNMRDVSVSPERRRVHGVPVWGIAVGGFLRGGAARGDSLGGFGEAGERVCRTALFCIFSVNQKLFPSKSWKAI

SEQ ID NO: 891622 - protein, 405 aa, Homo sapiens; identical to SEQ ID NO: 891614

SEQ ID NO: 891623 - protein, 435 aa, Homo sapiens
RRREQKHKSRTRLGWYRARVAGAGPCGGGGMFVQEEKIFAGKVLRLHICASDGAEWLEEATEDTSVEKLKERCLKHCAHGSLEDPKSITHHKLIHAASERVLSDARTILEENIQDQDVLLLIKKRAPSPLPKMADVSAEEKKKQDQKAPDKEAILRATANLPSYNMDRAAVQTNMRDFQTELRKILVSLIEVAQKLLALNPDAVELFKKANAMLDEDEDERVDEAALRQLTEMGFPENRATKALQLNHMSVPQAMEWLIEHAEDPTIDTPLPGQAPPEAEGATAAASEAAAGASATDEEARDELTEIFKKIRRKREFRADARAVISLMEMGFDEKEVIDALRVNNNQQNAACEWLLGDRKPSPEELDKGIDPDSPLFQAILDNPVVQLGLTNPKTLLAFEDMLENPLNSTQWMNDPETGPVMLQISRIFQTLNRT

SEQ ID NO: 891624 - protein, 405 aa, Homo sapiens; identical to SEQ ID NO: 891614

SEQ ID NO: 891625 - protein, 405 aa, Homo sapiens; identical to SEQ ID NO: 891614

SEQ ID NO: 891626 - protein, 405 aa, Homo sapiens; identical to SEQ ID NO: 891614

SEQ ID NO: 891627 - protein, 405 aa, Homo sapiens; identical to SEQ ID NO: 891614

SEQ ID NO: 891628 - protein, 313 aa, Homo sapiens
MDRAAVQTNMRDFQTELRKILVSLIEVAQKLLALNPDAVELFKKANAMLDEDEDERVDEAALRQLTEMGFPENRATKALQLNHMSVPQAMEWLIEHAEDPTIDTPLPGQAPPEAEGATAAASEAAAGASATDEEARDELTEIFKKIRRKREFRADARGAKFTSDPGSLSKLEQSLSSWVPCALRLDFALSCVVVLHGLLEAVISLMEMGFDEKEVIDALRVNNNQQNAACEWLLGDRKPSPEELDKGIDPDSPLFQAILDNPVVQLGLTNPKTLLAFEDMLENPLNSTQWMNDPETGPVMLQISRIFQTLNRT

SEQ ID NO: 891629 - protein, 106 aa, Homo sapiens
MGFDEKEVIDALRVNNNQQNAACEWLLGDRKPSPEELDKGIDPDSPLFQAILDNPVVQLGLTNPKTLLAFEDMLENPLNSTQWMNDPETGPVMLQISRIFQTLNRT

SEQ ID NO: 891630 - protein, 88 aa, Homo sapiens
CEWLLGDRKPSPEELDKGIDPDSPLFQAILDNPVVQLGLTNPKTLLGMCAFFYAKSRVGEAGWFPCRTNRCCGGDTEDPALRIAVRWQ

SEQ ID NO: 891631 - protein, 555 aa, Homo sapiens
MAFTQLTFRDVAIEFSQDEWKCLNSTQRTLYRDVMLENYRNLVSLDLSRNCVIKELAPQQEGNPGEVFHTVTLEQHEKHDIEEFCFREIKKKIHDFDCQWRDDERNCNKVTTAPKENLTCRRDQRDRRGIGNKSIKHQLGLSFLPHPHELQQFQAEGKIYECNHVEKSVNHGSSVSPPQILSSTVKTHVSNKYGTDFICSSLLTQEQKSCIREKPYRYIECDKALNHGSHMTVRQVSHSGEKGYKCDLCGKVFSQKSNLARHWRVHTGEKPYKCNECDRSFSRNSCLALHRRVHTGEKPYKCYECDKVFSRNSCLALHQKTHIGEKPYTCKECGKAFSVRSTLTNHQVIHSGKKPYKCNECGKVFSQTSSLATHQRIHTGEKPYKCNECGKVFSQTSSLARHWRIHTGEKPYKCNECGKVFSYNSHLASHRRVHTGEKPYKCNECGKAFSVHSNLTTHQVIHTGEKPYKCNQCGKGFSVHSSLTTHQVIHTGEKPYKCNECGKSFSVRPNLTRHQIIHTGKKPYKCSDCGKSFSVRPNLFRHQIIHTKEKPYKRN

SEQ ID NO: 891632 - protein, 591 aa, Homo sapiens
MAFTQLTFRDVAIEFSQDEWKCLNSTQRTLYRDVMLENYRNLVSLEYYPMWEHRKEPWTIESQVRVARKPKGWEWIKGVKTDLSRNCVIKELAPQQEGNPGEVFHTVTLEQHEKHDIEEFCFREIKKKIHDFDCQWRDDERNCNKVTTAPKENLTCRRDQRDRRGIGNKSIKHQLGLSFLPHPHELQQFQAEGKIYECNHVEKSVNHGSSVSPPQILSSTVKTHVSNKYGTDFICSSLLTQEQKSCIREKPYRYIECDKALNHGSHMTVRQVSHSGEKGYKCDLCGKVFSQKSNLARHWRVHTGEKPYKCNECDRSFSRNSCLALHRRVHTGEKPYKCYECDKVFSRNSCLALHQKTHIGEKPYTCKECGKAFSVRSTLTNHQVIHSGKKPYKCNECGKVFSQTSSLATHQRIHTGEKPYKCNECGKVFSQTSSLARHWRIHTGEKPYKCNECGKVFSYNSHLASHRRVHTGEKPYKCNECGKAFSVHSNLTTHQVIHTGEKPYKCNQCGKGFSVHSSLTTHQVIHTGEKPYKCNECGKSFSVRPNLTRHQIIHTGKKPYKCSDCGKSFSVRPNLFRHQIIHTKEKPYKRN

SEQ ID NO: 891633 - protein, 558 aa, Homo sapiens
MCLLFYGQLTFRDVAIEFSQDEWKCLNSTQRTLYRDVMLENYRNLVSLDLSRNCVIKELAPQQEGNPGEVFHTVTLEQHEKHDIEEFCFREIKKKIHDFDCQWRDDERNCNKVTTAPKENLTCRRDQRDRRGIGNKSIKHQLGLSFLPHPHELQQFQAEGKIYECNHVEKSVNHGSSVSPPQILSSTVKTHVSNKYGTDFICSSLLTQEQKSCIREKPYRYIECDKALNHGSHMTVRQVSHSGEKGYKCDLCGKVFSQKSNLARHWRVHTGEKPYKCNECDRSFSRNSCLALHRRVHTGEKPYKCYECDKVFSRNSCLALHQKTHIGEKPYTCKECGKAFSVRSTLTNHQVIHSGKKPYKCNECGKVFSQTSSLATHQRIHTGEKPYKCNECGKVFSQTSSLARHWRIHTGEKPYKCNECGKVFSYNSHLASHRRVHTGEKPYKCNECGKAFSVHSNLTTHQVIHTGEKPYKCNQCGKGFSVHSSLTTHQVIHTGEKPYKCNECGKSFSVRPNLTRHQIIHTGKKPYKCSDCGKSFSVRPNLFRHQIIHTKEKPYKRN

SEQ ID NO: 891634 - protein, 580 aa, Homo sapiens
ACQMFLGKTEAEDCPHCPGDVRGPPEGHHGTMTVEVGLGAGNHLEGVRDQPSQPGETPSLLQIQKLAGITDLSRNCVIKELAPQQEGNPGEVFHTVTLEQHEKHDIEEFCFREIKKKIHDFDCQWRDDERNCNKVTTAPKENLTCRRDQRDRRGIGNKSIKHQLGLSFLPHPHELQQFQAEGKIYECNHVEKSVNHGSSVSPPQILSSTVKTHVSNKYGTDFICSSLLTQEQKSCIREKPYRYIECDKALNHGSHMTVRQVSHSGEKGYKCDLCGKVFSQKSNLARHWRVHTGEKPYKCNECDRSFSRNSCLALHRRVHTGEKPYKCYECDKVFSRNSCLALHQKTHIGEKPYTCKECGKAFSVRSTLTNHQVIHSGKKPYKCNECGKVFSQTSSLATHQRIHTGEKPYKCNECGKVFSQTSSLARHWRIHTGEKPYKCNECGKVFSYNSHLASHRRVHTGEKPYKCNECGKAFSVHSNLTTHQVIHTGEKPYKCNQCGKGFSVHSSLTTHQVIHTGEKPYKCNECGKSFSVRPNLTRHQIIHTGKKPYKCSDCGKSFSVRPNLFRHQIIHTKEKPYKRN

SEQ ID NO: 891635 - protein, 657 aa, Homo sapiens
ISCLCPPRSLCSSQACVLPVPGPSLLLPQGLHVGCASAGTRWPLSCSIDFQRLLAHEEETQKRRAKESGMAFTQLTFRDVAIEFSQDEWKCLNSTQRTLYRDVMLENYRNLVSLGWSAMVQSRLTATFASRIQMILLPQPPEYAGITDLSRNCVIKELAPQQEGNPGEVFHTVTLEQHEKHDIEEFCFREIKKKIHDFDCQWRDDERNCNKVTTAPKENLTCRRDQRDRRGIGNKSIKHQLGLSFLPHPHELQQFQAEGKIYECNHVEKSVNHGSSVSPPQILSSTVKTHVSNKYGTDFICSSLLTQEQKSCIREKPYRYIECDKALNHGSHMTVRQVSHSGEKGYKCDLCGKVFSQKSNLARHWRVHTGEKPYKCNECDRSFSRNSCLALHRRVHTGEKPYKCYECDKVFSRNSCLALHQKTHIGEKPYTCKECGKAFSVRSTLTNHQVIHSGKKPYKCNECGKVFSQTSSLATHQRIHTGEKPYKCNECGKVFSQTSSLARHWRIHTGEKPYKCNECGKVFSYNSHLASHRRVHTGEKPYKCNECGKAFSVHSNLTTHQVIHTGEKPYKCNQCGKGFSVHSSLTTHQVIHTGEKPYKCNECGKSFSVRPNLTRHQIIHTGKKPYKCSDCGKSFSVRPNLFRHQIIHTKEKPYKRN

SEQ ID NO: 891636 - protein, 542 aa, Homo sapiens
MWEHRKEPWTIESQVRVARKPKGWEWIKGVKTDLSRNCVIKELAPQQEGNPGEVFHTVTLEQHEKHDIEEFCFREIKKKIHDFDCQWRDDERNCNKVTTAPKENLTCRRDQRDRRGIGNKSIKHQLGLSFLPHPHELQQFQAEGKIYECNHVEKSVNHGSSVSPPQILSSTVKTHVSNKYGTDFICSSLLTQEQKSCIREKPYRYIECDKALNHGSHMTVRQVSHSGEKGYKCDLCGKVFSQKSNLARHWRVHTGEKPYKCNECDRSFSRNSCLALHRRVHTGEKPYKCYECDKVFSRNSCLALHQKTHIGEKPYTCKECGKAFSVRSTLTNHQVIHSGKKPYKCNECGKVFSQTSSLATHQRIHTGEKPYKCNECGKVFSQTSSLARHWRIHTGEKPYKCNECGKVFSYNSHLASHRRVHTGEKPYKCNECGKAFSVHSNLTTHQVIHTGEKPYKCNQCGKGFSVHSSLTTHQVIHTGEKPYKCNECGKSFSVRPNLTRHQIIHTGKKPYKCSDCGKSFSVRPNLFRHQIIHTKEKPYKRN

SEQ ID NO: 891637 - protein, 241 aa, Homo sapiens
MDEMTFHIWYPQVRAPGQQPQAQLAMALCLKQVFAKDKTFRPRKRFEPGTQRFELYKKAQASLKSGLDLRSVVRLPPGENIDDWIAVHVVDFFNRINLIYGTMAERCSETSCPVMAGGPRYEYRWQDERQYRRPAKLSAPRYMALLMDWIEGLINDEEVFPTRVGVPFPKNFQQVCTKILTRLFRVFVHVYIHHFDSILSMGAEAHVNTCYKHFYYFIREFSLVDQRELEPLREMTERICH

SEQ ID NO: 891638 - protein, 238 aa, Homo sapiens
MCQELRIWEWIGRSRSLIGSRDKCDADDSRRAKKPPLSSSSCFCSRRSRAFSHFTVWELEAASLVEVQGSTERAGSSVSPLSKGKLGAPYGLSGKVGASASVYWSGGESPFSAPPRPVAAALAGPGRSWRRPGQEGSRGRQDRQTDRLTGERTGTAGPAGERRSCGWECDPTARRGPVSVRRAPAASPRTPPAWLPLSFLRPSWRGTVRRRVPPEGRLAAVLRLASEAQSFESCGGDC

SEQ ID NO: 891639 - protein, 216 aa, Homo sapiens
MALCLKQVFAKDKTFRPRKRFEPGTQRFELYKKAQASLKSGLDLRSVVRLPPGENIDDWIAVHVVDFFNRINLIYGTMAERCSETSCPVMAGGPRYEYRWQDERQYRRPAKLSAPRYMALLMDWIEGLINDEEVFPTRVGVPFPKNFQQVCTKILTRLFRVFVHVYIHHFDSILSMGAEAHVNTCYKHFYYFIREFSLVDQRELEPLREMTERICH

SEQ ID NO: 891640 - protein, 239 aa, Homo sapiens
MPLSLAGYPQVRAPGQQPQAQLAMALCLKQVFAKDKTFRPRKRFEPGTQRFELYKKAQASLKSGLDLRSVVRLPPGENIDDWIAVHVVDFFNRINLIYGTMAERCSETSCPVMAGGPRYEYRWQDERQYRRPAKLSAPRYMALLMDWIEGLINDEEVFPTRVGVPFPKNFQQVCTKILTRLFRVFVHVYIHHFDSILSMGAEAHVNTCYKHFYYFIREFSLVDQRELEPLREMTERICH

SEQ ID NO: 891641 - protein, 751 aa, Homo sapiens
MEDLSSPDSTLLQGGHNLLSSASFQEAVTFKDVIVDFTQEEWKQLDPGQRDLFRDVTLENYTHLVSIGLQVSKPDVISQLEQGTEPWIMEPSIPVGTCADWETRLENSVSAPEPDISEEELSPEVIVEKHKRDDSWSSNLLESWEYEGSLERQQANQQTLPKEIKVTEKTIPSWEKGPVNNEFGKSVNVSSNLVTQEPSPEETSTKRSIKQNSNPVKKEKSCKCNECGKAFSYCSALIRHQRTHTGEKPYKCNECEKAFSRSENLINHQRIHTGDKPYKCDQCGKGFIEGPSLTQHQRIHTGEKPYKCDECGKAFSQRTHLVQHQRIHTGEKPYTCNECGKAFSQRGHFMEHQKIHTGEKPFKCDECDKTFTRSTHLTQHQKIHTGEKTYKCNECGKAFNGPSTFIRHHMIHTGEKPYECNECGKAFSQHSNLTQHQKTHTGEKPYDCAECGKSFSYWSSLAQHLKIHTGEKPYKCNECGKAFSYCSSLTQHRRIHTREKPFECSECGKAFSYLSNLNQHQKTHTQEKAYECKECGKAFIRSSSLAKHERIHTGEKPYQCHECGKTFSYGSSLIQHRKIHTGERPYKCNECGRAFNQNIHLTQHKRIHTGAKPYECAECGKAFRHCSSLAQHQKTHTEEKPYQCNKCEKTFSQSSHLTQHQRIHTGEKPYKCNECDKAFSRSTHLTEHQNTHTGEKPYNCNECRKTFSQSTYLIQHQRIHSGEKPFGCNDCGKSFRYRSALNKHQRLHPGI

SEQ ID NO: 891642 - protein, 751 aa, Homo sapiens; identical to SEQ ID NO: 891641

SEQ ID NO: 891643 - protein, 751 aa, Homo sapiens; identical to SEQ ID NO: 891641

SEQ ID NO: 891644 - protein, 46 aa, Homo sapiens
MLDLYVQGVLHLCQVLHGLAGIQQCIAEVGQHIVQFRDPLDYPATR

SEQ ID NO: 891645 - protein, 154 aa, Homo sapiens
GLRCGVTQTRGRVEEEAAKSTVLLRCRRAPPTSADQPCPATRPRLEEGKAVASAPSAAHGDDAWHIRDPQAAAVASPAARAPAPAAVVTPPRLAVAPVPPAAPAARDMSNLGGRRNGPVEVRLTGTCHPRFRRTCIWFEKELESRRYPTFTIYP

SEQ ID NO: 891646 - protein, 154 aa, Homo sapiens; identical to SEQ ID NO: 891645

SEQ ID NO: 891647 - protein, 152 aa, Homo sapiens
GLRCGVTQTRGRVEEEAAKSTVLLRCRRAPPTSADQPCPATRPRLEEGKAVASAPSAAHGDDAWHIRDPQAAAVASPAARAPAPAAVVTPPRLAVAPVPPAAPAARDMSNLGGRRNGPVEVRLTGIILTGHENETKRSLEAINDKISWRRRP

SEQ ID NO: 891648 - protein, 154 aa, Homo sapiens; identical to SEQ ID NO: 891645

SEQ ID NO: 891649 - protein, 154 aa, Homo sapiens; identical to SEQ ID NO: 891645

SEQ ID NO: 891650 - protein, 154 aa, Homo sapiens; identical to SEQ ID NO: 891645

SEQ ID NO: 891651 - protein, 154 aa, Homo sapiens; identical to SEQ ID NO: 891645

SEQ ID NO: 891652 - protein, 154 aa, Homo sapiens; identical to SEQ ID NO: 891645

SEQ ID NO: 891653 - protein, 152 aa, Homo sapiens; identical to SEQ ID NO: 891647

SEQ ID NO: 891654 - protein, 154 aa, Homo sapiens; identical to SEQ ID NO: 891645

SEQ ID NO: 891655 - protein, 120 aa, Homo sapiens
MRGWVGLRVLDGPGQYLRHRLADDIHLLHLFEVIIQLGPLSPSDLLTDQLARLVELLLQPGNRHAASCRGTFRPDPPAQTPPATGSRAPPTLCAPQRPPSAPPPPPACQLGARPGAASSS

SEQ ID NO: 891656 - protein, 71 aa, Homo sapiens
CLLMRWLAAQNRMAEMSTTIKNSRTSAVGPVICFMEFTSLVSSKSRRMMADGRKEEEGNLEEFPDLLCCCD

SEQ ID NO: 891657 - protein, 103 aa, Homo sapiens
MAGRRKRVIWKSFLTYSAAVIKQPPGNFDDTVLLSSSLSSGKKSIETTKIKCYLAGVRSHVCLCGGSLLRTGNHWRYSLLFEGLQWNEFKYDLFEELKLTLWS

SEQ ID NO: 891658 - protein, 103 aa, Homo sapiens; identical to SEQ ID NO: 891657

SEQ ID NO: 891659 - protein, 119 aa, Homo sapiens
RHRFRRAMGPRVLQPPLLLLLLALLLAALPCGAEEASPLRPAQVTLSPPPAVTNGSQPGAPHNSTHTRPPGASGSALTRSFYVILGFCGLTALYFLIRAFRCVRRTWAPSLSLGQLARA

SEQ ID NO: 891660 - protein, 139 aa, Homo sapiens
RHRFRRAMGPRVLQPPLLLLLLALLLAALPCGAEEASPLRPAQVTLSPPPAVTNGSQPGAPHNSTHTRPPGASGSALTRSFYVILGFCGLTALYFLIRAFRLKKPQRRRYGLLANTEDPTEMASLDSDEETVFESRNLR

SEQ ID NO: 891661 - protein, 119 aa, Homo sapiens; identical to SEQ ID NO: 891659

SEQ ID NO: 891662 - protein, 139 aa, Homo sapiens; identical to SEQ ID NO: 891660

SEQ ID NO: 891663 - protein, 139 aa, Homo sapiens; identical to SEQ ID NO: 891660

SEQ ID NO: 891664 - protein, 139 aa, Homo sapiens; identical to SEQ ID NO: 891660

SEQ ID NO: 891665 - protein, 121 aa, Homo sapiens
MIELYPVSHAQLDVLWPELRQALRGSLYYLLSALPQPKAPGYICHGLSPGGLSNGSREECYWGHVFWDQVSTVHPAPATQQATHGGPRSLPSLGPGLWLGKHRDCGKREEAWKVCRSLVEE

SEQ ID NO: 891666 - protein, 91 aa, Homo sapiens
TLRPEACLSAFSAERPAAVTTALRRVGDERPEVMQAQASAWTAGIRGTKDGDSAPSEFPRVRSSAVSQEQDVMASAAETLMRTRPPAPLSA

SEQ ID NO: 891667 - protein, 535 aa, Homo sapiens
MEDAGEDPTTFAAHSLPSDPRLLATVTNAYLGTRVFHDTLHVSGVYNGAGGDTHRAMLPSPLNVRLEAPAGMGEQLTETFALDTNTGSFLHTLEGPRFRASQCIYAHRTLPHVLAFRVSIARLAPGSGPITLLLRSAFSPESPDLDLHQGPDFQGARYLYGHTLTPEQPGGPQQEVHMLWTPAPPDLTLGEGEEARTWDFLTAVGGSQAEAQACLTEALQLQARGALYTAHAQAWAQLWVECGLDVVGPLQLRQALRGSLYYLLSALPQPKAPGYICHGLSPGGLSNGSREECYWGHVFWDQDLWMFPSILMFHPEAARAILEYRIRTLDGALENAQNLGYQGAKFAWESADSGLEVCPEDIYGVQEVHVNGAVVLAFELYYHTTQDLQLFREAGGWDVVRAVAEFWCSRVEWSPREEKYHLRGVMSPDEYHSGVNNSVYTNVLVQNSLRFAAALAQDLGLPIPSQWLAVADKIKVPFDVEQNFHPEVPAPSSLGGLFQMLGTRSRAPSGSPWVPAARLSGKVHAAWPEFKAFCL

SEQ ID NO: 891668 - protein, 767 aa, Homo sapiens
MEDAGEDPTTFAAHSLPSDPRLLATVTNAYLGTRVFHDTLHVSGVYNGAGGDTHRAMLPSPLNVRLEAPAGMGEQLTETFALDTNTGSFLHTLEGPRFRASQCIYAHRTLPHVLAFRVSIARLAPGSGPITLLLRSAFSPESPDLDLHQGPDFQGARYLYGHTLTPEQPGGPQQEVHMLWTPAPPDLTLGEGEEARTWDFLTAVGGSQAEAQACLTEALQLQARGALYTAHAQAWAQLWVECGLDVVGPLQLRQALRGSLYYLLSALPQPKAPGYICHGLSPGGLSNGSREECYWGHVFWDQDLWMFPSILMFHPEAARAILEYRIRTLDGALENAQNLGYQGAKFAWESADSGLEVCPEDIYGVQEVHVNGAVVLAFELYYHTTQDLQLFREAGGWDVVRAVAEFWCSRVEWSPREEKYHLRGEAMVGRGSGRNGGCSQTQQMIFRHLTCASPTLTTGVEGRPLRLCTEHHLGLVCPGVMSPDEYHSGVNNSVYTNVLVQNSLRFAAALAQDLGLPIPSQWLAVADKIKVPFDVEQNFHPEFDGYEPGKILEIYEAVTSPQGPAMTWSMFAVGWMELKDAVRARGLLDRSFANMAEPFKVWTENADGSGAVNFLTGMGGFLQAVVFGCTGFRVTRAGVTFDPVCLSGISRVSVSGIFYQGNKLNFSFSEDSVTVEVTARAGPWAPHLEAELWPSQSRLSLLPGHKVSFPRSAGRIQMSPPKLPGSSSSEFPGRTFSDVRDPLQSPLWVTLGSSSPTESLTVDPASE

SEQ ID NO: 891669 - protein, 462 aa, Homo sapiens
MFPSILMFHPEAARAILEYRIRTLDGALENAQNLGYQGAKFAWESADSGLEVCPEDIYGVQEVHVNGAVVLAFELYYHTTQDLQLFREAGGWDVVRAVAEFWCSRVEWSPREEKYHLRGEAMVGRGSGRNGGCSQTQQMIFRHLTCASPTLTTGVEGRPLRLCTEHHLGLVCPGVMSPDEYHSGVNNSVYTNVLVQNSLRFAAALAQDLGLPIPSQWLAVADKIKVPFDVEQNFHPEFDGYEPGKILEIYEAVTSPQGPAMTWSMFAVGWMELKDAVRARGLLDRSFANMAEPFKVWTENADGSGAVNFLTGMGGFLQAVVFGCTGFRVTRAGVTFDPVCLSGISRVSVSGIFYQGNKLNFSFSEDSVTVEVTARAGPWAPHLEAELWPSQSRLSLLPGHKVSFPRSAGRIQMSPPKLPGSSSSEFPGRTFSDVRDPLQSPLWVTLGSSSPTESLTVDPASE

SEQ ID NO: 891670 - protein, 822 aa, Homo sapiens
MEDAGEDPTTFAAHSLPSDPRLLATVTNAYLGTRVFHDTLHVSGVYNGAGGDTHRAMLPSPLNVRLEAPAGMGEQLTETFALDTNTGSFLHTLEGPRFRASQCIYAHRTLPHVLAFRVSIARLAPGSGPITLLLRSAFSPESPDLDLHQGPDFQGARYLYGHTLTPEQPGGPQQEVHMLWTPAPPDLTLGEGEEARTWDFLTAVGGSQAEAQACLTEALQLQARGALYTAHAQAWAQLWVECGLDVVGPLQLRQALRGSLYYLLSALPQPKAPGYICHGLSPGGLSNGSREECYWGHVFWDQDLWMFPSILMFHPEAARAILEYRIRTLDGALENAQNLGYQGAKFAWESADSGLEVCPEDIYGVQEVHVNGAVVLAFELYYHTTQDLQLFREAGGWDVVRAVAEFWCSRVEWSPREEKYHLRGEAMVGRGSGRNGGCSQTQQMIFRHLTCASPTLTTGVEGRPLRLCTEHHLGLVCPGVMSPDEYHSGVNNSVYTNVLVQNSLRFAAALAQDLGLPIPSQWLAVADKIKVPFDVEQNFHPEFDGYEPGGGPLQGLLPCRRDPRVCPGTPSSQRHLPVGEVVKQADVVLLGYPVPFSLSPDVRRKNLEIYEAVTSPQGPAMTWSMFAVGWMELKDAVRARGLLDRSFANMAEPFKVWTENADGSGAVNFLTGMGGFLQAVVFGCTGFRVTRAGVTFDPVCLSGISRVSVSGIFYQGNKLNFSFSEDSVTVEVTARAGPWAPHLEAELWPSQSRLSLLPGHKVSFPRSAGRIQMSPPKLPGSSSSEFPGRTFSDVRDPLQSPLWVTLGSSSPTESLTVDPASE

SEQ ID NO: 891671 - protein, 737 aa, Homo sapiens
MEDAGEDPTTFAAHSLPSDPRLLATVTNAYLGTRVFHDTLHVSGVYNGAGGDTHRAMLPSPLNVRLEAPAGMGEQLTETFALDTNTGSFLHTLEGPRFRASQCIYAHRTLPHVLAFRVSIARLAPGSGPITLLLRSAFSPESPDLDLHQGPDFQGARYLYGHTLTPEQPGGPQQEVHMLWTPAPPDLTLGEGEEARTWDFLTAVGGSQAEAQACLTEALQLQARGALYTAHAQAWAQLWVECGLDVVGPLQLRQALRGSLYYLLSALPQPKAPGYICHGLSPGGLSNGSREECYWGHVFWDQDLWMFPSILMFHPEAARAILEYRIRTLDGALENAQNLGYQGAKFAWESADSGLEVCPEDIYGVQEVHVNGAVVLAFELYYHTTQDLQLFREAGGWDVVRAVAEFWCSRVEWSPREEKYHLRGVMSPDEYHSGVNNSVYTNVLVQNSLRFAAALAQDLGLPIPSQWLAVADKIKVPFDVEQNFHPEFDGYEPGEVVKQADVVLLGYPVPFSLSPDVRRKNLEIYEAVTSPQGPAMTWSMFAVGWMELKDAVRARGLLDRSFANMAEPFKVWTENADGSGAVNFLTGMGGFLQAVVFGCTGFRVTRAGVTFDPVCLSGISRVSVSGIFYQGNKLNFSFSEDSVTVEVTARAGPWAPHLEAELWPSQSRLSLLPGHKVSFPRSAGRIQMSPPKLPGSSSSEFPGRTFSDVRDPLQSPLWVTLGSSSPTESLTVDPASE

SEQ ID NO: 891672 - protein, 799 aa, Homo sapiens
MEDAGEDPTTFAAHSLPSDPRLLATVTNAYLGTRVFHDTLHVSGVYNGAGGDTHRAMLPSPLNVRLEAPAGMGEQLTETFALDTNTGSFLHTLEGPRFRASQCIYAHRTLPHVLAFRVSIARLAPGSGPITLLLRSAFSPESPDLDLHQGPDFQGARYLYGHTLTPEQPGGPQQEVHMLWTPAPPDLTLGEGEEARTWDFLTAVGGSQAEAQACLTEALQLQARGALYTAHAQAWAQLWVECGLDVVGPLQLRQALRGSLYYLLSALPQPKAPGYICHGLSPGGLSNGSREECYWGHVFWDQDLWMFPSILMFHPEAARAILEYRIRTLDGALENAQNLGYQGAKFAWESADSGLEVCPEDIYGVQEVHVNGAVVLAFELYYHTTQDLQLFREAGGWDVVRAVAEFWCSRVEWSPREEKYHLRGEAMVGRGSGRNGGCSQTQQMIFRHLTCASPTLTTGVEGRPLRLCTEHHLGLVCPGVMSPDEYHSGVNNSVYTNVLVQNSLRFAAALAQDLGLPIPSQWLAVADKIKVPFDVEQNFHPEFDGYEPVSGTSLVGEVVKQADVVLLGYPVPFSLSPDVRRKNLEIYEAVTSPQGPAMTWSMFAVGWMELKDAVRARGLLDRSFANMAEPFKVWTENADGSGAVNFLTGMGGFLQAVVFGCTGFRVTRAGVTFDPVCLSGISRVSVSGIFYQGNKLNFSFSEDSVTVEVTARAGPWAPHLEAELWPSQSRLSLLPGHKVSFPRSAGRIQMSPPKLPGSSSSEFPGRTFSDVRDPLQSPLWVTLGSSSPTESLTVDPASE

SEQ ID NO: 891673 - protein, 587 aa, Homo sapiens [sequence omitted]

SEQ ID NO: 891674 - protein, 719 aa, Homo sapiens
MEDAGEDPTTFAAHSLPSDPRLLATVTNAYLGTRVFHDTLHVSGVYNGAGGDTHRAMLPSPLNVRLEAPAGMGEQLTETFALDTNTGSFLHTLEGPRFRASQCIYAHRTLPHVLAFRVSIARLAPGSGPITLLLRSAFSPESPDLDLHQGPDFQGARYLYGHTLTPEQPGGPQQEVHMLWTPAPPDLTLGEGEEARTWDFLTAVGGSQAEAQACLTEALQLQARGALYTAHAQAWAQLWVECGLDVVGPLQLRQALRGSLYYLLSALPQPKAPGYICHGLSPGGLSNGSREECYWGHVFWDQDLWMFPSILMFHPEAARAILEYRIRTLDGALENAQNLGYQGAKFAWESADSGLEVCPEDIYGVQEVHVNGAVVLAFELYYHTTQDLQLFREAGGWDVVRAVAEFWCSRVEWSPREEKYHLRGVMSPDEYHSGVNNSVYTNVLVQNSLRFAAALAQDLGLPIPSQWLAVADKIKVPFDVEQNFHPEFDGYEPGEVVKQADVVLLGYPVPFSLSPDVRRKNLEIYEAVTSPQGPAMTWSMFAVGWMELKDAVRARGLLDRSFANMAEPFKVWTENADGSGAVNFLTGMGGFLQAVVFGCTGFRVSVSGIFYQGNKLNFSFSEDSVTVEVTARAGPWAPHLEAELWPSQSRLSLLPGHKVSFPRSAGRIQMSPPKLPGSSSSEFPGRTFSDVRDPLQSPLWVTLGSSSPTESLTVDPASE

SEQ ID NO: 891675 - protein, 109 aa, Homo sapiens
MFPSILMFHPEAARAILEYRIRTLDGALENAQNLGYQPQAASLPAGHKVSFPRSAGRIQMSPPKLPGSSSSEFPGRTFSDVRDPLQSPLWVTLGSSSPTESLTVDPASE

SEQ ID NO: 891676 - protein, 767 aa, Homo sapiens; identical to SEQ ID NO: 891668

SEQ ID NO: 891677 - protein, 354 aa, Homo sapiens
MEDAGEDPTTFAAHSLPSDPRLLATVTNAYLGTRVFHDTLHVSGVYNGAGGDTHRAMLPSPLNVRLEAPAGMGEQLTETFALDTNTGSFLHTLEGPRFRASQCIYAHRTLPHVLAFRVSIARLAPGSGPITLLLRSAFSPESPDLDLHQGPDFQGARYLYGHTLTPEQPGGPQQEVHMLWTPAPPDLTLGEGEEARTWDFLTAVGGSQAEAQACLTEALQLQARGALYTAHAQAWAQLWVECGLDVVGPLQLRQALRGSLYYLLSALPQPKAPGYICHGLSPGGLSNGSREECYWGHVFWDQVSTVHPAPATQQATHGGPRSLPSLGPGLWLGKHRDCGKREEAWKVCRSLVEE

SEQ ID NO: 891678 - protein, 545 aa, Homo sapiens
MEDAGEDPTTFAAHSLPSDPRLLATVTNAYLGTRVFHDTLHVSGVYNGAGGDTHRAMLPSPLNVRLEAPAGMGEQLTETFALDTNTGSFLHTLEGPRFRASQCIYAHRTLPHVLAFRVSIARLAPGSGPITLLLRSAFSPESPDLDLHQGPDFQGARYLYGHTLTPEQPGGPQQEVHMLWTPAPPDLTLGEGEEARTWDFLTAVGGSQAEAQACLTEALQLQARGALYTAHAQAWAQLWVECGLDVVGPLQLRQALRGSLYYLLSALPQPKAPGYICHGLSPGGLSNGSREECYWGHVFWDQDLWMFPSILMFHPEAARAILEYRIRTLDGALENAQNLGYQGAKFAWESADSGLEVCPEDIYGVQEVHVNGAVVLAFELYYHTTQDLQLFREAGGWDVVRAVAEFWCSRVEWSPREEKYHLRGVMSPDEYHSGVNNSVYTNVLVQNSLRFAAALAQDLGLPIPSQWLAVADKIKVPFDVEQNFHPEFDGYEPGEVVKQADVVLLGYPVPFSLSPDVRRKNLEIYEAVTSPQGPAMTWVSTLGLW

SEQ ID NO: 891679 - protein, 123 aa, Homo sapiens
MGIGNCTGGLRRMENPSSSCTRTEAKGPQFNRKPKTRARKRPNTRARRKPKLRRARRVCAFASLPASRFLLTRPRVLSPDGVENPGAGWGWSLAGLGAPPSPRATARRGPRERQAPGRDPRGR

SEQ ID NO: 891680 - protein, 512 aa, Homo sapiens
MEDAGEDPTTFAAHSLPSDPRLLATVTNAYLGTRVFHDTLHVSGVYNGAGGDTHRAMLPSPLNVRLEAPAGMGEQLTETFALDTNTGSFLHTLEGPRFRASQCIYAHRTLPHVLAFRVSIARLAPGSGPITLLLRSAFSPESPDLDLHQGPDFQGARYLYGHTLTPEQPGGPQQEVHMLWTPAPPDLTLGEGEEARTWDFLTAVGGSQAEAQACLTEALQLQARGALYTAHAQAWAQLWVECGLDVVGPLQLRQALRGSLYYLLSALPQPKAPGYICHGLSPGGLSNGSREECYWGHVFWDQDLWMFPSILMFHPEAARAILEYRIRTLDGALENAQNLGYQGAKFAWESADSGLEVCPEDIYGVQEVHVNGAVVLAFELYYHTTQDLQLFREAGGWDVVRAVAEFWCSRVEWSPREEKYHLRGEAMVGRGSGRNGGCSQTQQMIFRHLTCASPTLTTGVEGRPLRLCTEHHLGLVCPGVMSPDEYHSGVNNSVYTNVLVQNRSDTRSPHLT

SEQ ID NO: 891681 - protein, 111 aa, Homo sapiens
MENPSSSCTRTEAKGPQFNRKPKTRARKRPNTRARRKPKLRRARRVCAFASLPASRFLLTRPRVLSPDGVENPGAGWGWSLAGLGAPPSPRATARRGPRERQAPGRDPRGR

SEQ ID NO: 891682 - protein, 148 aa, Homo sapiens
VTVEVTARAGPWAPHLEAELWPSQSRLSLLPGRTAPNSPGACDPRLPLTPRLPLSLQDTRSPFPARLAGYKCHPRSCLEVPAPSSLGGLFQMLGTRSRAPSGSPWVPPAPPSHSLWTLPLNNQERWLQRRLLGLPSGHVCTHPSWAPS

SEQ ID NO: 891683 - protein, 70 aa, Homo sapiens
SFLHTLEGPRFRASQCIYAHRTLPHVLAFRVSIARLAPGSGPITLLLRSAFSPESPDLDLHQGPDFQGAR

SEQ ID NO: 891684 - protein, 89 aa, Homo sapiens
MSNRSSFSRLTWFRKQRKAVVSTSDKKMPNGILEEQEQQRVMLLSRSPSGPKKYFPIPVEHLEEEIRIRSADDCKQFREEFNVSVGRAL

SEQ ID NO: 891685 - protein, 794 aa, Homo sapiens
PQPELEPRRRRDAAGRTNFLLAADSGRQEPARAASGTHGLCASPRPFFAPGEDSRAPRRAAGRRPGDAEPPLQRDLRDQTGPPETIAFTFPRSTMEPLCPLLLVGFSLPLARALRGNETTADSNETTTTSGPPDPGASQPLLAWLLLPLLLLLLVLLLAAYFFRFRKQRKAVVSTSDKKMPNGILEEQEQQRVMLLSRSPSGPKKYFPIPVEHLEEEIRIRSADDCKQFREEFNSLPSGHIQGTFELANKEENREKNRYPNILPNDHSRVILSQLDGIPCSDYINASYIDGYKEKNKFIAAQGPKQETVNDFWRMVWEQKSATIVMLTNLKERKEEKCHQYWPDQGCWTYGNIRVCVEDCVVLVDYTIRKFCIQPQLPDGCKAPRLVSQLHFTSWPDFGVPFTPIGMLKFLKKVKTLNPVHAGPIVVHCSAGVGRTGTFIVIDAMMAMMHAEQKVDVFEFVSRIRNQRPQMVQTDMQYTFIYQALLEYYLYGDTELDVSSLEKHLQTMHGTTTHFDKIGLEEEFRKLTNVRIMKENMRTGNLPANMKKARVIQIIPYDFNRVILSMKRGQEYTDYINASFIDGYRQKDYFIATQGPLAHTVEDFWRMIWEWKSHTIVMLTEVQEREQDKCYQYWPTEGSVTHGEITIEIKNDTLSEAISIRDFLVTLNQPQARQEEQVRVVRQFHFHGWPEIGIPAEGKGMIDLIAAVQKQQQQTGNHPITVHCSAGAGRTGTFIALSNILERVKAEGLLDVFQAVKSLRLQRPHMVQTLEQYEFCYKVVQDFIDIFSDYANFK

SEQ ID NO: 891686 - protein, 480 aa, Homo sapiens
MVWEQKSATIVMLTNLKERKEEKCHQYWPDQGCWTYGNIRVCVEDCVVLVDYTIRKFCIQPQLPDGCKAPRLVSQLHFTSWPDFGVPFTPIGMLKFLKKVKTLNPVHAGPIVVHCSAGVGRTGTFIVIDAMMAMMHAEQKVDVFEFVSRIRNQRPQMVQTDMQYTFIYQALLEYYLYGDTELDVSSLEKHLQTMHGTTTHFDKIGLEEEFRKLTNVRIMKENMRTGNLPANMKKARVIQIIPYDFNRVILSMKRGQEYTDYINASFIDGYRQKDYFIATQGPLAHTVEDFWRMIWEWKSHTIVMLTEVQEREQDKCYQYWPTEGSVTHGEITIEIKNDTLSEAISIRDFLVTLNQPQARQEEQVRVVRQFHFHGWPEIGIPAEGKGMIDLIAAVQKQQQQTGNHPITVHCSAGAGRTGTFIALSNILERVKAEGLLDVFQAVKSLRLQRPHMVQTLEQYEFCYKVVQDFIDIFSDYANFK

SEQ ID NO: 891687 - protein, 480 aa, Homo sapiens; identical to SEQ ID NO: 891686

SEQ ID NO: 891688 - protein, 480 aa, Homo sapiens; identical to SEQ ID NO: 891686

SEQ ID NO: 891689 - protein, 615 aa, Homo sapiens
MPNGILEEQEQQRVMLLSRSPSGPKKYFPIPVEHLEEEIRIRSADDCKQFREEFNSLPSGHIQGTFELANKEENREKNRYPNILPNDHSRVILSQLDGIPCSDYINASYIDGYKEKNKFIAAQGPKQETVNDFWRMVWEQKSATIVMLTNLKERKEEKCHQYWPDQGCWTYGNIRVCVEDCVVLVDYTIRKFCIQPQLPDGCKAPRLVSQLHFTSWPDFGVPFTPIGMLKFLKKVKTLNPVHAGPIVVHCSAGVGRTGTFIVIDAMMAMMHAEQKVDVFEFVSRIRNQRPQMVQTDMQYTFIYQALLEYYLYGDTELDVSSLEKHLQTMHGTTTHFDKIGLEEEFRKLTNVRIMKENMRTGNLPANMKKARVIQIIPYDFNRVILSMKRGQEYTDYINASFIDGYRQKDYFIATQGPLAHTVEDFWRMIWEWKSHTIVMLTEVQEREQDKCYQYWPTEGSVTHGEITIEIKNDTLSEAISIRDFLVTLNQPQARQEEQVRVVRQFHFHGWPEIGIPAEGKGMIDLIAAVQKQQQQTGNHPITVHCSAGAGRTGTFIALSNILERVKAEGLLDVFQAVKSLRLQRPHMVQTLEQYEFCYKVVQDFIDIFSDYANFK

SEQ ID NO: 891690 - protein, 794 aa, Homo sapiens; identical to SEQ ID NO: 891685

SEQ ID NO: 891691 - protein, 794 aa, Homo sapiens; identical to SEQ ID NO: 891685

SEQ ID NO: 891692 - protein, 389 aa, Homo sapiens
MEPLCPLLLVGFSLPLARALRGNETTADSNETTTTSGPPDPGASQPLLAWLLLPLLLLLLVLLLAAYFFRFRKQRKAVVSTSDKKMPNGILEEQEQQRVMLLSRSPSGPKKYFPIPVEHLEEEIRIRSADDCKQFREEFNSLPSGHIQGTFELANKEENREKNRYPNILPNDHSRVILSQLDGIPCSDYINASYIDGYKEKNKFIAAQGPKQETVNDFWRMVWEQKSATIVMLTNLKERKEEKCHQYWPDQGCWTYGNIRVCVEDCVVLVDYTIRKFCIQPQLPDGCKAPRLVSQLHFTSWPDFGVPFTPIGMLKFLKKVKTLNPVHAGPIVVHCSAGVGRTGTFIVIDAMMAMMHAEQKVDVFEFVSRIRNQRPQMVQTDVSHAFLLP

SEQ ID NO: 891693 - protein, 209 aa, Homo sapiens
MEPLCPLLLVGFSLPLARALRGNETTADSNETTTTSGPPDPGASQPLLAWLLLPLLLLLLVLLLAAYFFRFRKQRKAVVSTSDKKMPNGILEEQEQQRVMLLSRSPSGPKKYFPIPVEHLEEEIRIRSADDCKQFREEFNSLPSGHIQGTFELANKEENREKNRYPNILPNDHSRVILSQLDGIPCSDYINASYIDLQREEEFIAAPPA

SEQ ID NO: 891694 - protein, 642 aa, Homo sapiens
MSNRSSFSRLTWFRKQRKAVVSTSDKKMPNGILEEQEQQRVMLLSRSPSGPKKYFPIPVEHLEEEIRIRSADDCKQFREEFNSLPSGHIQGTFELANKEENREKNRYPNILPNDHSRVILSQLDGIPCSDYINASYIDGYKEKNKFIAAQGPKQETVNDFWRMVWEQKSATIVMLTNLKERKEEKCHQYWPDQGCWTYGNIRVCVEDCVVLVDYTIRKFCIQPQLPDGCKAPRLVSQLHFTSWPDFGVPFTPIGMLKFLKKVKTLNPVHAGPIVVHCSAGVGRTGTFIVIDAMMAMMHAEQKVDVFEFVSRIRNQRPQMVQTDMQYTFIYQALLEYYLYGDTELDVSSLEKHLQTMHGTTTHFDKIGLEEEFRKLTNVRIMKENMRTGNLPANMKKARVIQIIPYDFNRVILSMKRGQEYTDYINASFIDGYRQKDYFIATQGPLAHTVEDFWRMIWEWKSHTIVMLTEVQEREQDKCYQYWPTEGSVTHGEITIEIKNDTLSEAISIRDFLVTLNQPQARQEEQVRVVRQFHFHGWPEIGIPAEGKGMIDLIAAVQKQQQQTGNHPITVHCSAGAGRTGTFIALSNILERVKAEGLLDVFQAVKSLRLQRPHMVQTLEQYEFCYKVVQDFIDIFSDYANFK

SEQ ID NO: 891695 - protein, 642 aa, Homo sapiens; identical to SEQ ID NO: 891694

SEQ ID NO: 891696 - protein, 700 aa, Homo sapiens
MEPLCPLLLVGFSLPLARALRGNETTADSNETTTTSGPPDPGASQPLLAWLLLPLLLLLLVLLLAAYFFRFRKQRKAVVSTSDKKMPNGILEEQEQQRVMLLSRSPSGPKKYFPIPVEHLEEEIRIRSADDCKQFREEFNSLPSGHIQGTFELANKEENREKNRYPNILPNDHSRVILSQLDGIPCSDYINASYIDGYKEKNKFIAAQGPKQETVNDFWRMVWEQKSATIVMLTNLKERKEEKCHQYWPDQGCWTYGNIRVCVEDCVVLVDYTIRKFCIQPQLPDGCKAPRLVSQLHFTSWPDFGVPFTPIGMLKFLKKVKTLNPVHAGPIVVHCSAGVGRTGTFIVIDAMMAMMHAEQKVDVFEFVSRIRNQRPQMVQTDMQYTFIYQALLEYYLYGDTELDVSSLEKHLQTMHGTTTHFDKIGLEEEFRKLTNVRIMKENMRTGNLPANMKKARVIQIIPYDFNRVILSMKRGQEYTDYINASFIDGYRQKDYFIATQGPLAHTVEDFWRMIWEWKSHTIVMLTEVQEREQDKCYQYWPTEGSVTHGEITIEIKNDTLSEAISIRDFLVTLNQPQARQEEQVRVVRQFHFHGWPEIGIPAEGKGMIDLIAAVQKQQQQTGNHPITVHCSAGAGRTGTFIALSNILERVKAEGLLDVFQAVKSLRLQRPHMVQTLEQYEFCYKVVQDFIDIFSDYANFK

SEQ ID NO: 891697 - protein, 735 aa, Homo sapiens
LPKGNLPLRPKNSAQWILQGQDGFPASSQEDKRSTMEPLCPLLLVGFSLPLARALRGNETTADSNETTTTSGPPDPGASQPLLAWLLLPLLLLLLVLLLAAYFFRFRKQRKAVVSTSDKKMPNGILEEQEQQRVMLLSRSPSGPKKYFPIPVEHLEEEIRIRSADDCKQFREEFNSLPSGHIQGTFELANKEENREKNRYPNILPNDHSRVILSQLDGIPCSDYINASYIDGYKEKNKFIAAQGPKQETVNDFWRMVWEQKSATIVMLTNLKERKEEKCHQYWPDQGCWTYGNIRVCVEDCVVLVDYTIRKFCIQPQLPDGCKAPRLVSQLHFTSWPDFGVPFTPIGMLKFLKKVKTLNPVHAGPIVVHCSAGVGRTGTFIVIDAMMAMMHAEQKVDVFEFVSRIRNQRPQMVQTDMQYTFIYQALLEYYLYGDTELDVSSLEKHLQTMHGTTTHFDKIGLEEEFRKLTNVRIMKENMRTGNLPANMKKARVIQIIPYDFNRVILSMKRGQEYTDYINASFIDGYRQKDYFIATQGPLAHTVEDFWRMIWEWKSHTIVMLTEVQEREQDKCYQYWPTEGSVTHGEITIEIKNDTLSEAISIRDFLVTLNQPQARQEEQVRVVRQFHFHGWPEIGIPAEGKGMIDLIAAVQKQQQQTGNHPITVHCSAGAGRTGTFIALSNILERVKAEGLLDVFQAVKSLRLQRPHMVQTLEQYEFCYKVVQDFIDIFSDYANFK

SEQ ID NO: 891698 - protein, 480 aa, Homo sapiens; identical to SEQ ID NO: 891686

SEQ ID NO: 891699 - protein, 794 aa, Homo sapiens; identical to SEQ ID NO: 891685

SEQ ID NO: 891700 - protein, 794 aa, Homo sapiens; identical to SEQ ID NO: 891685

SEQ ID NO: 891701 - protein, 70 aa, Homo sapiens
LREECDSRRSIFLFPQSAGVGRTGTFIVIDAMMAMMHAEQKVDVFEFVSRIRNQRPQMVQTDVSHAFLLP

SEQ ID NO: 891702 - protein, 1753 aa, Homo sapiens
MPRRRKNLGGNPFRKTANPKEVVVSSVASREEPTTTLPSMGETKVDQEELFTSISEIFSDLDPDVVYLMLSECDFKVENAMDCLLELSATDTKIEESSSQSFVASENQVGAAESKIMEKRPEEESEDSKMDSFLDMQLTEDLDSLIQNAFEKLNSSPDDQVYSFLPSQDVNSFNDSSEFINPDSSNMTPIFSTQNMNLNGENLENSGSTLSLNPLPSHSVLNESKCFIKDNTLALESNYPEDSLLSSSLNVASDSIAGCSSLNQKQKELLESECVEAQFSEAPVDLDASEPQACLNLPGLDLPGTGGDQKSTRVSDVFLPSEGFNFKPHKHPELPTKGKDVSYCPVLAPLPLLLPPPPPPPMWNPMIPAFDLFQGNHGFVAPVVTTAAHWRSVNYTFPPSVISHTSPTKVWRNKDGTSAYQVQETPVSQVVRKKTSYVGLVLVLLRGLPGSGKSFLARTLQEDNPSGVILSTDDYFYINGQYQFDVKYLGEAHEWNQNRAKEAFEKKISPIIIDNTNLQAWEMKPYVALSQKHKYKVLFREPDTWWKFKPKELARRNIHGVSKEKITRMLEHYQRFVSVPIIMSSSVPEKIERIELCAYSCEDRSTSPRDDEDIISEKEENILSLSLKHLEFTEEKNLDVTKETMLPENVAYLSNADLNKRRKEISDMNPSIQSALILETPHMYFSDSESKLQATDKSENEQIEMVAVKGYSKTDTDSSMERVSPSTCCSENNQEDCDLANSGPLQNEKSSPGEIVEERATVTKKAFGKQKSKSTLEKFPRHELSNFVGDWPVDKTIGQRTKRNRKTEKTSSVQSDKKYNYPQSHKLVNSVSVNTDCVQQRGSPHESVEDGRKSQCDDASEPLNSYKYDAYKNIDKNSFNIMGDWPSSDSLAQREHRSRMPKTGLSEPNLEIGTNDKMNEISLSTAHEACWGTSSQKLKTLGSSNLGSSEMLLSEMTCESQTCLSKKSHGQHTSLPLTFTNSAPTVSGVVEPQTLAECQEQMPKRDPGKEVGMCTQTEPQDFALLWKIEKNKISISDSIKVLTGRLDGFKPKVFNINTKSDVQEAIPYRVMYDKSTFVEESELTSADESENLNILCKLFGSFSLEALKDLYERCNKDIIWATSLLLDSETKLCEDTEFENFQKSCDGSQIGPFSLGLNLKEIISQRGTLENSNSPVPEFSHGIGISNADSQSTCDAERGNSEQAEMRAVTPENHESMTSIFPSAAVGLKNNNDILPNSQEELLYSSKQSFPGILKATTPKDMSETEKNLVVTETGDNIHSPSHFSDIFNFVSSTSNLELNEEIYFTDSLEIKRNENFPKDYVKFSDEEEFMNEDEKEMKEILMAGSSLSAGVSGEDKTEILNPTPAMAKSLTIDCLELALPPELAFQLNELFGPVGIDSGSLTVEDCVVHIDLNLAKVIHEKWKESVMERQRQEEVSCGKFMQDPSLVGHTGLDNPEQKSSQRTGKKLLKTLTASEMLPLLDHWNTQTKKVSLREIMSEEIALQEKHNLKRETLMFEKDCATKLKEKQLFKIFPAINQNFLVDIFKDHNYSLEHTVQFLNCVLEGDPVKTVVAQEFVHQNENVTSHTGQKSKEKKDFEYPDYDDYRAEAFLHQQKRMECYSKAKEAYRIGKKNVATFYAQQGTLHEQKMKEANHLAAIEIFEKVNASLLPQNVLDLHGLHVDEALEHLMRVLEKKTEEFKQNGGKPYLSVITGRGNHSQGGVARIKPAVIKYLISHSFRFSEIKPGCLKVMLK

SEQ ID NO: 891703 - protein, 1673 aa, Homo sapiens
MDCLLELSATDTKIEESSSQSFVASENQVGAAESKIMEKRPEEESEDSKMDSFLDMQLTEDLDSLIQNAFEKLNSSPDDQVYSFLPSQDVNSFNDSSEFINPDSSNMTPIFSTQNMNLNGENLENSGSTLSLNPLPSHSVLNESKCFIKDNTLALGSNYPEDSLLSSSLNVASDSIAGCSSLNQKQKELLESECVEAQFSEAPVDLDASEPQACLNLPGLDLPGTGGDQKSTRVSDVFLPSEGFNFKPHKHPELPTKGKDVSYCPVLAPLPLLLPPPPPPPMWNPMIPAFDLFQGNHGFVAPVVTTAAHWRSVNYTFPPSVISHTSPTKVWRNKDGTSAYQVQETPVSQVVRKKTSYVGLVLVLLRGLPGSGKSFLARTLQEDNPSGVILSTDDYFYINGQYQFDVKYLGEAHEWNQNRAKEAFEKKISPIIIDNTNLQAWEMKPYVALSQKHKYKVLFREPDTWWKFKPKELARRNIHGVSKEKITRMLEHYQRFVSVPIIMSSSVPEKIERIELCAYSCEDRSTSPRDDEDIISEKEENILSLSLKHLEFTEEKNLDVTKETMLPENVAYLSNADLNKRRKEISDMNPSIQSALILETPHMYFSDSESKLQATDKSENEQIEMVAVKGYSKTDTDSSMERVSPSTCCSENNQEDCDLANSGPLQNEKSSPGEIVEERATVTKKAFGKQKSKSTLEKFPRHELSNFVGDWPVDKTIGQRTKRNRKTEKTSSVQSDKKYNYPQSHKLVNSVSVNTDCVQQRGSPHESVEDGRKSQCDDASEPLNSYKYDAYKNIDKNSFNIMGDWPSSDSLAQREHRSRMPKTGLSEPNLEIGTNDKMNEISLSTAHEACWGTSSQKLKTLGSSNLGSSEMLLSEMTCESQTCLSKKSHGQHTSLPLTFTNSAPTVSGVVEPQTLAECQEQMPKRDPGKEVGMCTQTEPQDFALLWKIEKNKISISDSIKVLTGRLDGFKPKVFNINTKSDVQEAIPYRVMYDKSTFVEESELTSADESENLNILCKLFGSFSLEALKDLYERCNKDIIWATSLLLDSETKLCEDTEFENFQKSCDGSQIGPFSLGLNLKEIISQRGTLENSNSPVPEFSHGIGISNADSQSTCDAERGNSEQAEMRAVTPENHESMTSIFPSAAVGLKNNNDILPNSQEELLYSSKQSFPGILKATTPKDMSETEKNLVVTETGDNIHSPSHFSDIFNFVSSTSNLELNEEIYFTDSLEIKRNENFPKDYVKFSDEEEFMNEDEKEMKEILMAGSSLSAGVSGEDKTEILNPTPAMAKSLTIDCLELALPPELAFQLNELFGPVGIDSGSLTVEDCVVHIDLNLAKVIHEKWKESVMERQRQEEVSCGKFMQDPSLVGHTGLDNPEQKSSQRTGKKLLKTLTASEMLPLLDHWNTQTKKVSLREIMSEEIALQEKHNLKRETLMFEKDCATKLKEKQLFKIFPAINQNFLVDIFKDHNYSLEHTVQFLNCVLEGDPVKTVVAQEFVHQNENVTSHTGQKSKEKKDFEYPDYDDYRAEAFLHQQKRMECYSKAKEAYRIGKKNVATFYAQQGTLHEQKMKEANHLAAIEIFEKVNASLLPQNVLDLHGLHVDEALEHLMRVLEKKTEEFKQNGGKPYLSVITGRGNHSQGGVARIKPAVIKYLISHSFRFSEIKPGCLKVMLK

SEQ ID NO: 891704 - protein, 1770 aa, Homo sapiens
MPRRRKNLGGNPFRKTANPKEVVVSSVASREEPTTTLPSMGETKVDQEELFTSISEIFSDLDPDVVYLMLSECDFKVENAMDCLLELSATDTKIEESSSQSFVASENQVGAAESKIMEKRPEEESEDSKMDSFLDMQLTEDLDSLIQNAFEKLNSSPDDQVYSFLPSQDVNSFNDSSEFINPDSSNMTPIFSTQNMNLNGENLENSGSTLSLNPLPSHSVLNESKCFIKDNTLALESNYPEDSLLSSSLNVASDSIAGCSSLNQKQKELLESECVEAQFSEAPVDLDASEPQACLNLPGLDLPGTGGDQKSTRVSDVFLPSEGFNFKPHKHPELPTKGKDVSYCPVLAPLPLLLPPPPPPPMWNPMIPAFDLFQGNHGFVAPVVTTAAHWRSVNYTFPPSVISHTSPTKVWRNKDGTSAYQVQETPVSQVVRKKTSYVGLVLVLLRGLPGSGKSFLARTLQEDNPSGVILSTDDYFYINGQYQFDVKYLGEAHEWNQNRAKEAFEKKISPIIIDNTNLQAWEMKPYVALSQKHKYKVLFREPDTWWKFKPKELARRNIHGVSKEKITRMLEHYQRFVSVPIIMSSSVPEKIERIELCAYSCEDRSTSPRDDEDIISEKEENILSLSLKHLEFTEEKNLDVTKETMLPENVAYLSNADLNKRRKEISDMNPSIQSALILETPHMYFSDSESKLQATDKSENEQIEMVAVKGYSKTDTDSSMERVSPSTCCSENNQEDCDLANSGPLQNEKSSPGEIVEERATVTKKAFGKQKSKSTLEKFPRHELSNFVGDWPVDKTIGQRTKRNRKTEKTSSVQSDKKYNYPQSHKLVNSVSVNTDCVQQRGSPHESVEDGRKSQCDDASEPLNSYKYDAYKNIDKNSFNIMGDWPSSDSLAQREHRSRMPKTGLSEPNLEIGTNDKMNEISLSTAHEACWGTSSQKLKTLGSSNLGSSEMLLSEMTCESQTCLSKKSHGQHTSLPLTFTNSAPTVSGVVEPQTLAECQEQMPKRDPGKEVGMCTQTEPQDFALLWKIEKNKISISDSIKVLTGRLDGFKPKVFNINTKSDVQEAIPYRVMYDKSTFVEESELTSADESENLNILCKLFGSFSLEALKDLYERCNKDIIWATSLLLDSETKLCEDTEFENFQKSCDGSQIGPFSLGLNLKEIISQRGTLENSNSPVPEFSHGIGISNADSQSTCDAERGNSEQAEMRAVTPENHESMTSIFPSAAVGLKNNNDILPNSQEELLYSSKQSFPGILKATTPKDMSETEKNLVVTETGDNIHSPSHFSDIFNFVSSTSNLELNEEIYFTDSLEIKRNENFPKDYVKFSDEEEFMNEDEKEMKEILMAGSSLSAGVSGEDKTEILNPTPAMAKSLTIDCLELALPPELAFQLNELFGPVGIDSGSLTVEDCVVHIDLNLAKVIHEKWKESVMERQRQEEVSCGKFMQDPSLVGHTGLDNPEQKSSQRTGKKLLKTLTASEMLPLLDHWNTQTKKVSLREIMSEEIALQEKHNLKRETLMFEKDCATKLKEKQLFKIFPAINQNFLVDIFKDHNYSLEHTVQFLNCVLEGDPVKTVVAQEFVHQNENVTSHTGQKSKEKKPKKLKETEETPSELSFQDFEYPDYDDYRAEAFLHQQKRMECYSKAKEAYRIGKKNVATFYAQQGTLHEQKMKEANHLAAIEIFEKVNASLLPQNVLDLHGLHVDEALEHLMRVLEKKTEEFKQNGGKPYLSVITGRGNHSQGGVARIKPAVIKYLISHSFRFSEIKPGCLKVMLK

SEQ ID NO: 891705 - protein, 380 aa, Homo sapiens
ELLVLWYDSGSLTVEDCVVHIDLNLAKVIHEKWKESVMERQRQEEVSCGKFMQDPSLVGHTGLDNPEQKSSQRTGKKLLKTLTASEMLPLLDHWNTQTKKVSLREIMSEEIALQEKHNLKRETLMFEKDCATKLKEKQLFKIFPAINQNFLVDIFKDHNYSLEHTVQFLNCVLEGDPVKTVVAQEFVHQNENVTSHTGQKSKEKKPKKLKETEETPSELSFQDFEYPDYDDYRAEAFLHQQKRMECYSKAKEAYRIGKKNVATFYAQQGTLHEQKMKEANHLAAIEIFEKVNASLLPQNVLDLHGLHVDEALEHLMRVLEKKTEEFKQNGGKPYLSVITGRGNHSQGGVARIKPAVIKYLISHSFRFSEIKPGCLKVMLK

SEQ ID NO: 891706 - protein, 199 aa, Homo sapiens
VPVPSSLDAAPAAVVGCWVWSFPAPLGSDPLSVLLRRQPTSLLGAMTTTTTFKGVDPNSRNSSRVLRPPGGGSNFSLGFDEPTEQPVRKNKMASNIFGTPEENQASWAKSAGAKSSGGREDLESSGLQRRNSSEASSGDFLDLKGEGDIHENVDTDLPGSLGQSEEKPVPAAPVPSPVAPAPVPSRRNPPGGKSSLVLG

SEQ ID NO: 891707 - protein, 154 aa, Homo sapiens
MTTTTTFKGVDPNSRNSSRVLRPPGGGSNFSLGFDEPTEQPVRKNKMASNIFGTPEENQASWAKSAGAKSSGGREDLESSGLQRRNSSEASSGDFLDLKGEGDIHENVDTDLPGSLGQSEEKPVPAAPVPSPVAPAPVPSRRNPPGGKSSLVLG

SEQ ID NO: 891708 - protein, 203 aa, Homo sapiens
MAVISGYKVARPGSPAAVVGCWVWSFPAPLGSDPLSVLLRRQPTSLLGAMTTTTTFKGVDPNSRNSSRVLRPPGGGSNFSLGFDEPTEQPVRKNKMASNIFGTPEENQASWAKSAGAKSSGGREDLESSGLQRRNSSEASSGDFLDLKGEGDIHENVDTDLPGSLGQSEEKPVPAAPVPSPVAPAPVPSRRNPPGGKSSLVLG

SEQ ID NO: 891709 - protein, 154 aa, Homo sapiens; identical to SEQ ID NO: 891707

SEQ ID NO: 891710 - protein, 199 aa, Homo sapiens; identical to SEQ ID NO: 891706

SEQ ID NO: 891711 - protein, 154 aa, Homo sapiens; identical to SEQ ID NO: 891707

SEQ ID NO: 891712 - protein, 154 aa, Homo sapiens; identical to SEQ ID NO: 891707

SEQ ID NO: 891713 - protein, 154 aa, Homo sapiens; identical to SEQ ID NO: 891707

SEQ ID NO: 891714 - protein, 108 aa, Homo sapiens
MASNIFGTPEENQASWAKSAGAKSSGGREDLESSGLQRRNSSEASSGDFLDLKGEGDIHENVDTDLPGSLGQSEEKPVPAAPVPSPVAPAPVPSRRNPPGGKSSLVLG

SEQ ID NO: 891715 - protein, 252 aa, Homo sapiens
SPVRCARAGAGGGVLPSAPPLCRLASPARRPHPGPCCSPFIPSTESGAEEAGAGRPSEHGRFSLIGTFGEGFAFSCVHPGWCIPRVVGLAPQVPGDPLGPHAWSGPIVPLMGHALLSLPRGMRLVSLSRAAIGSGDRIDQVRRAPYPRRAPTPYSDLPDRCMCGRAGLVIATLHPPLRTQSFFPSSKCLPSSKCLPFLTKERPLLPIPALISKAGGGGGRGERANPSGFSALKPSDRGLCILPSLPPLTFAQ

SEQ ID NO: 891716 - protein, 275 aa, Homo sapiens
SPVRCARAGAGGGVLPSAPPLCRLASPARRPHPGPCCSPFIPSTESGAEEAGAGRPSEHGRFSLIGTFGEGFAFSCVHPGWCIPRVVGLAPQVPGDPLGPHAWSGPIVPLMGHALLSLPRGMRLVSLSRAAIGSGDRIDRVLRPPGGGSNFSLGFDEPTEQPVRKNKMASNIFGTPEENQASWAKSAGAKSSGGREDLESSGLQRRNSSEASSGDFLDLKGEGDIHENVDTDLPGSLGQSEEKPVPAAPVPSPVAPAPVPSRRNPPGGKSSLVLG

SEQ ID NO: 891717 - protein, 295 aa, Homo sapiens
SPVRCARAGAGGGVLPSAPPLCRLASPARRPHPGPCCSPFIPSTESGAEEAGAGRPSEHGRFSLIGTFGEGFAFSCVHPGWCIPRVVGLAPQVPGDPLGPHAWSGPIVPLMGHALLSLPRGMRLVSLSRAAIGSGDRIDQVRRAPYPRRAPTPYSDLPDRVLRPPGGGSNFSLGFDEPTEQPVRKNKMASNIFGTPEENQASWAKSAGAKSSGGREDLESSGLQRRNSSEASSGDFLDLKGEGDIHENVDTDLPGSLGQSEEKPVPAAPVPSPVAPAPVPSRRNPPGGKSSLVLG

SEQ ID NO: 891718 - protein, 108 aa, Homo sapiens; identical to SEQ ID NO: 891714

SEQ ID NO: 891719 - protein, 150 aa, Homo sapiens
VSPPVCATISRNSSRVLRPPGGGSNFSLGFDEPTEQPVRKNKMASNIFGTPEENQASWAKSAGAKSSGGREDLESSGLQRRNSSEASSGDFLDLKGEGDIHENVDTDLPGSLGQSEEKPVPAAPVPSPVAPAPVPSRRNPPGGKSSLVLG

SEQ ID NO: 891720 - protein, 154 aa, Homo sapiens; identical to SEQ ID NO: 891707

SEQ ID NO: 891721 - protein, 154 aa, Homo sapiens; identical to SEQ ID NO: 891707

SEQ ID NO: 891722 - protein, 181 aa, Homo sapiens
MAVISGYKVARPGSPAAVVGCWVWSFPAPLGSDPLSVLLRRQPTSLLGAMTTTTTFKGVDPNSRNSSRVLRPPGGGSNFSLGFDEPTEQPVRKNKMASNIFGTPEENQASWAKSAGAKSSGGREDLESSGLQRRNSSEASSGDFLDLKGEGDREGDIHENVDTDLPSRRNPPGGKSSLVLG

SEQ ID NO: 891723 - protein, 172 aa, Homo sapiens
MAVISGYKVARPGSPAAVVGCWVWSFPAPLGSDPLSVLLRRQPTSLLGAMTTTTTFKGVDPNSRNSSRVLRPPGGGSNFSLGFDEPTEQPVRKNKMASNIFGTPEENQASWAKSAGAKSSGGREDLESSGLQRRNSSEASSGDFLDLKGEGDMTVLNAVVLSVSSMLVNCTT

SEQ ID NO: 891724 - protein, 68 aa, Homo sapiens
EYDLTRQTEAWGQLGLQGDAFIRDRSGPSCAIQKKSPWRQVQPRLGLALTVLNAVVLSVSSMLVNCTT

SEQ ID NO: 891725 - protein, 161 aa, Homo sapiens
MTTTTTFKGVDPNSRNSSRVLRPPGGGSNFSLGFDEPTEQPVRKNKMASNIFGTPEENQASWAKSAGAKSSGGREDLESSGLQRRNSSEASSGDFLDLKGEGDIHENVDTDLPGSLGQSEEKPVPAAPVPSPNPQGVSPQSLLGVALTCQWPLLRASSCDM

SEQ ID NO: 891726 - protein, 154 aa, Homo sapiens
MAVISGYKVARPGSPAAVVGCWVWSFPAPLGSDPLSVLLRRQPTSLLGAMTTTTTFKGVDPNSRNSSRVLRPPGGGSNFSLGFDEPTEQPVRKNKMASNIFGTPEENQASWAKSAGAKSSGGREDLESSGLQRRNSSEASSGDFLDLKGEGDTA

SEQ ID NO: 891727 - protein, 194 aa, Homo sapiens
MQAVRNAGSRFLRSWTWPQTAGRVVARTPAGTICTGARQLQDAAAKQKVEQNAAPSHTKFSIYPPIPGEESSLRWAGKKFEEIPIAHIKASHNNTQIQVVSASNEPLAFASCGTEGFRNAKKGTGIAAQTAGIAAAARAKQKGVIHIRVVVKGLGPGRLSAMHGLIMGGLEVISITDNTPIPHNGCRPRKARKL

SEQ ID NO: 891728 - protein, 161 aa, Homo sapiens
MQAVRNAGSRFLRSWTWPQTAGRVVARTPAGTICTGARQLQDAAAKQKVEQNAAPSHTKFSTQIQVVSASNEPLAFASCGTEGFRNAKKGTGIAAQTAGIAAAARAKQKGVIHIRVVVKGLGPGRLSAMHGLIMGGLEVISITDNTPIPHNGCRPRKARKL

SEQ ID NO: 891729 - protein, 194 aa, Homo sapiens; identical to SEQ ID NO: 891727

SEQ ID NO: 891730 - protein, 159 aa, Homo sapiens
MEKRTWSSEVNGSSSGQVEVGHWRQSIYPPIPGEESSLRWAGKKFEEIPIAHIKASHNNTQIQVVSASNEPLAFASCGTEGFRNAKKGTGIAAQTAGIAAAARAKQKGVIHIRVVVKGLGPGRLSAMHGLIMGGLEVISITDNTPIPHNGCRPRKARKL

SEQ ID NO: 891731 - protein, 159 aa, Homo sapiens; identical to SEQ ID NO: 891730

SEQ ID NO: 891732 - protein, 161 aa, Homo sapiens; identical to SEQ ID NO: 891728

SEQ ID NO: 891733 - protein, 95 aa, Homo sapiens
MQAVRNAGSRFLRSWTWPQTAGRVVARTPAGTICTGARQLQDAAAKQKVEQNAAPSHTKFSIYPPIPGEESSLRWAGKKFEEIPIAHCRDSVRLD

SEQ ID NO: 891734 - protein, 70 aa, Homo sapiens
MQAVRNAGSRFLRSWTWPQTAGRVVARTPAGTICTGARQLQDANEGAARVIGTLLGTVDNTHVEVTIAFR

SEQ ID NO: 891735 - protein, 194 aa, Homo sapiens; identical to SEQ ID NO: 891727

SEQ ID NO: 891736 - protein, 194 aa, Homo sapiens; identical to SEQ ID NO: 891727

SEQ ID NO: 891737 - protein, 194 aa, Homo sapiens; identical to SEQ ID NO: 891727

SEQ ID NO: 891738 - protein, 159 aa, Homo sapiens; identical to SEQ ID NO: 891730

SEQ ID NO: 891739 - protein, 171 aa, Homo sapiens
MQAVRNAGSRFLRSWTWPQTAGRVVARTPAGTICTGARQLQDAAAKQKVEQNAAPSHTKFSIYPPIPGEESSLRWAGKKFEEIPIAHIKASHNNRNAKKGTGIAAQTAGIAAAARAKQKGVIHIRVVVKGLGPGRLSAMHGLIMGGLEVISITDNTPIPHNGCRPRKARKL

SEQ ID NO: 891740 - protein, 355 aa, Homo sapiens
REVCYGDTGPTTFVPSSIVFSRAMASGLVRLLQQGHRCLLAPVAPKLVPPVRGVKKGFRAAFRFQKELERQRLLRCPPPPVRRSEKPNWDYHAEIQAFGHRLQENFSLDLLKTAFVNSCYIKSEEAKRQQLGIEKEAVLLNLKSNQELSEQGTSFSQTCLTQFLEDEYPDMPTEGIKNLVDFLTGEEVVCHVARNLAVEQLTLSEEFPVPPAVLQQTFFAVIGALLQSSGPERTALFIRDFLITQMTGKELFEMWKIINPMGLLVEELKKRNVSAPESRLTRQSGGTTALPLYFVGLYCDKKLIAEGPGETVLVAEEEAARVALRKLYGFTENRRPWNYSKPKETLRAEKSITAS

SEQ ID NO: 891741 - protein, 355 aa, Homo sapiens; identical to SEQ ID NO: 891740

SEQ ID NO: 891742 - protein, 355 aa, Homo sapiens; identical to SEQ ID NO: 891740

SEQ ID NO: 891743 - protein, 355 aa, Homo sapiens; identical to SEQ ID NO: 891740

SEQ ID NO: 891744 - protein, 1331 aa, Homo sapiens
MQAAPRAGCGAALLLWIVSSCLCRAWTAPSTSQKCDEPLVSGLPHVAFSSSSSISGSYSPGYAKINKRGGAGGWSPSDSDHYQWLQVDFGNRKQISAIATQGRYSSSDWVTQYRMLYSDTGRNWKPYHQDGNIWAFPGNINSDGVVRHELQHPIIARYVRIVPLDWNGEGRIGLRIEVYGCSYWADVINFDGHVVLPYRFRNKKMKTLKDVIALNFKTSESEGVILHGEGQQGDYITLELKKAKLVLSLNLGSNQLGPIYGHTSVMTGSLLDDHHWHSVVIERQGRSINLTLDRSMQHFRTNGEFDYLDLDYEITFGGIPFSGKPSSSSRKNFKGCMESINYNGVNITDLARRKKLEPSNVGNLSFSCVEPYTVPVFFNATSYLEVPGRLNQDLFSVSFQFRTWNPNGLLVFSHFADNLGNVEIDLTESKVGVHINITQTKMSQIDISSGSGLNDGQWHEVRFLAKENFAILTIDGDEASAVRTNSPLQVKTGEKYFFGGFLNQMNNSSHSVLQPSFQGCMQLIQVDDQLVNLYEVAQRKPGSFANVSIDMCAIIDRCVPNHCEHGGKCSQTWDSFKCTCDETGYSGATCHNSIYEPSCEAYKHLGQTSNYYWIDPDGSGPLGPLKVYCNMTEDKVWTIVSHDLQMQTPVVGYNPEKYSVTQLVYSASMDQISAITDSAEYCEQYVSYFCKMSRLLNTPDGSPYTWWVGKANEKHYYWGGSGPGIQKCACGIERNCTDPKYYCNCDADYKQWRKDAGFLSYKDHLPVSQVVVGDTDRQGSEAKLSVGPLRCQGDRNYWNAASFPNPSSYLHFSTFQGETSADISFYFKTLTPWGVFLENMGKEDFIKLELKSATEVSFSFDVGNGPVEIVVRSPTPLNDDQWHRVTAERNVKQASLQVDRLPQQIRKAPTEGHTRLELYSQLFVGGAGGQQGFLGCIRSLRMNGVTLDLEERAKVTSGFISGCSGHCTSYGTNCENGGKCLERYHGYSCDCSNTAYDGTFCNKDVGAFFEEGMWLRYNFQAPATNARDSSSRVDNAPDQQNSHPDLAQEEIRFSFSTTKAPCILLYISSFTTDFLAVLVKPTGSLQIRYNLGGTREPYNIDVDHRNMANGQPHSVNITRHEKTIFLKLDHYPSVSYHLPSSSDTLFNSPKSLFLGKVIETGKIDQEIHKYNTPGFTGCLSRVQFNQIAPLKAALRQTNASAHVHIQGELVESNCGASPLTLSPMSSATDPWHLDHLDSASADFPYNPGQGQAIRNGVNRNSAIIGGVIAVVIFTILCTLVFLIRYMFRHKGTYHTNEAKGAESAESADAAIMNNDPNFTETIDESKKEWLI

SEQ ID NO: 891745 - protein, 425 aa, Homo sapiens
SLCSSLLPHPSLCSSLLVGGAGGQQGFLGCIRSLRMNGVTLDLEERAKVTSGFISGCSGHCTSYGTNCENGGKCLERYHGYSCDCSNTAYDGTFCNKDVGAFFEEGMWLRYNFQAPATNARDSSSRVDNAPDQQNSHPDLAQEEIRFSFSTTKAPCILLYISSFTTDFLAVLVKPTGSLQIRYNLGGTREPYNIDVDHRNMANGQPHSVNITRHEKTIFLKLDHYPSVSYHLPSSSDTLFNSPKSLFLGKVIETGKIDQEIHKYNTPGFTGCLSRVQFNQIAPLKAALRQTNASAHVHIQGELVESNCGASPLTLSPMSSATDPWHLDHLDSASADFPYNPGQGQAIRNGVNRNSAIIGGVIAVVIFTILCTLVFLIRYMFRHKGTYHTNEAKGAESAESADAAIMNNDPNFTETIDESKKEWLI

SEQ ID NO: 891746 - protein, 1377 aa, Homo sapiens
RGEEEAGGAWLPRVFEDSPSPFKNPTESRTASPQRALGAPPAGRRRMQAAPRAGCGAALLLWIVSSCLCRAWTAPSTSQKCDEPLVSGLPHVAFSSSSSISGSYSPGYAKINKRGGAGGWSPSDSDHYQWLQVDFGNRKQISAIATQGRYSSSDWVTQYRMLYSDTGRNWKPYHQDGNIWAFPGNINSDGVVRHELQHPIIARYVRIVPLDWNGEGRIGLRIEVYGCSYWADVINFDGHVVLPYRFRNKKMKTLKDVIALNFKTSESEGVILHGEGQQGDYITLELKKAKLVLSLNLGSNQLGPIYGHTSVMTGSLLDDHHWHSVVIERQGRSINLTLDRSMQHFRTNGEFDYLDLDYEITFGGIPFSGKPSSSSRKNFKGCMESINYNGVNITDLARRKKLEPSNVGNLSFSCVEPYTVPVFFNATSYLEVPGRLNQDLFSVSFQFRTWNPNGLLVFSHFADNLGNVEIDLTESKVGVHINITQTKMSQIDISSGSGLNDGQWHEVRFLAKENFAILTIDGDEASAVRTNSPLQVKTGEKYFFGGFLNQMNNSSHSVLQPSFQGCMQLIQVDDQLVNLYEVAQRKPGSFANVSIDMCAIIDRCVPNHCEHGGKCSQTWDSFKCTCDETGYSGATCHNSIYEPSCEAYKHLGQTSNYYWIDPDGSGPLGPLKVYCNMTEDKVWTIVSHDLQMQTPVVGYNPEKYSVTQLVYSASMDQISAITDSAEYCEQYVSYFCKMSRLLNTPDGSPYTWWVGKANEKHYYWGGSGPGIQKCACGIERNCTDPKYYCNCDADYKQWRKDAGFLSYKDHLPVSQVVVGDTDRQGSEAKLSVGPLRCQGDRNYWNAASFPNPSSYLHFSTFQGETSADISFYFKTLTPWGVFLENMGKEDFIKLELKSATEVSFSFDVGNGPVEIVVRSPTPLNDDQWHRVTAERNVKQASLQVDRLPQQIRKAPTEGHTRLELYSQLFVGGAGGQQGFLGCIRSLRMNGVTLDLEERAKVTSGFISGCSGHCTSYGTNCENGGKCLERYHGYSCDCSNTAYDGTFCNKDVGAFFEEGMWLRYNFQAPATNARDSSSRVDNAPDQQNSHPDLAQEEIRFSFSTTKAPCILLYISSFTTDFLAVLVKPTGSLQIRYNLGGTREPYNIDVDHRNMANGQPHSVNITRHEKTIFLKLDHYPSVSYHLPSSSDTLFNSPKSLFLGKVIETGKIDQEIHKYNTPGFTGCLSRVQFNQIAPLKAALRQTNASAHVHIQGELVESNCGASPLTLSPMSSATDPWHLDHLDSASADFPYNPGQGQAIRNGVNRNSAIIGGVIAVVIFTILCTLVFLIRYMFRHKGTYHTNEAKGAESAESADAAIMNNDPNFTETIDESKKEWLI

SEQ ID NO: 891747 - protein, 108 aa, Homo sapiens
MSSATDPWHLDHLDSASADFPYNPGQGQAIRNGVNRNSAIIGGVIAVVIFTILCTLVFLIRYMFRHKGTYHTNEAKGAESAESADAAIMNNDPNFTETIDESKKEWLI

SEQ ID NO: 891748 - protein, 798 aa, Homo sapiens
MQAAPRAGCGAALLLWIVSSCLCRAWTAPSTSQKCDEPLVSGLPHVAFSSSSSISGSYSPGYAKINKRGGAGGWSPSDSDHYQWLQVDFGNRKQISAIATQGRYSSSDWVTQYRMLYSDTGRNWKPYHQDGNIWAFPGNINSDGVVRHELQHPIIARYVRIVPLDWNGEGRIGLRIEVYGCSYWADVINFDGHVVLPYRFRNKKMKTLKDVIALNFKTSESEGVILHGEGQQGDYITLELKKAKLVLSLNLGSNQLGPIYGHTSVMTGSLLDDHHWHSVVIERQGRSINLTLDRSMQHFRTNGEFDYLDLDYEITFGGIPFSGKPSSSSRKNFKGCMESINYNGVNITDLARRKKLEPSNVGNLSFSCVEPYTVPVFFNATSYLEVPGRLNQDLFSVSFQFRTWNPNGLLVFSHFADNLGNVEIDLTESKVGVHINITQTKMSQIDISSGSGLNDGQWHEVRFLAKENFAILTIDGDEASAVRTNSPLQVKTGEKYFFGGFLNQMNNSSHSVLQPSFQGCMQLIQVDDQLVNLYEVAQRKPGSFANVSIDMCAIIDRCVPNHCEHGGKCSQTWDSFKCTCDETGYSGATCHNSIYEPSCEAYKHLGQTSNYYWIDPDGSGPLGPLKVYCNMTEDKVWTIVSHDLQMQTPVVGYNPEKYSVTQLVYSASMDQISAITDSAEYCEQYVSYFCKMSRLLNTPDGSPYTWWVGKANEKHYYWGGSGPGIQKCACGIERNCTDPKYYCNCDADYKQWRKDAGFLSYKDHLPVSQVVVGDTDRQGSEAKLSVGPLRCQGDSKFA

SEQ ID NO: 891749 - protein, 483 aa, Homo sapiens
MKLWIHLFYSSLLACISLHSQTPVLSSRGSCDSLCNCEEKDGTMLINCEAKGIKMVSEISVPPSRPFQLSLLNNGLTMLHTNDFSGLTNAISIHLGFNNIADIEIGAFNGLGLLKQLHINHNSLEILKEDTFHGLENLEFLQADNNFITVIEPSAFSKLNRLKVLILNDNAIESLPPNIFRFVPLTHLDLRGNQLQTLPYVGFLEHIGRILDLQLEDNKWACNCDLLQLKTWLENMPPQSIIGDVVCNSPPFFKGSILSRLKKESICPTPPVYEEHEDPSGSLHLAATSSINDSRMSTKTTSILKLPTKAPGLIPYITKPSTQLPGPYCPIPCNCKVLSPSGLLIHCQERNIESLSDLRPPPQNPRKLILAGNIIHSLMKSDLVEYFTLEMLHLGNNRIEVLEEGSFMNLTRLQKLYLNGNHLTKLSKGMFLGLHNLEYLYLEYNAIKEILPGTFNPMPKLKVLYLNNTSSKFYHHIFFQGFL

SEQ ID NO: 891750 - protein, 423 aa, Homo sapiens
MKLWIHLFYSSLLACISLHSQTPVLSSRGSCDSLCNCEEKDGTMLINCEAKGIKMVSEISVPPSRPFQLSLLNNGLTMLHTNDFSGLTNAISIHLGFNNIADIEIGAFNGLGLLKQLHINHNSLEILKEDTFHGLENLEFLQADNNFITVIEPSAFSKLNRLKVLILNDNAIESLPPNIFRFVPLTHLDLRGNQLQTLPYVGFLEHIGRILDLQLEDNKWACNCDLLQLKTWLENMPPQSIIGDVVCNSPPFFKGSILSRLKKESICPTPPVYEEHEDPSGSLHLAATSSINDSRMSTKTTSILKLPTKAPGLIPYITKPSTQLPGPYCPIPCNCKVLSPSGLLIHCQERNIESLSDLRPPPQNPRKLILAGNIIHSLMKFHPLVQSIWKRKKRGMRKKEVMQNISKEVFWNRKIIHHSQGQI

SEQ ID NO: 891751 - protein, 308 aa, Homo sapiens
MNQNHSLELDFLQAEARLLEEQRRVQVYLHESTQDELARKCEQVLIEKHLEIFHTEFQNLLDADKNEDLGRMYNLVSRIQDGLGELKKLLETHIHNQGLAAIEKCGEAALNDPKMYVQTVLDVHKKYNALVMSAFNNDAGFVAALDKACGRFINNNAVTKMAQSSSKSPELLARYCDSLLKKSSKNPEEAELEDTLNQVMVVFKVHRRHTAPGAEEMRINSSTENSDEGLKVRDGKGIPFTATLASSSVNSAEEHVASTNEGREPTDSVPKEQMSLVHVGTEAFPISDESMIKDRKDRLPLESAVVRG

SEQ ID NO: 891752 - protein, 776 aa, Homo sapiens
MSSTRSQNPHGLKQIGLDQIWDDLRAGIQQVYTRQSMAKSRYMELYTHVYNYCTSVHQSNQARGAGVPPSKSKKGQTPGGAQFVGLELYKRLKEFLKNYLTNLLKDGEDLMDESVLKFYTQQWEDYRFSSKVLNGICAYLNRHWVRRECDEGRKGIYEIYSLALVTWRDCLFRPLNKQVTNAVLKLIEKERNGETINTRLISGVVQSYVELGLNEDDAFAKGPTLTVYKESFESQFLADTERFYTRESTEFLQQNPVTEYMKKAEARLLEEQRRVQVYLHESTQDELARKCEQVLIEKHLEIFHTEFQNLLDADKNEDLGRMYNLVSRIQDGLGELKKLLETHIHNQGLAAIEKCGEAALNDPKMYVQTVLDVHKKYNALVMSAFNNDAGFVAALDKACGRFINNNAVTKMAQSSSKSPELLARYCDSLLKKSSKNPEEAELEDTLNQVMVVFKYIEDKDVFQKFYAKMLAKRLVHQNSASDDAEASMISKLKQACGFEYTSKLQRMFQDIGVSKDLNEQFKKHLTNSEPLDLDFSIQVLSSGSWPFQQSCTFALPSELERSYQRFTAFYASRHSGRKLTWLYQLSKGELVTNCFKNRYTLQASTFQMAILLQYNTEDAYTVQQLTDSTQIKMDILAQVLQILLKSKLLVLEDENANVDEVELKPDTLIKLYLGYKNKKLRVNINVPMKTEQKQEQETTHKNIEEDRKLLIQAAIVRIMKMRKVLKHQQLLGEVLTQLSSRFKPRVPVIKKCIDILIEKEYLERVDGEKDTYSYLA

SEQ ID NO: 891753 - protein, 666 aa, Homo sapiens
MDESVLKFYTQQWEDYRFSSKVLNGICAYLNRHWVRRECDEGRKGIYEIYSLALVTWRDCLFRPLNKQVTNAVLKLIEKERNGETINTRLISGVVQSYVELGLNEDDAFAKGPTLTVYKESFESQFLADTERFYTRESTEFLQQNPVTEYMKKAEARLLEEQRRVQVYLHESTQDELARKCEQVLIEKHLEIFHTEFQNLLDADKNEDLGRMYNLVSRIQDGLGELKKLLETHIHNQGLAAIEKCGEAALNDPKMYVQTVLDVHKKYNALVMSAFNNDAGFVAALDKACGRFINNNAVTKMAQSSSKSPELLARYCDSLLKKSSKNPEEAELEDTLNQVMVVFKYIEDKDVFQKFYAKMLAKRLVHQNSASDDAEASMISKLKQACGFEYTSKLQRMFQDIGVSKDLNEQFKKHLTNSEPLDLDFSIQVLSSGSWPFQQSCTFALPSELERSYQRFTAFYASRHSGRKLTWLYQLSKGELVTNCFKNRYTLQASTFQMAILLQYNTEDAYTVQQLTDSTQIKMDILAQVLQILLKSKLLVLEDENANVDEVELKPDTLIKLYLGYKNKKLRVNINVPMKTEQKQEQETTHKNIEEDRKLLIQAAIVRIMKMRKVLKHQQLLGEVLTQLSSRFKPRVPVIKKCIDILIEKEYLERVDGEKDTYSYLA

SEQ ID NO: 891754 - protein, 666 aa, Homo sapiens; identical to SEQ ID NO: 891753

SEQ ID NO: 891755 - protein, 666 aa, Homo sapiens; identical to SEQ ID NO: 891753

SEQ ID NO: 891756 - protein, 776 aa, Homo sapiens; identical to SEQ ID NO: 891752

SEQ ID NO: 891757 - protein, 776 aa, Homo sapiens; identical to SEQ ID NO: 891752

SEQ ID NO: 891758 - protein, 776 aa, Homo sapiens; identical to SEQ ID NO: 891752

SEQ ID NO: 891759 - protein, 776 aa, Homo sapiens; identical to SEQ ID NO: 891752

SEQ ID NO: 891760 - protein, 759 aa, Homo sapiens
MSSTRSQNPHGLKQIGLDQIWDDLRAGIQQVYTRQSMAKSRYMELYTHVYNYCTSVHQSNQARGAGVPPSKSKKGQTPGGAQFVGLELYKRLKEFLKNYLTNLLKDGEDLMDESVLKFYTQQWEDYRFSSKVLNGICAYLNRHWVRRECDEGRKGIYEIYSVTNAVLKLIEKERNGETINTRLISGVVQSYVELGLNEDDAFAKGPTLTVYKESFESQFLADTERFYTRESTEFLQQNPVTEYMKKAEARLLEEQRRVQVYLHESTQDELARKCEQVLIEKHLEIFHTEFQNLLDADKNEDLGRMYNLVSRIQDGLGELKKLLETHIHNQGLAAIEKCGEAALNDPKMYVQTVLDVHKKYNALVMSAFNNDAGFVAALDKACGRFINNNAVTKMAQSSSKSPELLARYCDSLLKKSSKNPEEAELEDTLNQVMVVFKYIEDKDVFQKFYAKMLAKRLVHQNSASDDAEASMISKLKQACGFEYTSKLQRMFQDIGVSKDLNEQFKKHLTNSEPLDLDFSIQVLSSGSWPFQQSCTFALPSELERSYQRFTAFYASRHSGRKLTWLYQLSKGELVTNCFKNRYTLQASTFQMAILLQYNTEDAYTVQQLTDSTQIKMDILAQVLQILLKSKLLVLEDENANVDEVELKPDTLIKLYLGYKNKKLRVNINVPMKTEQKQEQETTHKNIEEDRKLLIQAAIVRIMKMRKVLKHQQLLGEVLTQLSSRFKPRVPVIKKCIDILIEKEYLERVDGEKDTYSYLA

SEQ ID NO: 891761 - protein, 703 aa, Homo sapiens
MSSTRSQNPHGLKQIGLDQIWDDLRAGIQQVYTRQSMAKSRYMELYTHVYNYCTSVHQSNQARGAGVPPSKSKKGQTPGGAQFVGLELYKRLKEFLKNYLTNLLKDGEDLMDESVLKFYTQQWEDYRFSSKVLNGICAYLNRHWVRRECDEGRKGIYEIYSLALVTWRDCLFRPLNKQVTNAVLKLIEKERNGETINTRLISGVVQSYVELGLNEDDAFAKGPTLTVYKESFESQFLADTERFYTRESTEFLQQNPVTEYMKKAEARLLEEQRRVQVYLHESTQDELARKCEQVLIEKHLEIFHTEFQNLLDADKNEDLGRMYNLVSRIQDGLGELKKLLETHIHNQGLAAIEKCGEAALNDPKMYVQTVLDVHKKYNALVMSAFNNDAGFVAALDKACGRFINNNAVTKMAQSSSKSPELLARYCDSLLKKSSKNPEEAELEDTLNQVMVVFKYIEDKDVFQKFYAKMLAKRLVHQNSASDDAEASMISKLKQACGFEYTSKLQRMFQDIGVSKDLNEQFKKHLTNSEPLDLDFSIQVLSSGSWPFQQSCTFALPSELERSYQRFTAFYASRHSGRKLTWLYQLSKGELVTNCFKNRYTLQASTFQMAILLQYNTEDAYTVQQLTDSTQIKMDILAQVLQILLKSKLLVLEDENANVDEVELKPDTLIKLYLGYKNKKLRVNINVPMKTEQKQEQETTQRPS

SEQ ID NO: 891762 - protein, 776 aa, Homo sapiens; identical to SEQ ID NO: 891752

SEQ ID NO: 891763 - protein, 776 aa, Homo sapiens; identical to SEQ ID NO: 891752

SEQ ID NO: 891764 - protein, 755 aa, Homo sapiens [sequence omitted]

SEQ ID NO: 891765 - protein, 223 aa, Homo sapiens
PSKLILYSQPYSAFTIANSARRVTTFTWLYQLSKGELVTNCFKNRYTLQASTFQMAILLQYNTEDAYTVQQLTDSTQIKMDILAQVLQILLKSKLLVLEDENANVDEVELKPDTLIKLYLGYKNKKLRVNINVPMKTEQKQEQETTHKNIEEDRKLLIQAAIVRIMKMRKVLKHQQLLGEVLTQLSSRFKPRVPVIKKCIDILIEKEYLERVDGEKDTYSYLA

SEQ ID NO: 891766 - protein, 558 aa, Homo sapiens
MSSTRSQNPHGLKQIGLDQIWDDLRAGIQQVYTRQSMAKSRYMELYTHVYNYCTSVHQSNQARGAGVPPSKSKKGQTPGGAQFVGLELYKRLKEFLKNYLTNLLKDGEDLMDESVLKFYTQQWEDYRFSSKVLNGICAYLNRHWVRRECDEGRKGIYEIYSLALVTWRDCLFRPLNKQVTNAVLKLIEKERNGETINTRLISGVVQSYVELGLNEDDAFAKGPTLTVYKESFESQFLADTERFYTRESTEFLQQNPVTEYMKKAEARLLEEQRRVQVYLHESTQDELARKCEQVLIEKHLEIFHTEFQNLLDADKNEDLGRMYNLVSRIQDGLGELKKLLETHIHNQGLAAIEKCGEAALNDPKMYVQTVLDVHKKYNALVMSAFNNDAGFVAALDKACGRFINNNAVTKMAQSSSKSPELLARYCDSLLKKSSKNPEEAELEDTLNQVMVVFKVHRRHTAPGAEEMRINSSTENSDEGLKVRDGKGIPFTATLASSSVNSAEEHVASTNEGREPTDSVPKEQMSLVHVGTEAFPISDESMIKDRKDRLPLESAVVRG

SEQ ID NO: 891767 - protein, 184 aa, Homo sapiens
MSSTRSQNPHGLKQIGLDQIWDDLRAGIQQVYTRQSMAKSRYMELYTHVYNYCTSVHQSNQARGAGVPPSKSKKGQTPGGAQFVGLELYKRLKEFLKNYLTNLLKDGEDLMDESVLKFYTQQWEDYRFSSKVLNGICAYLNRHWVRRECDEGRKGIYEIYSLALVTWRDCLFRPLNKQTNAVLS

SEQ ID NO: 891768 - protein, 776 aa, Homo sapiens; identical to SEQ ID NO: 891752

SEQ ID NO: 891769 - protein, 776 aa, Homo sapiens; identical to SEQ ID NO: 891752

SEQ ID NO: 891770 - protein, 776 aa, Homo sapiens; identical to SEQ ID NO: 891752

SEQ ID NO: 891771 - protein, 907 aa, Homo sapiens
MSSTRSQNPHGLKQIGLDQIWDDLRAGIQQVYTRQSMAKSRYMELYTHVYNYCTSVHQSNQARGAGVPPSKSKKGQTPGGAQFVGLELYKRLKEFLKNYLTNLLKDGEDLMDESVLKFYTQQWEDYRFSSKVLNGICAYLNRHWVRRECDEGRKGIYEIYSLALVTWRDCLFRPLNKQVTNAVLKLIEKERNGETINTRLISGVVQSYVELGLNEDDAFAKGPTLTVYKESFESQFLADTERFYTRESTEFLQQNPVTEYMKKAEARLLEEQRRVQVYLHESTQDELARKCEQVLIEKHLEIFHTEFQNLLDADKNEDLGRMYNLVSRIQDGLGELKKLLETHIHNQGLAAIEKCGEAALNDPKMYVQTVLDVHKKYNALVMSAFNNDAGFVAALDKACGRFINNNAVTKMAQSSSKSPELLARYCDSLLKKSSKNPEEAELEDTLNQVVKCFMSIPISSSCVFHKLFVMLFVDGLLKCEEVIIIDFILNLWFYFLNSVTTFSIHTFLINTQSVQLTELRDSQNFQDSGVEIFAIINVGVQTCPKPKAHLGSWLVAGDSQLCTVGLCVCWLSVLSRWLCQMVVFKYIEDKDVFQKFYAKMLAKRLVHQNSASDDAEASMISKLKQACGFEYTSKLQRMFQDIGVSKDLNEQFKKHLTNSEPLDLDFSIQVLSSGSWPFQQSCTFALPSELERSYQRFTAFYASRHSGRKLTWLYQLSKGELVTNCFKNRYTLQASTFQMAILLQYNTEDAYTVQQLTDSTQIKMDILAQVLQILLKSKLLVLEDENANVDEVELKPDTLIKLYLGYKNKKLRVNINVPMKTEQKQEQETTHKNIEEDRKLLIQAAIVRIMKMRKVLKHQQLLGEVLTQLSSRFKPRVPVIKKCIDILIEKEYLERVDGEKDTYSYLA

SEQ ID NO: 891772 - protein, 759 aa, Homo sapiens; identical to SEQ ID NO: 891760

SEQ ID NO: 891773 - protein, 455 aa, Homo sapiens
MYNLVSRIQDGLGELKKLLETHIHNQGLAAIEKCGEAALNDPKMYVQTVLDVHKKYNALVMSAFNNDAGFVAALDKACGRFINNNAVTKMAQSSSKSPELLARYCDSLLKKSSKNPEEAELEDTLNQVMVVFKYIEDKDVFQKFYAKMLAKRLVHQNSASDDAEASMISKLKQACGFEYTSKLQRMFQDIGVSKDLNEQFKKHLTNSEPLDLDFSIQVLSSGSWPFQQSCTFALPSELERSYQRFTAFYASRHSGRKLTWLYQLSKGELVTNCFKNRYTLQASTFQMAILLQYNTEDAYTVQQLTDSTQIKMDILAQVLQILLKSKLLVLEDENANVDEVELKPDTLIKLYLGYKNKKLRVNINVPMKTEQKQEQETTHKNIEEDRKLLIQAAIVRIMKMRKVLKHQQLLGEVLTQLSSRFKPRVPVIKKCIDILIEKEYLERVDGEKDTYSYLA

SEQ ID NO: 891774 - protein, 614 aa, Homo sapiens
MSSTRSQNPHGLKQIGLDQIWDDLRAGIQQVYTRQSMAKSRYMELYTHVYNYCTSVHQSNQARGAGVPPSKSKKGQTPGGAQFVGLELYKRLKEFLKNYLTNLLKDGEDLMDESVLKFYTQQWEDYRFSSKVLNGICAYLNRHWVRRECDEGRKGIYEIYSLALVTWRDCLFRPLNKQVTNAVLKLIEKERNGETINTRLISGVVQSYVELGLNEDDAFAKGPTLTVYKESFESQFLADTERFYTRESTEFLQQNPVTEYMKKAEARLLEEQRRVQVYLHESTQDELARKCEQVLIEKHLEIFHTEFQNLLDADKNEDLGRMYNLVSRIQDGLGELKKLLETHIHNQGLAAIEKCGEAALNDPKMYVQTVLDVHKKYNALVMSAFNNDAGFVAALDKACGRFINNNAVTKMAQSSSKSPELLARYCDSLLKKSSKNPEEAELEDTLNQVMVVFKYIEDKDVFQKFYAKMLAKRLVHQNSASDDAEASMISKLKQACGFEYTSKLQRMFQDIGVSKDLNEQFKKHLTNSEPLDLDFSIQVLSSGSWPFQQSCTFALPSELERSYQRFTAFYASRHSGRKLTWLYQLSKGELVTNCFKNRYTLQVRSHFYLKIFLF

SEQ ID NO: 891775 - protein, 190 aa, Homo sapiens [sequence omitted]

SEQ ID NO: 891776 - protein, 453 aa, Homo sapiens
MSSTRSQNPHGLKQIGLDQIWDDLRAGIQQVYTRQSMAKSRYMELYTHVYNYCTSVHQSNQARGAGVPPSKSKKGQTPGGAQFVGLELYKRLKEFLKNYLTNLLKDGEDLMDESVLKFYTQQWEDYRFSSKVLNGICAYLNRHWVRRECDEGRKGIYEIYSLALVTWRDCLFRPLNKQVTNAVLKLIEKERNGETINTRLISGVVQSYVELGLNEDDAFAKGPTLTVYKESFESQFLADTERFYTRESTEFLQQNPVTEYMKKAEARLLEEQRRVQVYLHESTQDELARKCEQVLIEKHLEIFHTEFQNLLDADKNEDLGRMYNLVSRIQDGLGELKKLLETHIHNQGLAAIEKCGEAALNDPKMYVQTVLDVHKKYNALVMSAFNNDAGFVAALDKACGRFINNNAVTKMAQSSSKSPELLARYCDSLLKKSSKNPEEAELEDTLNQVVSAS

SEQ ID NO: 891777 - protein, 193 aa, Homo sapiens [sequence omitted]

SEQ ID NO: 891778 - protein, 193 aa, Homo sapiens [sequence omitted]

SEQ ID NO: 891779 - protein, 193 aa, Homo sapiens [sequence omitted]

SEQ ID NO: 891780 - protein, 212 aa, Homo sapiens
PDRSSRHALFGTRRVGRQARGRSGLPGVLCAAPGDKMAARGRRAEPQGREAPGPAGGGGGGSRWAESGSGTSPESGDEEVSGAGSSPVSGGVNLFANDGSFLELFKRKMEEEQRQRQEEPPPGPQRPDQSAAAAGPGDPKRKGGPGSTLSFVGKRRGGNKLALKTGIVAKKQKTEDEVLTSKGDAWAKYMAEVKKYKAHQCGDDDKTRPLVK

SEQ ID NO: 891781 - protein, 212 aa, Homo sapiens; identical to SEQ ID NO: 891780

SEQ ID NO: 891782 - protein, 212 aa, Homo sapiens; identical to SEQ ID NO: 891780

SEQ ID NO: 891783 - protein, 169 aa, Homo sapiens
PDRSSRHALFGTRRVGRQARGRSGLPGVLCAAPGDKMAARGRRAEPQGREAPGPAGGGGGGSRWAESGSGTSPESGDEEVSGAGSSPVSGGVNLFANDGSFLELFKRKMEEEQRQRQEEPPPGPQRPDQSAAAAGPGDPKRKGGPGSTLSFVGRLAELGAASGRATRPG

SEQ ID NO: 891784 - protein, 169 aa, Homo sapiens; identical to SEQ ID NO: 891783

SEQ ID NO: 891785 - protein, 194 aa, Homo sapiens
PDRSSRHALFGTRRVGRQARGRSGLPGVLCAAPGDKMAARGRRAEPQGREAPGPAGGGGGGSRWAESGSGTSPESGDEEVSGAGSSPVSGGVNLFANDGSFLELFKRKMEEEQRQRQEEPPPGPQRPDQSAAAAGPGDPKRKGGPGSTLSFVRSRGGGGGRHGLSWQRESGPVKGDRDRSPLSVLNEGPVRVTR

SEQ ID NO: 891786 - protein, 194 aa, Homo sapiens; identical to SEQ ID NO: 891785

SEQ ID NO: 891787 - protein, 212 aa, Homo sapiens; identical to SEQ ID NO: 891780

SEQ ID NO: 891788 - protein, 212 aa, Homo sapiens; identical to SEQ ID NO: 891780

SEQ ID NO: 891789 - protein, 133 aa, Homo sapiens
AIHRHLAIHRHLAIDRHLAIHRHLAIHRHLASHPHPRPCNWNESTLNPLTIAIIGTPGDPKRKGGPGSTLSFVGKRRGGNKLALKTGIVAKKQKTEDEVLTSKGDAWAKYMAEVKKYKAHQCGDDDKTRPLVK

SEQ ID NO: 891790 - protein, 212 aa, Homo sapiens; identical to SEQ ID NO: 891780

SEQ ID NO: 891791 - protein, 180 aa, Homo sapiens
PDRSSRHALFGTRRVGRQARGRSGLPGVLCAAPGDKMAARGRRAEPQGREAPGPAGGGGGGSRWAESGSGTSPESGDEEVSGAGSSPVSGGVNLFANDGSFLELFKRKMEEEQRQRQEEPPPGPQRPDQSAAAAGPGDPKRKGGPGSTLSFVGKRRGGNKLALKTGIVAKKQKTEDEITI

SEQ ID NO: 891792 - protein, 163 aa, Homo sapiens
MSLLLLVVSALHILILILLFVATLDKSWWTLPGKESLNLWYDCTWNNDTKTWACSNVSENGWLKAVQVLMVLSLILCCLSFILFMFQLYTMRRGGLFYATGLCQLCTSVAVFTGALIYAIHAEEILEKHPRGGSFGYCFALAWVAFPLALVSGIIYIHLRKRE

SEQ ID NO: 891793 - protein, 163 aa, Homo sapiens; identical to SEQ ID NO: 891792

SEQ ID NO: 891794 - protein, 131 aa, Homo sapiens
EKGHMVSKQVKLELWTHGDVPLCVLLTAGWLKAVQVLMVLSLILCCLSFILFMFQLYTMRRGGLFYATGLCQLCTSVAVFTGALIYAIHAEEILEKHPRGGSFGYCFALAWVAFPLALVSGIIYIHLRKRE

SEQ ID NO: 891795 - protein, 103 aa, Homo sapiens
MSLLLLVVSALHILILCCLSFILFMFQLYTMRRGGLFYATGLCQLCTSVAVFTGALIYAIHAEEILEKHPRGGSFGYCFALAWVAFPLALVSGIIYIHLRKRE

SEQ ID NO: 891796 - protein, 163 aa, Homo sapiens; identical to SEQ ID NO: 891792

SEQ ID NO: 891797 - protein, 177 aa, Homo sapiens
MSLLLLVVSALHILILILLFVATLDKSWWTLPGKESLNLWYDCTWNNDTKTWACSNVSENGEEVRAAGLVFKGEGWLKAVQVLMVLSLILCCLSFILFMFQLYTMRRGGLFYATGLCQLCTSVAVFTGALIYAIHAEEILEKHPRGGSFGYCFALAWVAFPLALVSGIIYIHLRKRE

SEQ ID NO: 891798 - protein, 118 aa, Homo sapiens
MLQLSLLACSNVSENGWLKAVQVLMVLSLILCCLSFILFMFQLYTMRRGGLFYATGLCQLCTSVAVFTGALIYAIHAEEILEKHPRGGSFGYCFALAWVAFPLALVSGIIYIHLRKRE

SEQ ID NO: 891799 - protein, 111 aa, Homo sapiens
MPPGSCMPEEPKPKRGRRSWPRKRTATHTCDYAGCGKTYTKSSHLKAHLRTHTGEKPYHCDWDGCGWKFARSDELTRHYRKHTGHRPFQCQKCDRAFSRSDHLALHMKRHF

SEQ ID NO: 891800 - protein, 479 aa, Homo sapiens
MRQPPGESDMAVSDALLPSFSTFASGPAGREKTLRQAGAPNNRWREELSHMKRLPPVLPGRPYDLAAATVATDLESGGAGAACGGSNLAPLPRRETEEFNDLLDLDFILSNSLTHPPESVAATVSSSASASSSSSPSSSGPASAPSTCSFTYPIRAGNDPGVAPGGTGGGLLYGRESAPPPTAPFNLADINDVSPSGGFVAELLRPELDPVYIPPQQPQPPGGGLMGKFVLKASLSAPGSEYGSPSVISVSKGSPDGSHPVVVAPYNGGPPRTCPKIKQEAVSSCTHLGAGPPLSNGHRPAAHDFPLGRQLPSRTTPTLGLEEVLSSRDCHPALPLPPGFHPHPGPNYPSFLPDQMQPQVPPLHYQELMPPGSCMPEEPKPKRGRRSWPRKRTATHTCDYAGCGKTYTKSSHLKAHLRTHTGEKPYHCDWDGCGWKFARSDELTRHYRKHTGHRPFQCQKCDRAFSRSDHLALHMKRHF

SEQ ID NO: 891801 - protein, 479 aa, Homo sapiens; identical to SEQ ID NO: 891800

SEQ ID NO: 891802 - protein, 429 aa, Homo sapiens
MKRLPPVLPGRPYDLAAATVATDLESGGAGAACGGSNLAPLPRRETEEFNDLLDLDFILSNSLTHPPESVAATVSSSASASSSSSPSSSGPASAPSTCSFTYPIRAGNDPGVAPGGTGGGLLYGRESAPPPTAPFNLADINDVSPSGGFVAELLRPELDPVYIPPQQPQPPGGGLMGKFVLKASLSAPGSEYGSPSVISVSKGSPDGSHPVVVAPYNGGPPRTCPKIKQEAVSSCTHLGAGPPLSNGHRPAAHDFPLGRQLPSRTTPTLGLEEVLSSRDCHPALPLPPGFHPHPGPNYPSFLPDQMQPQVPPLHYQELMPPGSCMPEEPKPKRGRRSWPRKRTATHTCDYAGCGKTYTKSSHLKAHLRTHTGEKPYHCDWDGCGWKFARSDELTRHYRKHTGHRPFQCQKCDRAFSRSDHLALHMKRHF

SEQ ID NO: 891803 - protein, 104 aa, Homo sapiens
GRLSLCGGGRRSWPRKRTATHTCDYAGCGKTYTKSSHLKAHLRTHTGEKPYHCDWDGCGWKFARSDELTRHYRKHTGHRPFQCQKCDRAFSRSDHLALHMKRHF

SEQ ID NO: 891804 - protein, 82 aa, Homo sapiens
HFGTHGMMLTPPSSPLELMPPGSCMPEEPKPKRGRRSWPRKRTATHTCDYAGCGKTYTKSSHLKAHLRTHTGRGTNCRREGG

SEQ ID NO: 891805 - protein, 479 aa, Homo sapiens; identical to SEQ ID NO: 891800

SEQ ID NO: 891806 - protein, 200 aa, Homo sapiens
MRQPPGESDMAVSDALLPSFSTFASGPAGREKTLRQAGAPNNRWREELSHMKRLPPVLPGRPYDLAAATVATDLESGGAGAACGGSNLAPLPRRETEEFNDLLDLDFILSNSLTHPPESVAATVSSSASASSSSSPSSSGPASAPSTCSFTYPIRAGNDPGVAPGGTGGGLLYGRESSLAVLTALHSSRLHLAMTARRRG

SEQ ID NO: 891807 - protein, 479 aa, Homo sapiens; identical to SEQ ID NO: 891800

SEQ ID NO: 891808 - protein, 470 aa, Homo sapiens
MAVSDALLPSFSTFASGPAGREKTLRQAGAPNNRWREELSHMKRLPPVLPGRPYDLAAATVATDLESGGAGAACGGSNLAPLPRRETEEFNDLLDLDFILSNSLTHPPESVAATVSSSASASSSSSPSSSGPASAPSTCSFTYPIRAGNDPGVAPGGTGGGLLYGRESAPPPTAPFNLADINDVSPSGGFVAELLRPELDPVYIPPQQPQPPGGGLMGKFVLKASLSAPGSEYGSPSVISVSKGSPDGSHPVVVAPYNGGPPRTCPKIKQEAVSSCTHLGAGPPLSNGHRPAAHDFPLGRQLPSRTTPTLGLEEVLSSRDCHPALPLPPGFHPHPGPNYPSFLPDQMQPQVPPLHYQELMPPGSCMPEEPKPKRGRRSWPRKRTATHTCDYAGCGKTYTKSSHLKAHLRTHTGEKPYHCDWDGCGWKFARSDELTRHYRKHTGHRPFQCQKCDRAFSRSDHLALHMKRHF

SEQ ID NO: 891809 - protein, 69 aa, Homo sapiens
APTRPWPAPMAARAPHNSPESAPCAADQFAAPRHGSQSHLAAPPAHRPGHSPCAHGSNRGDRDSGGGRC

SEQ ID NO: 891810 - protein, 159 aa, Homo sapiens
MGQGHVELLKTQWTEFNGIRDYHKRGSMCNTLFSDAILEYKLYEALKFIMLYQVTEVYEQMKTKKVIPSLFRLLFSRETSSDPLSFMMNHLNSVGDTCGLEQIDMFILGYSLEVKIKVFRLFKFNSRDFEVCYPEEPLRDWPEISLLTENDRHYHIPVF

SEQ ID NO: 891811 - protein, 380 aa, Homo sapiens
AAVASDRPLQTTGRGPAPVRSAAGMAATRSPTRARERERSGAPAAGSDQVHSWMLATSQALDTVWRMAKGFVMLAVSFLVAAICYFRRLHLYSGHKLKWWIGYLQRKFKRNLSVEAEVDLLSYCAREWKGETPRNKLMRKAYEELFWRHHIKCVRQVRRDNYDALRSVLFQIFSQGISFPSWMKEKDIVKLPEKLLFSQGCNWIQQYSFGPEKYTGSNVFGKLRKYVELLKTQWTEFNGIRDYHKRGSMCNTLFSDAILEYKLYEALKFIMLYQVTEVYEQMKTKKVIPSLFRLLFSRETSSDPLSFMMNHLNSVGDTCGLEQIDMFILGYSLEVKIKVFRLFKFNSRDFEVCYPEEPLRDWPEISLLTENDRHYHIPVF

SEQ ID NO: 891812 - protein, 380 aa, Homo sapiens; identical to SEQ ID NO: 891811

SEQ ID NO: 891813 - protein, 122 aa, Homo sapiens
MARVLKAAAANAVGLFSRLQAPIPTVRASSTSQPLDQVTGSVWNLGRLNHVAIAVPDLEKAAAFYKNILGAQVDNINAAVMDLKKKKIRSLSEEVKIGAHGKPVIFLHPKDCGGVLVELEQA

SEQ ID NO: 891814 - protein, 176 aa, Homo sapiens
MARVLKAAAANAVGLFSRLQAPIPTVRASSTSQPLDQVTGSVWNLGRLNHVAIAVPDLEKAAAFYKNILGAQVSEAVPLPEHGVSVVFVNLGNTKMELLHPLGRDSPIAGFLQKNKAGGMHHICIEVDNINAAVMDLKKKKIRSLSEEVKIGAHGKPVIFLHPKDCGGVLVELEQA

SEQ ID NO: 891815 - protein, 118 aa, Homo sapiens
MARVLKAAAANAVGEYRAPATFAMGQGAWERRSGAEEASAWPKHLDLMSSPGGAFHSSCCHLGRGCLPEAPPLSSGDCLVHESHFHPRAVRLGLCTFQYVGGRVEGTCPAGQAGQGQK

SEQ ID NO: 891816 - protein, 176 aa, Homo sapiens; identical to SEQ ID NO: 891814

SEQ ID NO: 891817 - protein, 176 aa, Homo sapiens; identical to SEQ ID NO: 891814

SEQ ID NO: 891818 - protein, 118 aa, Homo sapiens; identical to SEQ ID NO: 891815

SEQ ID NO: 891819 - protein, 176 aa, Homo sapiens; identical to SEQ ID NO: 891814

SEQ ID NO: 891820 - protein, 498 aa, Homo sapiens
SSWLLAFSCQQFLSQHVLQIFLGLCAENHFHPGNSSPGHWKQQGQQYSHVSCWFENAEGQERGGGSKPWSARTEERETSRAFPSPLQRQSASPRKGNMVVETEPSSAQRPNPVQLDKGLKELETLRFGAINCREYEPDHNLESNFITNPRTLLGKKPYICSDCGRSFKDRSTLIRHHRIHSMEKPYVCSECGRGFSQKSNLSRHQRTHSEEKPYLCRECGQSFRSKSILNRHQWTHSEEKPYVCSECGRGFSEKSSFIRHQRTHSGEKPYVCLECGRSFVISQPSENTRGYTQGRSLMFAGSVGEALARTQISSNTRGHTWMRSLMFAGSVGEAFVTSQPSSYTSGRTLERSLMCVVSVAEALVGNHSSLSTRGHTQGRSIMSAGSVGEVLARSQISSDTRGRTQMRSLIFAGNVGEAFVTSQPSLYMRGHTQERSLTCAVSVAEALAGNHSSLSTRGHTQGRSIMFVGSVGEALVISQISSDTRGHTDGRNLCMQGS

SEQ ID NO: 891821 - protein, 498 aa, Homo sapiens; identical to SEQ ID NO: 891820

SEQ ID NO: 891822 - protein, 498 aa, Homo sapiens; identical to SEQ ID NO: 891820

SEQ ID NO: 891823 - protein, 604 aa, Homo sapiens
MEAPLQTEMVELVPNGKHSEGLLPVITPMAGNQRVEDPARSCMEGKSFLQKSPSKEPHFTDFEGKTSFGMSVFNLSNAIMGSGILGLAYAMANTGIILFLFLLTAVALLSSYSIHLLLKSSGVVGIRAYEQLGYRAFGTPGKLAAALAITLQNIGAMSSYLYIIKSELPLVIQTFLNLEEKTSDWYMNGNYLVILVSVTIILPLALMRQLGYLGYSSGFSLSCMVFFLIAVIYKKFHVPCPLPPNFNNTTGNFSHVEIVKEKVQLQVEPEASAFCTPSYFTLNSQVLTGQGKAGAQMRVADCLDSSPVFPQTAYTIPIMAFAFVCHPEVLPIYTELKDPSKKKMQHISNLSIAVMYIMYFLAALFGYLTFYSTVAPVGRGLARLGGRGWLWPWCPPYRGVWCLAVPCRCGGESACQSPQCWGPLGSSDPTSFLGPPTGPPSLPATDGVESELLHTYSKVDPFDVLILCVRVAVLTAVTLTVPIVLFPVRRAIQQMLFPNQEFSWLRHVLIAVGLLTCINLLVIFAPNILGIFGVIGATSAPFLIFIFPAIFYFRIMPTEKEPARSTPKILALCFAMLGFLLMTMSLSFIIIDWASGTSRHGGNH

SEQ ID NO: 891824 - protein, 544 aa, Homo sapiens
VQTPRSQTLHPQASQSPSPSASHGSPPVASFSSIFPCVPRFLLTAVALLSSYSIHLLLKSSGVVGIRAYEQLGYRAFGTPGKLAAALAITLQNIGAMSSYLYIIKSELPLVIQTFLNLEEKTSDWYMNGNYLVILVSVTIILPLALMRQLGYLGYSSGFSLSCMVFFLIAVIYKKFHVPCPLPPNFNNTTGNFSHVEIVKEKVQLQVEPEASAFCTPSYFTLNSQVLTGQGKAGAQMRVADCLDSSPVFPQTAYTIPIMAFAFVCHPEVLPIYTELKDPSKKKMQHISNLSIAVMYIMYFLAALFGYLTFYSTVAPVGRGLGWLGGRGWLWPWCPPYRGVWCLAVPCRCGGESACQSPQCWGPLGSSDPTSFLGPPTGPPSLPATDGVESELLHTYSKVDPFDVLILCVRVAVLTAVTLTVPIVLFPVRRAIQQMLFPNQEFSWLRHVLIAVGLLTCINLLVIFAPNILGIFGVIGATSAPFLIFIFPAIFYFRIMPTEKEPARSTPKILALCFAMLGFLLMTMSLSFIIIDWASGTSRHGGNH

SEQ ID NO: 891825 - protein, 288 aa, Homo sapiens
MEAPLQTEMVELVPNGKHSEGLLPVITPMAGNQRVEDPARSCMEGKSFLQKSPSKEPHFTDFEGKTSFGMSVFNLSNAIMGSGILGLAYAMANTGIILFLFLLTAVALLSSYSIHLLLKSSGVVGIRAYEQLGYRAFGTPGKLAAALAITLQNIGAMSSYLYIIKSELPLVIQTFLNLEEKTSDWYMNGNYLVILVSVTIILPLALMRQLGYLGYSSGFSLSCMVFFLIAVIYKKFHVPCPLPPNFNNTTGNFSHVEIVKEKVQLQVEPEASAFCTPSLGYRMKNCFT

SEQ ID NO: 891826 - protein, 504 aa, Homo sapiens
MEAPLQTEMVELVPNGKHSEGLLPVITPMAGNQRVEDPARSCMEGKSFLQKSPSKEPHFTDFEGKTSFGMSVFNLSNAIMGSGILGLAYAMANTGIILFLFLLTAVALLSSYSIHLLLKSSGVVGIRAYEQLGYRAFGTPGKLAAALAITLQNIGAMSSYLYIIKSELPLVIQTFLNLEEKTSDWYMNGNYLVILVSVTIILPLALMRQLGYLGYSSGFSLSCMVFFLIAVIYKKFHVPCPLPPNFNNTTGNFSHVEIVKEKVQLQVEPEASAFCTPSYFTLNSQTAYTIPIMAFAFVCHPEVLPIYTELKDPSKKKMQHISNLSIAVMYIMYFLAALFGYLTFYNGVESELLHTYSKVDPFDVLILCVRVAVLTAVTLTVPIVLFPVRRAIQQMLFPNQEFSWLRHVLIAVGLLTCINLLVIFAPNILGIFGVIGATSAPFLIFIFPAIFYFRIMPTEKEPARSTPKILALCFAMLGFLLMTMSLSFIIIDWASGTSRHGGNH

SEQ ID NO: 891827 - protein, 530 aa, Homo sapiens
MEAPLQTEMVELVPNGKHSEGLLPVITPMAGNQRVEDPARSCMEGKSFLQKSPSKEPHFTDFEGKTSFGMSVFNLSNAIMGSGILGLAYAMANTGIILFLFLLTAVALLSSYSIHLLLKSSGVVGIRAYEQLGYRAFGTPGKLAAALAITLQNIGAMSSYLYIIKSELPLVIQTFLNLEEKTSDWYMNGNYLVILVSVTIILPLALMRQLGYLGYSSGFSLSCMVFFLIAVIYKKFHVPCPLPPNFNNTTGNFSHVEIVKEKVQLQVEPEASAFCTPSYFTLNSQVLTGQGKAGAQMRVADCLDSSPVFPQTAYTIPIMAFAFVCHPEVLPIYTELKDPSKKKMQHISNLSIAVMYIMYFLAALFGYLTFYNGVESELLHTYSKVDPFDVLILCVRVAVLTAVTLTVPIVLFPVRRAIQQMLFPNQEFSWLRHVLIAVGLLTCINLLVIFAPNILGIFGVIGATSAPFLIFIFPAIFYFRIMPTEKEPARSTPKILALCFAMLGFLLMTMSLSFIIIDWASGTSRHGGNH

SEQ ID NO: 891828 - protein, 345 aa, Homo sapiens
MTSVRENILFGMGNPLLDISAVVDKDFLDKYSLKPNDQILAEDKHKELFDELVKKFKVEYHAGGSTQNSIKVAQWMIQQPHKAATFFGCIGIDKFGEILKRKAAEAHVDAHYYEQNEQPTGTCAACITGDNRSLIANLAAANCYKKEKHLDLEKNWMLVEKARVCYIAGFFLTVSPESVLKVAHHASENNRIFTLNLSAPFISQFYKESLMKVMPYVDILFGNETEAATFAREQGFETKDIKEIAKKTQALPKMNSKRQRIVIFTQGRDDTIMATESEVTAFAVLDQDQKEIIDTNGAGDAFVGGFLSQLVSDKPLTECIRAGHYAASIIIRRTGCTFPEKPDFH

SEQ ID NO: 891829 - protein, 345 aa, Homo sapiens; identical to SEQ ID NO: 891828

SEQ ID NO: 891830 - protein, 345 aa, Homo sapiens; identical to SEQ ID NO: 891828

SEQ ID NO: 891831 - protein, 362 aa, Homo sapiens
MAAAEEEPKPKKLKVEAPQALRENILFGMGNPLLDISAVVDKDFLDKYSLKPNDQILAEDKHKELFDELVKKFKVEYHAGGSTQNSIKVAQWMIQQPHKAATFFGCIGIDKFGEILKRKAAEAHVDAHYYEQNEQPTGTCAACITGDNRSLIANLAAANCYKKEKHLDLEKNWMLVEKARVCYIAGFFLTVSPESVLKVAHHASENNRIFTLNLSAPFISQFYKESLMKVMPYVDILFGNETEAATFAREQGFETKDIKEIAKKTQALPKMNSKRQRIVIFTQGRDDTIMATESEVTAFAVLDQDQKEIIDTNGAGDAFVGGFLSQLVSDKPLTECIRAGHYAASIIIRRTGCTFPEKPDFH

SEQ ID NO: 891832 - protein, 345 aa, Homo sapiens; identical to SEQ ID NO: 891828

SEQ ID NO: 891833 - protein, 334 aa, Homo sapiens [sequence omitted]

SEQ ID NO: 891834 - protein, 345 aa, Homo sapiens; identical to SEQ ID NO: 891828

SEQ ID NO: 891835 - protein, 345 aa, Homo sapiens; identical to SEQ ID NO: 891828

SEQ ID NO: 891836 - protein, 345 aa, Homo sapiens; identical to SEQ ID NO: 891828

SEQ ID NO: 891837 - protein, 262 aa, Homo sapiens
GRVGRPTRPDKFGEILKRKAAEAHVDAHYYEQNEQPTGTCAACITGDNRSLIANLAAANCYKKEKHLDLEKNWMLVEKARVCYIAGFFLTVSPESVLKVAHHASENNRIFTLNLSAPFISQFYKESLMKVMPYVDILFGNETEAATFAREQGFETKDIKEIAKKTQALPKMNSKRQRIVIFTQGRDDTIMATESEVTAFAVLDQDQKEIIDTNGAGDAFVGGFLSQLVSDKPLTECIRAGHYAASIIIRRTGCTFPEKPDFH

SEQ ID NO: 891838 - protein, 345 aa, Homo sapiens; identical to SEQ ID NO: 891828

SEQ ID NO: 891839 - protein, 186 aa, Homo sapiens
MTSVRENILFGMGNPLLDISAVVDKDFLDKYSLKPNDQILAEDKHKELFDELVKKFKVEYHAGGSTQNSIKVAQWMIQQPHKAATFFGCIGIDKFGEILKRKAAEAHVDAHYYEQNEQPTGTCAACITGDNRSLIANLAAANCYKKEKHLDLEKNWMLVEKARVCYIAKLPLLLESKALRLKTLKR

SEQ ID NO: 891840 - protein, 345 aa, Homo sapiens; identical to SEQ ID NO: 891828

SEQ ID NO: 891841 - protein, 345 aa, Homo sapiens; identical to SEQ ID NO: 891828

SEQ ID NO: 891842 - protein, 133 aa, Homo sapiens
HSCNDSLNLHRYSEAATFAREQGFETKDIKEIAKKTQALPKMNSKRQRIVIFTQGRDDTIMATESEVTAFAVLDQDQKEIIDTNGAGDAFVGGFLSQLVSDKPLTECIRAGHYAASIIIRRTGCTFPEKPDFH

SEQ ID NO: 891843 - protein, 348 aa, Homo sapiens
MTSVRENILFGMGNPLLDISAVVDKDFLDKYSLKPNDQILAEDKHKELFDELVKKFKVEYHAGGSTQNSIKVAQWMIQQPHKAATFFGCIGIDKFGEILKRKAAEAHVDAHYYEQNEQPTGTCAACITGDNRSLIANLAAANCYKKEKHLDLEKNWMLVEKARVCYIAGFFLTVSPESVLKVAHHASENNRIFTLNLSAPFISQFYKESLMKVMPYVDILFGNETEAATFAREQGFETKDIKEIAKKTQALPKMNSKRQRIVIFTQGRDDTIMATESEVTAFAVLDQDQKEIIDTNGAGDAFVGGWCAVVQSQLTATSTSRVQMILLPQPPKQLGPQVFCLNWSLTSL

SEQ ID NO: 891844 - protein, 85 aa, Homo sapiens
FYFVIQYTHKSNQHHQSEVTAFAVLDQDQKEIIDTNGAGDAFVGGFLSQLVSDKPLTECIRAGHYAASIIIRRTGCTFPEKPDFH

SEQ ID NO: 891845 - protein, 325 aa, Homo sapiens
MTSVRENILFGMGNPLLDISAVVDKDFLDKYSLKPNDQILAEDKHKELFDELVKKFKVEYHAGGSTQNSIKVAQWMIQQPHKAATFFGCIGIDKFGEILKRKAAEAHVDAHYYEQNEQPTGTCAACITGDNRSLIANLAAANCYKKEKHLDLEKNWMLVEKARVCYIAGFFLTVSPESVLKVAHHASENNRIFTLNLSAPFISQFYKESLMKVMPYVDILFGNETEAATFAREQGFETKDIKEIAKKTQALPKMNSKRQRIVIFTQGRDDTIMATESEVTAFAVLDQDQKEIIDTNGAGDAFVGGFLSQLVSDKPLTECIRAGHY

SEQ ID NO: 891846 - protein, 92 aa, Homo sapiens
AQSDKKNNKQPTTPTKTPHKNKKSEVTAFAVLDQDQKEIIDTNGAGDAFVGGFLSQLVSDKPLTECIRAGHYAASIIIRRTGCTFPEKPDFH

SEQ ID NO: 891847 - protein, 316 aa, Homo sapiens
MTSVRENILFGMGNPLLDISAVVDKDFLDKYSLKPNDQILAEDKHKELFDELVKKFKVEYHAGGSTQNSIKVAQWMIQQPHKAATFFGCIGIDKFGEILKRKAAEAHVDAHYYEQNEQPTGTCAACITGDNRSLIANLAAANCYKKEKHLDLEKNWMLVEKARVCYIAGFFLTVSPESVLKVAHHASENNRIFTLNLSAPFISQFYKESLMKVMPYVDILFGNETEAATFAREQGFETKDIKEIAKKTQALPKMNSKRQRIVIFTQGRDDTIMATGFLSQLVSDKPLTECIRAGHYAASIIIRRTGCTFPEKPDFH

SEQ ID NO: 891848 - protein, 203 aa, Homo sapiens
MAAAEEEPKPKKLKVEAPQALRENILFGMGNPLLDISAVVDKDFLDKYSLKPNDQILAEDKHKELFDELVKKFKVEYHAGGSTQNSIKVAQWMIQQPHKAATFFGCIGIDKFGEILKRKAAEAHVDAHYYEQNEQPTGTCAACITGDNRSLIANLAAANCYKKEKHLDLEKNWMLVEKARVCYIAKLPLLLESKALRLKTLKR

SEQ ID NO: 891849 - protein, 186 aa, Homo sapiens; identical to SEQ ID NO: 891839

SEQ ID NO: 891850 - protein, 82 aa, Homo sapiens
FGAKAALSSRFFVEANEDMVGSQLLLSELQENCKAVLAPLGQRAARDLDVEAAATQHCSPVNAFGVCEPGLDVENPRLVVGR

SEQ ID NO: 891851 - protein, 138 aa, Homo sapiens
MAELQQLRVQEAVESMVKSLERENIRKMQGLMFRCSASCCEDSQASMKQVHQCIERCHVPLAQAQALVTSELEKFQDRLARCTMHCNDKAKDSIDAGSKELQVKQQLDSCVTKCVDDHMHLIPTMTKKMKEALLSIGK

SEQ ID NO: 891852 - protein, 223 aa, Homo sapiens
MAELQQLRVQEAVESMVKSLERENIRKMQVAGLGPNQDPLLSGWVPGPSLSHHATPCTAAASPQTGCGRPWGRRGGLGQDFGSFGGSDEIRVPLPCARLFSAPSSPGQERPRRQGLMFRCSASCCEDSQASMKQVHQCIERCHVPLAQAQALVTSELEKFQDRLARCTMHCNDKAKDSIDAGSKELQVKQQLDSCVTKCVDDHMHLIPTMTKKMKEALLSIGK

SEQ ID NO: 891853 - protein, 138 aa, Homo sapiens; identical to SEQ ID NO: 891851

SEQ ID NO: 891854 - protein, 138 aa, Homo sapiens; identical to SEQ ID NO: 891851

SEQ ID NO: 891855 - protein, 107 aa, Homo sapiens
MFRCSASCCEDSQASMKQVHQCIERCHVPLAQAQALVTSELEKFQDRLARCTMHCNDKAKDSIDAGSKELQVKQQLDSCVTKCVDDHMHLIPTMTKKMKEALLSIGK

SEQ ID NO: 891856 - protein, 138 aa, Homo sapiens; identical to SEQ ID NO: 891851

SEQ ID NO: 891857 - protein, 107 aa, Homo sapiens; identical to SEQ ID NO: 891855

SEQ ID NO: 891858 - protein, 138 aa, Homo sapiens; identical to SEQ ID NO: 891851

SEQ ID NO: 891859 - protein, 138 aa, Homo sapiens; identical to SEQ ID NO: 891851

SEQ ID NO: 891860 - protein, 531 aa, Homo sapiens
GAATPPAPADLRLAQSPLGPFATPLARRAETSVPGGSCGAQVSPGCARGPSSPAPPSQGPSPYDESEVHDSFQQLIQEQSQCTAQEGLELQQREREVTGSSQQTLWRPEGTQSTATLRILASMPSRTIGRSRGAIISQYYNRTVQLRCRSSRPLLGNFVRSAWPSLRLYDLELDPTALEEEEKQSLLVKELQSLAVAQRDHMLRGMPLSLAEKRSLRPCTAWAWLLLSALQALMPWRYALKRIGGQFGSSVLSYFLFLKTLLAFNALLLLLLVAFIMGPQVAFPPALPGPAPVCTGLELLTGAGCFTHTVMYYGHYSNATLNQPCGSPLDGSQCTPRVGGLPYNMPLAYLSTVGVSFFITCITLVYSMAHSFGESYRVGSTSGIHAITVFCSWDYKVTQKRASRLQQDNIRTRLKELLAEWQLRHSPRSVCGRLRQAAVLGLVWLLCLGTALGCAVAVHVFSEFMIQSPEAAGQEAVLLVLPLVVGLLNLGAPYLCRVLAALEPHDSPVLEVYVAICRCVAAHENIIWCWS

SEQ ID NO: 891861 - protein, 87 aa, Homo sapiens
AKSDIEFAAARRRRQKLGVLFSPLLPAVQIIKLLLVFYVKKEGEDKIFLINKLHSIYERKEREERSRVGTTEEAAAPPALLTDEQDA

SEQ ID NO: 891862 - protein, 805 aa, Homo sapiens
MAQPLAFILDVPETPGDQGQGPSPYDESEVHDSFQQLIQEQSQCTAQEGLELQQREREVTGSSQQTLWRPEGTQSTATLRILASMPSRTIGRSRGAIISQYYNRTVQLRCRSSRPLLGNFVRSAWPSLRLYDLELDPTALEEEEKQSLLVKELQSLAVAQRDHMLRGMPLSLAEKRSLREKSRTPRGKWRGQPGSGGVCSCCGRLRYACVLALHSLGLALLSALQALMPWRYALKRIGGQFGSSVLSYFLFLKTLLAFNALLLLLLVAFIMGPQVAFPPALPGPAPVCTGLELLTGAGCFTHTVMYYGHYSNATLNQPCGSPLDGSQCTPRVGGLPYNMPLAYLSTVGVSFFITCITLVYSMAHSFGESYRVGSTSGIHAITVFCSWDYKVTQKRASRLQQDNIRTRLKELLAEWQLRHSPRSVCGRLRQAAVLGLVWLLCLGTALGCAVAVHVFSEFMIQSPEAAGQEAVLLVLPLVVGLLNLGAPYLCRVLAALEPHDSPVLEVYVAICRNLILKLAILGTLCYHWLGRRVGVLQGQCWEDFVGQELYRFLVMDFVLMLLDTLFGELVWRIISEKKLKRRRKPEFDIARNVLELIYGQTLTWLGVLFSPLLPAVQIIKLLLVFYVKKTSLLANCQAPRRPWLASHMSTVFLTLLCFPAFLGAAVFLCYAVWQVKPSSTCGPFRTLDTMYEAGRVWVRHLEAAGPRVSWLPWVHRYLMENTFFVFLVSALLLAVIYLNIQVVRGQRKVICLLKEQISNEGEDKIFLINKLHSIYERKEREERSRVGTTEEAAAPPALLTDEQDA

SEQ ID NO: 891863 - protein, 805 aa, Homo sapiens; identical to SEQ ID NO: 891862

SEQ ID NO: 891864 - protein, 805 aa, Homo sapiens; identical to SEQ ID NO: 891862

SEQ ID NO: 891865 - protein, 595 aa, Homo sapiens
MAQPLAFILDVPETPGDQGQGPSPYDESEVHDSFQQLIQEQSQCTAQEGLELLLLLVAFIMGPQVAFPPALPGPAPVCTGLELLTGAGCFTHTVMYYGHYSNATLNQPCGSPLDGSQCTPRVGGLPYNMPLAYLSTVGVSFFITCITLVYSMAHSFGESYRVGSTSGIHAITVFCSWDYKVTQKRASRLQQDNIRTRLKELLAEWQLRHSPRSVCGRLRQAAVLGLVWLLCLGTALGCAVAVHVFSEFMIQSPEAAGQEAVLLVLPLVVGLLNLGAPYLCRVLAALEPHDSPVLEVYVAICRNLILKLAILGTLCYHWLGRRVGVLQGQCWEDFVGQELYRFLVMDFVLMLLDTLFGELVWRIISEKKLKRRRKPEFDIARNVLELIYGQTLTWLGVLFSPLLPAVQIIKLLLVFYVKKTSLLANCQAPRRPWLASHMSTVFLTLLCFPAFLGAAVFLCYAVWQVKPSSTCGPFRTLDTMYEAGRVWVRHLEAAGPRVSWLPWVHRYLMENTFFVFLVSALLLAVIYLNIQVVRGQRKVICLLKEQISNEGEDKIFLINKLHSIYERKEREERSRVGTTEEAAAPPALLTDEQDA

SEQ ID NO: 891866 - protein, 854 aa, Homo sapiens
MAQPLAFILDVPETPGDQGQGPSPYDESEVHDSFQQLIQEQSQCTAQEGLELQQREREVTGSSQQTLWRPEGTQSTATLRILASMPSRTIGRSRGAIISQYYNRTVQLRCRSSRPLLGNFVRSAWPSLRLYDLELDPTALEEEEKQSLLVKELQSLAVAQRDHMLRGMPLSLAEKRSLREKSRTPRGKWRGQPGSGGVCSCCGRLRYACVLALHSLGLALLSALQALMPWRYALKRIGGQFGSSVLSYFLFLKTLLAFNALLLLLLVAFIMGPQVAFPPALPGPAPVCTGLELLTGAGCFTHTVMYYGHYSNATLNQPCGSPLDGSQCTPRVGGLPYNMPLAYLSTVGVSFFITCITLVYSMAHSFGESYRVGSTSGIHAITVFCSWDYKVTQKRASRLQQDNIRTRLKELLAEWQLRHSPRSVCGRLRQAAVLGLVWLLCLGTALGCAVAVHVFSEFMIQSPEAAGQEAVLLVLPLVVGLLNLGAPYLCRVLAALEPHDSPVLEVYVAICRNLILKLAILGTLCYHWLGRRVGVLQGQCWEDFVGQELYRFLVMDFVLMLLDTLFGELVWRALCLHPSEEDSGNRTELIFRLERKTGFKVMCMARHGGSCLESQHFGRLRIISEKKLKRRRKPEFDIARNVLELIYGQTLTWLGVLFSPLLPAVQIIKLLLVFYVKKTSLLANCQAPRRPWLASHMSTVFLTLLCFPAFLGAAVFLCYAVWQVKPSSTCGPFRTLDTMYEAGRVWVRHLEAAGPRVSWLPWVHRYLMENTFFVFLVSALLLAVIYLNIQVVRGQRKVICLLKEQISNEGEDKIFLINKLHSIYERKEREERSRVGTTEEAAAPPALLTDEQDA

SEQ ID NO: 891867 - protein, 525 aa, Homo sapiens
MAQPLAFILDVPETPGDQGQGPSPYDESEVHDSFQQLIQEQSQCTAQEGLELQQREREVTGSSQQTLWRPEGTQSTATLRILASMPSRTIGRSRGAIISQYYNRTVQLRCRSSRPLLGNFVRSAWPSLRLYDLELDPTALEEEEKQSLLVKELQSLAVAQRDHMLRGMPLSLAEKRSLREKSRTPRGKWRGQPGSGGVCSCCGRLRYACVLALHSLGLALLSALQALMPWRYALKRIGGQFGSSVLSYFLFLKTLLAFNALLLLLLVAFIMGPQVAFPPALPGPAPVCTGLELLTGAGCFTHTVMYYGHYSNATLNQPCGSPLDGSQCTPRVGGLPYNMPLAYLSTVGVSFFITCITLVYSMAHSFGESYRVGSTSGIHAITVFCSWDYKVTQKRASRLQQDNIRTRLKELLAEWQLRHSPRSVCGRLRQAAVLGLVWLLCLGTALGCAVAVHVFSEFMIQSPEAAGQEAVLLVLPLVVGLLNLGAPYLCRVLAALEPHDSPVLEVYVAICRCVAAHENIIWCWS

SEQ ID NO: 891868 - protein, 805 aa, Homo sapiens; identical to SEQ ID NO: 891862

SEQ ID NO: 891869 - protein, 327 aa, Homo sapiens
ASKRWMESACGGSHWGPTVRLRLDDDSRYEVYVWNLILKLAILGTLCYHWLGRRVGVLQGQCWEDFVGQELYRFLVMDFVLMLLDTLFGELVWRIISEKKLKRRRKPEFDIARNVLELIYGQTLTWLGVLFSPLLPAVQIIKLLLVFYVKKTSLLANCQAPRRPWLASHMSTVFLTLLCFPAFLGAAVFLCYAVWQVKPSSTCGPFRTLDTMYEAGRVWVRHLEAAGPRVSWLPWVHRYLMENTFFVFLVSALLLAVIYLNIQVVRGQRKVICLLKEQISNEGEDKIFLINKLHSIYERKEREERSRVGTTEEAAAPPALLTDEQDA

SEQ ID NO: 891870 - protein, 675 aa, Homo sapiens
MAQPLAFILDVPETPGDQGQGPSPYDESEVHDSFQQLIQEQSQCTAQEGLELQQREREVTGSSQQTLWRPEGTQSTATLRILASMPSRTIGRSRGAIISQYYNRTVQLRCRSSRPLLGNFVRSAWPSLRLYDLELDPTALEEEEKQSLLVKELQSLAVAQRDHMLRGMPLSLAEKRSLREKSRTPRGKWRGQPGSGGVCSCCGRLRYACVLALHSLGLALLSALQALMPWRYALKRIGGQFGSSVLSYFLFLKTLLAFNALLLLLLVAFIMGPQVAFPPALPGPAPVCTGLELLTGAGCFTHTVMYYGHYSNATLNQPCGSPLDGSQCTPRVGGLPYNMPLAYLSTVGVSFFITCITLVYSMAHSFGESYRVGSTSGIHAITVFCSWDYKVTQKRASRLQQDNIRTRLKELLAEWQLRHSPRSVCGRLRQAAVLGLVWLLCLGTALGCAVAVHVFSEFMIQSPEAAGQEAVLLVLPLVVGLLNLGAPYLCRVLAALEPHDSPVLEVYVAICRNLILKLAILGTLCYHWLGRRVGVLQGQCWEDFVGQELYRFLVMDFVLMLLDTLFGELVWRIISEKKLKRRRKPEFDIARNVLELIYGQTLTWLGVLFSPLLPAVQIIKLLLVFYVKKEGEDKIFLINKLHSIYERKEREERSRVGTTEEAAAPPALLTDEQDA

SEQ ID NO: 891871 - protein, 271 aa, Homo sapiens
MAQPLAFILDVPETPGDQGQGPSPYDESEVHDSFQQLIQEQSQCTAQEGLELQQREREVTGSSQQTLWRPEGTQSTATLRILASMPSRTIGRSRGAIISQYYNRTVQLRCRSSRPLLGNFVRSAWPSLRLYDLELDPTALEEEEKQSLLVKELQSLAVAQRDHMLRGMPLSLAEKRSLREKSRTPRGKWRGQPGSGGVCSCCGRLRYACVLALHSLGLALLSALQALMPWRYALKRIGGQFGSACSPTSSFSRSFASRKPQLRLGWSWKGG

SEQ ID NO: 891872 - protein, 102 aa, Homo sapiens
EVPSSPSTTTARCSFGAGAAGPCSGTLSAPPGPASACTTWSWTPRPWRRRVSEWALEPQWRTPAWGGVQEASLAWAVAGVLQSQRPLSYPLAGCLKAPPSLC

SEQ ID NO: 891873 - protein, 488 aa, Homo sapiens
MAQPLAFILDVPETPGDQGQGPSPYDESEVHDSFQQLIQEQSQCTAQEGLELQQREREVTGSSQQTLWRPEGTQSTATLRSAWPSLRLYDLELDPTALEEEEKQSLLVKELQSLAVAQRDHMLRGMPLSLAEKRSLREKSRTPRGKWRGQPGSGGVCSCCGRLRYACVAALLAFNALLLLLLVAFIMGPQVAFPPALPGPAPVCTGLELLTGAGCFTHTVMYYGHYSNATLNQPCGSPLDGSQCTPRVGGLPYNMPLAYLSTVGVSFFITCITLVYSMAHSFGESYRVGSTSGIHAITVFCSWDYKVTQKRASRLQQDNIRTRLKELLAEWQLRHSPRSVCGRLRQAAVLGLVWLLCLGTALGCAVAVHVFSEFMIQSPEAAGQEAVLLVLPLVVGLLNLGAPYLCRVLAALEPHDSPVLEVYVAICRNLILKLAILGTLCYHWLGRRVGVLQGQCWEDFVGQELYRFLVMDFVLMLLDTLFGELVWR

SEQ ID NO: 891874 - protein, 237 aa, Homo sapiens
GAATPPAPADLRLAQSPLGPFATPLARRAETSVPGGSCGAQVSPGCARGPSSPAPPSQGPSPYDESEVHDSFQQLIQEQSQCTAQEGLELQQREREVTGSSQQTLWRPEGTQSTATLRILASMPSRTIGRSRGAIISQYYNRTVQLRCRSSRPLLGNFVRSAWPSLRLYDLELDPTALEEEEKQSLLVKELQSLAVAQRDHMLRGMPLSLAEKRSLRLTAGLACAWGLMRASLTMGS

SEQ ID NO: 891875 - protein, 721 aa, Homo sapiens
MAQPLAFILDVPETPGDQGQGPSPYDESEVHDSFQQLIQEQSQCTAQEGLELQQREREVTGSSQQTLWRPEGTQSTATLRSAWPSLRLYDLELDPTALEEEEKQSLLVKELQSLAVAQRDHMLRGMPLSLAEKRSLREKSRTPRGKWRGQPGSGGVCSCCGRLRYACVAALLAFNALLLLLLVAFIMGPQVAFPPALPGPAPVCTGLELLTGAGCFTHTVMYYGHYSNATLNQPCGSPLDGSQCTPRVGGLPYNMPLAYLSTVGVSFFITCITLVYSMAHSFGESYRVGSTSGIHAITVFCSWDYKVTQKRASRLQQDNIRTRLKELLAEWQLRHSPRSVCGRLRQAAVLGLVWLLCLGTALGCAVAVHVFSEFMIQSPEAAGQEAVLLVLPLVVGLLNLGAPYLCRVLAALEPHDSPVLEVYVAICRNLILKLAILGTLCYHWLGRRVGVLQGQCWEDFVGQELYRFLVMDFVLMLLDTLFGELVWRIISEKKLKRRRKPEFDIARNVLELIYGQTLTWLGVLFSPLLPAVQIIKLLLVFYVKKTSLLANCQAPRRPWLASHMSTVFLTLLCFPAFLGAAVFLCYAVWQVKPSSTCGPFRTLDTMYEAGRVWVRHLEAAGPRVSWLPWVHRYLMENTFFVFLVSALLLAVIYLNIQVVRGQRKVICLLKEQISNEGEDKIFLINKLHSIYERKEREERSRVGTTEEAAAPPALLTDEQDA

SEQ ID NO: 891876 - protein, 805 aa, Homo sapiens; identical to SEQ ID NO: 891862

SEQ ID NO: 891877 - protein, 501 aa, Homo sapiens [sequence omitted]

SEQ ID NO: 891878 - protein, 745 aa, Homo sapiens
MAQPLAFILDVPETPGDQGQGPSPYDESEVHDSFQQLIQEQSQCTAQEGLELQQREREVTGSSQQTLWRPEGTQSTATLRILASMPSRTIGRSRGAIISQYYNRTVQLRCRSSRPLLGNFVRSAWPSLRLYDLELDPTALEEEEKQSLLVKELQSLAVAQRDHMLRGMPLSLAEKRSLREKSRTPRGKWRGQPGSGGVCSCCGRLRYACVLALHSLGLALLSALQALMPWRYALKRIGGQFGSSVLSYFLFLKTLLAFNALLLLLLVAFIMGPQVAFPPALPGPAPVCTGLELLTGAGCFTHTVMYYGHYSNATLNQPCGSPLDGSQCTPRVGGLPYNMPLAYLSTVGVSFFITCITLVYSMAHSFGESYRVGSTSGIHAITVFCSWDYKVTQKRASRLQQDNIRTRLKELLAEWQLRHSPRSVCGRLRQAAVLGLVWLLCLGTALGCAVAVHVFSEFMIQSPEAAGQEAVLLVLPLVVGLLNLGAPYLCRVLAALEPHDSPVLEVYVAICRIISEKKLKRRRKPEFDIARNVLELIYGQTLTWLGVLFSPLLPAVQIIKLLLVFYVKKTSLLANCQAPRRPWLASHMSTVFLTLLCFPAFLGAAVFLCYAVWQVKPSSTCGPFRTLDTMYEAGRVWVRHLEAAGPRVSWLPWVHRYLMENTFFVFLVSALLLAVIYLNIQVVRGQRKVICLLKEQISNEGEDKIFLINKLHSIYERKEREERSRVGTTEEAAAPPALLTDEQDA

SEQ ID NO: 891879 - protein, 381 aa, Homo sapiens
LEEGGATCQFHPGPFPVAARSHHGWGASMTPLPAPLQSPEAAGQEAVLLVLPLVVGLLNLGAPYLCRVLAALEPHDSPVLEVYVAICRNLILKLAILGTLCYHWLGRRVGVLQGQCWEDFVGQELYRFLVMDFVLMLLDTLFGELVWRIISEKKLKRRRKPEFDIARNVLELIYGQTLTWLGVLFSPLLPAVQIIKLLLVFYVKKTSLLANCQAPRRPWLASHMSTVFLTLLCFPAFLGAAVFLCYAVWQVKPSSTCGPFRTLDTMYEAGRVWVRHLEAAGPRVSWLPWVHRYLMENTFFVFLVSALLLAVIYLNIQVVRGQRKVICLLKEQISNEGEDKIFLINKLHSIYERKEREERSRVGTTEEAAAPPALLTDEQDA

SEQ ID NO: 891880 - protein, 675 aa, Homo sapiens; identical to SEQ ID NO: 891870

SEQ ID NO: 891881 - protein, 539 aa, Homo sapiens
MAQPLAFILDVPETPGDQGQGPSPYDESEVHDSFQQLIQEQSQCTAQEGLELQQREREVTGSSQQTLWRPEGTQSTATLRILASMPSRTIGRSRGAIISQYYNRTVQLRCRSSRPLLGNFVRSAWPSLRLYDLELDPTALEEEEKQSLLVKELQSLAVAQRDHMLRGMPLSLAEKRSLREKSRTPRGKWRGQPGSGGVCSCCGRLRYACVLALHSLGLALLSALQALMPWRYALKRIGGQFGSSVLSYFLFLKTLLAFNALLLLLLVAFIMGPQVAFPPALPGPAPVCTGLELLTGAGCFTHTVMYYGHYSNATLNQPCGSPLDGSQCTPRVGGLPYNMPLAYLSTVGVSFFITCITLVYSMAHSFGESYRVGSTSGIHAITVFCSWDYKVTQKRASRLQQDNIRTRLKELLAEWQLRHSPRSVCGRLRQAAVLGLVWLLCLGTALGCAVAVHVFSEFMIQVRGWGEPGPCLERVPSDSGHLPPGEAALPLLLHPASPGCHVRCAPCWGPLRAPLLSPLSCLTVLFFGFWFLFHYLYPS

SEQ ID NO: 891882 - protein, 99 aa, Homo sapiens
DYRHEPPHLAILAPVSSGLLFPHPCSGDHVPVGTEGGGVYSVVCRAWHGSDLQQMEVLLASPVCVQVTGRLLSSSVNEEAAGSRVQALPGRTALVALPS

SEQ ID NO: 891883 - protein, 220 aa, Homo sapiens
MAILFAVVARGTTILAKHAWCGGNFLEVTEQILAKIPSENNKLTYSHGNYLFHYICQDRIVYLCITDDDFERSRAFNFLNEIKKRFQTTYGSRAQTALPYAMNSEFSSVLAAQLKHHSENKGLDKVMETQAQVDELKGIMVRNIDLVAQRGERLELLIDKTENLVDSSVTFKTTSRNLARAMCMKNLKLTIIIIIVSIVFIYIIVSPLCGGFTWPSCVKK

SEQ ID NO: 891884 - protein, 260 aa, Homo sapiens
MAILFAVVARGTTILAKHAWCGGNFLEVTEQILAKIPSENNKLTYSHGNYLFHYICQDRIVYLCITDDDFERSRAFNFLNEIKKRFQTTYGSRAQTALPYAMNSEFSSVLAAQLKHHSENKGLDKVMETQAQVDELKGIMVRNIVCHLQNYQQKSCSSHVYEEPQAHYYHHHRINCVHLYHCFTSLWWIYMAKLCEEIGKKKLPLTKDMREQGVKSNPCDSSLSHTDRWYLPVSSTLFSLFKILFHASRFIFVLSTSLFL

SEQ ID NO: 891885 - protein, 119 aa, Homo sapiens
MNSEFSSVLAAQLKHHSENKGLDKVMETQAQVDELKGIMVRNIDLVAQRGERLELLIDKTENLVDSSVTFKTTSRNLARAMCMKNLKLTIIIIIVSIVFIYIIVSPLCGGFTWPSCVKK

SEQ ID NO: 891886 - protein, 220 aa, Homo sapiens; identical to SEQ ID NO: 891883

SEQ ID NO: 891887 - protein, 179 aa, Homo sapiens
MAILFAVVARGTTILAKHAWCGGNFLEDFERSRAFNFLNEIKKRFQTTYGSRAQTALPYAMNSEFSSVLAAQLKHHSENKGLDKVMETQAQVDELKGIMVRNIDLVAQRGERLELLIDKTENLVDSSVTFKTTSRNLARAMCMKNLKLTIIIIIVSIVFIYIIVSPLCGGFTWPSCVKK

SEQ ID NO: 891888 - protein, 173 aa, Homo sapiens
MCYLFHYICQDRIVYLCITDDDFERSRAFNFLNEIKKRFQTTYGSRAQTALPYAMNSEFSSVLAAQLKHHSENKGLDKVMETQAQVDELKGIMVRNIDLVAQRGERLELLIDKTENLVDSSVTFKTTSRNLARAMCMKNLKLTIIIIIVSIVFIYIIVSPLCGGFTWPSCVKK

SEQ ID NO: 891889 - protein, 74 aa, Homo sapiens
MERCWGGARRQCRGDLGFSGVDSSSCRAGPVLARCVLCHWKGLELKSVRMRHLSCHYRREKMLTFSQFVFYKTF

SEQ ID NO: 891890 - protein, 1557 aa, Homo sapiens
MAGGVRLLWVSLLVLLAQLGPQPGLGRLGERLRVRFTPVVCGLRCVHGPTGSRCTPTCAPRNATSVDSGAPGGAAPGGPGFRAFLCPLICHNGGVCVKPDRCLCPPDFAGKFCQLHSSGARPPAPAVPGLTRSVYTMPLANHRDDEHGVASMVSVHVEHPQEASVVVHQVERVSGPWEEADAEAVARAEAAARAEAAAPYTVLAQSAPREDGYSDASGFGYCFRELRGGECASPLPGLRTQEVCCRGAGLAWGVHDCQLCSERLGNSERVSAPDGPCPTGFERVNGSCEDVDECATGGRCQHGECANTRGGYTCVCPDGFLLDSSRSSCISQHVISEAKGPCFRVLRDGGCSLPILRNITKQICCCSRVGKAWGRGCQLCPPFGSEGFREICPAGPGYHYSASDLRYNTRPLGQEPPRVSLSQPRTLPATSRPSAGFLPTHRLEPRPEPRPDPRPGPELPLPSIPAWTGPEIPESGPSSGMCQRNPQVCGPGRCISRPSGYTCACDSGFRLSPQGTRCIDVDECRRVPPPCAPGRCENSPGSFRCVCGPGFRAGPRAAECLDVDECHRVPPPCDLGRCENTPGSFLCVCPAGYQAAPHGASCQDVDECTQSPGLCGRGACKNLPGSFRCVCPAGFRGSACEEDVDECAQEPPPCGPGRCDNTAGSFHCACPAGFRSRGPGAPCQDVDECARSPPPCTYGRCENTEGSFQCVCPMGFQPNTAGSECEDVDECENHLACPGQECVNSPGSFQCRTCPSGHHLHRGRCTDVDECSSGAPPCGPHGHCTNTEGSFRCSCAPGYRAPSGRPGPCADVNECLEGDFCFPHGECLNTDGSFACTCAPGYRPGPRGASCLDVDECSEEDLCQSGICTNTDGSFECICPPGHRAGPDLASCLDVDECRERGPALCGSQRCENSPGSYRCVRDCDPGYHAGPEGTCDDVDECQEYGPEICGAQRCENTPGSYRCTPACDPGYQPTPGGGCQDVDECRNRSFCGAHAVCQNLPGSFQCLCDQGYEGARDGRHCVDVNECETLQGVCGAALCENVEGSFLCVCPNSPEEFDPMTGRCVPPRTSAGTFPGSQPQAPASPVLPARPPPPPLPRRPSTPRQGPVGSGRRECYFDTAAPDACDNILARNVTWQECCCTVGEGWGSGCRIQQCPGTETAEYQSLCPHGRGYLAPSGDLSLRRDVDECQLFRDQVCKSGVCVNTAPGYSCYCSNGYYYHTQRLECIDNDECADEEPACEGGRCVNTVGSYHCTCEPPLVLDGSQRRCVSNESQSLDDNLGVCWQEVGADLVCSHPRLDRQATYTECCCLYGEAWGMDCALCPAQDSDDFEALCNVLRPPAYSPPRPGGFGLPYEYGPDLGPPYQGLPYGPELYPPPALPYDPYPPPPGPFARREAPYGAPRFDMPDFEDDGGPYGESEAPAPPGPGTRWPYRSRDTRRSFPEPEEPPEGGSYAGSLAEPYEELEAEECGILDGCTNGRCVRVPEGFTCRCFDGYRLDMTRMACVDINECDEAEAASPLCVNARCLNTDGSFRCICRPGFAPTHQPHHCAPARPRA

SEQ ID NO: 891891 - protein, 57 aa, Homo sapiens
MVAPLSVLVLLPVLCPLICHNGGVCVKPDRCLVAARELRSDRGGGYTYGSPTRVPRG

SEQ ID NO: 891892 - protein, 1538 aa, Homo sapiens
MPRPGTSGRRPLLLVLLLPLFAAATSAASPSPSPSQVVEVPGVPSRPASVAVCRCCPGQTSRRSRCIRAFCRVRSCQPKKCAGPQRCLNPVPAVPSPSPSVRKRQVSLNWQPLTLQEARALLKRRRPRGPGGRGLLRRRPPQRAPAGKAPVLCPLICHNGGVCVKPDRCLCPPDFAGKFCQLHSSGARPPAPAVPGLTRSVYTMPLANHRDDEHGVASMVSVHVEHPQEASVVVHQVERVSGPWEEADAEAVARAEAAARAEAAAPYTVLAQSAPREDGYSDASGFGYCFRELRGGECASPLPGLRTQEVCCRGAGLAWGVHDCQLCSERLGNSERVSAPDGPCPTGFERVNGSCEDVDECATGGRCQHGECANTRGGYTCVCPDGFLLDSSRSSCISQHVISEAKGPCFRVLRDGGCSLPILRNITKQICCCSRVGKAWGRGCQLCPPFGSEGFREICPAGPGYHYSASDLRYNTRPLGQEPPRVSLSQPRTLPATSRPSAGFLPTHRLEPRPEPRPDPRPGPELPLPSIPAWTGPEIPESGPSSGMCQRNPQVCGPGRCISRPSGYTCACDSGFRLSPQGTRCIDVDECRRVPPPCAPGRCENSPGSFRCVCGPGFRAGPRAAECLDVDECHRVPPPCDLGRCENTPGSFLCVCPAGYQAAPHGASCQDVDECTQSPGLCGRGACKNLPGSFRCVCPAGFRGSACEEDVDECAQEPPPCGPGRCDNTAGSFHCACPAGFRSRGPGAPCQDVDECARSPPPCTYGRCENTEGSFQCVCPMGFQPNTAGSECEDVDECENHLACPGQECVNSPGSFQCRTCPSGHHLHRGRCTDVDECSSGAPPCGPHGHCTNTEGSFRCSCAPGYRAPSGRPGPCADVNECLEGDFCFPHGECLNTDGSFACTCAPGYRPGPRGASCLDVDECSEEDLCQSGICTNTDGSFECICPPGHRAGPDLASCLDVDECRERGPALCGSQRCENSPGSYRCVRDCDPGYHAGPEGTCDDVNECETLQGVCGAALCENVEGSFLCVCPNSPEEFDPMTGRCVPPRTSAGTFPGSQPQAPASPVLPARPPPPPLPRRPSTPRQGPVGSGRRECYFDTAAPDACDNILARNVTWQECCCTVGEGWGSGCRIQQCPGTETAEYQSLCPHGRGYLAPSGDLSLRRDVDECQLFRDQVCKSGVCVNTAPGYSCYCSNGYYYHTQRLECIDNDECADEEPACEGGRCVNTVGSYHCTCEPPLVLDGSQRRCVSNESQSLDDNLGVCWQEVGADLVCSHPRLDRQATYTECCCLYGEAWGMDCALCPAQDSDDFEALCNVLRPPAYSPPRPGGFGLPYEYGPDLGPPYQGLPYGPELYPPPALPYDPYPPPPGPFARREAPYGAPRFDMPDFEDDGGPYGESEAPAPPGPGTRWPYRSRDTRRSFPEPEEPPEGGSYAGSLAEPYEELEAEECGILDGCTNGRCVRVPEGFTCRCFDGYRLDMTRMACVDINECDEAEAASPLCVNARCLNTDGSFRCICRPGFAPTHQPHHCAPARPRA

SEQ ID NO: 891893 - protein, 1335 aa, Homo sapiens
MPLANHRDDEHGVASMVSVHVEHPQEASVVVHQVERVSGPWEEADAEAVARAEAAARAEAAAPYTVLAQSAPREDGYSDASGFGYCFRELRGGECASPLPGLRTQEVCCRGAGLAWGVHDCQLCSERLGNSERVSAPDGPCPTGFERVNGSCEDVDECATGGRCQHGECANTRGGYTCVCPDGFLLDSSRSSCISQHVISEAKGPCFRVLRDGGCSLPILRNITKQICCCSRVGKAWGRGCQLCPPFGSEGFREICPAGPGYHYSASDLRYNTRPLGQEPPRVSLSQPRTLPATSRPSAGFLPTHRLEPRPEPRPDPRPGPELPLPSIPAWTGPEIPESGPSSGMCQRNPQVCGPGRCISRPSGYTCACDSGFRLSPQGTRCIDVDECRRVPPPCAPGRCENSPGSFRCVCGPGFRAGPRAAECLDVDECHRVPPPCDLGRCENTPGSFLCVCPAGYQAAPHGASCQDVDECTQSPGLCGRGACKNLPGSFRCVCPAGFRGSACEEDVDECAQEPPPCGPGRCDNTAGSFHCACPAGFRSRGPGAPCQDVDECARSPPPCTYGRCENTEGSFQCVCPMGFQPNTAGSECEDVDECENHLACPGQECVNSPGSFQCRTCPSGHHLHRGRCTDVDECSSGAPPCGPHGHCTNTEGSFRCSCAPGYRAPSGRPGPCADVNECLEGDFCFPHGECLNTDGSFACTCAPGYRPGPRGASCLDVDECSEEDLCQSGICTNTDGSFECICPPGHRAGPDLASCLDVDECRERGPALCGSQRCENSPGSYRCVRDCDPGYHAGPEGTCDDVNECETLQGVCGAALCENVEGSFLCVCPNSPEEFDPMTGRCVPPRTSAGTFPGSQPQAPASPVLPARPPPPPLPRRPSTPRQGPVGSGRRECYFDTAAPDACDNILARNVTWQECCCTVGEGWGSGCRIQQCPGTETAEYQSLCPHGRGYLAPSGDLSLRRDVDECQLFRDQVCKSGVCVNTAPGYSCYCSNGYYYHTQRLECIDNDECADEEPACEGGRCVNTVGSYHCTCEPPLVLDGSQRRCVSNESQSLDDNLGVCWQEVGADLVCSHPRLDRQATYTECCCLYGEAWGMDCALCPAQDSDDFEALCNVLRPPAYSPPRPGGFGLPYEYGPDLGPPYQGLPYGPELYPPPALPYDPYPPPPGPFARREAPYGAPRFDMPDFEDDGGPYGESEAPAPPGPGTRWPYRSRDTRRSFPEPEEPPEGGSYAGSLAEPYEELEAEECGILDGCTNGRCVRVPEGFTCRCFDGYRLDMTRMACVDINECDEAEAASPLCVNARCLNTDGSFRCICRPGFAPTHQPHHCAPARPRA

SEQ ID NO: 891894 - protein, 1335 aa, Homo sapiens; identical to SEQ ID NO: 891893

SEQ ID NO: 891895 - protein, 1549 aa, Homo sapiens
MPRPGTSGRRPLLLVLLLPLFAAATSAASPSPSPSQVVEVPGVPSRPASVAVCRCCPGQTSRRSRCIRAFCRVRSCQPKKCAGPQRCLNPVPAVPSPSPSVRKRQVSLNWQPLTLQEARALLKRRRPRGPGGRGLLRRRPPQRAPAGKAPVLCPLICHNGGVCVKPDRCLCPPDFAGKFCQLHSSGARPPAPAVPGLTRSVYTMPLANHRDDEHGVASMVSVHVEHPQEASVVVHQVERVSGPWEEADAEAVARAEAAARAEAAAPYTVLAQSAPREDGYSDASGFGYCFRELRGGECASPLPGLRTQEVCCRGAGLAWGVHDCQLCSERLGNSERVSAPDGPCPTGFERVNGSCEDVDECATGGRCQHGECANTRGGYTCVCPDGFLLDSSRSSCISQHVISEAKGPCFRVLRDGGCSLPILRNITKQICCCSRVGKAWGRGCQLCPPFGSEGFREICPAGPGYHYSASDLRYNTRPLGQEPPRVSLSQPRTLPATSRPSAGFLPTHRLEPRPEPRPDPRPGPELPLPSIPAWTGPEIPESGPSSGMCQRNPQVCGPGRCISRPSGYTCACDSGFRLSPQGTRCIDVDECRRVPPPCAPGRCENSPGSFRCVCGPGFRAGPRAAECLDVDECHRVPPPCDLGRCENTPGSFLCVCPAGYQAAPHGASCQDVDECTQSPGLCGRGACKNLPGSFRCVCPAGFRGSACEEDVDECAQEPPPCGPGRCDNTAGSFHCACPAGFRSRGPGAPCQDVDECARSPPPCTYGRCENTEGSFQCVCPMGFQPNTAGSECEDVDECENHLACPGQECVNSPGSFQCRTCPSGHHLHRGRCTDVDECSSGAPPCGPHGHCTNTEGSFRCSCAPGYRAPSGRPGPCADVNECLEGDFCFPHGECLNTDGSFACTCAPGYRPGPRGASCLDVDECSEEDLCQSGICTNTDGSFECICPPGHRAGPDLASCLDVDECRERGPALCGSQRCENSPGSYRCVRDCDPGYHAGPEGTCDDVNECETLQGVCGAALCENVEGSFLCVCPNSPEEFDPMTGRCVPPRTSAGTFPGSQPQAPASPVLPARPPPPPLPRRPSTPRQGPVGSGRRECYFDTAAPDACDNILARNVTWQECCCTVGEGWGSGCRIQQCPGTETAEYQSLCPHGRGYLAPSGDLSLRRDVDECQLFRDQVCKSGVCVNTAPGYSCYCSNGYYYHTQRLECIDNDECADEEPACEGGRCVNTVGSYHCTCEPPLVLDGSQRRCVSNESQSLDDNLGVCWQEVGADLVCSHPRLDRQATYTECCCLYGEAWGMDCALCPAQDSDDFEALCNVLRPPAYSPPRPGGFGLPYEYGPDLGPPYQGLPYGPELYPPPALPYDPYPPPPGPFARREAPYGAPRFDMPDFEDDGGPYGESEAPAPPGPGTRWPYRSRDTRRSFPEPEEPPEGGSYAGSLAEPYEELEAEECGILDGCTNGRCVRVPEGFTCRCFDGYRLDMTRMACVAFSSDRCLPSADINECDEAEAASPLCVNARCLNTDGSFRCICRPGFAPTHQPHHCAPARPRA

SEQ ID NO: 891896 - protein, 809 aa, Homo sapiens
MPRPGTSGRRPLLLVLLLPLFAAATSAASPSPSPSQVVEVPGVPSRPASVAVCRCCPGQTSRRSRCIRAFCRVRSCQPKKCAGPQRCLNPVPAVPSPSPSVRKRQVSLNWQPLTLQEARALLKRRRPRGPGGRGLLRRRPPQRAPAGKAPVLCPLICHNGGVCVKPDRCLCPPDFAGKFCQLHSSGARPPAPAVPGLTRSVYTMPLANHRDDEHGVASMVSVHVEHPQEASVVVHQVERVSGPWEEADAEAVARAEAAARAEAAAPYTVLAQSAPREDGYSDASGFGYCFRELRGGECASPLPGLRTQEVCCRGAGLAWGVHDCQLCSERLGNSERVSAPDGPCPTGFERVNGSCEDVDECATGGRCQHGECANTRGGYTCVCPDGFLLDSSRSSCISQHVISEAKGPCFRVLRDGGCSLPILRNITKQICCCSRVGKAWGRGCQLCPPFGSEGFREICPAGPGYHYSASDLRYNTRPLGQEPPRVSLSQPRTLPATSRPSAGFLPTHRLEPRPEPRPDPRPGPELPLPSIPAWTGPEIPESGPSSGMCQRNPQVCGPGRCISRPSGYTCACDSGFRLSPQGTRCIDVDECRRVPPPCAPGRCENSPGSFRCVCGPGFRAGPRAAECLDVDECHRVPPPCDLGRCENTPGSFLCVCPAGYQAAPHGASCQDVDECTQSPGLCGRGACKNLPGSFRCVCPAGFRGSACEEDVDECAQEPPPCGPGRCDNTAGSFHCACPAGFRSRGPGAPCQDVDECARSPPPCTYGGVRTQKAASSVSAPWASNPTLLAPSARMWMSVRTTSHALGRSV

SEQ ID NO: 891897 - protein, 1710 aa, Homo sapiens
MPRPGTSGRRPLLLVLLLPLFAAATSAASPSPSPSQVVEVPGVPSRPASVAVCRCCPGQTSRRSRCIRAFCRVRSCQPKKCAGPQRCLNPVPAVPSPSPSVRKRQVSLNWQPLTLQEARALLKRRRPRGPGGRGLLRRRPPQRAPAGKAPVLCPLICHNGGVCVKPDRCLCPPDFAGKFCQLHSSGARPPAPAVPGLTRSVYTMPLANHRDDEHGVASMVSVHVEHPQEASVVVHQVERVSGPWEEADAEAVARAEAAARAEAAAPYTVLAQSAPREDGYSDASGFGYCFRELRGGECASPLPGLRTQEVCCRGAGLAWGVHDCQLCSERLGNSERVSAPDGPCPTGFERVNGSCEDVDECATGGRCQHGECANTRGGYTCVCPDGFLLDSSRSSCISQHVISEAKGPCFRVLRDGGCSLPILRNITKQICCCSRVGKAWGRGCQLCPPFGSEGFREICPAGPGYHYSASDLRYNTRPLGQEPPRVSLSQPRTLPATSRPSAGFLPTHRLEPRPEPRPDPRPGPELPLPSIPAWTGPEIPESGPSSGMCQRNPQVCGPGRCISRPSGYTCACDSGFRLSPQGTRCIDVDECRRVPPPCAPGRCENSPGSFRCVCGPGFRAGPRAAECLDVDECHRVPPPCDLGRCENTPGSFLCVCPAGYQAAPHGASCQDVDECTQSPGLCGRGACKNLPGSFRCVCPAGFRGSACEEDVDECAQEPPPCGPGRCDNTAGSFHCACPAGFRSRGPGAPCQDVDECARSPPPCTYGRCENTEGSFQCVCPMGFQPNTAGSECEDVDECENHLACPGQECVNSPGSFQCRTCPSGHHLHRGRCTDVDECSSGAPPCGPHGHCTNTEGSFRCSCAPGYRAPSGRPGPCADVNECLEGDFCFPHGECLNTDGSFACTCAPGYRPGPRGASCLGSYRADPGPGKGGLRAGKGGTGRRGRKGENEFLAGVFQQDQGAAGGSLEAVRGGGAGDERAESGYLDRDCKEAVLNPSGGGVCREGSSVRQVGEGVRGLGEPRGGGGVWPRMLGGAGGGPGLRTPCPADVDECSEEDLCQSGICTNTDGSFECICPPGHRAGPDLASCLDVDECRERGPALCGSQRCENSPGSYRCVRDCDPGYHAGPEGTCDDVDECQEYGPEICGAQRCENTPGSYRCTPACDPGYQPTPGGGCQDVNECETLQGVCGAALCENVEGSFLCVCPNSPEEFDPMTGRCVPPRTSAGTFPGSQPQAPASPVLPARPPPPPLPRRPSTPRQGPVGSGRRECYFDTAAPDACDNILARNVTWQECCCTVGEGWGSGCRIQQCPGTETAEYQSLCPHGRGYLAPSGDLSLRRDVDECQLFRDQVCKSGVCVNTAPGYSCYCSNGYYYHTQRLECIDNDECADEEPACEGGRCVNTVGSYHCTCEPPLVLDGSQRRCVSNESQSLDDNLGVCWQEVGADLVCSHPRLDRQATYTECCCLYGEAWGMDCALCPAQDSDDFEALCNVLRPPAYSPPRPGGFGLPYEYGPDLGPPYQGLPYGPELYPPPALPYDPYPPPPGPFARREAPYGAPRFDMPDFEDDGGPYGESEAPAPPGPGTRWPYRSRDTRRSFPEPEEPPEGGSYAGSLAEPYEELEAEECGILDGCTNGRCVRVPEGFTCRCFDGYRLDMTRMACVDINECDEAEAASPLCVNARCLNTDGSFRCICRPGFAPTHQPHHCAPARPRA

SEQ ID NO: 891898 - protein, 1492 aa, Homo sapiens
MPRPGTSGRRPLLLVLLLPLFAAATSAASPSPSPSQVVEVPGVPSRPASVAVCRCCPGQTSRRSRCIRAFCRVRSCQPKKCAGPQRCLNPVPAVPSPSPSVRKRQVSLNWQPLTLQEARALLKRRRPRGPGGRGLLRRRPPQRAPAGKAPVLCPLICHNGGVCVKPDRCLCPPDFAGKFCQLHSSGARPPAPAVPGLTRSVYTMPLANHRDDEHGVASMVSVHVEHPQEASVVVHQVERVSGPWEEADAEAVARAEAAARAEAAAPYTVLAQSAPREDGYSDASGFGYCFRELRGGECASPLPGLRTQEVCCRGAGLAWGVHDCQLCSERLGNSERVSAPDGPCPTGFERVNGSCEDVDECATGGRCQHGECANTRGGYTCVCPDGFLLDSSRSSCISQHVISEAKGPCFRVLRDGGCSLPILRNITKQICCCSRVGKAWGRGCQLCPPFGSEGFREICPAGPGYHYSASDLRYNTRPLGQEPPRVSLSQPRTLPATSRPSAGFLPTHRLEPRPEPRPDPRPGPELPLPSIPAWTGPEIPESGPSSGMCQRNPQVCGPGRCISRPSGYTCACDSGFRLSPQGTRCIDVDECRRVPPPCAPGRCENSPGSFRCVCGPGFRAGPRAAECLDVDECHRVPPPCDLGRCENTPGSFLCVCPAGYQAAPHGASCQDVDECTQSPGLCGRGACKNLPGSFRCVCPAGFRGSACEEDVDECAQEPPPCGPGRCDNTAGSFHCACPAGFRSRGPGAPCQDVDECARSPPPCTYGRCENTEGSFQCVCPMGFQPNTAGSECEDVDECENHLACPGQECVNSPGSFQCRTCPSGHHLHRGRCTDVDECSSGAPPCGPHGHCTNTEGSFRCSCAPGYRAPSGRPGPCADVNECLEGDFCFPHGECLNTDGSFACTCAPGYRPGPRGASCLDVDECSEEDLCQSGICTNTDGSFECICPPGHRAGPDLASCLDVDECRERGPALCGSQRCENSPGSYRCVRDCDPGYHAGPEGTCDDVNECETLQGVCGAALCENVEGSFLCVCPNSPEEFDPMTGRCVPPRTSAGTFPGSQPQAPASPVLPARPPPPPLPRRPSTPRQGPVGSGRRECYFDTAAPDACDNILARNVTWQECCCTVGEGWGSGCRIQQCPGTETAEYQSLCPHGRGYLAPSGDLSLRRDVDECQLFRDQVCKSGVCVNTAPGYSCYCSNGYYYHTQRLECIDNDECADEEPACEGGRCVNTVGSYHCTCEPPLVLDGSQRRCVSNESQSLDDNLGVCWQEVGADLVCSHPRLDRQATYTECCCLYGEAWGMDCALCPAQDSDDFEALCNVLRPPAYSPPRPGGFGLPYEYGPDLGPPYQGLPYGPELYPPPALPYDPYPPPPGPFARREAPYGAPRFDMPDFEDDGGPYGESEAEECGILDGCTNGRCVRVPEGFTCRCFDGYRLDMTRMACVDINECDEAEAASPLCVNARCLNTDGSFRCICRPGFAPTHQPHHCAPARPRA

SEQ ID NO: 891899 - protein, 809 aa, Homo sapiens; identical to SEQ ID NO: 891896

SEQ ID NO: 891900 - protein, 1437 aa, Homo sapiens
MPRPGTSGRRPLLLVLLLPLFAAATSAASPSPSPSQVVEVPGVPSRPASVAVCRCCPGQTSRRSRCIRAFCRVRSCQPKKCAGPQRCLNPVPAVPSPSPSVRKRQVSLNWQPLTLQEARALLKRRRPRGPGGRGLLRRRPPQRAPAGKAPVLCPLICHNGGVCVKPDRCLCPPDFAGKFCQLHSSGARPPAPAVPGLTRSVYTMPLANHRDDEHGVASMVSVHVEHPQEASVVVHQVERVSGPWEEADAEAVARAEAAARAEAAAPYTVLAQSAPREDGYSDASGFGYCFRELRGGECASPLPGLRTQEVCCRGAGLAWGVHDCQLCSERLGNSERVSAPDGPCPTGFERVNGSCEDVDECATGGRCQHGECANTRGGYTCVCPDGFLLDSSRSSCISQHVISEAKGPCFRVLRDGGCSLPILRNITKQICCCSRVGKAWGRGCQLCPPFGSEGFREICPAGPGYHYSASDLRYNTRPLGQEPPRVSLSQPRTLPATSRPSAGFLPTHRLEPRPEPRPDPRPGPELPLPSIPAWTGPEIPESGPSSGMCQRNPQVCGPGRCISRPSGYTCACDSGFRLSPQGTRCIDVDECRRVPPPCAPGRCENSPGSFRCVCGPGFRAGPRAAECLDVDECHRVPPPCDLGRCENTPGSFLCVCPAGYQAAPHGASCQDVDECTQSPGLCGRGACKNLPGSFRCVCPAGFRGSACEEDVDECAQEPPPCGPGRCDNTAGSFHCACPAGFRSRGPGAPCQDVDECARSPPPCTYGRCENTEGSFQCVCPMGFQPNTAGSECEDVDECENHLACPGQECVNSPGSFQCRTCPSGHHLHRGRCTDVDECSSGAPPCGPHGHCTNTEGSFRCSCAPGYRAPSGRPGPCADVNECLEGDFCFPHGECLNTDGSFACTCAPGYRPGPRGASCLDVDECSEEDLCQSGICTNTDGSFECICPPGHRAGPDLASCLDVDECRERGPALCGSQRCENSPGSYRCVRDCDPGYHAGPEGTCDDVNECETLQGVCGAALCENVEGSFLCVCPNSPEEFDPMTGRCVPPRTSAGTFPGSQPQAPASPVLPARPPPPPLPRRPSTPRQGPVGSGRRECYFDTAAPDACDNILARNVTWQECCCTVGEGWGSGCRIQQCPGTETAEYQSLCPHGRGYLAPSGDLSLRRDVDECQLFRDQVCKSGVCVNTAPGYSCYCSNGYYYHTQRLECIDNDECADEEPACEGGRCVNTVGSYHCTCEPPLVLDGSQRRCVSNESQSLDDNLGVCWQEVGADLVCSHPRLDRQATYTECCCLYGEAWGMDCALCPAQDSDDFEALCNVLRPPAYSPPRPGGFGLPVGPQPSWGHEEAMGGTGRNRWGYGVQDEEEGRDAGTDTPSLESLGTEGGVGGSDSLRPASSCPRVGGGGRVVGVCGGVHTRSPNPTDPSFPQPRPLPQPGDR

SEQ ID NO: 891901 - protein, 1691 aa, Homo sapiens
MPRPGTSGRRPLLLVLLLPLFAAATSAASPSPSPSQVVEVPGVPSRPASVAVCRCCPGQTSRRSRCIRAFCRVRSCQPKKCAGPQRCLNPVPAVPSPSPSVRKRQVSLNWQPLTLQEARALLKRRRPRGPGGRGLLRRRPPQRAPAGKAPVLCPLICHNGGVCVKPDRCLCPPDFAGKFCQLHSSGARPPAPAVPGLTRSVYTMPLANHRDDEHGVASMVSVHVEHPQEASVVVHQVERVSGPWEEADAEAVARAEAAARAEAAAPYTVLAQSAPREDGYSDASGFGYCFRELRGGECASPLPGLRTQEVCCRGAGLAWGVHDCQLCSERLGNSERVSAPDGPCPTGFERVNGSCEDVDECATGGRCQHGECANTRGGYTCVCPDGFLLDSSRSSCISQHVISEAKGPCFRVLRDGGCSLPILRNITKQICCCSRVGKAWGRGCQLCPPFGSEGFREICPAGPGYHYSASDLRYNTRPLGQEPPRVSLSQPRTLPATSRPSAGFLPTHRLEPRPEPRPDPRPGPELPLPSIPAWTGPEIPESGPSSGMCQRNPQVCGPGRCISRPSGYTCACDSGFRLSPQGTRCIDVDECRRVPPPCAPGRCENSPGSFRCVCGPGFRAGPRAAECLDVDECHRVPPPCDLGRCENTPGSFLCVCPAGYQAAPHGASCQDVDECTQSPGLCGRGACKNLPGSFRCVCPAGFRGSACEEDVDECAQEPPPCGPGRCDNTAGSFHCACPAGFRSRGPGAPCQDVDECARSPPPCTYGRCENTEGSFQCVCPMGFQPNTAGSECEDVDECENHLACPGQECVNSPGSFQCRTCPSGHHLHRGRCTDVDECSSGAPPCGPHGHCTNTEGSFRCSCAPGYRAPSGRPGPCADVNECLEGDFCFPHGECLNTDGSFACTCAPGYRPGPRGASCLDVDECSEEDLCQSGICTNTDGSFECICPPGHRAGPDLASCLDVDECRERGPALCGSQRCENSPGSYRCVRDCDPGYHAGPEGTCDDVDECQEYGPEICGAQRCENTPGSYRCTPACDPGYQPTPGGGCQDVDECRNRSFCGAHAVCQNLPGSFQCLCDQGYEGARDGRHCVDVNECETLQGVCGAALCENVEGSFLCVCPNSPEEFDPMTGRCVPPRTSAGTFPGSQPQAPASPVLPARPPPPPLPRRPSTPRQGPVGSGRRECYFDTAAPDACDNILARNVTWQECCCTVGEGWGSGCRIQQCPGTETAEYQSLCPHGRGYLAPSGDLSLRRDVDECQLFRDQVCKSGVCVNTAPGYSCYCSNGYYYHTQRLECIGQAPPPPTPGNSLQPLALPAPLWNVATTSGKSFLESRLHPSHCQCAGKRNGKGWGELKGMPLNHPLPDNDECADEEPACEGGRCVNTVGSYHCTCEPPLVLDGSQRRCVSNESQSLDDNLGVCWQEVGADLVCSHPRLDRQATYTECCCLYGEAWGMDCALCPAQDSDDFEALCNVLRPPAYSPPRPGGFGLPYEYGPDLGPPYQGLPYGPELYPPPALPYDPYPPPPGPFARREAPYGAPRFDMPDFEDDGGPYGESEAPAPPGPGTRWPYRSRDTRRSFPEPEEPPEGGSYAGSLAEPYEELEAEECGILDGCTNGRCVRVPEGFTCRCFDGYRLDMTRMACVDINECDEAEAASPLCVNARCLNTDGSFRCICRPGFAPTHQPHHCAPARPRA

SEQ ID NO: 891902 - protein, 1600 aa, Homo sapiens
MPRPGTSGRRPLLLVLLLPLFAAATSAASPSPSPSQVVEVPGVPSRPASVAVCRCCPGQTSRRSRCIRAFCRVRSCQPKKCAGPQRCLNPVPAVPSPSPSVRKRQVSLNWQPLTLQEARALLKRRRPRGPGGRGLLRRRPPQRAPAGKAPVLCPLICHNGGVCVKPDRCLCPPDFAGKFCQLHSSGARPPAPAVPGLTRSVYTMPLANHRDDEHGVASMVSVHVEHPQEASVVVHQVERVSGPWEEADAEAVARAEAAARAEAAAPYTVLAQSAPREDGYSDASGFGYCFRELRGGECASPLPGLRTQEVCCRGAGLAWGVHDCQLCSERLGNSERVSAPDGPCPTGFERVNGSCEDVDECATGGRCQHGECANTRGGYTCVCPDGFLLDSSRSSCISQHVISEAKGPCFRVLRDGGCSLPILRNITKQICCCSRVGKAWGRGCQLCPPFGSEGFREICPAGPGYHYSASDLRYNTRPLGQEPPRVSLSQPRTLPATSRPSAGFLPTHRLEPRPEPRPDPRPGPELPLPSIPAWTGPEIPESGPSSGMCQRNPQVCGPGRCISRPSGYTCACDSGFRLSPQGTRCIDVDECRRVPPPCAPGRCENSPGSFRCVCGPGFRAGPRAAECLDVDECHRVPPPCDLGRCENTPGSFLCVCPAGYQAAPHGASCQDVDECTQSPGLCGRGACKNLPGSFRCVCPAGFRGSACEEDVDECAQEPPPCGPGRCDNTAGSFHCACPAGFRSRGPGAPCQDVDECARSPPPCTYGRCENTEGSFQCVCPMGFQPNTAGSECEDVDECENHLACPGQECVNSPGSFQCRTCPSGHHLHRGRCTDVDECSSGAPPCGPHGHCTNTEGSFRCSCAPGYRAPSGRPGPCADVNECLEGDFCFPHGECLNTDGSFACTCAPGYRPGPRGASCLDVDECSEEDLCQSGICTNTDGSFECICPPGHRAGPDLASCLDVDECRERGPALCGSQRCENSPGSYRCVRDCDPGYHAGPEGTCDDVDECQEYGPEICGAQRCENTPGSYRCTPACDPGYQPTPGGGCQDVDECRNRSFCGAHAVCQNLPGSFQCLCDQGYEGARDGRHCVDVNECETLQGVCGAALCENVEGSFLCVCPNSPEEFDPMTGRCVPPRTSAGTFPGSQPQAPASPVLPARPPPPPLPRRPSTPRQGPVGSGRRECYFDTAAPDACDNILARNVTWQECCCTVGEGWGSGCRIQQCPGTETDVDECQLFRDQVCKSGVCVNTAPGYSCYCSNGYYYHTQRLECIDNDECADEEPACEGGRCVNTVGSYHCTCEPPLVLDGSQRRCVSNESQSLDDNLGVCWQEVGADLVCSHPRLDRQATYTECCCLYGEAWGMDCALCPAQDSDDFEALCNVLRPPAYSPPRPGGFGLPYEYGPDLGPPYQGLPYGPELYPPPALPYDPYPPPPGPFARREAPYGAPRFDMPDFEDDGGPYGESEAPAPPGPGTRWPYRSRDTRRSFPEPEEPPEGGSYAGSLAEPYEELEAEECGILDGCTNGRCVRVPEGFTCRCFDGYRLDMTRMACVDINECDEAEAASPLCVNARCLNTDGSFRCICRPGFAPTHQPHHCAPARPRA

SEQ ID NO: 891903 - protein, 1467 aa, Homo sapiens
MPRPGTSGRRPLLLVLLLPLFAAATSAASPSPSPSQVVEVPGVPSRPASVAVCRCCPGQTSRRSRCIRAFCRVRSCQPKKCAGPQRCLNPVPAVPSPSPSVRKRQVSLNWQPLTLQEARALLKRRRPRGPGGRGLLRRRPPQRAPAGKAPVLCPLICHNGGVCVKPDRCLCPPDFAGKFCQLHSSGARPPAPAVPGLTRSVYTMPLANHRDDEHGVASMVSVHVEHPQEASVVVHQVERVSGPWEEADAEAVARAEAAARAEAAAPYTVLAQSAPREDGYSDASGFGYCFRELRGGECASPLPGLRTQEVCCRGAGLAWGVHDCQLCSERLGNSERVSAPDGPCPTGFERVNGSCEDVDECATGGRCQHGECANTRGGYTCVCPDGFLLDSSRSSCISQHVISEAKGPCFRVLRDGGCSLPILRNITKQICCCSRVGKAWGRGCQLCPPFGSEGFREICPAGPGYHYSASDLRYNTRPLGQEPPRVSLSQPRTLPATSRPSAGFLPTHRLEPRPEPRPDPRPGPELPLPSIPAWTGPEIPESGPSSGMCQRNPQVCGPGRCISRPSGYTCACDSGFRLSPQGTRCIDVDECRRVPPPCAPGRCENSPGSFRCVCGPGFRAGPRAAECLDVDECHRVPPPCDLGRCENTPGSFLCVCPAGYQAAPHGASCQDVDECTQSPGLCGRGACKNLPGSFRCVCPAGFRGSACEEDVDECAQEPPPCGPGRCDNTAGSFHCACPAGFRSRGPGAPCQDVDECARSPPPCTYGRCENTEGSFQCVCPMGFQPNTAGSECEDVDECENHLACPGQECVNSPGSFQCRTCPSGHHLHRGRCTDVDECSSGAPPCGPHGHCTNTEGSFRCSCAPGYRAPSGRPGPCADVNECLEGDFCFPHGECLNTDGSFACTCAPGYRPGPRGASCLDVDECSEEDLCQSGICTNTDGSFECICPPGHRAGPDLASCLDVDECRERGPALCGSQRCENSPGSYRCVRDCDPGYHAGPEGTCDDVDECRNRSFCGAHAVCQNLPGSFQCLCDQGYEGARDGRHCVDVNECETLQGVCGAALCENVEGSFLCVCPNSPEEFDPMTGRCVPPRTSADVDECQLFRDQVCKSGVCVNTAPGYSCYCSNGYYYHTQRLECIDNDECADEEPACEGGRCVNTVGSYHCTCEPPLVLDGSQRRCVSNESQSLDDNLGVCWQEVGADLVCSHPRLDRQATYTECCCLYGEAWGMDCALCPAQDSDDFEALCNVLRPPAYSPPRPGGFGLPYEYGPDLGPPYQGLPYGPELYPPPALPYDPYPPPPGPFARREAPYGAPRFDMPDFEDDGGPYGESEAPAPPGPGTRWPYRSRDTRRSFPEPEEPPEGGSYAGSLAEPYEELEAEECGILDGCTNGRCVRVPEGFTCRCFDGYRLDMTRMACVDINECDEAEAASPLCVNARCLNTDGSFRCICRPGFAPTHQPHHCAPARPRA

SEQ ID NO: 891904 - protein, 857 aa, Homo sapiens
MPRPGTSGRRPLLLVLLLPLFAAATSAASPSPSPSQVVEVPGVPSRPASVAVCRCCPGQTSRRSRCIRAFCRVRSCQPKKCAGPQRCLNPVPAVPSPSPSVRKRQVSLNWQPLTLQEARALLKRRRPRGPGGRGLLRRRPPQRAPAGKAPVLCPLICHNGGVCVKPDRCLCPPDFAGKFCQLHSSGARPPAPAVPGLTRSVYTMPLANHRDDEHGVASMVSVHVEHPQEASVVVHQVERVSGPWEEADAEAVARAEAAARAEAAAPYTVLAQSAPREDGYSDASGFGYCFRELRGGECASPLPGLRTQEVCCRGAGLAWGVHDCQLCSERLGNSERVSAPDGPCPTGFERVNGSCEDVDECATGGRCQHGECANTRGGYTCVCPDGFLLDSSRSSCISQHVISEAKGPCFRVLRDGGCSLPILRNITKQICCCSRVGKAWGRGCQLCPPFGSEGFREICPAGPGYHYSASDLLYLAPSGDLSLRRDVDECQLFRDQVCKSGVCVNTAPGYSCYCSNGYYYHTQRLECIDNDECADEEPACEGGRCVNTVGSYHCTCEPPLVLDGSQRRCVSNESQSLDDNLGVCWQEVGADLVCSHPRLDRQATYTECCCLYGEAWGMDCALCPAQDSDDFEALCNVLRPPAYSPPRPGGFGLPYEYGPDLGPPYQGLPYGPELYPPPALPYDPYPPPPGPFARREAPYGAPRFDMPDFEDDGGPYGESEAPAPPGPGTRWPYRSRDTRRSFPEPEEPPEGGSYAGSLAEPYEELEAEECGILDGCTNGRCVRVPEGFTCRCFDGYRLDMTRMACVDINECDEAEAASPLCVNARCLNTDGSFRCICRPGFAPTHQPHHCAPARPRA

SEQ ID NO: 891905 - protein, 478 aa, Homo sapiens
KLPLAINPNPGAESQDVDECRNRSFCGAHAVCQNLPGSFQCLCDQGYEGARDGRHCVDVNECETLQGVCGAALCENVEGSFLCVCPNSPEEFDPMTGRCVPPRTSADVDECQLFRDQVCKSGVCVNTAPGYSCYCSNGYYYHTQRLECIDNDECADEEPACEGGRCVNTVGSYHCTCEPPLVLDGSQRRCVSNESQSLDDNLGVCWQEVGADLVCSHPRLDRQATYTECCCLYGEAWGMDCALCPAQDSDDFEALCNVLRPPAYSPPRPGGFGLPYEYGPDLGPPYQGLPYGPELYPPPALPYDPYPPPPGPFARREAPYGAPRFDMPDFEDDGGPYGESEAPAPPGPGTRWPYRSRDTRRSFPEPEEPPEGGSYAGSLAEPYEELEAEECGILDGCTNGRCVRVPEGFTCRCFDGYRLDMTRMACVDINECDEAEAASPLCVNARCLNTDGSFRCICRPGFAPTHQPHHCAPARPRA

SEQ ID NO: 891906 - protein, 152 aa, Homo sapiens [sequence omitted]

SEQ ID NO: 891907 - protein, 924 aa, Homo sapiens
MPRPGTSGRRPLLLVLLLPLFAAATSAASPSPSPSQVVEVPGVPSRPASVAVCRCCPGQTSRRSRCIRAFCRVRSCQPKKCAGPQRCLNPVPAVPSPSPSVRKRQVSLNWQPLTLQEARALLKRRRPRGPGGRGLLRRRPPQRAPAGKAPVLCPLICHNGGVCVKPDRCLCPPDFAGKFCQLHSSGARPPAPAVPGLTRSVYTMPLANHRDDEHGVASMVSVHVEHPQEASVVVHQVERVSGPWEEADAEAVARAEAAARAEAAAPYTVLAQSAPREDGYSDASGFGYCFRELRGGECASPLPGLRTQEVCCRGAGLAWGVHDCQLCSERLGNSERVSAPDGPCPTGFERVNGSCEDVDECATGGRCQHGECANTRGGYTCVCPDGFLLDSSRSSCISQHVISEAKGPCFRVLRDGGCSLPILRNITKQICCCSRVGKAWGRGCQLCPPFGSEGFREICPAGPGYHYSASDLRYNTRPLGQEPPRVSLSQPRTLPATSRPSAGFLPTHRLEPRPEPRPDPRPGPELPLPSIPAWTGPEIPESGPSSGMCQRNPQVCGPGRCISRPSGYTCACDSGFRLSPQGTRCIDVDECRRVPPPCAPGRCENSPGSFRCVCGPGFRAGPRAAECLDVDECHRVPPPCDLGRCENTPGSFLCVCPAGYQAAPHGASCQDVDECTQSPGLCGRGACKNLPGSFRCVCPAGFRGSACEEDVDECAQEPPPCGPGRCDNTAGSFHCACPAGFRSRGPGAPCQDVDECARSPPPCTYGRCENTEGSFQCVCPMGFQPNTAGSECEDVDECENHLACPGQECVNSPGSFQCRTCPSGHHLHRGRCTDVDECSSGAPPCGPHGHCTNTEGSFRCSCAPGYRAPSGRPGPCADVNECLEGDFCFPHGECLNTDGSFACTCAPGYRPGPRGASCLGSYPG

SEQ ID NO: 891908 - protein, 112 aa, Homo sapiens
CDWREVRSPWLDCGESESASGGGGGGGRGGAGASLTRWTDRPPGAGLGARHDAEAWHQRPPPPPAGAVAAALRSRHLRRQPQPQPQPGRRGPGGPQPPGQVSPLLPCAPSTQ

SEQ ID NO: 891909 - protein, 1682 aa, Homo sapiens
CDWREVRSPWLDCGESESASGGGGGGGRGGAGASLTRWTDRPPGAGLGARHDAEAWQPAAAAPSCWCCCCRSSQPPPPPPAPAPAPARSSRSRGSPAARPALLFVAAARARRLGGAAASESLAVSEAFCRVRSCQPKKCAGPQRCLNPVPAVPSPSPSVRKRQVSLNWQPLTLQEARALLKRRRPRGPGGRGLLRRRPPQRAPAGKAPVLCPLICHNGGVCVKPDRCLCPPDFAGKFCQLHSSGARPPAPAVPGLTRSVYTMPLANHRDDEHGVASMVSVHVEHPQEASVVVHQVERVSGPWEEADAEAVARAEAAARAEAAAPYTVLAQSAPREDGYSDASGFGYCFRELRGGECASPLPGLRTQEVCCRGAGLAWGVHDCQLCSERLGNSERVSAPDGPCPTGFERVNGSCEDVDECATGGRCQHGECANTRGGYTCVCPDGFLLDSSRSSCISQHVISEAKGPCFRVLRDGGCSLPILRNITKQICCCSRVGKAWGRGCQLCPPFGSEGFREICPAGPGYHYSASDLRYNTRPLGQEPPRVSLSQPRTLPATSRPSAGFLPTHRLEPRPEPRPDPRPGPELPLPSIPAWTGPEIPESGPSSGMCQRNPQVCGPGRCISRPSGYTCACDSGFRLSPQGTRCIDVDECRRVPPPCAPGRCENSPGSFRCVCGPGFRAGPRAAECLDVDECHRVPPPCDLGRCENTPGSFLCVCPAGYQAAPHGASCQDVDECTQSPGLCGRGACKNLPGSFRCVCPAGFRGSACEEDVDECAQEPPPCGPGRCDNTAGSFHCACPAGFRSRGPGAPCQDVDECARSPPPCTYGRCENTEGSFQCVCPMGFQPNTAGSECEDVDECENHLACPGQECVNSPGSFQCRTCPSGHHLHRGRCTDVDECSSGAPPCGPHGHCTNTEGSFRCSCAPGYRAPSGRPGPCADVNECLEGDFCFPHGECLNTDGSFACTCAPGYRPGPRGASCLDVDECSEEDLCQSGICTNTDGSFECICPPGHRAGPDLASCLDVDECRERGPALCGSQRCENSPGSYRCVRDCDPGYHAGPEGTCDDVDECQEYGPEICGAQRCENTPGSYRCTPACDPGYQPTPGGGCQDVDECRNRSFCGAHAVCQNLPGSFQCLCDQGYEGARDGRHCVDVNECETLQGVCGAALCENVEGSFLCVCPNSPEEFDPMTGRCVPPRTSAGTFPGSQPQAPASPVLPARPPPPPLPRRPSTPRQGPVGSGRRECYFDTAAPDACDNILARNVTWQECCCTVGEGWGSGCRIQQCPGTETAEYQSLCPHGRGYLAPSGDLSLRRDVDECQLFRDQVCKSGVCVNTAPGYSCYCSNGYYYHTQRLECIDNDECADEEPACEGGRCVNTVGSYHCTCEPPLVLDGSQRRCVSNESQSLDDNLGVCWQEVGADLVCSHPRLDRQATYTECCCLYGEAWGMDCALCPAQDSDDFEALCNVLRPPAYSPPRPGGFGLPYEYGPDLGPPYQGLPYGPELYPPPALPYDPYPPPPGPFARREAPYGAPRFDMPDFEDDGGPYGESEAPAPPGPGTRWPYRSRDTRRSFPEPEEPPEGGSYAGSLAEPYEELEAEECGILDGCTNGRCVRVPEGFTCRCFDGYRLDMTRMACVDINECDEAEAASPLCVNARCLNTDGSFRCICRPGFAPTHQPHHCAPARPRA

SEQ ID NO: 891910 - protein, 1498 aa, Homo sapiens
PPANAPATGVAVCRCCPGQTSRRSRCIRAFCRVRSCQPKKCAGPQRCLNPVPAVPSPSPSVRKRQVSLNWQPLTLQEARALLKRRRPRGPGGRGLLRRRPPQRAPAGKAPVLCPLICHNGGVCVKPDRCLCPPDFAGKFCQLHSSGARPPAPAVPGLTRSVYTMPLANHRDDEHGVASMVSVHVEHPQEASVVVHQVERVSGPWEEADAEAVARAEAAARAEAAAPYTVLAQSAPREDGYSDASGFGYCFRELRGGECASPLPGLRTQEVCCRGAGLAWGVHDCQLCSERLGNSERVSAPDGPCPTGFERVNGSCEDVDECATGGRCQHGECANTRGGYTCVCPDGFLLDSSRSSCISQHVISEAKGPCFRVLRDGGCSLPILRNITKQICCCSRVGKAWGRGCQLCPPFGSEGFREICPAGPGYHYSASDLRYNTRPLGQEPPRVSLSQPRTLPATSRPSAGFLPTHRLEPRPEPRPDPRPGPELPLPSIPAWTGPEIPESGPSSGMCQRNPQVCGPGRCISRPSGYTCACDSGFRLSPQGTRCIDVDECRRVPPPCAPGRCENSPGSFRCVCGPGFRAGPRAAECLDVDECHRVPPPCDLGRCENTPGSFLCVCPAGYQAAPHGASCQDVDECTQSPGLCGRGACKNLPGSFRCVCPAGFRGSACEEDVDECAQEPPPCGPGRCDNTAGSFHCACPAGFRSRGPGAPCQDVDECARSPPPCTYGRCENTEGSFQCVCPMGFQPNTAGSECEDVDECENHLACPGQECVNSPGSFQCRTCPSGHHLHRGRCTDVDECSSGAPPCGPHGHCTNTEGSFRCSCAPGYRAPSGRPGPCADVNECLEGDFCFPHGECLNTDGSFACTCAPGYRPGPRGASCLDVDECSEEDLCQSGICTNTDGSFECICPPGHRAGPDLASCLDVDECRERGPALCGSQRCENSPGSYRCVRDCDPGYHAGPEGTCDDVNECETLQGVCGAALCENVEGSFLCVCPNSPEEFDPMTGRCVPPRTSAGTFPGSQPQAPASPVLPARPPPPPLPRRPSTPRQGPVGSGRRECYFDTAAPDACDNILARNVTWQECCCTVGEGWGSGCRIQQCPGTETAEYQSLCPHGRGYLAPSGDLSLRRDVDECQLFRDQVCKSGVCVNTAPGYSCYCSNGYYYHTQRLECIDNDECADEEPACEGGRCVNTVGSYHCTCEPPLVLDGSQRRCVSNESQSLDDNLGVCWQEVGADLVCSHPRLDRQATYTECCCLYGEAWGMDCALCPAQDSDDFEALCNVLRPPAYSPPRPGGFGLPYEYGPDLGPPYQGLPYGPELYPPPALPYDPYPPPPGPFARREAPYGAPRFDMPDFEDDGGPYGESEAPAPPGPGTRWPYRSRDTRRSFPEPEEPPEGGSYAGSLAEPYEELEAEECGILDGCTNGRCVRVPEGFTCRCFDGYRLDMTRMACVDINECDEAEAASPLCVNARCLNTDGSFRCICRPGFAPTHQPHHCAPARPRA

SEQ ID NO: 891911 - protein, 1580 aa, Homo sapiens
MPRPGTSGRRPLLLVLLLPLFAAATSAASPSPSPSQVVEVPGVPSRPASVAVCRCCPGQTSRRSRCIRAFCRVRSCQPKKCAGPQRCLNPVPAVPSPSPSVRKRQVSLNWQPLTLQEARALLKRRRPRGPGGRGLLRRRPPQRAPAGKAPVLCPLICHNGGVCVKPDRCLCPPDFAGKFCQLHSSGARPPAPAVPGLTRSVYTMPLANHRDDEHGVASMVSVHVEHPQEASVVVHQVERVSGPWEEADAEAVARAEAAARAEAAAPYTVLAQSAPREDGYSDASGFGYCFRELRGGECASPLPGLRTQEVCCRGAGLAWGVHDCQLCSERLGNSERVSAPDGPCPTGFERVNGSCEDVDECATGGRCQHGECANTRGGYTCVCPDGFLLDSSRSSCISQHVISEAKGPCFRVLRDGGCSLPILRNITKQICCCSRVGKAWGRGCQLCPPFGSEGFREICPAGPGYHYSASDLRYNTRPLGQEPPRVSLSQPRTLPATSRPSAGFLPTHRLEPRPEPRPDPRPGPELPLPSIPAWTGPEIPESGPSSGMCQRNPQVCGPGRCISRPSGYTCACDSGFRLSPQGTRCIDVDECRRVPPPCAPGRCENSPGSFRCVCGPGFRAGPRAAECLDVDECHRVPPPCDLGRCENTPGSFLCVCPAGYQAAPHGASCQDVDECTQSPGLCGRGACKNLPGSFRCVCPAGFRGSACEEDVDECAQEPPPCGPGRCDNTAGSFHCACPAGFRSRGPGAPCQDVDECARSPPPCTYGRCENTEGSFQCVCPMGFQPNTAGSECEDVDECENHLACPGQECVNSPGSFQCRTCPSGHHLHRGRCTDVDECSSGAPPCGPHGHCTNTEGSFRCSCAPGYRAPSGRPGPCADVNECLEGDFCFPHGECLNTDGSFACTCAPGYRPGPRGASCLDVDECSEEDLCQSGICTNTDGSFECICPPGHRAGPDLASCLDVDECRERGPALCGSQRCENSPGSYRCVRDCDPGYHAGPEGTCDDVDECRNRSFCGAHAVCQNLPGSFQCLCDQGYEGARDGRHCVDVNECETLQGVCGAALCENVEGSFLCVCPNSPEEFDPMTGRCVPPRTSAGTFPGSQPQAPASPVLPARPPPPPLPRRPSTPRQGPVGSGRRECYFDTAAPDACDNILARNVTWQECCCTVGEGWGSGCRIQQCPGTETAEYQSLCPHGRGYLAPSGDLSLRRDVDECQLFRDQVCKSGVCVNTAPGYSCYCSNGYYYHTQRLECIDNDECADEEPACEGGRCVNTVGSYHCTCEPPLVLDGSQRRCVSNESQSLDDNLGVCWQEVGADLVCSHPRLDRQATYTECCCLYGEAWGMDCALCPAQDSDDFEALCNVLRPPAYSPPRPGGFGLPYEYGPDLGPPYQGLPYGPELYPPPALPYDPYPPPPGPFARREAPYGAPRFDMPDFEDDGGPYGESEAPAPPGPGTRWPYRSRDTRRSFPEPEEPPEGGSYAGSLAEPYEELEAEECGILDGCTNGRCVRVPEGFTCRCFDGYRLDMTRMACVDINECDEAEAASPLCVNARCLNTDGSFRCICRPGFAPTHQPHHCAPARPRA

SEQ ID NO: 891912 - protein, 1666 aa, Homo sapiens
MPRPGTSGRRPLLLVLLLPLFAAATSAASPSPSPSQVVEVPGVPSRPASVAVCRCCPGQTSRRSRCIRAFCRVRSCQPKKCAGPQRCLNPVPAVPSPSPSVRKRQVSLNWQPLTLQEARALLKRRRPRGPGGRGLLRRRPPQRAPAGKAPVLCPLICHNGGVCVKPDRCLCPPDFAGKFCQLHSSGARPPAPAVPGLTRSVYTMPLANHRDDEHGVASMVSVHVEHPQEASVVVHQVERVSGPWEEADAEAVARAEAAARAEAAAPYTVLAQSAPREDGYSDASGFGYCFRELRGGECASPLPGLRTQEVCCRGAGLAWGVHDCQLCSERLGNSERVSAPDGPCPTGFERVNGSCEDVDECATGGRCQHGECANTRGGYTCVCPDGFLLDSSRSSCISQHVISEAKGPCFRVLRDGGCSLPILRNITKQICCCSRVGKAWGRGCQLCPPFGSEGFREICPAGPGYHYSASDLRYNTRPLGQEPPRVSLSQPRTLPATSRPSAGFLPTHRLEPRPEPRPDPRPGPELPLPSIPAWTGPEIPESGPSSGMCQRNPQVCGPGRCISRPSGYTCACDSGFRLSPQGTRCIDVDECRRVPPPCAPGRCENSPGSFRCVCGPGFRAGPRAAECLDVDECHRVPPPCDLGRCENTPGSFLCVCPAGYQAAPHGASCQDVDECTQSPGLCGRGACKNLPGSFRCVCPAGFRGSACEEDVDECAQEPPPCGPGRCDNTAGSFHCACPAGFRSRGPGAPCQDVDECARSPPPCTYGRCENTEGSFQCVCPMGFQPNTAGSECEDVDECENHLACPGQECVNSPGSFQCRTCPSGHHLHRGRCTDVDECSSGAPPCGPHGHCTNTEGSFRCSCAPGYRAPSGRPGPCADVNECLEGDFCFPHGECLNTDGSFACTCAPGYRPGPRGASCLGSYRADPGPGKGGLRAGKGGTGRRGRKGENEFLAGVFQQDQGAAGGSLEAVRGGGAGDERAESGYLDRDCKEAVLNPSGGGVCREGSSVRQVGEGVRGLGEPRGGGGVWPRMLGGAGGGPGLRTPCPADVDECSEEDLCQSGICTNTDGSFECICPPGHRAGPDLASCLDVDECRERGPALCGSQRCENSPGSYRCVRDCDPGYHAGPEGTCDDVNECETLQGVCGAALCENVEGSFLCVCPNSPEEFDPMTGRCVPPRTSAGTFPGSQPQAPASPVLPARPPPPPLPRRPSTPRQGPVGSGRRECYFDTAAPDACDNILARNVTWQECCCTVGEGWGSGCRIQQCPGTETAEYQSLCPHGRGYLAPSGDLSLRRDVDECQLFRDQVCKSGVCVNTAPGYSCYCSNGYYYHTQRLECIDNDECADEEPACEGGRCVNTVGSYHCTCEPPLVLDGSQRRCVSNESQSLDDNLGVCWQEVGADLVCSHPRLDRQATYTECCCLYGEAWGMDCALCPAQDSDDFEALCNVLRPPAYSPPRPGGFGLPYEYGPDLGPPYQGLPYGPELYPPPALPYDPYPPPPGPFARREAPYGAPRFDMPDFEDDGGPYGESEAPAPPGPGTRWPYRSRDTRRSFPEPEEPPEGGSYAGSLAEPYEELEAEECGILDGCTNGRCVRVPEGFTCRCFDGYRLDMTRMACVDINECDEAEAASPLCVNARCLNTDGSFRCICRPGFAPTHQPHHCAPARPRA

SEQ ID NO: 891913 - protein, 1752 aa, Homo sapiens
MPRPGTSGRRPLLLVLLLPLFAAATSAASPSPSPSQVVEVPGVPSRPASVAVCRCCPGQTSRRSRCIRAFCRVRSCQPKKCAGPQRCLNPVPAVPSPSPSVRKRQVSLNWQPLTLQEARALLKRRRPRGPGGRGLLRRRPPQRAPAGKAPVLCPLICHNGGVCVKPDRCLCPPDFAGKFCQLHSSGARPPAPAVPGLTRSVYTMPLANHRDDEHGVASMVSVHVEHPQEASVVVHQVERVSGPWEEADAEAVARAEAAARAEAAAPYTVLAQSAPREDGYSDASGFGYCFRELRGGECASPLPGLRTQEVCCRGAGLAWGVHDCQLCSERLGNSERVSAPDGPCPTGFERVNGSCEDVDECATGGRCQHGECANTRGGYTCVCPDGFLLDSSRSSCISQHVISEAKGPCFRVLRDGGCSLPILRNITKQICCCSRVGKAWGRGCQLCPPFGSEGFREICPAGPGYHYSASDLRYNTRPLGQEPPRVSLSQPRTLPATSRPSAGFLPTHRLEPRPEPRPDPRPGPELPLPSIPAWTGPEIPESGPSSGMCQRNPQVCGPGRCISRPSGYTCACDSGFRLSPQGTRCIDVDECRRVPPPCAPGRCENSPGSFRCVCGPGFRAGPRAAECLDVDECHRVPPPCDLGRCENTPGSFLCVCPAGYQAAPHGASCQDVDECTQSPGLCGRGACKNLPGSFRCVCPAGFRGSACEEDVDECAQEPPPCGPGRCDNTAGSFHCACPAGFRSRGPGAPCQDVDECARSPPPCTYGRCENTEGSFQCVCPMGFQPNTAGSECEDVDECENHLACPGQECVNSPGSFQCRTCPSGHHLHRGRCTDVDECSSGAPPCGPHGHCTNTEGSFRCSCAPGYRAPSGRPGPCADVNECLEGDFCFPHGECLNTDGSFACTCAPGYRPGPRGASCLGSYRADPGPGKGGLRAGKGGTGRRGRKGENEFLAGVFQQDQGAAGGSLEAVRGGGAGDERAESGYLDRDCKEAVLNPSGGGVCREGSSVRQVGEGVRGLGEPRGGGGVWPRMLGGAGGGPGLRTPCPADVDECSEEDLCQSGICTNTDGSFECICPPGHRAGPDLASCLDVDECRERGPALCGSQRCENSPGSYRCVRDCDPGYHAGPEGTCDDVDECQEYGPEICGAQRCENTPGSYRCTPACDPGYQPTPGGGCQDVDECRNRSFCGAHAVCQNLPGSFQCLCDQGYEGARDGRHCVDVNECETLQGVCGAALCENVEGSFLCVCPNSPEEFDPMTGRCVPPRTSAGTFPGSQPQAPASPVLPARPPPPPLPRRPSTPRQGPVGSGRRECYFDTAAPDACDNILARNVTWQECCCTVGEGWGSGCRIQQCPGTETAEYQSLCPHGRGYLAPSGDLSLRRDVDECQLFRDQVCKSGVCVNTAPGYSCYCSNGYYYHTQRLECIDNDECADEEPACEGGRCVNTVGSYHCTCEPPLVLDGSQRRCVSNESQSLDDNLGVCWQEVGADLVCSHPRLDRQATYTECCCLYGEAWGMDCALCPAQDSDDFEALCNVLRPPAYSPPRPGGFGLPYEYGPDLGPPYQGLPYGPELYPPPALPYDPYPPPPGPFARREAPYGAPRFDMPDFEDDGGPYGESEAPAPPGPGTRWPYRSRDTRRSFPEPEEPPEGGSYAGSLAEPYEELEAEECGILDGCTNGRCVRVPEGFTCRCFDGYRLDMTRMACVDINECDEAEAASPLCVNARCLNTDGSFRCICRPGFAPTHQPHHCAPARPRA

SEQ ID NO: 891914 - protein, 597 aa, Homo sapiens
CVSKILSGLGTAAEACRLIDVDECQEYGPEICGAQRCENTPGSYRCTPACDPGYQPTPGGGCQDVNECETLQGVCGAALCENVEGSFLCVCPNSPEEFDPMTGRCVPPRTSAGTFPGSQPQAPASPVLPARPPPPPLPRRPSTPRQGPVGSGRRECYFDTAAPDACDNILARNVTWQECCCTVGEGWGSGCRIQQCPGTETAEYQSLCPHGRGYLAPSGDLSLRRDVDECQLFRDQVCKSGVCVNTAPGYSCYCSNGYYYHTQRLECIDNDECADEEPACEGGRCVNTVGSYHCTCEPPLVLDGSQRRCVSNESQSLDDNLGVCWQEVGADLVCSHPRLDRQATYTECCCLYGEAWGMDCALCPAQDSDDFEALCNVLRPPAYSPPRPGGFGLPYEYGPDLGPPYQGLPYGPELYPPPALPYDPYPPPPGPFARREAPYGAPRFDMPDFEDDGGPYGESEAPAPPGPGTRWPYRSRDTRRSFPEPEEPPEGGSYAGSLAEPYEELEAEECGILDGCTNGRCVRVPEGFTCRCFDGYRLDMTRMACVDINECDEAEAASPLCVNARCLNTDGSFRCICRPGFAPTHQPHHCAPARPRA

SEQ ID NO: 891915 - protein, 1485 aa, Homo sapiens
MPRPGTSGRRPLLLVLLLPLFAAATSAASPSPSPSQVVEVPGVPSRPASVAVCRCCPGQTSRRSRCIRAFCRVRSCQPKKCAGPQRCLNPVPAVPSPSPSVRKRQVSLNWQPLTLQEARALLKRRRPRGPGGRGLLRRRPPQRAPAGKAPVLCPLICHNGGVCVKPDRCLCPPDFAGKFCQLHSSGARPPAPAVPGLTRSVYTMPLANHRDDEHGVASMVSVHVEHPQEASVVVHQVERVSGPWEEADAEAVARAEAAARAEAAAPYTVLAQSAPREDGYSDASGFGYCFRELRGGECASPLPGLRTQEVCCRGAGLAWGVHDCQLCSERLGNSERVSAPDGPCPTGFERVNGSCEDVDECATGGRCQHGECANTRGGYTCVCPDGFLLDSSRSSCISQHVISEAKGPCFRVLRDGGCSLPILRNITKQICCCSRVGKAWGRGCQLCPPFGSEGFREICPAGPGYHYSASDLRYNTRPLGQEPPRVSLSQPRTLPATSRPSAGFLPTHRLEPRPEPRPDPRPGPELPLPSIPAWTGPEIPESGPSSGMCQRNPQVCGPGRCISRPSGYTCACDSGFRLSPQGTRCIDVDECRRVPPPCAPGRCENSPGSFRCVCGPGFRAGPRAAECLDVDECHRVPPPCDLGRCENTPGSFLCVCPAGYQAAPHGASCQDVDECTQSPGLCGRGACKNLPGSFRCVCPAGFRGSACEEDVDECAQEPPPCGPGRCDNTAGSFHCACPAGFRSRGPGAPCQDVDECARSPPPCTYGRCENTEGSFQCVCPMGFQPNTAGSECEDVDECENHLACPGQECVNSPGSFQCRTCPSGHHLHRGRCTDVDECSSGAPPCGPHGHCTNTEGSFRCSCAPGYRAPSGRPGPCADVNECLEGDFCFPHGECLNTDGSFACTCAPGYRPGPRGASCLDVDECSEEDLCQSGICTNTDGSFECICPPGHRAGPDLASCLDVDECRERGPALCGSQRCENSPGSYRCVRDCDPGYHAGPEGTCDDVNECETLQGVCGAALCENVEGSFLCVCPNSPEEFDPMTGRCVPPRTSAGTFPGSQPQAPASPVLPARPPPPPLPRRPSTPRQGPVGSGRRECYFDTAAPDACDNILARNVTWQECCCTVGEGWGSGCRIQQCPGTETAEYQSLCPHGRGYLAPSGDLSLRRDVDECQLFRDQVCKSGVCVNTAPGYSCYCSNGYYYHTQRLECIDNDECADEEPACEGGRCVNTVGSYHCTCEPPLVLDGSQRRCVSNESQSLDDNLGVCWQEVGADLVCSHPRLDRQATYTECCCLYGEAWGMDCALCPAQDSDDFEALCNVLRPPAYSPPRPGGFGLPYEYGPDLGPPVTMWTSVKHYRVYVELPCVKMSEGSFLSAAQQLGFHLCLMGWLANGSTAHPVVFPVADCGNGRVGVVSLGARKNLSERWDAYCFRVQDVACRCRNGFVGDGISTCNGKLLDVLAATANFSTFYGMLLGYANATQPGSRLS

SEQ ID NO: 891916 - protein, 809 aa, Homo sapiens; identical to SEQ ID NO: 891896

SEQ ID NO: 891917 - protein, 1621 aa, Homo sapiens
MPRPGTSGRRPLLLVLLLPLFAAATSAASPSPSPSQVVEVPGVPSRPASVAVCRCCPGQTSRRSRCIRAFCRVRSCQPKKCAGPQRCLNPVPAVPSPSPSVRKRQVSLNWQPLTLQEARALLKRRRPRGPGGRGLLRRRPPQRAPAGKAPVLCPLICHNGGVCVKPDRCLCPPDFAGKFCQLHSSGARPPAPAVPGLTRSVYTMPLANHRDDEHGVASMVSVHVEHPQEASVVVHQVERVSGPWEEADAEAVARAEAAARAEAAAPYTVLAQSAPREDGYSDASGFGYCFRELRGGECASPLPGLRTQEVCCRGAGLAWGVHDCQLCSERLGNSERVSAPDGPCPTGFERVNGSCEDVDECATGGRCQHGECANTRGGYTCVCPDGFLLDSSRSSCISQHVISEAKGPCFRVLRDGGCSLPILRNITKQICCCSRVGKAWGRGCQLCPPFGSEGFREICPAGPGYHYSASDLRYNTRPLGQEPPRVSLSQPRTLPATSRPSAGFLPTHRLEPRPEPRPDPRPGPELPLPSIPAWTGPEIPESGPSSGMCQRNPQVCGPGRCISRPSGYTCACDSGFRLSPQGTRCIDVDECRRVPPPCAPGRCENSPGSFRCVCGPGFRAGPRAAECLDVDECHRVPPPCDLGRCENTPGSFLCVCPAGYQAAPHGASCQDVDECTQSPGLCGRGACKNLPGSFRCVCPAGFRGSACEEDVDECAQEPPPCGPGRCDNTAGSFHCACPAGFRSRGPGAPCQDVDECARSPPPCTYGRCENTEGSFQCVCPMGFQPNTAGSECEDVDECENHLACPGQECVNSPGSFQCRTCPSGHHLHRGRCTDVDECSSGAPPCGPHGHCTNTEGSFRCSCAPGYRAPSGRPGPCADVNECLEGDFCFPHGECLNTDGSFACTCAPGYRPGPRGASCLDVDECSEEDLCQSGICTNTDGSFECICPPGHRAGPDLASCLDVDECRERGPALCGSQRCENSPGSYRCVRDCDPGYHAGPEGTCDDVDECQEYGPEICGAQRCENTPGSYRCTPACDPGYQPTPGGGCQDVDECRNRSFCGAHAVCQNLPGSFQCLCDQGYEGARDGRHCVDVNECETLQGVCGAALCENVEGSFLCVCPNSPEEFDPMTGRCVPPRTSAGTFPGSQPQAPASPVLPARPPPPPLPRRPSTPRQGPVGSGRRECYFDTAAPDACDNILARNVTWQECCCTVGEGWGSGCRIQQCPGTETELCPHRPVPHRRTRHYRCTPAAVCGSSSRCCNSMSSPGPCSHTRHPCTPGLGRASTFVHVSPEAQVSTGRQVAPACEGGRCVNTVGSYHCTCEPPLVLDGSQRRCVSNESQSLDDNLGVCWQEVGADLVCSHPRLDRQATYTECCCLYGEAWGMDCALCPAQDSDDFEALCNVLRPPAYSPPRPGGFGLPYEYGPDLGPPYQGLPYGPELYPPPALPYDPYPPPPGPFARREAPYGAPRFDMPDFEDDGGPYGESEAPAPPGPGTRWPYRSRDTRRSFPEPEEPPEGGSYAGSLAEPYEELEAEECGILDGCTNGRCVRVPEGFTCRCFDGYRLDMTRMACVDINECDEAEAASPLCVNARCLNTDGSFRCICRPGFAPTHQPHHCAPARPRA

SEQ ID NO: 891918 - protein, 1597 aa, Homo sapiens
MPRPGTSGRRPLLLVLLLPLFAAATSAASPSPSPSQVVEVPGVPSRPASVAVCRCCPGQTSRRSRCIRAFCRVRSCQPKKCAGPQRCLNPVPAVPSPSPSVRKRQVSLNWQPLTLQEARALLKRRRPRGPGGRGLLRRRPPQRAPAGKAPVLCPLICHNGGVCVKPDRCLCPPDFAGKFCQLHSSGARPPAPAVPGLTRSVYTMPLANHRDDEHGVASMVSVHVEHPQEASVVVHQVERVSGPWEEADAEAVARAEAAARAEAAAPYTVLAQSAPREDGYSDASGFGYCFRELRGGECASPLPGLRTQEVCCRGAGLAWGVHDCQLCSERLGNSERVSAPDGPCPTGFERVNGSCEDVDECATGGRCQHGECANTRGGYTCVCPDGFLLDSSRSSCISQHVISEAKGPCFRVLRDGGCSLPILRNITKQICCCSRVGKAWGRGCQLCPPFGSEGFREICPAGPGYHYSASDLRYNTRPLGQEPPRVSLSQPRTLPATSRPSAGFLPTHRLEPRPEPRPDPRPGPELPLPSIPAWTGPEIPESGPSSGMCQRNPQVCGPGRCISRPSGYTCACDSGFRLSPQGTRCIDVDECRRVPPPCAPGRCENSPGSFRCVCGPGFRAGPRAAECLDVDECHRVPPPCDLGRCENTPGSFLCVCPAGYQAAPHGASCQDVDECTQSPGLCGRGACKNLPGSFRCVCPAGFRGSACEEDVDECAQEPPPCGPGRCDNTAGSFHCACPAGFRSRGPGAPCQDVDECARSPPPCTYGRCENTEGSFQCVCPMGFQPNTAGSECEDVDECENHLACPGQECVNSPGSFQCRTCPSGHHLHRGRCTDVDECSSGAPPCGPHGHCTNTEGSFRCSCAPGYRAPSGRPGPCADVNECLEGDFCFPHGECLNTDGSFACTCAPGYRPGPRGASCLGSYRADPGPGKGGLRAGKGGTGRRGRKGENEFLAGVFQQDQGAAGGSLEAVRGGGAGDERAESGYLDRDCKEAVLNPSGGGVCREGSSVRQVGEGVRGLGEPRGGGGVWPRMLGGAGGGPGLRTPCPADVDECSEEDLCQSGICTNTDGSFECICPPGHRAGPDLASCLDVDECRERGPALCGSQRCENSPGSYRCVRDCDPGYHAGPEGTCDDVDECQEYGPEICGAQRCENTPGSYRCTPACDPGYQPTPGGGCQDVNECETLQGVCGAALCENVEGSFLCVCPNSPEEFDPMTGRCVPPRTSADVDECQLFRDQVCKSGVCVNTAPGYSCYCSNGYYYHTQRLECIDNDECADEEPACEGGRCVNTVGSYHCTCEPPLVLDGSQRRCVSNESQSLDDNLGVCWQEVGADLVCSHPRLDRQATYTECCCLYGEAWGMDCALCPAQDSDDFEALCNVLRPPAYSPPRPGGFGLPYEYGPDLGPPYQGLPYGPELYPPPALPYDPYPPPPGPFARREAPYGAPRFDMPDFEDDGGPYGESEAPAPPGPGTRWPYRSRDTRRSFPEPEEPPEGGSYAGSLAEPYEELEAEECGILDGCTNGRCVRVPEGFTCRCFDGYRLDMTRMACVDINECDEAEAASPLCVNARCLNTDGSFRCICRPGFAPTHQPHHCAPARPRA

SEQ ID NO: 891919 - protein, 453 aa, Homo sapiens
MRMCTGRPPGPGEEDYGRLEAATPCTCPASTSASHCCTVGEGWGSGCRIQQCPGTETAEYQSLCPHGRGYLAPSGDLSLRRDVDECQLFRDQVCKSGVCVNTAPGYSCYCSNGYYYHTQRLECIDNDECADEEPACEGGRCVNTVGSYHCTCEPPLVLDGSQRRCVSNESQSLDDNLGVCWQEVGADLVCSHPRLDRQATYTECCCLYGEAWGMDCALCPAQDSDDFEALCNVLRPPAYSPPRPGGFGLPYEYGPDLGPPYQGLPYGPELYPPPALPYDPYPPPPGPFARREAPYGAPRFDMPDFEDDGGPYGESEAPAPPGPGTRWPYRSRDTRRSFPEPEEPPEGGSYAGSLAEPYEELEAEECGILDGCTNGRCVRVPEGFTCRCFDGYRLDMTRMACVDINECDEAEAASPLCVNARCLNTDGSFRCICRPGFAPTHQPHHCAPARPRA

SEQ ID NO: 891920 - protein, 1102 aa, Homo sapiens
MPRPGTSGRRPLLLVLLLPLFAAATSAASPSPSPSQVVEVPGVPSRPASVAVCRCCPGQTSRRSRCIRAFCRVRSCQPKKCAGPQRCLNPVPAVPSPSPSVRKRQVSLNWQPLTLQEARALLKRRRPRGPGGRGLLRRRPPQRAPAGKAPVLCPLICHNGGVCVKPDRCLCPPDFAGKFCQLHSSGARPPAPAVPGLTRSVYTMPLANHRDDEHGVASMVSVHVEHPQEASVVVHQVERVSGPWEEADAEAVARAEAAARAEAAAPYTVLAQSAPREDGYSDASGFGYCFRELRGGECASPLPGLRTQEVCCRGAGLAWGVHDCQLCSERLGNSERVSAPDGPCPTGFERVNGSCEDVDECATGGRCQHGECANTRGGYTCVCPDGFLLDSSRSSCISQHVISEAKGPCFRVLRDGGCSLPILRNITKQICCCSRVGKAWGRGCQLCPPFGSEGFREICPAGPGYHYSASDLRYNTRPLGQEPPRVSLSQPRTLPATSRPSAGFLPTHRLEPRPEPRPDPRPGPELPLPSIPAWTGPEIPESGPSSGMCQRNPQVCGPGRCISRPSGYTCACDSGFRLSPQGTRCIDVDECRRVPPPCAPGRCENSPGSFRCVCGPGFRAGPRAAECLDVDECHRVPPPCDLGRCENTPGSFLCVCPAGYQAAPHGASCQDVDECTQSPGLCGRGACKNLPGSFRCVCPAGFRGSACEEDVDECAQEPPPCGPGRCDNTAGSFHCACPAGFRSRGPGAPCQDVDECARSPPPCTYGRCENTEGSFQCVCPMGFQPNTAGSECEDVDECENHLACPGQECVNSPGSFQCRTCPSGHHLHRGRCTDVDECSSGAPPCGPHGHCTNTEGSFRCSCAPGYRAPSGRPGPCADVNECLEGDFCFPHGECLNTDGSFACTCAPGYRPGPRGASCLDVDECSEEDLCQSGICTNTDGSFECICPPGHRAGPDLASCLDVDECRERGPALCGSQRCENSPGSYRCVRDCDPGYHAGPEGTCDDVDECRNRSFCGAHAVCQNLPGSFQCLCDQGYEGARDGRHCVDVNECETLQGVCGAALCENVEGSFLCVCPNSPEEFDPMTGRCVPPRTSAGETDVSI

SEQ ID NO: 891921 - protein, 567 aa, Homo sapiens
MPRPGTSGRRPLLLVLLLPLFAAATSAASPSPSPSQVVEVPGVPSRPASVAVCRCCPGQTSRRSRCIRAFCRVRSCQPKKCAGPQRCLNPVPAVPSPSPSVRKRQVSLNWQPLTLQEARALLKRRRPRGPGGRGLLRRRPPQRAPAGKAPVLCPLICHNGGVCVKPDRCLCPPDFAGKFCQLHSSGARPPAPAVPGLTRSVYTMPLANHRDDEHGVASMVSVHVEHPQEASVVVHQVERVSGPWEEADAEAVARAEAAARAEAAAPYTVLAQSAPREDGYSDASGFGYCFRELRGGECASPLPGLRTQEVCCRGAGLAWGVHDCQLCSERLGNSERVSAPDGPCPTGFERVNGSCEDVDECATGGRCQHGECANTRGGYTCVCPDGFLLDSSRSSCISQHVISEAKGPCFRVLRDGGCSLPILRNITKQICCCSRVGKAWGRGCQLCPPFGSEGFREICPAGPGYHYSASDLRYNTRPLGQEPPRVSLSQPRTLPATSRPSAGFLPTHRLEPRPEPRPDPRPGPELPLPSIPAWTGPEIPESGLLERTEGIGPAAVAHACNPSILGG

SEQ ID NO: 891922 - protein, 496 aa, Homo sapiens
MFAKATRNFLREVDADGDLIAVSNLNDSDKLQLLSLVTKKKRFWCWQRPKYQFLSLTLGDVLIEDQFPSPVVVESDFVKYEGKFANHVSGTLETALGKVKLNLGGSSRVESQSSFGTLRKQEVDLQQLIRDSAERTINLRNPVLQQVLEGRNEVLCVLTQKITTMQKCVISEHMQVEEKCGGIVGIQTKTVQVSATEDGNVTKDSNVVLEIPAATTIAYGVIELYVKLDGQFEFCLLRGKQGGFENKKRIDSVYLDPLVFREFAFIDMPDAAHGISSQDGPLSVLKQATLLLERNFHPFAELPEPQQTALSDIFQAVLFDDELLMVLEPVCDDLVSGLSPTVAVLGELKPRQQQDLVAFLQLVGCSLQGGCPGPEDAGSKQLFMTAYFLVSALAEMPDSAAALLGTCCKLQIIPTLCHLLRALSDDGVSDLEDPTLTPLKDTERFGIVQRLFASADISLERLKSSVKAVILKDSKVFPLLLCITLNGLCALGREHS

SEQ ID NO: 891923 - protein, 344 aa, Homo sapiens [sequence omitted]

SEQ ID NO: 891924 - protein, 496 aa, Homo sapiens; identical to SEQ ID NO: 891922

SEQ ID NO: 891925 - protein, 475 aa, Homo sapiens
GAPGPSKGPGGRALSPPSPSARPPPAQRRLLRLRQRRGRGCRGPSSGRAVVVESDFVKYEGKFANHVSGTLETALGKVKLNLGGSSRVESQSSFGTLRKQEVDLQQLIRDSAERTINLRNPVLQQVLEGRNEVLCVLTQKITTMQKCVISEHMQVEEKCGGIVGIQTKTVQVSATEDGNVTKDSNVVLEIPAATTIAYGVIELYVKLDGQFEFCLLRGKQGGFENKKRIDSVYLDPLVFREFAFIDMPDAAHGISSQDGPLSVLKQATLLLERNFHPFAELPEPQQTALSDIFQAVLFDDELLMVLEPVCDDLVSGLSPTVAVLGELKPRQQQDLVAFLQLVGCSLQGGCPGPEDAGSKQLFMTAYFLVSALAEMPDSAAALLGTCCKLQIIPTLCHLLRALSDDGVSDLEDPTLTPLKDTERFGIVQRLFASADISLERLKSSVKAVILKDSKVFPLLLCITLNGLCALGREHS

SEQ ID NO: 891926 - protein, 435 aa, Homo sapiens
MFAKATRNFLREVDADGDLIAVSNLNDSDKLQLLSLVTKKKRFWCWQRPKYQFLSLTLGDVLIEDQFPSPVVVESDFVKYEGKFANHVSGTLETALGKVKLNLGGSSRVESQSSFGTLRKQEVDLQQLIRDSAERTINLRNPVLQQVLEGRNEVLCVLTQKITTMQKCVISEHMQVEEKCGGIVGIQTKTVQVSATEDGNVTKDSNVVLEIPAATTIAYGVIELYVKLDGQFEFCLLRGKQGGFENKKRIDSVYLDPLVFREFAFIDMPDAAHGISSQDGPLSVLKQATLLLERNFHPFAELPEPQQTALSDIFQAVLFDDELLMVLEPVCDDLVSGLSPTVAVLGELKPRQQQDLVAFLQLVGCSLQGGCPGPEDAGSKQLFMTAYFLVSALAEMPDSAAALLGTCCKLQIIPTLCHLVSNLPGGTLEWIGMGK

SEQ ID NO: 891927 - protein, 367 aa, Homo sapiens
MFAKATRNFLREVDADGDLIAVSNLNDSDKLQLLSLVTKKKRFWCWQRPKYQFLSLTLGDVLIEDQFPSPVVVESDFVKYEGKFANHVSGTLETALGKVKLNLGGSSRVESQSSFGTLRKQEVDLQQLIRDSAERTINLRNPVLQQVLEGRNEVLCVLTQKITTMQKCVISEHMQVEEKCGGIVGIQTKTVQVSATEDGNVTKDSNVVLEIPAATTIAYGVIELYVKLDGQFEFCLLRGKQGGFENKKRIDSVYLDPLVFREFAFIDMPDAAHGISSQDGPLSVLKQATLLLERNFHPFAELPEPQQTALSDIFQAVLFDDELLMVLEPVQKDILGRSSSLTLSCTNGESHTSCQPSSHPDSVSSLS

SEQ ID NO: 891928 - protein, 101 aa, Homo sapiens
MPDSAAALLGTCCKLQIIPTLCHLLRALSDDGVSDLEDPTLTPLKDTERFGIVQRLFASADISLERLKSSVKAVILKDSKVFPLLLCITLNGLCALGREHS

SEQ ID NO: 891929 - protein, 338 aa, Homo sapiens
MSDFDSNPFADPDLNNPFKDPSVTQVTRNVPPGLDEYNPFSDSRTPPPGGVKMPNVPNTQPAIMKPTEEHPAYTQIAKEHALAQAELLKRQEELERKAAELDRREREMQNLSQHGRKNNWPPLPSNFPVGPCFYQDFSVDIPVEFQKTVKLMYYLWMFHAVTLFLNIFGCLAWFCVDSARAVDFGLSILWFLLFTPCSFVCWYRPLYGAFRSDSSFRFFVFFFVYICQFAVHVLQAAGFHNWGNCGWISSLTGLNQNIPVGIMMIIIAALFTASAVISLVMFKKVHGLYRTTGASFEKAQQEFATGVMSNKTVQTAAANAASTAASSAAQNAFKGNQI

SEQ ID NO: 891930 - protein, 157 aa, Homo sapiens
MSDFDSNPFADPDLNNPFKDPSVTQVTRNVPPGLDEYNPFSDSRTPPPGGVKMPNVPNTQPAIMKPTEEHPAYTQIAKEHALAQAELLKRQEELERKAAELDRREREMQNLSQHGRKNNWPPLPSNFPVGPCFYQDFSVDIPVEFQKTVKLMYYLWM

SEQ ID NO: 891931 - protein, 147 aa, Homo sapiens
PPCSLISDCCASNQRDSVGVGPSEPGAGYNLVVRHFLSRSERRNIRVGVTRFSSGWISSLTGLNQNIPVGIMMIIIAALFTASAVISLVMFKKVHGLYRTTGASFEKAQQEFATGVMSNKTVQTAAANAASTAASSAAQNAFKGNQI

SEQ ID NO: 891932 - protein, 122 aa, Homo sapiens
MSDFDSNPFADPDLNNPFKDPSVTQVTRNVPPGLDEYNPFSDSRTPPPGGVKMPNVPNTQPAIMKPTEEHPAYTQIAKEHALAQAELLKRQEELERKAAELDRREREMQNLSQHGSIQRNLK

SEQ ID NO: 891933 - protein, 338 aa, Homo sapiens; identical to SEQ ID NO: 891929

SEQ ID NO: 891934 - protein, 304 aa, Homo sapiens
MSDFDSNPFADPDLNNPFKDPSVTQVTRNVPPGLDEYNPFSDSRTPPPGGVKMPNVPNTQPAIMKPTEEHPAYTQIAKEHALAQAELLKRQEELERKAAELDRREREMQNLSQHGRKNNWPPLPSNFPVGPCFYQDFSVDIPVEFQKTVKLMYYLWMFHAVTLFLNIFGCLAWFCVDSARAVDFGLSILWFLLFTPCSFVCWYRPLYGAFSGWISSLTGLNQNIPVGIMMIIIAALFTASAVISLVMFKKVHGLYRTTGASFEKAQQEFATGVMSNKTVQTAAANAASTAASSAAQNAFKGNQI

SEQ ID NO: 891935 - protein, 278 aa, Homo sapiens
MSDFDSNPFADPDLNNPFKPPPGGVKMPNVPNTQPAIMKPTEEHPAYTQIAKEHALAQAELLKRQEELERKAAELDRREREMQNLSQHGRKNNWPPLPSNFPVGPCFYQDFSVDIPVEFQKTVKLMYYLWMFHAVTLFLNIFGCLAWFCVDSARAVDFGLSILWFLLFTPCSFVCWYRPLYGAFSGWISSLTGLNQNIPVGIMMIIIAALFTASAVISLVMFKKVHGLYRTTGASFEKAQQEFATGVMSNKTVQTAAANAASTAASSAAQNAFKGNQI

SEQ ID NO: 891936 - protein, 147 aa, Homo sapiens; identical to SEQ ID NO: 891931

SEQ ID NO: 891937 - protein, 304 aa, Homo sapiens; identical to SEQ ID NO: 891934

SEQ ID NO: 891938 - protein, 338 aa, Homo sapiens; identical to SEQ ID NO: 891929

SEQ ID NO: 891939 - protein, 338 aa, Homo sapiens; identical to SEQ ID NO: 891929

SEQ ID NO: 891940 - protein, 177 aa, Homo sapiens
METEETRGIRRSSSSLLASPGHISVKEPTPSIASDISLPIATQELRQRLRQLENGTTLGQSPLGQIQLTIRHSSQRNKLIVVVHACRDKRRSGRRKTHVSKKTLNPVFDQSFDFSVSLPEVQRRTLDVAVKNSGGFLSKDKGLLGKVLVALASEELAKGWTQWYDLTEDGTRPQAMT

SEQ ID NO: 891941 - protein, 890 aa, Homo sapiens
PSRAEAGVRRSRVPSEGRWRGAEPPGISASTQPASAGRAARHCGAMSGARGEGPEAGAGGAGGRAAPENPGGVLSVELPGLLAQLARSFALLLPVYALGYLGLSFSWVLLALALLAWCRRSRGLKALRLCRALALLEDEERVVRLGVRACDLPAWVHFPDTERAEWLNKTVKHMWPFICQFIEKLFRETIEPAVRGANTHLSTFSFTKVDVGQQPLRINGVKVYTENVDKRQIILDLQISFVGNCEIDLEIKRYFCRAGVKSIQIHGTMRVILEPLIGDMPLVGALSIFFLRKPLLEINWTGLTNLLDVPGLNGLSDTIILDIISNYLVLPNRITVPLVSEVQIAQLRFPVPKGVLRIHFIEAQDLQGKDTYLKGLVKGKSDPYGIIRVGNQIFQSRVIKENLSPKWNEVYEALVYEHPGQELEIELFDEDPDKDDFLGSLMIDLIEVEKERLLDEWFTLDEVPKGKLHLRLEWLTLMPNASNLDKVLTDIKADKDQANDGLSSALLILYLDSARNLPSGKKISSNPNPVVQMSVGHKAQESKIRYKTNEPVWEENFTFFIHNPKRQDLEVEVRDEQHQCSLGNLKVPLSQLLTSEDMTVSQRFQLSNSGPNSTIKMKIALRVLHLEKRERPPDHQHSAQVKRPSVSKEGRKTSIKSHMSGSPGPGGSNTAPSTPVIGGSDKPGMEEKAQPPEAGPQGLHDLGRSSSSLLASPGHISVKEPTPSIASDISLPIATQELRQRLRQLENGTTLGQSPLGQIQLTIRHSSQRNKLIVVVHACRNLIAFSEDGSDPYVRMYLLPDKRRSGRRKTHVSKKTLNPVFDQSFDFSVSLPEVQRRTLDVAVKNSGGFLSKDKGLLGKVLVALASEELAKGWTQWYDLTEDGTRPQAMT

SEQ ID NO: 891942 - protein, 890 aa, Homo sapiens; identical to SEQ ID NO: 891941

SEQ ID NO: 891943 - protein, 1048 aa, Homo sapiens
MGGNKENMEPKGNCSESTKILGYCEQMGWRGALLSYRRNDLVVKIKHKSNLFELSTVSNGDLLAGLAIPGPKALHGLHNIHAFFHFAKHHMLAIQPLSLGSADEKLGTICVGSSICHGQDARTRMLLDEVLIFKFLPIDGLATSAIMACEVTTLTHKPWNNSVKARAPSPPRPGGQQRHCGAMSGARGEGPEAGAGGAGGRAAPENPGGVLSVELPGLLAQLARSFALLLPVYALGYLGLSFSWVLLALALLAWCRRSRGLKALRLCRALALLEDEERVVRLGVRACDLPAWVHFPDTERAEWLNKTVKHMWPFICQFIEKLFRETIEPAVRGANTHLSTFSFTKVDVGQQPLRINGVKVYTENVDKRQIILDLQISFVGNCEIDLEIKRYFCRAGVKSIQIHGTMRVILEPLIGDMPLVGALSIFFLRKPLLEINWTGLTNLLDVPGLNGLSDTIILDIISNYLVLPNRITVPLVSEVQIAQLRFPVPKGVLRIHFIEAQDLQGKDTYLKGLVKGKSDPYGIIRVGNQIFQSRVIKENLSPKWNEVYEALVYEHPGQELEIELFDEDPDKDDFLGSLMIDLIEVEKERLLDEWFTLDEVPKGKLHLRLEWLTLMPNASNLDKVLTDIKADKDQANDGLSSALLILYLDSARNLPSNPLEFNPDVLKKTAVQRALKSGKKISSNPNPVVQMSVGHKAQESKIRYKTNEPVWEENFTFFIHNPKRQDLEVEVRDEQHQCSLGNLKVPLSQLLTSEDMTVSQRFQLSNSGPNSTIKMKIALRVLHLEKRERPPDHQHSAQVKRPSVSKEGRKTSIKSHMSGSPGPGGSNTAPSTPVIGGSDKPGMEEKAQPPEAGPQGLHDLGRSSSSLLASPGHISVKEPTPSIASDISLPIATQELRQRLRQLENGTTLGQSPLGQIQLTIRHSSQRNKLIVVVHACRNLIAFSEDGSDPYVRMYLLPDKRRSGRRKTHVSKKTLNPVFDQSFDFSVSLPEVQRRTLDVAVKNSGGFLSKDKGLLGKVLVALASEELAKGWTQWYDLTEDGTRPQAMT

SEQ ID NO: 891944 - protein, 499 aa, Homo sapiens
LGGAGSNLAEVDIELFDEDPDKDDFLGSLMIDLIEVEKERLLDEWFTLDEVPKGKLHLRLEWLTLMPNASNLDKVLTDIKADKDQANDGLSSALLILYLDSARNLPSNPLEFNPDVLKKTAVQRALKSGKKISSNPNPVVQMSVGHKAQESKIRYKTNEPVWEENFTFFIHNPKRQDLEVEVRDEQHQCSLGNLKVPLSQLLTSEDMTVSQRFQLSNSGPNSTIKMKIALRVLHLEKRERPPDHQHSAQVKRPSVSKEGRKTSIKSHMSGSPGPGGSNTAPSTPVIGGSDKPGMEEKAQPPEAGPQGLHDLGRSSSSLLASPGHISVKEPTPSIASDISLPIATQELRQRLRQLENGTTLGQSPLGQIQLTIRHSSQRNKLIVVVHACRNLIAFSEDGSDPYVRMYLLPDKRRSGRRKTHVSKKTLNPVFDQSFDFSVSLPEVQRRTLDVAVKNSGGFLSKDKGLLGKVLVALASEELAKGWTQWYDLTEDGTRPQAMT

SEQ ID NO: 891945 - protein, 358 aa, Homo sapiens
MSVGHKAQESKIRYKTNEPVWEENFTFFIHNPKRQDLEVEVRDEQHQCSLGNLKVPLSQLLTSEDMTVSQRFQLSNSGPNSTIKMKIALRVLHLEKRERPPDHQHSAQVKRPSVSKEGRKTSIKSHMSGSPGPGGSNTAPSTPVIGGSDKPGMEEKAQPPEAGPQGLHDLGRSSSSLLASPGHISVKEPTPSIASDISLPIATQELRQRLRQLENGTTLGQSPLGQIQLTIRHSSQRNKLIVVVHACRNLIAFSEDGSDPYVRMYLLPDKRRSGRRKTHVSKKTLNPVFDQSFDFSVSLPEVQRRTLDVAVKNSGGFLSKDKGLLGKVLVALASEELAKGWTQWYDLTEDGTRPQAMT

SEQ ID NO: 891946 - protein, 185 aa, Homo sapiens
NLGSEAGLMDEAVKEPTPSIASDISLPIATQELRQRLRQLENGTTLGQSPLGQIQLTIRHSSQRNKLIVVVHACRNLIAFSEDGSDPYVRMYLLPDKRRSGRRKTHVSKKTLNPVFDQSFDFSVSLPEVQRRTLDVAVKNSGGFLSKDKGLLGKVLVALASEELAKGWTQWYDLTEDGTRPQAMT

SEQ ID NO: 891947 - protein, 109 aa, Homo sapiens
TLRERETGLKYCSIINSTTDKRRSGRRKTHVSKKTLNPVFDQSFDFSVSLPEVQRRTLDVAVKNSGGFLSKDKGLLGKVLVALASEELAKGWTQWYDLTEDGTRPQAMT

SEQ ID NO: 891948 - protein, 1048 aa, Homo sapiens; identical to SEQ ID NO: 891943

SEQ ID NO: 891949 - protein, 1048 aa, Homo sapiens; identical to SEQ ID NO: 891943

SEQ ID NO: 891950 - protein, 582 aa, Homo sapiens
PSRAEAGVRRSRVPSEGRWRGAEPPGISASTQPASAGRAARHCGAMSGARGEGPEAGAGGAGGRAAPENPGGVLSVELPGLLAQLARSFALLLPVYALGYLGLSFSWVLLALALLAWCRRSRGLKALRLCRALALLEDEERVVRLGVRACDLPAWVHFPDTERAEWLNKTVKHMWPFICQFIEKLFRETIEPAVRGANTHLSTFSFTKVDVGQQPLRINGVKVYTENVDKRQIILDLQISFVGNCEIDLEIKRYFCRAGVKSIQIHGTMRVILEPLIGDMPLVGALSIFFLRKPLLEINWTGLTNLLDVPGLNGLSDTIILDIISNYLVLPNRITVPLVSEVQIAQLRFPVPKGVLRIHFIEAQDLQGKDTYLKGLVKGKSDPYGIIRVGNQIFQSRVIKENLSPKWNEVYEALVYEHPGQELEIELFDEDPDKDDFLGSLMIDLIEVEKERLLDEWFTLDEVPKGKLHLRLEWLTLMPNASNLDKVLTDIKADKDQANDGLSSALLILYLDSARNLPSNPLEFNPDVLKKTAVQRALKSGKKISSNPNPVVQMSVGHKAQESKIRYKTNEPVVVGGGDTLE

SEQ ID NO: 891951 - protein, 347 aa, Homo sapiens
PSRAEAGVRRSRVPSEGRWRGAEPPGISASTQPASAGRAARHCGAMSGARGEGPEAGAGGAGGRAAPENPGGVLSVELPGLLAQLARSFALLLPVYALGYLGLSFSWVLLALALLAWCRRSRGLKALRLCRALALLEDEERVVRLGVRACDLPAWVHFPDTERAEWLNKTVKHMWPFICQFIEKLFRETIEPAVRGANTHLSTFSFTKVDVGQQPLRINGVKVYTENVDKRQIILDLQISFVGNCEIDLEIKRYFCRAGVKSIQIHGTMRVILEPLIGDMPLVGALSIFFLRKPVSQYLFHFYFPIWWQKYIPVEEYIKWRNKILSTHRCPFLLCESCGSFLYFFVP

SEQ ID NO: 891952 - protein, 153 aa, Homo sapiens
MWPFICQFIEKLFRETIEPAVRGANTHLSTFSFTKVDVGQQPLRINGVKVYTENVDKRQIILDLQISFVGNCEIDLEIKRYFCRAGVKSIQIHGTMRVILEPLIGDMPLVGALSIFFLRKPLLEINWTGLTNLLDVPGLNGLIQILSLSGIYI

SEQ ID NO: 891953 - protein, 1048 aa, Homo sapiens; identical to SEQ ID NO: 891943

SEQ ID NO: 891954 - protein, 913 aa, Homo sapiens
PSRAEAGVRRSRVPSEGRWRGAEPPGISASTQPASAGRAARHCGAMSGARGEGPEAGAGGAGGRAAPENPGGVLSVELPGLLAQLARSFALLLPVYALGYLGLSFSWVLLALALLAWCRRSRGLKALRLCRALALLEDEERVVRLGVRACDLPAWVHFPDTEESRMATVRTTVKHMWPFICQFIEKLFRETIEPAVRGANTHLSTFSFTKVDVGQQPLRINGVKVYTENVDKRQIILDLQISFVGNCEIDLEIKRYFCRAGVKSIQIHGTMRVILEPLIGDMPLVGALSIFFLRKPLLEINWTGLTNLLDVPGLNGLSDTIILDIISNYLVLPNRITVPLVSEVQIAQLRFPVPKGVLRIHFIEAQDLQGKDTYLKGLVKGKSDPYGIIRVGNQIFQSRVIKENLSPKWNEVYEALVYEHPGQELEIELFDEDPDKDDFLGSLMIDLIEVEKERLLDEWFTLDEVPKGKLHLRLEWLTLMPNASNLDKVLTDIKADKDQANDGLSSALLILYLDSARNLPSNPLEFNPDVLKKTAVQRALKSGKKISSNPNPVVQMSVGHKAQESKIRYKTNEPVWEENFTFFIHNPKRQDLEVEVRDEQHQCSLGNLKVPLSQLLTSEDMTVSQRFQLSNSGPNSTIKMKIALRVLHLEKRERPPDHQHSAQVKRPSVSKEGRKTSIKSHMSGSPGPGGSNTAPSTPVIGGSDKPGMEEKAQPPEAGPQGLHDLGRSSSSLLASPGHISVKEPTPSIASDISLPIATQELRQRLRQLENGTTLGQSPLGQIQLTIRHSSQRNKLIVVVHACRNLIAFSEDGSDPYVRMYLLPDKRRSGRRKTHVSKKTLNPVFDQSFDFSVSLPEVQRRTLDVAVKNSGGFLSKDKGLLGKVLVALASEELAKGWTQWYDLTEDGTRPQAMT

SEQ ID NO: 891955 - protein, 1048 aa, Homo sapiens; identical to SEQ ID NO: 891943

SEQ ID NO: 891956 - protein, 158 aa, Homo sapiens
MYEAGVESAEGQLENGTTLGQSPLGQIQLTIRHSSQRNKLIVVVHACRNLIAFSEDGSDPYVRMYLLPDKRRSGRRKTHVSKKTLNPVFDQSFDFSVSLPEVQRRTLDVAVKNSGGFLSKDKGLLGKVLVALASEELAKGWTQWYDLTEDGTRPQAMT

SEQ ID NO: 891957 - protein, 94 aa, Homo sapiens
LLLLLNSRPRRRKTHVSKKTLNPVFDQSFDFSVSLPEVQRRTLDVAVKNSGGFLSKDKGLLGKVLVALASEELAKGWTQWYDLTEDGTRPQAMT

SEQ ID NO: 891958 - protein, 890 aa, Homo sapiens; identical to SEQ ID NO: 891941

SEQ ID NO: 891959 - protein, 240 aa, Homo sapiens
PSRAEAGVRRSRVPSEGRWRGAEPPGISASTQPASAGRAARHCGAMSGARGEGPEAGAGGAGGRAAPENPGGVLSVELPGLLAQLARSFALLLPVYALGYLGLSFSWVLLALALLAWCRRSRGLKALRLCRALALLEDEERVVRLGVRACDLPAWVHFPDTERAEWLNKTVKHMWPFICQFIEKLFRETIEPAVRGANTHLSTFSFTKVDVGQQPLRINGVKVYTENVDKRQIILDLQIR

SEQ ID NO: 891960 - protein, 145 aa, Homo sapiens
MAPKGKVGTRGKKQIFEENRETLKFYLRIILGANAIYCLVTLVFFYSSASFWAWLALGFSLAVYGASYHSMSSMARAAFSEDGALMDGWHGPQHGQAWQSDVPHAAQHLKDVILLTAIVQCSAASLSMSGPSGFWLQAGPFTSCG

SEQ ID NO: 891961 - protein, 173 aa, Homo sapiens
MAPKGKVGTRGKKQIFEENRETLKFYLRIILGANAIYCLVTLVFFYSSASFWAWLALGFSLAVYGASYHSMSSMARAAFSEDGALMDGGMDLNMEQGMAEHLKDVILLTAIVQVLSCFSLYVWSFWLLAPGRALYLLWVNVLGPWFTADSGTPAPEHNEKRQRRQERRQMKRL

SEQ ID NO: 891962 - protein, 173 aa, Homo sapiens; identical to SEQ ID NO: 891961

SEQ ID NO: 891963 - protein, 173 aa, Homo sapiens; identical to SEQ ID NO: 891961

SEQ ID NO: 891964 - protein, 103 aa, Homo sapiens
MSSMARAAFSEDGALMDGGMDLNMEQGMAEHLKDVILLTAIVQVLSCFSLYVWSFWLLAPGRALYLLWVNVLGPWFTADSGTPAPEHNEKRQRRQERRQMKRL

SEQ ID NO: 891965 - protein, 103 aa, Homo sapiens; identical to SEQ ID NO: 891964

SEQ ID NO: 891966 - protein, 136 aa, Homo sapiens
TLTDSPNPPHLPLFWAWLALGFSLAVYGASYHSMSSMARAAFSEDGALMDGGMDLNMEQGMAEHLKDVILLTAIVQVLSCFSLYVWSFWLLAPGRALYLLWVNVLGPWFTADSGTPAPEHNEKRQRRQERRQMKRL

SEQ ID NO: 891967 - protein, 140 aa, Homo sapiens
MAPKGKVGTRGKKQIFEENRETLKFYLRIILGANAIYCLVTLVFFYSSASFWAWLALGFSLAVYGASYHSMSSMARAAFSEDGALMDGGMDLNMEQGMAEHLKDVILLTAIVQVLSCFSLYVWSFWLLVCGLGALPRRGI

SEQ ID NO: 891968 - protein, 173 aa, Homo sapiens; identical to SEQ ID NO: 891961

SEQ ID NO: 891969 - protein, 103 aa, Homo sapiens; identical to SEQ ID NO: 891964

SEQ ID NO: 891970 - protein, 103 aa, Homo sapiens; identical to SEQ ID NO: 891964

SEQ ID NO: 891971 - protein, 103 aa, Homo sapiens; identical to SEQ ID NO: 891964

SEQ ID NO: 891972 - protein, 173 aa, Homo sapiens; identical to SEQ ID NO: 891961

SEQ ID NO: 891973 - protein, 95 aa, Homo sapiens
VAKAGRLRSAPEVHELPMWCLVIAVSVALPCFPGWVFASHHGGFCTTGTWLSCGWSSIAHQAGGENEEDRGLLTASHHSSAAQGQSGHEREEADI

SEQ ID NO: 891974 - protein, 207 aa, Homo sapiens
MVAPVTGYSLGVRRAEIKPGVREIHLCKDERGKTGLRLRKVDQGLFVQLVQANTPASLVGLRFGDQLLQIDGRDCAGWSSHKAHQVVKKASGDKIVMVVRDRPFQRTVTMHKDSMGHVGFVIKKGKIVSLVKGSSAARNGLLTNHYVCEVDGQNVIGLKDKKIMEILATAGNVVTLTIIPSVIYEHMVKKLPPVLLHHTMDHSIPDA

SEQ ID NO: 891975 - protein, 292 aa, Homo sapiens [sequence omitted]

SEQ ID NO: 891976 - protein, 292 aa, Homo sapiens [sequence omitted]

SEQ ID NO: 891977 - protein, 94 aa, Homo sapiens
YSKLQSKGSPLGFGKPRKAQGVLTVARIIVNTGQQRGYSSIQNVCKDKKIMEILATAGNVVTLTIIPSVIYEHMVKKLPPVLLHHTMDHSIPDA

SEQ ID NO: 891978 - protein, 292 aa, Homo sapiens [sequence omitted]

SEQ ID NO: 891979 - protein, 292 aa, Homo sapiens [sequence omitted]

SEQ ID NO: 891980 - protein, 267 aa, Homo sapiens
MSSLYPSLEDLKVDQAIQAQVRASPKMPALPVQATAISPPPVLYPNLAELENYMGLSLSSQEVQESLLQIPEGDSTAVSGPGPGQMVAPVTGYSLGVRRAEIKGLFVQLVQANTPASLVGLRFGDQLLQIDGRDCAGWSSHKAHQVVKKASGDKIVMVVRDRPFQRTVTMHKDSMGHVGFVIKKGKIVSLVKGSSAARNGLLTNHYVCEVDGQNVIGLKDKKIMEILATAGNVVTLTIIPSVIYEHMVKKLPPVLLHHTMDHSIPDA

SEQ ID NO: 891981 - protein, 233 aa, Homo sapiens
MGEPQQVSALPPPPMQYIKEYTDENIQEGLAPKPPPPIKDSYMMFGNQFQCDDLIIRPLESQGIERLHPMQFDHKKELRKLNMSILINFLDLLDILIRSPGSIKREEKLEDLKLLFVHVHHLINEYRPHQARETLRVMMEVQKRQRLETAERFQKHLERVIEMIQNCLASLPDDLPHSEAGMRVKTEPMDADDSNNCTGQNEHQRENSGHRRDQIIEKDAALCVLIDEMNERP

SEQ ID NO: 891982 - protein, 233 aa, Homo sapiens; identical to SEQ ID NO: 891981

SEQ ID NO: 891983 - protein, 233 aa, Homo sapiens; identical to SEQ ID NO: 891981

SEQ ID NO: 891984 - protein, 233 aa, Homo sapiens; identical to SEQ ID NO: 891981

SEQ ID NO: 891985 - protein, 93 aa, Homo sapiens
AGNWGGMAEFGLQRRSFVFLSRVSPRVRSLRERGGLGVDSLEEGALSVAVSGLPPCWDAEPEWRLGDLASSPRAAVFLSCVALGESFALSGSL

SEQ ID NO: 891986 - protein, 233 aa, Homo sapiens; identical to SEQ ID NO: 891981

SEQ ID NO: 891987 - protein, 314 aa, Homo sapiens
MEDKRNIQIIEWEHLDKKKFYVFGVAMTMMIRVSVYPFTLIRTRLQVQKGKSLYHGTFDAFIKILRADGITGLYRGFLVNTFTLISGQCYVTTYELTRKFVADYSQSNTVKSLVAGGSASLVAQSITVPIDVVSQHLMMQRKGEKMGRFQVRGNPEGQGVVAFGQTKDIIRQILQADGLRGFYRGYVASLLTYIPNSAVWWPFYHFYAEQLSYLCPKECPHIVFQAVSGPLAAATASILTNPMDVIRTRVQVEGKNSIILTFRQLMAEEGPWGLMKGLSARIISATPSTIVIVVGYESLKKLSLRPELVDSRHW

SEQ ID NO: 891988 - protein, 314 aa, Homo sapiens; identical to SEQ ID NO: 891987

SEQ ID NO: 891989 - protein, 344 aa, Homo sapiens
HHSLISSSQDTKHCGRRQGPLPRKARSSGTMEDKRNIQIIEWEHLDKKKFYVFGVAMTMMIRVSVYPFTLIRTRLQVQKGKSLYHGTFDAFIKILRADGITGLYRGFLVNTFTLISGQCYVTTYELTRKFVADYSQSNTVKSLVAGGSASLVAQSITVPIDVVSQHLMMQRKGEKMGRFQVRGNPEGQGVVAFGQTKDIIRQILQADGLRGFYRGYVASLLTYIPNSAVWWPFYHFYAEQLSYLCPKECPHIVFQAVSGPLAAATASILTNPMDVIRTRVQVEGKNSIILTFRQLMAEEGPWGLMKGLSARIISATPSTIVIVVGYESLKKLSLRPELVDSRHW

SEQ ID NO: 891990 - protein, 143 aa, Homo sapiens
MRPADGIRWERRIDWGLRPRGPGLEFASDAASIEAMWLHCLPISQTVLSGGPSITSMQVEGKNSIILTFRQLMAEEGPWGLMKGLSARIISATPSTIVIVVGYESLKKLSLRPELVDSRHGSSSWAFSPDSKQLLSTLSPFIS

SEQ ID NO: 891991 - protein, 700 aa, Homo sapiens
MSISSVTSPPSLSKTEVVVYMLRVESMGSNVFCTLEFPRLFQGNYLALRWFFSVFLRASYLITEEDSALWPVPDFLTPFAGGRGGVRGVPCGVKAPLALSSILSSNADGRKYHKCSDCGSGEPERPAQETRNKMSQFVGGDQRHPAEGARPQVMPPQEAQEHQNGNSPFQPSGASQMSLSDVPFTCLKALLLPGSWFVHSILSSAWVSQTKRMIPGQSSDTRAQTEAESPDRRSCEAGVGSRGGHGARGIIEVRDNFWRRETEKEGLAKDQEGDSILIYERRLKWGLTEPDWVESSFGQVSVQEMRAENGPSEPSQKGKAQSSTLLLHIPPYCSNPRSSGTMEDKRNIQIIEWEHLDKKKFYVFGVAMTMMIRVSVYPFTLIRTRLQVQKGKSLYHGTFDAFIKILRADGITGLYRGFLVNTFTLISGQCYVTTYELTRKFVADYSQSNTVKSLVAGGSASLVAQSITVPIDVVSQHLMMQRKGEKMGRFQVRGNPEGQGVVAFGQTKDIIRQILQADGLRGFYRGYVASLLTYIPNSAVWWPFYHFYAEQLSYLCPKECPHIVFQAVSGPLAAATASILTNPMDVIRTRVQVEGKNSIILTFRQLMAEEGPWGLMKGLSARIISATPSTIVIVVGYESLKKLSLRPELVDSRHWYQWWGEKPAVFHTTVGQGQSGEDSTLSRCSHHTPSPALGQVAYLG

SEQ ID NO: 891992 - protein, 209 aa, Homo sapiens
MEDKRNIQIIEWEHLDKKKFYVFGVAMTMMIRVSVYPFTLIRTRLQVQKGKSLYHGTFDAFIKILRADGITGLYRGFLVNTFTLISGQCYVTTYELTRKFVADYSQSNTVKSLVAGGSASLVAQSITVPIDVVSQHLMMQRKGEKMGRFQVRGNPEGQGVVAFGQTKDIIRQILQADGLRGFYRGYVASLLTYIPNSAVWWPFYHFYAG

SEQ ID NO: 891993 - protein, 136 aa, Homo sapiens
WESHLVEAASTVRADRWCFVSLAIVFPWIPEQLSYLCPKECPHIVFQAVSGPLAAATASILTNPMDVIRTRVQVEGKNSIILTFRQLMAEEGPWGLMKGLSARIISATPSTIVIVVGYESLKKLSLRPELVDSRHW

SEQ ID NO: 891994 - protein, 237 aa, Homo sapiens
MEDKRNIQIIEWEHLDKKKFYVFGVAMTMMIRVSVYPFTLIRTRLQVQKGKSLYHGTFDAFIKILRADGITGLYRGFLVNTFTLISGQCYVTTYELTRKFVADYSQSNTVKSLVAGGSASLVAQSITVPIDVVSQHLMMQRKGEKMGRFQVRGNPEGQGVVAFGQTKDIIRQILQADGLRGFYRGYVASLLTYIPNSAVWWPFYHFYAGKQGPGQWGRKVGFLMGLRYCCFVHVRVE

SEQ ID NO: 891995 - protein, 118 aa, Homo sapiens
SLGGGTYKDWKLFLAPSLTPSSSPLSFSLGKQSWGLENEALIVRCPRQGKPSYTVDWYYSQTNKSIPTQERNRVFASGQLLKFLPAAVADSGIYTCIVRRYYAEGSHLLSPCSPFFSG

SEQ ID NO: 891996 - protein, 328 aa, Homo sapiens
MGFWILAILTILMYSTAAKFSKQSWGLENEALIVRCPRQGKPSYTVDWYYSQTNKSIPTQERNRVFASGQLLKFLPAAVADSGIYTCIVRSPTFNRTGYANVTIYKKQSDCNVPDYLMYSTVSGSEKNSKIYCPTIDLYNWTAPLEWFKNCQALQGSRYRAHKSFLVIDNVMTEDAGDYTCKFIHNENGANYSVTATRSFTVKDEQGFSLFPVIGAPAQNEIKEVEIGKNANLTCSACFGKGTQFLAAVLWQLNGTKITDFGEPRIQQEEGQNQSFSNGLACLDMVLRIADVKEEDLLLQYDCLALNLHGLRRHTVRLSRKNPSKECF

SEQ ID NO: 891997 - protein, 385 aa, Homo sapiens
MGFWILAILTILMYSTAAKFSKQSWGLENEALIVRCPRQGKPSYTVDWYYSQTNKSIPTQERNRVFASGQLLKFLPAAVADSGIYTCIVRSPTFNRTGYANVTIYKKQSDCNVPDYLMYSTVSGSEKNSKIYCPTIDLYNWTAPLEWFKNCQALQGSRYRAHKSFLVIDNVMTEDAGDYTCKFIHNENGANYSVTATRSFTVKVWCQSFCKLKKSLIFSNTHWIQSLMRGFVMVYYGVHKCCRVVFNLCLQYFSTSSMALNEQGFSLFPVIGAPAQNEIKEVEIGKNANLTCSACFGKGTQFLAAVLWQLNGTKITDFGEPRIQQEEGQNQSFSNGLACLDMVLRIADVKEEDLLLQYDCLALNLHGLRRHTVRLSRKNPSKECF

SEQ ID NO: 891998 - protein, 209 aa, Homo sapiens
MGFWILAILTILMYSTAAKFSKQSWGLENEALIVRCPRQGKPSYTVDWYYSQTNKSIPTQERNRVFASGQLLKFLPAAVADSGIYTCIVRSPTFNRTGYANVTIYKKQSDCNVPDYLMYSTVSGSEKNSKIYCPTIDLYNWTAPLEWFKNCQALQGSRYRAHKSFLVIDNVMTEDAGDYTCKFIHNENGANYSVTATRSFTVKDEQGKF

SEQ ID NO: 891999 - protein, 556 aa, Homo sapiens
MGFWILAILTILMYSTAAKFSKQSWGLENEALIVRCPRQGKPSYTVDWYYSQTNKSIPTQERNRVFASGQLLKFLPAAVADSGIYTCIVRSPTFNRTGYANVTIYKKQSDCNVPDYLMYSTVSGSEKNSKIYCPTIDLYNWTAPLEWFKNCQALQGSRYRAHKSFLVIDNVMTEDAGDYTCKFIHNENGANYSVTATRSFTVKDEQGFSLFPVIGAPAQNEIKEVEIGKNANLTCSACFGKGTQFLAAVLWQLNGTKITDFGEPRIQQEEGQNQSFSNGLACLDMVLRIADVKEEDLLLQYDCLALNLHGLRRHTVRLSRKNPIDHHSIYCIIAVCSVFLMLINVLVIILKMFWIEATLLWRDIAKPYKTRNDGKLYDAYVVYPRNYKSSTDGASRVEHFVHQILPDVLENKCGYTLCIYGRDMLPGEDVVTAVETNIRKSRRHIFILTPQITHNKEFAYEQEVALHCALIQNDAKVILIEMEALSELDMLQAEALQDSLQHLMKVQGTIKWREDHIANKRSLNSKFWKHVRYQMPVPSKIPRKASSLTPLAAQKQ

SEQ ID NO: 892000 - protein, 328 aa, Homo sapiens; identical to SEQ ID NO: 891996

SEQ ID NO: 892001 - protein, 556 aa, Homo sapiens; identical to SEQ ID NO: 891999

SEQ ID NO: 892002 - protein, 55 aa, Homo sapiens
RAHKSFLVIDNVMTEDAGDYTCKFIHNENGANYSVTATRSFTVKGKLLTLMRQNT

SEQ ID NO: 892003 - protein, 78 aa, Homo sapiens
MLGPNPVHKDLAAEPHTQEKVDKWATKGFLQARGGAGPPFLGQVWGGGSPERRLGKPGGREGNRGPGAAGGGTPPWGP

SEQ ID NO: 892004 - protein, 117 aa, Homo sapiens
MTVLEAVLEIQAITGSRLLSMVPGPARPPGSCWDPTQCTRTWLLSHTPRRRWISGLPRASCRLGEEPPPLPYCDQAYGEELSIRHRETWAWLSRTDTAWPGAPGVKQARILGELLLV

SEQ ID NO: 892005 - protein, 117 aa, Homo sapiens; identical to SEQ ID NO: 892004

SEQ ID NO: 892006 - protein, 117 aa, Homo sapiens; identical to SEQ ID NO: 892004

SEQ ID NO: 892007 - protein, 117 aa, Homo sapiens; identical to SEQ ID NO: 892004

SEQ ID NO: 892008 - protein, 117 aa, Homo sapiens; identical to SEQ ID NO: 892004

SEQ ID NO: 892009 - protein, 78 aa, Homo sapiens; identical to SEQ ID NO: 892003

SEQ ID NO: 892010 - protein, 120 aa, Homo sapiens
MTVLEAVLEIQAITGSRLLSMVPGPARPPGSCWDPTQCTRTWLLSHTPRRRWISGLPRASCRLGEERPIGQLWGVCTPGDLAVSENVAGPVGANGRPVGQKRGWGNSPWVAGPIGMARGR

SEQ ID NO: 892011 - protein, 117 aa, Homo sapiens; identical to SEQ ID NO: 892004

SEQ ID NO: 892012 - protein, 117 aa, Homo sapiens; identical to SEQ ID NO: 892004

SEQ ID NO: 892013 - protein, 117 aa, Homo sapiens; identical to SEQ ID NO: 892004

SEQ ID NO: 892014 - protein, 117 aa, Homo sapiens; identical to SEQ ID NO: 892004

SEQ ID NO: 892015 - protein, 117 aa, Homo sapiens; identical to SEQ ID NO: 892004

SEQ ID NO: 892016 - protein, 117 aa, Homo sapiens; identical to SEQ ID NO: 892004

SEQ ID NO: 892017 - protein, 120 aa, Homo sapiens; identical to SEQ ID NO: 892010

SEQ ID NO: 892018 - protein, 117 aa, Homo sapiens; identical to SEQ ID NO: 892004

SEQ ID NO: 892019 - protein, 117 aa, Homo sapiens; identical to SEQ ID NO: 892004

SEQ ID NO: 892020 - protein, 117 aa, Homo sapiens; identical to SEQ ID NO: 892004

SEQ ID NO: 892021 - protein, 117 aa, Homo sapiens; identical to SEQ ID NO: 892004

SEQ ID NO: 892022 - protein, 318 aa, Homo sapiens
MERGDQPKRTRNENIFNCLYKNPEATFKLICFPWMGGGSTHFAKWGQDTHDLLEETASHHVAKAGLKLRRSSDPPASAYPCAGVSHRRREPPCLAKILGLFWILIFFMHSLRLPGRESRVEEPLENDISQLVDEVVCALQPVIQDKPFAFFGHSMGSYIAFRTALGLKENNQPEPLHLFLSSATPVHSKAWHRIPKDDELSEEQISHYLMEFGGTPKHFAEAKEFVKQCSPIIRADLNIVRSCTSNVPSKAVLSCDLTCFVGSEDIAKDMEAWKDVTSGNAKIYQLPGGHFYLLDPANEKLIKNYIIKCLEVSSISNF

SEQ ID NO: 892023 - protein, 265 aa, Homo sapiens
MERGDQPKRTRNENIFNCLYKNPEATFKLICFPWMGGGSTHFAKWGQDTHDLLEVHSLRLPGRESRVEEPLENDISQLVDEVVCALQPVIQDKPFAFFGHSMGSYIAFRTALGLKENNQPEPLHLFLSSATPVHSKAWHRIPKDDELSEEQISHYLMEFGGTPKHFAEAKEFVKQCSPIIRADLNIVRSCTSNVPSKAVLSCDLTCFVGSEDIAKDMEAWKDVTSGNAKIYQLPGGHFYLLDPANEKLIKNYIIKCLEVSSISNF

SEQ ID NO: 892024 - protein, 265 aa, Homo sapiens; identical to SEQ ID NO: 892023

SEQ ID NO: 892025 - protein, 318 aa, Homo sapiens; identical to SEQ ID NO: 892022

SEQ ID NO: 892026 - protein, 160 aa, Homo sapiens
MERGDQPKRTRNENIFNCLYKNPEATFKLICFPWMGGGSTHFAKWGQDTHDLLEVHSLRLPGRESRVEEPLENDISQLVDEVVCALQPVIQDKPFAFFGHSMGSYIAFRTALGLKENNQPEPLHLFLSSATPVHACVVVHVSSQRPGIAFPKMMNCQKNK

SEQ ID NO: 892027 - protein, 116 aa, Homo sapiens
MERGDQPKRTRNENIFNCLYKNPEATFKLICFPWMGGGSTHFAKWGQDTHDLLEVHSLRLPGRESRVEEPLENDISQLVDEVVCALQPVIQDKPFAFFGHRYLISVLKDFRGVSSI

SEQ ID NO: 892028 - protein, 265 aa, Homo sapiens; identical to SEQ ID NO: 892023

SEQ ID NO: 892029 - protein, 286 aa, Homo sapiens
MERGDQPKRTRQATPCATRLFLHPRGSDTLPLNENIFNCLYKNPEATFKLICFPWMGGGSTHFAKWGQDTHDLLEVHSLRLPGRESRVEEPLENDISQLVDEVVCALQPVIQDKPFAFFGHSMGSYIAFRTALGLKENNQPEPLHLFLSSATPVHSKAWHRIPKDDELSEEQISHYLMEFGGTPKHFAEAKEFVKQCSPIIRADLNIVRSCTSNVPSKAVLSCDLTCFVGSEDIAKDMEAWKDVTSGNAKIYQLPGGHFYLLDPANEKLIKNYIIKCLEVSSISNF

SEQ ID NO: 892030 - protein, 196 aa, Homo sapiens
MERGDQPKRTRNENIFNCLYKNPEATFKLICFPWMGGGSTHFAKWGQDTHDLLEVHSLRLPGRESRVEEPLENDISQLVDEVVCALQPVIQDKPFAFFGHSMGSYIAFRTALGLKENNQPEPLHLFLSSATPVHSKAWHRIPKDDELSEEQISHYLMEFGGTPKHFAEAKEFVKQCSPIIRADLNIVRSCTVNNFL

SEQ ID NO: 892031 - protein, 237 aa, Homo sapiens
RAHPEVGAGQPARPGAMAAAATAAEGVPSRGPPGEVIHLNVGGKRFSTSRQTLTWIPDSFFSSLLSGRISTLKDETGAIFIDRDPTVFAPILNFLRTKELDPRGVHGSSLLHEAQFYGLTPLVRRLQLREELDRSSCGNVLFNGYLPPPVFPVKAGGTRAAGLGWGALKTDLREGNRGQGPPVGPGTGEAKTNRNWPTPDNLLWPQMARCLPGGAEIGLVHEERNPLHPSSPSRDES

SEQ ID NO: 892032 - protein, 118 aa, Homo sapiens
RAHPEVGAGQPARPGAMAAAATAAEGVPSRGPPGEVIHLNVGGKRFSTSRQTLTWIPDSFFSSLLSGRISTLKDETGAIFIDRDPTVFAPILNFLRTKELDPRLAWKKGRESLTVFSP

SEQ ID NO: 892033 - protein, 762 aa, Homo sapiens
RAHPEVGAGQPARPGAMAAAATAAEGVPSRGPPGEVIHLNVGGKRFSTSRQTLTWIPDSFFSSLLSGRISTLKDETGAVSRTRTEMGWGGRGLVGRGAGPHSVLPLTPSILCPPFPQIFIDRDPTVFAPILNFLRTKELDPRGVHGSSLLHEAQFYGLTPLVRRLQLREELDRSSCGNVLFNGYLPPPVFPVKRRNRHSLVGPQQLGGRPAPVRRSNTMPPNLGNAGLLGRMLDEKTPPSPSGQPEEPGMVRLVCGHHNWIAVAYTQFLVCYRLKEASGWQLVFSSPRLDWPIERLALTARVHGGALGEHDKMVAAATGSEILLWALQAEGGGSEIGVFHLGVPVEALFFVGNQLIATSHTGRIGVWNAVTKHWQVQEVQPITSYDAAGSFLLLGCNNGSIYYVDVQKFPLRMKDNDLLVSELYRDPAEDGVTALSVYLTPKTSDSGNWIEIAYGTSSGGVRVIVQHPETVGSGPQLFQTFTVHRSPVTKIMLSEKHLISVCADNNHVRTWSVTRFRGMISTQPGSTPLASFKILALESADGHGGCSAGNDIGPYGERDDQQVFIQKVVPSASQLFVRLSSTGQRVCSVRSVDGSPTTAFTVLECEGSRRLGSRPRRYLLTGQANGSLAMWDLTTAMDGLGQAPAGGLTEQELMEQLEHCELAPPAPSAPSWGCLPSPSPRISLTSLHSASSNTSLSGHRGSPSPPQAEARRRGGGSFVERCQELVRSGPDLRRPPTPAPWPSSGLGTPLTPPKMKLNETSF

SEQ ID NO: 892034 - protein, 734 aa, Homo sapiens
RAHPEVGAGQPARPGAMAAAATAAEGVPSRGPPGEVIHLNVGGKRFSTSRQTLTWIPDSFFSSLLSGRISTLKDETGAIFIDRDPTVFAPILNFLRTKELDPSTLTSSQFYYPGGVHGSSLLHEAQFYGLTPLVRRLQLREELDRSSCGNVLFNGYLPPPVFPVKRRNRHSLVGPQQLGGRPAPVRRSNTMPPNLGNAGLLGRMLDEKTPPSPSGQPEEPGMVRLVCGHHNWIAVAYTQFLVCYRLKEASGWQLVFSSPRLDWPIERLALTARVHGGALGEHDKMVAAATGSEILLWALQAEGGGSEIGVFHLGVPVEALFFVGNQLIATSHTGRIGVWNAVTKHWQVQEVQPITSYDAAGSFLLLGCNNGSIYYVDVQKFPLRMKDNDLLVSELYRDPAEDGVTALSVYLTPKTSDSGNWIEIAYGTSSGGVRVIVQHPETVGSGPQLFQTFTVHRSPVTKIMLSEKHLISVCADNNHVRTWSVTRFRGMISTQPGSTPLASFKILALESADGHGGCSAGNDIGPYGERDDQQVFIQKVVPSASQLFVRLSSTGQRVCSVRSVDGSPTTAFTVLECEGSRRLGSRPRRYLLTGQANGSLAMWDLTTAMDGLGQAPAGGLTEQELMEQLEHCELAPPAPSAPSWGCLPSPSPRISLTSLHSASSNTSLSGHRGSPSPPQAEARRRGGGSFVERCQELVRSGPDLRRPPTPAPWPSSGLGTPLTPPKMKLNETSF

SEQ ID NO: 892035 - protein, 723 aa, Homo sapiens
RAHPEVGAGQPARPGAMAAAATAAEGVPSRGPPGEVIHLNVGGKRFSTSRQTLTWIPDSFFSSLLSGRISTLKDETGAIFIDRDPTVFAPILNFLRTKELDPRGVHGSSLLHEAQFYGLTPLVRRLQLREELDRSSCGNVLFNGYLPPPVFPVKRRNRHSLVGPQQLGGRPAPVRRSNTMPPNLGNAGLLGRMLDEKTPPSPSGQPEEPGMVRLVCGHHNWIAVAYTQFLVCYRLKEASGWQLVFSSPRLDWPIERLALTARVHGGALGEHDKMVAAATGSEILLWALQAEGGGSEIGVFHLGVPVEALFFVGNQLIATSHTGRIGVWNAVTKHWQVQEVQPITSYDAAGSFLLLGCNNGSIYYVDVQKFPLRMKDNDLLVSELYRDPAEDGVTALSVYLTPKTSDSGNWIEIAYGTSSGGVRVIVQHPETVGSGPQLFQTFTVHRSPVTKIMLSEKHLISVCADNNHVRTWSVTRFRGMISTQPGSTPLASFKILALESADGHGGCSAGNDIGPYGERDDQQVFIQKVVPSASQLFVRLSSTGQRVCSVRSVDGSPTTAFTVLECEGSRRLGSRPRRYLLTGQANGSLAMWDLTTAMDGLGQAPAGGLTEQELMEQLEHCELAPPAPSAPSWGCLPSPSPRISLTSLHSASSNTSLSGHRGSPSPPQAEARRRGGGSFVERCQELVRSGPDLRRPPTPAPWPSSGLGTPLTPPKMKLNETSF

SEQ ID NO: 892036 - protein, 631 aa, Homo sapiens
RAHPEVGAGQPARPGAMAAAATAAEGVPSRGPPGEVIHLNVGGKRFSTSRQTLTWIPDSFFSSLLSGRISTLKDETGAIFIDRDPTVFAPILNFLRTKELDPRGVHGSSLLHEAQFYGLTPLVRRLQLREELDRSSCGNVLFNGYLPPPVFPVKRRNRHSLVGPQQLGGRPAPVRRSNTMPPNLGNAGLLGRMLDEKTPPSPSGQPEEPGMVRLVCGHHNWIAVAYTQFLVCYRLKEASGWQLVFSSPRLDWPIERLALTARVHGGALGEHDKMVAAATGSEILLWALQAEGGGSEIGVFHLGVPVEALFFVGNQLIATSHTGRIGVWNAVTKHWQVQEVQPITSYDAAGSFLLLGCNNGSIYYVDVQKFPLRMKDNDLLVSELYRDPAEDGVTALSVYLTPKTSDSGNWIEIAYGTSSGGVRVIVQHPETVGSGPQLFQTFTVHRSPVTKIMLSEKHLISVCADNNHVRTWSVTRFRGMISTQPGSTPLASFKILALESADGHGGCSAGNDIAGGLTEQELMEQLEHCELAPPAPSAPSWGCLPSPSPRISLTSLHSASSNTSLSGHRGSPSPPQAEARRRGGGSFVERCQELVRSGPDLRRPPTPAPWPSSGLGTPLTPPKMKLNETSF

SEQ ID NO: 892037 - protein, 400 aa, Homo sapiens
RSVIQPRLECNGAISAHYNLCLLGSSNSPDSASQVAGITGACHHAQLIFVFLVEAGFATLAKQVLNSWDSPLVVSQSAGITGDSGNWIEIAYGTSSGGVRVIVQHPETVGSGPQLFQTFTVHRSPVTKIMLSEKHLISVCADNNHVRTWSVTRFRGMISTQPGSTPLASFKILALESADGHGGCSAGNDIGPYGERDDQQVFIQKVVPSASQLFVRLSSTGQRVCSVRSVDGSPTTAFTVLECEGSRRLGSRPRRYLLTGQANGSLAMWDLTTAMDGLGQAPAGGLTEQELMEQLEHCELAPPAPSAPSWGCLPSPSPRISLTSLHSASSNTSLSGHRGSPSPPQAEARRRGGGSFVERCQELVRSGPDLRRPPTPAPWPSSGLGTPLTPPKMKLNETSF

SEQ ID NO: 892038 - protein, 352 aa, Homo sapiens
RAHPEVGAGQPARPGAMAAAATAAEGVPSRGPPGEVIHLNVGGKRFSTSRQTLTWIPDSFFSSLLSGRISTLKDETGAIFIDRDPTVFAPILNFLRTKELDPRGVHGSSLLHEAQFYGLTPLVRRLQLREELDRSSCGNVLFNGYLPPPVFPVKRRNRHSLVGPQQLGGRPAPVRRSNTMPPNLGNAGLLGRMLDEKTPPSPSGQPEEPGMVRLVCGHHNWIAVAYTQFLVCYRLKEASGWQLVFSSPRLDWPIERLALTARVHGGALGEHDKMVAAATGSEILLWALQAEGGGSEIGVFHLGVPVEALFFVGNQLIATSHTGRIGVWNAVTKHWQVRVLASLAAPFPVFQT

SEQ ID NO: 892039 - protein, 189 aa, Homo sapiens
ARVTTSPTAPPRVCSVRSVDGSPTTAFTVLECEGSRRLGSRPRRYLLTGQANGSLAMWDLTTAMDGLGQAPAGGLTEQELMEQLEHCELAPPAPSAPSWGCLPSPSPRISLTSLHSASSNTSLSGHRGSPSPPQAEARRRGGGSFVERCQELVRSGPDLRRPPTPAPWPSSGLGTPLTPPKMKLNETSF

SEQ ID NO: 892040 - protein, 52 aa, Homo sapiens
GPGSARRVECRHQALAVQEVQPITSYDAAGSFLLLGCNNGSIYYVDVQKFPL

SEQ ID NO: 892041 - protein, 723 aa, Homo sapiens; identical to SEQ ID NO: 892035

SEQ ID NO: 892042 - protein, 608 aa, Homo sapiens
CPTHGEINHRHILSACCVTATITMTVTLPLILTVVFPVKRRNRHSLVGPQQLGGRPAPVRRSNTMPPNLGNAGLLGRMLDEKTPPSPSGQPEEPGMVRLVCGHHNWIAVAYTQFLVCYRLKEASGWQLVFSSPRLDWPIERLALTARVHGGALGEHDKMVAAATGSEILLWALQAEGGGSEIGVFHLGVPVEALFFVGNQLIATSHTGRIGVWNAVTKHWQVQEVQPITSYDAAGSFLLLGCNNGSIYYVDVQKFPLRMKDNDLLVSELYRDPAEDGVTALSVYLTPKTSDSGNWIEIAYGTSSGGVRVIVQHPETVGSGPQLFQTFTVHRSPVTKIMLSEKHLISVCADNNHVRTWSVTRFRGMISTQPGSTPLASFKILALESADGHGGCSAGNDIGPYGERDDQQVFIQKVVPSASQLFVRLSSTGQRVCSVRSVDGSPTTAFTVLECEGSRRLGSRPRRYLLTGQANGSLAMWDLTTAMDGLGQAPAGGLTEQELMEQLEHCELAPPAPSAPSWGCLPSPSPRISLTSLHSASSNTSLSGHRGSPSPPQAEARRRGGGSFVERCQELVRSGPDLRRPPTPAPWPSSGLGTPLTPPKMKLNETSF

SEQ ID NO: 892043 - protein, 666 aa, Homo sapiens
RAHPEVGAGQPARPGAMAAAATAAEGVPSRGPPGEVIHLNVGGKRFSTSRQTLTWIPDSFFSSLLSGRISTLKDETGAIFIDRDPTVFAPILNFLRTKELDPRGVHGSSLLHEAQFYGLTPLVRRLQLREELDRSSCGNVLFNGYLPPPVFPVKRRNRHSLVGPQQLGGRPAPVRRSNTMPPNLGNAGLLGRMLDEKTPPSPSGQPEEPGMVRLVCGHHNWIAVAYTQFLVCYRLKEASGWQLVFSSPRLDWPIERLALTARVHGGALGEHDKMVAAATGSEILLWALQAEGGGSEIGVFHLGVPVEALFFVGNQLIATSHTGRIGVWNAVTKHWQVQEVQPITSYDAAGSFLLLGCNNGSIYYVDVQKFPLRMKDNDLLVSELYRDPAEDGVTALSVYLTPKTICADNNHVRTWSVTRFRGMISTQPGSTPLASFKILALESADGHGGCSAGNDIGPYGERDDQQVFIQKVVPSASQLFVRLSSTGQRVCSVRSVDGSPTTAFTVLECEGSRRLGSRPRRYLLTGQANGSLAMWDLTTAMDGLGQAPAGGLTEQELMEQLEHCELAPPAPSAPSWGCLPSPSPRISLTSLHSASSNTSLSGHRGSPSPPQAEARRRGGGSFVERCQELVRSGPDLRRPPTPAPWPSSGLGTPLTPPKMKLNETSF

SEQ ID NO: 892044 - protein, 524 aa, Homo sapiens
RAHPEVGAGQPARPGAMAAAATAAEGVPSRGPPGEVIHLNVGGKRFSTSRQTLTWIPDSFFSSLLSGRISTLKDETGAIFIDRDPTVFAPILNFLRTKELDPRGVHGSSLLHEAQFYGLTPLVRRLQLREELDRSSCGNVLFNGYLPPPVFPVKRRNRHSLVGPQQLGGRPAPVRRSNTMPPNLGNAGLLGRMLDEKTPPSPSGQPEEPGMVRLVCGHHNWIAVAYTQFLVCYRLKEASGWQLVFSSPRLDWPIERLALTARVHGGALGEHDKMVAAATGSEILLWALQAEGGGSEIGVFHLGVPVEALFFVGNQLIATSHTGRIGVWNAVTKHWQVQEVQPITSYDAAGSFLLLGCNNGSIYYVDVQKFPLRMKDNDLLVSELYRDPAEDGVTALSVYLTPKTSDSGNWIEIAYGTSSGGVRVIVQHPETVGSGPQLFQTFTVHRSPVTKIMLSEKHLISVCADNNHVRTWSVTRFRGMISTQPGSTPLASFKILALESADGHGGCSAGNDIGAYWLLAFPPH

SEQ ID NO: 892045 - protein, 130 aa, Homo sapiens
MLVAHTFGARRPEYCSSEQLVIVASLYHQVVSPCPYYELRILGPNNIQSARSATEAVLEITPPDSEFLMVIYWYLSSMDVQVEHHIKFIALVPMYICIHMRVAAQGFVVGAMTVGMGYSMYREFWAKPKP

SEQ ID NO: 892046 - protein, 78 aa, Homo sapiens
GIAGFAAIVAYGLYKLKSRGNTKMSIHLIHMRVAAQGFVVGAMTVGMGYSMYREFWAKPAIPTGTNGASLAFRMSFDP

SEQ ID NO: 892047 - protein, 109 aa, Homo sapiens
MSYTDSSVCPFLQYERTSGIHDSIPKSSRVHLSRLARLGDMLSANREATLSRHYCVLILTVARAKSRGNTKMSIHLIHMRVAAQGFVVGAMTVGMGYSMYREFWAKPKP

SEQ ID NO: 892048 - protein, 261 aa, Homo sapiens
PAHKPLQGAGPGGARSRSGRRPACSMSAPSATPIFAPGENCSPAWGAAPAAYDAADTHLRILGKPVMERWETPYMHALAAAASSKGGRVLEVGFGMAIAASKVQEAPIDEHWIIECNDGVFQRLRDWAPRQTHKVIPLKGLWEDVAPTLPDGHFDGILYDTYPLSEETWHTHQFNFIKNHAFRLLKPGGVLTYCNLTSWGELMKSKYSDITIMFEETQVPALLEAGFRRENIRTEVMALVPPADCRYYAFPQMITPLVTKG

SEQ ID NO: 892049 - protein, 236 aa, Homo sapiens
MSAPSATPIFAPGENCSPAWGAAPAAYDAADTHLRILGKPVMERWETPYMHALAAAASSKGGRVLEVGFGMAIAASKVQEAPIDEHWIIECNDGVFQRLRDWAPRQTHKVIPLKGLWEDVAPTLPDGHFDGILYDTYPLSEETWHTHQFNFIKNHAFRLLKPGGVLTYCNLTSWGELMKSKYSDITIMFEETQVPALLEAGFRRENIRTEVMALVPPADCRYYAFPQMITPLVTKG

SEQ ID NO: 892050 - protein, 261 aa, Homo sapiens; identical to SEQ ID NO: 892048

SEQ ID NO: 892051 - protein, 261 aa, Homo sapiens; identical to SEQ ID NO: 892048

SEQ ID NO: 892052 - protein, 269 aa, Homo sapiens
MSAPSATPIFAPGENCSPAWGAAPAAYDAADTHLRILGKPVMERWETPYMHALAAAASSKGGRVLEVGFGMAIAASKVQEAPIDEHWIIECNDGVFQRLRDWAPRQTHKVIPLKGLWEDVAPTLPDGHFDGILYDTYPLSEETWHTHQFNFIKNHAFRLLKPGGVLTYCNLTSWGELMKSKYSDITIMFEVRPPEVPHGSPGSDLGWGWEGAAGATLLPGEGPFLTPWVGWTVLVHLEIKVLCLAQWLPGAVAQVYNPSTVEGRGGQIA

SEQ ID NO: 892053 - protein, 121 aa, Homo sapiens
MSAPSATPIFAPGENCSPAWGAAPAAYDAADTHLRILGKPVMERWETPYMHALAAAASSKGGRVLEVGFGMAIAASKVQEAPIDEHWIIECNDGVFQRLRDWAPRQTQSSLKGLWRMCTTC

SEQ ID NO: 892054 - protein, 132 aa, Homo sapiens
MCSAGELLRGGDGGERDEDGDALAEREAAGTEWDPGASPRRRGQRPKESEQDVEDSQNHTGEPVGDDYKKMGTLFGELNKNLINMGFTRMYFGERIVEPVIVIFFWVMLWFLGLQALGLVAVLCLVIIYVQQ

SEQ ID NO: 892055 - protein, 205 aa, Homo sapiens
RVRLRPDGRGLGEPVTGGAGLVLQAPRPAGRAPAAPVSGGCGGSQAAFGRRRCLVRRGVVLRRLSGAVGVGCGMCSAGELLRGGDGGERDEDGDALAEREAAGTEWDPGASPRRRGQRPKESEQDVEDSQNHTGEPVGDDYKKMGTLFGELNKNLINMGFTRMYFGERIVEPVIVIFFWVMLWFLGLQALGLVAVLCLVIIYVQQ

SEQ ID NO: 892056 - protein, 197 aa, Homo sapiens
TASTPRGVARPGWYFRRPGRRGALRRLLSAAGAADPRAAFGRRRCLVRRGVVLRRLSGAVGVGCGMCSAGELLRGGDGGERDEDGDALAEREAAGTEWDPGASPRRRGQRPKESEQDVEDSQNHTGEPVGDDYKKMGTLFGELNKNLINMGFTRMYFGERIVEPVIVIFFWVMLWFLGLQALGLVAVLCLVIIYVQQ

SEQ ID NO: 892057 - protein, 205 aa, Homo sapiens; identical to SEQ ID NO: 892055

SEQ ID NO: 892058 - protein, 81 aa, Homo sapiens
AGAAPPRRPGVGRASDRRGRAGTSGAQAGGARSGGSCQRRVRRIPGQPSGGGAAWMLKTHRTTLVSRLEMTTRKWEHFLVN

SEQ ID NO: 892059 - protein, 162 aa, Homo sapiens
MGVCPGESQKRAGAAKGHQVKCQRQTCSASISPLPAPWLPHLHRPEALLTATGADGEAAGHRHAAAPPKAYSEQQGVQWPGWARVGGPAGQWRPPHDPIPLPRLPVTTELNSRAVWSHCCCWGHVGWQLLQVVLTREQQPGRPGTRSPTLGCGGGWALRGQI

SEQ ID NO: 892060 - protein, 284 aa, Homo sapiens
MGWGFVRVSPRRGLALLRDTKSSAKDRRAPPPSPLFLPPGCHTSTGLRPSSLPQELMERLQGIVTRPHHLRPIQSSKIASDHRAEFARCLEPLLLLGPRRVAAAASGANTLAGGLGPKALTGPHCPSPVGKMSGSPVQKPTLHRSISTKVLLAEGENTPFAEHCRHYEDSYRHLQAEMQSLKDQVQELHRDLTKHHSLIKAEIMGDVLHKSLQLDVQIASEHASLEGMRVVFQELFSFRFGRKPISEWLMSRRFMKVPDSWLLSEPSVPELTHILAEEEVRVGH

SEQ ID NO: 892061 - protein, 153 aa, Homo sapiens
MSGSPVQKPTLHRSISTKVLLAEGENTPFAEHCRHYEDSYRHLQAEMQSLKDQVQELHRDLTKHHSLIKAEIMGDVLHKSLQLDVQIASEHASLEGMRVVFQELFSFRFGRKPISEWLMSRRFMKVPDSWLLSEPSVPELTHILAEEEVRVGH

SEQ ID NO: 892062 - protein, 228 aa, Homo sapiens
MSGSPVQKPTLHRSISTKVLLAEGENTPFAEHCRHYEDSYRHLQAEMQSLKDQVQELHRDLTKHHSLIKAEIMGDVLHKSLQLDVQIASEHASLEGMRVVFQEAFLFQIWEEAYQRVANEQEIYEAQLHDLLQLRQENAYLTTITKQITPYVRSIAKVKERLEPRFQAPVDEQSESLQNTHDDSRNNAASARNNPGSVPEKREKTSEPKGNSWAPNGLSEEPLLKNMD

SEQ ID NO: 892063 - protein, 153 aa, Homo sapiens; identical to SEQ ID NO: 892061

SEQ ID NO: 892064 - protein, 288 aa, Homo sapiens
CVSRGPKTKRDWAHTSSVQHRSEHTTHSVLAPAAFRRTCSWPHILEPTPGTLKNRCGCPGEALPQPFQISWWLCCAPGGGEGCEIPEQSRGLPWEAGGGADFPTPCIHTGSLPRLAGGLGPKALTGPHCPSPVGKMSGSPVQKPTLHRSISTKVLLAEGENTPFAEHCRHYEDSYRHLQAEMQSLKDQVQELHRDLTKHHSLIKAEIMGDVLHKSLQLDVQIASEHASLEGMRVVFQELFSFRFGRKPISEWLMSRRFMKVPDSWLLSEPSVPELTHILAEEEVRVGH

SEQ ID NO: 892065 - protein, 39 aa, Homo sapiens
KASLSTGECARDVASEANRTTKETPGFSPLAPALGPWLG

SEQ ID NO: 892066 - protein, 150 aa, Homo sapiens
PPKAYSEQQGVQWPGWARVGGPAGQWRPPHDPIPLPRLPVTTELNSRAVWSHCCCWGHVGWQLLQVVLTREQQPGRPGTRSPTLGCGGGWALRGQIASKKPGATIPSSVLSSPPSQQGVWAQGMARASPLSRGTGSPGPEVHGRPGSELG

SEQ ID NO: 892067 - protein, 149 aa, Homo sapiens
AAAPPKAYSEQQGVQWPGWARVGGPAGQWRPPHDPIPLPRLPVTTELNSRAVWSHCCCWGHVGWQLLQVVLTREQQPGRPGTRSPTLGCGGGWALRGQIASKKPGATIPSSVLSSPPSQQGVWAQGMARASPLSRGTGSPGPEVHGRPG

SEQ ID NO: 892068 - protein, 579 aa, Homo sapiens
MNKLYIGNLSENAAPSDLESIFKDAKIPVSGPFLVKTGYAFVDCPDESWALKAIEALSGKIELHGKPIEVEHSVPKRQRIRKLQIRNIPPHLQWEVLDSLLVQYGVVESCEQVNTDSETAVVNVTYSSKDQARQALDKLNGFQLENFTLKVAYIPDEMAAQQNPLQQPRGRRGLGQRGSSRQGSPGSVSKQKPCDLPLRLLVPTQFVGAIIGKEGATIRNITKQTQSKIDVHRKENAGAAEKSITILSTPEGTSAACKSILEIMHKEAQDIKFTEEIPLKILAHNNFVGRLIGKEGRNLKKIEQDTDTKITISPLQELTLYNPERTITVKGNVETCAKAEEEIMKKIRESYENDIASMNLQAHLIPGLNLNALGLFPPTSGMPPPTSGPPSAMTPPYPQFEQSETETVHLFIPALSVGAIIGKQGQHIKQLSRFAGASIKIAPAEAPDAKVRMVIITGPPEAQFKAQGRIYGKIKEENFVSPKEEVKLEAHIRVPSFAAGRVIGKGGKTVNELQNLSSAEVVVPRDQTPDENDQVVVKITGHFYACQVAQRKIQEILTQVKQHQQQKALQSGPPQSRRK

SEQ ID NO: 892069 - protein, 134 aa, Homo sapiens [sequence omitted]

SEQ ID NO: 892070 - protein, 504 aa, Homo sapiens
MQYKCAKVLQVYVTFADHIQVLDSLLVQYGVVESCEQVNTDSETAVVNVTYSSKDQARQALDKLNGFQLENFTLKVAYIPDEMAAQQNPLQQPRGRRGLGQRGSSRQGSPGSVSKQKPCDLPLRLLVPTQFVGAIIGKEGATIRNITKQTQSKIDVHRKENAGAAEKSITILSTPEGTSAACKSILEIMHKEAQDIKFTEEIPLKILAHNNFVGRLIGKEGRNLKKIEQDTDTKITISPLQELTLYNPERTITVKGNVETCAKAEEEIMKKIRESYENDIASMNLQAHLIPGLNLNALGLFPPTSGMPPPTSGPPSAMTPPYPQFEQSETETVHLFIPALSVGAIIGKQGQHIKQLSRFAGASIKIAPAEAPDAKVRMVIITGPPEAQFKAQGRIYGKIKEENFVSPKEEVKLEAHIRVPSFAAGRVIGKGGKTVNELQNLSSAEVVVPRDQTPDENDQVVVKITGHFYACQVAQRKIQEILTQVKQHQQQKALQSGPPQSRRK

SEQ ID NO: 892071 - protein, 363 aa, Homo sapiens
MNKLYIGNLSENAAPSDLESIFKDAKIPVSGPFLVKTGYAFVDCPDESWALKAIEALSGKIELHGKPIEVEHSVPKRQRIRKLQIRNIPPHLQWEVLDSLLVQYGVVESCEQVNTDSETAVVNVTYSSKDQARQALDKLNGFQLENFTLKVAYIPDEMAAQQNPLQQPRGRRGLGQRGSSRQGSPGSVSKQKPCDLPLRLLVPTQFVGAIIGKEGATIRNITKQTQSKIDVHRKENAGAAEKSITILSTPEGTSAACKSILEIMHKEAQDIKFTEEIPLKILAHNNFVGRLIGKEGRNLKKIEQDTDTKITISPNQKRRLFICLSQLYQSVPSSASRASTSSSFLALLELQLRLLQRKHQMLK

SEQ ID NO: 892072 - protein, 491 aa, Homo sapiens
MNKLYIGNLSENAAPSDLESIFKDAKIPVSGPFLVKTGYAFVDCPDESWALKAIEALSGKIELHGKPIEVEHSVPKRQRIRKLQIRNIPPHLQWEVLDSLLVQYGVVESCEQVNTDSETAVVNVTYSSKDQARQALDKLNGFQLENFTLKVAYIPDEMAAQQNPLQQPRGRRGLGQRGSSRQGSPGSVSKQKPCDLPLRLLVPTQFVGAIIGKEGATIRNITKQTQSKIDVHRKENAGAAEKSITILSTPEGTSAACKSILEIMHKEAQDIKFTEEIPLKILAHNNFVGRLIGKEGRNLKKIEQDTDTKITISPLQELTLYNPERTITVKGNVETCAKAEEEIMKKIRESYENDIASMNLQAHLIPGLNLNALGLFPPTSGMPPPTSGPPSAMTPPYPQFEQSETETVHLFIPALSVGAIIGKQGQHIKQLSRFAGASIKIAPAEAPDAKVRMVIITGPPEAQFKQEILTQVKQHQQQKALQSGPPQSRRK

SEQ ID NO: 892073 - protein, 579 aa, Homo sapiens; identical to SEQ ID NO: 892068

SEQ ID NO: 892074 - protein, 144 aa, Homo sapiens
MNKLYIGNLSENAAPSDLESIFKDAKIPVSGPFLVKTGYAFVDCPDESWALKAIEALSGKIELHGKPIEVEHSVPKRQRIRKLQIRNIPPHLQWEEDGAALRSDLELCPSSTTFSLCDLVMGSLNRQGPADAVMPTDGRDLRMQ

SEQ ID NO: 892075 - protein, 579 aa, Homo sapiens; identical to SEQ ID NO: 892068

SEQ ID NO: 892076 - protein, 236 aa, Homo sapiens
MKKIRESYENDIASMNLQAHLIPGLNLNALGLFPPTSGMPPPTSGPPSAMTPPYPQFEQSETETVHLFIPALSVGAIIGKQGQHIKQLSRFAGASIKIAPAEAPDAKVRMVIITGPPEAQFKAQGRIYGKIKEENFVSPKEEVKLEAHIRVPSFAAGRVIGKGGKTVNELQNLSSAEVVVPRDQTPDENDQVVVKITGHFYACQVAQRKIQEILTQVKQHQQQKALQSGPPQSRRK

SEQ ID NO: 892077 - protein, 579 aa, Homo sapiens; identical to SEQ ID NO: 892068

SEQ ID NO: 892078 - protein, 101 aa, Homo sapiens
VWLFLHLSEPGFACPFHSTPSAPSALSWDCLLSVRPAPSPCPQNPRYSGLPSLPCSGLAPRPEQARPGLLRSWLAPYCLWQILQPAPMKHLPHAGSFRNKE

SEQ ID NO: 892079 - protein, 559 aa, Homo sapiens
MGSRIKQNPETTFEVYVEVAYPRTGGTLSDPEVQRQFPEDYSDQEVLQTLTKFCFPFYVDSLTVSQVGQNFTFVLTDIDSKQRFGFCRLSSGAKSCFCILSYLPWFEVFYKLLNILADYTTKRQENQWNELLETLHKLPIPDPGVSVHLSVHSYFTVPDTRELPSIPENRNLTEYFVAVDVNNMLHLYASMLYERRILIICSKLSTLTACIHGSAAMLYPMYWQHVYIPVLPPHLLDYCCAPMPYLIGIHLSLMEKVRNMALDDVVILNVDTNTLETPFDDLQSLPNDVISSLKNRLKKVSTTTGDGVARAFLKAQAAFFGSYRNALKIEPEEPITFCEEAFVSHYRSGAMRQFLQNATQLQLFKQFIDGRLDLLNSGEGFSDVFEEEINMGEYAGSDKLYHQWLSTVRKGSGAILNTVKTKANPAMKTVYKFAKDHAKMGIKEVKNRLKQKDIAENGCAPTPEEQLPKTAPSPLVEAKDPKLREDRRPITVHFGQVRPPRPHVVKRPKSNIAVEGRRTSVPSPEQNTIATPATLHILQKSITHFAAKFPTRGWTSSSH

SEQ ID NO: 892080 - protein, 227 aa, Homo sapiens
PGRSPKCPLIMFSDLPPWRICRFLFGLLWTLYPPPHPTLEEPITFCEEAFVSHYRSGAMRQFLQNATQLQLFKQFIDGRLDLLNSGEGFSDVFEEEINMGEYAGSDKLYHQWLSTVRKGSGAILNTVKTKANPAMKTVYKFAKDHAKMGIKEVKNRLKQKDIAENGCAPTPEEQLPKTAPSPLVEAKDPKLREDRRPITVHFGQTPWYLFCCLHHIPLRKGPLAPFY

SEQ ID NO: 892081 - protein, 1037 aa, Homo sapiens
MGSRIKQNPETTFEVYVEVAYPRTGGTLSDPEVQRQFPEDYSDQEVLQTLTKFCFPFYVDSLTVSQVGQNFTFVLTDIDSKQRFGFCRLSSGAKSCFCILSYLPWFEVFYKLLNILADYTTKRQENQWNELLETLHKLPIPDPGVSVHLSVHSYFTVPDTRELPSIPENRNLTEYFVAVDVNNMLHLYASMLYERRILIICSKLSTLTACIHGSAAMLYPMYWQHVYIPVLPPHLLDYCCAPMPYLIGIHLSLMEKVRNMALDDVVILNVDTNTLETPFDDLQSLPNDVISSLKNRLKKVSTTTGDGVARAFLKAQAAFFGSYRNALKIEPEEPITFCEEAFVSHYRSGAMRQFLQNATQLQLFKQFIDGRLDLLNSGEGFSDVFEEEINMGEYAGFLLRLNQSTEERFVQSSRTVPGMGTVCSSDKLYHQWLSTVRKGSGAILNTVKTKANPAMKTVYKFAKDHAKMGIKEVKNRLKQKDIAENGCAPTPEEQLPKTAPSPLVEAKDPKLREDRRPITVHFGQVRPPRPHVVKRPKSNIAVEGRRTSVPSPEQPQPYRTLRESDSAEGDEAESPEQQVRKSTGPVPAPPDRAASIDLLEDVFSNLDMEAALQPLGQAKSLEDLRAPKDLREQPGTFDYQRLDLGGSERSRGVTVALKLTHPYNKLWSLGQDDMAIPSKPPAASPEKPSALLGNSLALPRRPQNRDSILNPSDKEEVPTPTLGSITIPRPQGRKTPELGIVPPPPIPRPAKLQAAGAALGDVSERLQTDRDRRAALSPGLLPGVVPQGPTELLQPLSPGPGAAGTSSDALLALLDPLSTAWSGSTLPSRPATPNVATPFTPQFSFPPAGTPTPFPQPPLNPFVPSMPAAPPTLPLVSTPAGPFGAPPASLGPAFASGLLLSSAGFCAPHRSQPNLSALSMPNLFGQMPMGTHTSPLQPLGPPAVAPSRIRTLPLARSSARAAETKQGLALRPGDPPLLPPRPPQGLEPTLQPSAPQQARDPFEDLLQKTKQDVSPSPALAPAPDSVEQLRKQWETFE

SEQ ID NO: 892082 - protein, 1099 aa, Homo sapiens
RRAPGTRAGDHGVRRAGASTLTPGGGGGGEGASLERAGPSLREGRKGRGERQREAGRPRAGGQRSAERGPRAHEEAWGPWAPGSSRIQRPHLKYMLKWPIPGQVALFQLLQIQIQLCSAFMCSLTVSQVGQNFTFVLTDIDSKQRFGFCRLSSGAKSCFCILSYLPWFEVFYKLLNILADYTTKRQENQWNELLETLHKLPIPDPGVSVHLSVHSYFTVPDTRELPSIPENRNLTEYFVAVDVNNMLHLYASMLYERRILIICSKLSTLTACIHGSAAMLYPMYWQHVYIPVLPPHLLDYCCAPMPYLIGIHLSLMEKVRNMALDDVVILNVDTNTLETPFDDLQSLPNDVISSLKNRLKKVSTTTGDGVARAFLKAQAAFFGSYRNALKIEPEEPITFCEEAFVSHYRSGAMRQFLQNATQLQLFKQFIDGRLDLLNSGEGFSDVFEEEINMGEYAGFLLRLNQSTEERFVQSSRTVPGMGTVCSSDKLYHQWLSTVRKGSGAILNTVKTKANPAMKTVYKFAKDHAKMGIKEVKNRLKQKDIAENGCAPTPEEQLPKTAPSPLVEAKDPKLREDRRPITVHFGQVRPPRPHVVKRPKSNIAVEGRRTSVPSPEQPQPYRTLRESDSAEGDEAESPEQQVRKSTGPVPAPPDRAASIDLLEDVFSNLDMEAALQPLGQAKSLEDLRAPKDLREQPGTFDYQRLDLGGSERSRGVTVALKLTHPYNKLWSLGQDDMAIPSKPPAASPEKPSALLGNSLALPRRPQNRDSILNPSDKEEVPTPTLGSITIPRPQGRKTPELGIVPPPPIPRPAKLQAAGAALGDVSERLQTDRDRRAALSPGLLPGVVPQGPTELLQPLSPGPGAAGTSSDALLALLDPLSTAWSGSTLPSRPATPNVATPFTPQFSFPPAGTPTPFPQPPLNPFVPSMPAAPPTLPLVSTPAGPFGAPPASLGPAFASGLLLSSAGFCAPHRSQPNLSALSMPNLFGQMPMGTHTSPLQPLGPPAVAPSRIRTLPLARSSARAAETKQGLALRPGDPPLLPPRPPQGLEPTLQPSAPQQARDPFEDLLQKTKQDVSPSPALAPAPDSVEQLRKQWETFE

SEQ ID NO: 892083 - protein, 1059 aa, Homo sapiens
RRAPGTRAGDHGVRRAGASTLTPGGGGGGEGASLERAGPSLREGRKGRGERQREAGRPRAGGQRSAERGPRAHEEAWGPWAPGSSRIQRPHLKYMLKWPIPGQVALFQILRCRGNSRRTTVTSYLPWFEVFYKLLNILADYTTKRQENQWNELLETLHKLPIPDPGVSVHLSVHSYFTVPDTRELPSIPENRNLTEYFVAVDVNNMLHLYASMLYERRILIICSKLSTLTACIHGSAAMLYPMYWQHVYIPVLPPHLLDYCCAPMPYLIGIHLSLMEKVRNMALDDVVILNVDTNTLETPFDDLQSLPNDVISSLKNRLKKVSTTTGDGVARAFLKAQAAFFGSYRNALKIEPEEPITFCEEAFVSHYRSGAMRQFLQNATQLQLFKQFIDGRLDLLNSGEGFSDVFEEEINMGEYAGFLLRLNQSTEERFVQSSRTVPGMGTVCSSDKLYHQWLSTVRKGSGAILNTVKTKANPAMKTVYKFAKDHAKMGIKEVKNRLKQKDIAENGCAPTPEEQLPKTAPSPLVEAKDPKLREDRRPITVHFGQVRPPRPHVVKRPKSNIAVEGRRTSVPSPEQPQPYRTLRESDSAEGDEAESPEQQVRKSTGPVPAPPDRAASIDLLEDVFSNLDMEAALQPLGQAKSLEDLRAPKDLREQPGTFDYQRLDLGGSERSRGVTVALKLTHPYNKLWSLGQDDMAIPSKPPAASPEKPSALLGNSLALPRRPQNRDSILNPSDKEEVPTPTLGSITIPRPQGRKTPELGIVPPPPIPRPAKLQAAGAALGDVSERLQTDRDRRAALSPGLLPGVVPQGPTELLQPLSPGPGAAGTSSDALLALLDPLSTAWSGSTLPSRPATPNVATPFTPQFSFPPAGTPTPFPQPPLNPFVPSMPAAPPTLPLVSTPAGPFGAPPASLGPAFASGLLLSSAGFCAPHRSQPNLSALSMPNLFGQMPMGTHTSPLQPLGPPAVAPSRIRTLPLARSSARAAETKQGLALRPGDPPLLPPRPPQGLEPTLQPSAPQQARDPFEDLLQKTKQDVSPSPALAPAPDSVEQLRKQWETFE

SEQ ID NO: 892084 - protein, 1037 aa, Homo sapiens; identical to SEQ ID NO: 892081

SEQ ID NO: 892085 - protein, 888 aa, Homo sapiens
MGSRIKQNPETTFEVYVEVAYPRTGGTLSDPEVQRQFPEDYSDQEVLQTLTKFCFPFYVDSLTVSQVGQNFTFVLTDIDSKQRFGFCRLSSGAKSCFCILSYLPWFEVFYKLLNILADYTTKRQENQWNELLETLHKLPIPDPGVSVHLSVHSYFTVPDTRELPSIPENRNLTEYFVAVDVNNMLHLYASMLYERRILIICSKLSTLTACIHGSAAMLYPMYWQHVYIPVLPPHLLDYCCAPMPYLIGIHLSLMEKVRNMALDDVVILNVDTNTLETPFDDLQSLPNDVISSLKNRLKKVSTTTGDGVARAFLKAQAAFFGSYRNALKIEPEEPITFCEEAFVSHYRSGAMRQFLQNATQLQLFKQFIDGRLDLLNSGEGFSDVFEEEINMGEYAGFLLRLNQSTEERFVQSSRTVPGMGTVCSSDKLYHQWLSTVRKGSGAILNTVKTKANPAMKTVYKFAKDHAKMGIKEVKNRLKQKDIAENGCAPTPEEQLPKTAPSPLVEAKDPKLREDRRPITVHFGQVRPPRPHVVKRPKSNIAVEGRRTSVPSPEQPQPYRTLRESDSAEGDEAESPEQQVRKSTGPVPAPPDRAASIDLLEDVFSNLDMEAALQPLGQAKSLEDLRAPKDLREQPGTFDYQRLDLGGSERSRGVTVALKLTHPYNKLWSLGQDDMAIPSKPPAASPEKPSALLGNSLALPRRPQNRDSILNPSDKEEVPTPTLGSITIPRPQGRKTPELGIVPPPPIPRPAKLQAAGAALGDVSERLQTDRDRRAALSPGLLPGVVPQGPTELLQPLSPGPGAAGTSSDALLALLDPLSTAWSGSTLPSRPATPNVATPFTPQFSFPPAGTPTPFPQPPLNPFVPSMPAAPPTLPLAVLRGWGERSMFT

SEQ ID NO: 892086 - protein, 888 aa, Homo sapiens; identical to SEQ ID NO: 892085

SEQ ID NO: 892087 - protein, 530 aa, Homo sapiens
MGSRIKQNPETTFEVYVEVAYPRTGGTLSDPEVQRQFPEDYSDQEVLQTLTKFCFPFYVDSLTVSQVGQNFTFVLTDIDSKQRFGFCRLSSGAKSCFCILSYLPWFEVFYKLLNILADYTTKRQENQWNELLETLHKLPIPDPGVSVHLSVHSYFTVPDTRELPSIPENRNLTEYFVAVDVNNMLHLYASMLYERRILIICSKLSTLTACIHGSAAMLYPMYWQHVYIPVLPPHLLDYCCAPMPYLIGIHLSLMEKVRNMALDDVVILNVDTNTLETPFDDLQSLPNDVISSLKNRLKKVSTTTGDGVARAFLKAQAAFFGSYRNALKIEPEEPITFCEEAFVSHYRSGAMRQFLQNATQLQLFKQFIDGRLDLLNSGEGFSDVFEEEINMGEYAGFLLRLNQSTEERFVQSSRTVPGMGTVCSSDKLYHQWLSTVRKGSGAILNTVKTKANPAMKTVYKFAKDHAKMGIKEVKNRLKQKDIAENGCAPTPEEQLPKTAPSPLVEAKDPKLREDRRPITVHFGQANFQKF

SEQ ID NO: 892088 - protein, 483 aa, Homo sapiens
MGSRIKQNPETTFEVYVEVAYPRTGGTLSDPEVQRQFPEDYSDQEVLQTLTKFCFPFYVDSLTVSQVGQNFTFVLTDIDSKQRFGFCRLSSGAKSCFCILSYLPWFEVFYKLLNILADYTTKRQENQWNELLETLHKLPIPDPGVSVHLSVHSYFTVPDTRELPSIPENRNLTEYFVAVDVNNMLHLYASMLYERRILIICSKLSTLTACIHGSAAMLYPMYWQHVYIPVLPPHLLDYCCAPMPYLIGIHLSLMEKVRNMALDDVVILNVDTNTLETPFDDLQSLPNDVISSLKNRLKKVSTTTGDGVARAFLKAQAAFFGSYRNALKIEPEEPITFCEEAFVSHYRSGAMRQFLQNATQLQLFKQFIDGRLDLLNSGEGFSDVFEEEINMGEYAGSDKLYHQWLSTVRKGSGAILNTVKTKANPAMKTVYKFDIAENGCAPTPEEQLPKTAPSPLVEAKDPKLREDRRPITVHFGQANFQKF

SEQ ID NO: 892089 - protein, 296 aa, Homo sapiens
MGSRIKQNPETTFEVYVEVAYPRTGGTLSDPEVQRQFPEDYSDQEVLQTLTKFCFPFYVDSLTVSQVGQNFTFVLTDIDSKQRFGFCRLSSGAKSCFCILSYLPWFEVFYKLLNILADYTTKRQENQWNELLETLHKLPIPDPGVSVHLSVHSYFTVPDTRELPSIPENRNLTEYFVAVDVNNMLHLYASMLYERRILIICSKLSTLTACIHGSAAMLYPMYWQHVYIPVLPPHLLDYCCAPMPYLIGIHLSLMEKVRNMALDDVVILNVDTNTLETPFDDLQSLPNDVEESIVIQ

SEQ ID NO: 892090 - protein, 633 aa, Homo sapiens
SSSSPGSTSNENHQGEYAEKMTKCTIRWLSTVRKGSGAILNTVKTKANPAMKTVYKFAKDHAKMGIKEVKNRLKQKDIAENGCAPTPEEQLPKTAPSPLVEAKDPKLREDRRPITVHFGQVRPPRPHVVKRPKSNIAVEGRRTSVPSPEQPQPYRTLRESDSAEGDEAESPEQQVRKSTGPVPAPPDRAASIDLLEDVFSNLDMEAALQPLGQAKSLEDLRAPKDLREQPGTFDYQRLDLGGSERSRGVTVALKLTHPYNKLWSLGQDDMAIPSKPPAASPEKPSALLGNSLALPRRPQNRDSILNPSDKEEVPTPTLGSITIPRPQGRKTPELGIVPPPPIPRPAKLQAAGAALGDVSERLQTDRDRRAALSPGLLPGVVPQGPTELLQPLSPGPGAAGTSSDALLALLDPLSTAWSGSTLPSRPATPNVATPFTPQFSFPPAGTPTPFPQPPLNPFVPSMPAAPPTLPLVSTPAGPFGAPPASLGPAFASGLLLSSAGFCAPHRSQPNLSALSMPNLFGQMPMGTHTSPLQPLGPPAVAPSRIRTLPLARSSARAAETKQGLALRPGDPPLLPPRPPQGLEPTLQPSAPQQARDPFEDLLQKTKQDVSPSPALAPAPDSVEQLRKQWETFE

SEQ ID NO: 892091 - protein, 1037 aa, Homo sapiens; identical to SEQ ID NO: 892081

SEQ ID NO: 892092 - protein, 854 aa, Homo sapiens
MLHLYASMLYERRILIICSKLSTLTACIHGSAAMLYPMYWQHVYIPVLPPHLLDYCCAPMPYLIGIHLSLMEKVRNMALDDVVILNVDTNTLETPFDDLQSLPNDVISSLKNRLKKVSTTTGDGVARAFLKAQAAFFGSYRNALKIEPEEPITFCEEAFVSHYRSGAMRQFLQNATQLQLFKQFIDGRLDLLNSGEGFSDVFEEEINMGEYAGFLLRLNQSTEERFVQSSRTVPGMGTVCSSDKLYHQWLSTVRKGSGAILNTVKTKANPAMKTVYKFAKDHAKMGIKEVKNRLKQKDIAENGCAPTPEEQLPKTAPSPLVEAKDPKLREDRRPITVHFGQVRPPRPHVVKRPKSNIAVEGRRTSVPSPEQPQPYRTLRESDSAEGDEAESPEQQVRKSTGPVPAPPDRAASIDLLEDVFSNLDMEAALQPLGQAKSLEDLRAPKDLREQPGTFDYQRLDLGGSERSRGVTVALKLTHPYNKLWSLGQDDMAIPSKPPAASPEKPSALLGNSLALPRRPQNRDSILNPSDKEEVPTPTLGSITIPRPQGRKTPELGIVPPPPIPRPAKLQAAGAALGDVSERLQTDRDRRAALSPGLLPGVVPQGPTELLQPLSPGPGAAGTSSDALLALLDPLSTAWSGSTLPSRPATPNVATPFTPQFSFPPAGTPTPFPQPPLNPFVPSMPAAPPTLPLVSTPAGPFGAPPASLGPAFASGLLLSSAGFCAPHRSQPNLSALSMPNLFGQMPMGTHTSPLQPLGPPAVAPSRIRTLPLARSSARAAETKQGLALRPGDPPLLPPRPPQGLEPTLQPSAPQQARDPFEDLLQKTKQDVSPSPALAPAPDSVEQLRKQWETFE

SEQ ID NO: 892093 - protein, 1037 aa, Homo sapiens; identical to SEQ ID NO: 892081

SEQ ID NO: 892094 - protein, 1037 aa, Homo sapiens; identical to SEQ ID NO: 892081

SEQ ID NO: 892095 - protein, 559 aa, Homo sapiens; identical to SEQ ID NO: 892079

SEQ ID NO: 892096 - protein, 855 aa, Homo sapiens
MGSRIKQNPETTFEVYVEVAYPRTGGTLSDPEVQRQFPEDYSDQEVLQTLTKFCFPFYVDSLTVSQVGQNFTFVLTDIDSKQRFGFCRLSSGAKSCFCILSYLPWFEVFYKLLNILADYTTKRQENQWNELLETLHKLPIPDPGVSVHLSVHSYFTVPDTRELPSIPENRNLTEYFVAVDVNNMLHLYASMLYERRILIICSKLSTLTACIHGSAAMLYPMYWQHVYIPVLPPHLLDYCCAPMPYLIGIHLSLMEKVRNMALDDVVILNVDTNTLETPFDDLQSLPNDVISSLKNRLKKVSTTTGDGVARAFLKAQAAFFGSYRNALKIEPEEPITFCEEAFVSHYRSGAMRQFLQNATQLQLFKQFIDGRLDLLNSGEGFSDVFEEEINMGEYAGFLLRLNQSTEERFVQSSRTVPGMGTVCSSDKLYHQWLSTVRKGSGAILNTVKTKANPAMKTVYKFAKDHAKMGIKEVKNRLKQKDIAENGCAPTPEEQLPKTAPSPLVEAKDPKLREDRRPITVHFGQVRPPRPHVVKRPKSNIAVEGRRTSVPSPEQPQPYRTLRESDSAEGDEAESPEQQVRKSTGPVPAPPDRAASIDLLEDVFSNLDMEAALQPLGQAKSLEDLRAPKDLREQPGTFDYQRLDLGGSERSRGVTVALKLTHPYNKLWSLGQDDMAIPSKPPAASPEKPSALLGNSLALPRRPQNRDSILNPSDKEEVPTPTLGSITIPRPQGRKTPELGIVPPPPIPRPAKLQAAGAALGDVSERLQTDRDRRAALSPGLLPGVVPQGPTELLQPLSPGPGAAGTSSDALLALLDPLSTAWSGSTLPVRGWAILIGSSRYIFVSRFDVLCVFLTF

SEQ ID NO: 892097 - protein, 525 aa, Homo sapiens
MGSRIKQNPETTFEVYVEVAYPRTGGTLSDPEVQRQFPEDYSDQEVLQTLTKFCFPFYVDSLTVSQVGQNFTFVLTDIDSKQRFGFCRLSSGAKSCFCILSYLPWFEVFYKLLNILADYTTKRQENQWNELLETLHKLPIPDPGVSVHLSVHSYFTVPDTRELPSIPENRNLTEYFVAVDVNNMLHLYASMLYERRILIICSKLSTLTACIHGSAAMLYPMYWQHVYIPVLPPHLLDYCCAPMPYLIGIHLSLMEKVRNMALDDVVILNVDTNTLETPFDDLQSLPNDVISSLKNRLKKVSTTTGDGVARAFLKAQAAFFGSYRNALKIEPEEPITFCEEAFVSHYRSGAMRQFLQNATQLQLFKQFIDGRLDLLNSGEGFSDVFEEEINMGEYAGSDKLYHQWLSTVRKGSGAILNTVKTKANPAMKTVYKFAKDHAKMGIKEVKNRLKQKDIAENGCAPTPEEQLPKTAPSPLVEAKDPKLREDRRPITVHFGQLQRLRPPNAPRYSARAVRHSSPVVETKSN

SEQ ID NO: 892098 - protein, 240 aa, Homo sapiens
MGSRIKQNPETTFEVYVEVAYPRTGGTLSDPEVQRQFPEDYSDQEVLQTLTKFCFPFYVDSLTVSQVGQNFTFVLTDIDSKQRFGFCRLSSGAKSCFCILSYLPWFEVFYKLLNILADYTTKRQENQWNELLETLHKLPIPDPGVSVHLSVHSYFTVPDTRELPSIPENRNLTEYFVAVDVNNMLHLYASMLYERRILIICSKLSTLTACIHGSAAMLYPMYWQHVYIPVLPPHLLDYCW

SEQ ID NO: 892099 - protein, 970 aa, Homo sapiens
MLCFLDDGAGMDPSDAASVIQFGKSAKRTPESTQIGQYGNGLKSGSMRIGKDFILFTKKEDTMTCLFLSRTFHEEEGIDEVIVPLPTWNARTREPVTDNVEKFAIETELIYKYSPFRTEEEVMTQFMKIPGDSGTLVIIFNLKLMDNGEPELDIISNPRDIQMAETSPEGTKPERRSFRAYAAVLYIDPRMRIFIHGHKVQTKRLSCCLYKPRMYKYTSSRFKTRAEQEVKKAEHVARIAEEKAREAESKARTLEVRLGGDLTRDSRVMLRQVQNRAITLRREADVKKRIKEAKQRALKEPKELNFVFGVNIEHRDLDGMFIYNCSRLIKMYEKVGPQLEGGMACGGVVGVVDVPYLVLEPTHNKQDFADAKEYRHLLRAMGEHLAQYWKDIAIAQRGIIKFWDEFGYLSANWNQPPSSELRYKRRRAMEIPTTIQCDLCLKWRTLPFQLSSVEKDYPDTWVCSMNPDPEQDRCEASEQKQKVPLGTFRKDMKTQEEKQKQLTEKIRQQQEKLEALQKTTPIRSQADLKKLPLEVTTRPSTEEPVRRPQRPRSPPLPAVIRNAPSRPPSLPTPRPASQPRKAPVISSTPKLPALAAREEASTSRLLQPPEAPRKPANTLVKTASRPAPLVQQLSPSLLPNSKSPREVPSPKVIKTPVVKKTESPIKLSPATPSRKRSVAVSDEEEVEEEAERRKERCKRGRFVVKEEKKDSNELSDSAGEEDSADLKRAQKDKGLHVEVRVNREWYTGRVTAVEVGKHVVRWKVKFDYVPTDTTPRDRWVEKGSEDVRLMKPPSPEHQSLDTQQEGGEEEVGPVAQQAIAVAEPSTSECLRIEPDTTALSTNHETIDLLVQILRNCLRYFLPPSFPISKKQLSAMNSDELISFPLKEYFKQYEVGLQNLCNSYQSRADSRAKASEESLRTSERKLRETEEKLQKLRTNIVALLQKVQEDIDINTDDELDAYIEDLITKGD

SEQ ID NO: 892100 - protein, 123 aa, Homo sapiens
PQEKVFHDSEFNPLTIGNLPSRAKNWAKGLVRVNIFSLKEYFKQYEVGLQNLCNSYQSRADSRAKASEESLRTSERKLRETEEKLQKLRTNIVALLQKVQEDIDINTDDELDAYIEDLITKGD

SEQ ID NO: 892101 - protein, 124 aa, Homo sapiens
RGSPIKLSPATPSQTRHQEDRWVEKGSEDVRLMKPPSPEHQSLDTQQEGGEEEVGPVAQQAIAVAEPSTSECLRIEPDTTALSTNHETIDLLVQILRNCLRYFLPPSFPISKKAAPLPTCPSTL

SEQ ID NO: 892102 - protein, 994 aa, Homo sapiens
MQEMLDATRIDIYAERREDLRGGFMLCFLDDGAGMDPSDAASVIQFGKSAKRTPESTQIGQYGNGLKSGSMRIGKDFILFTKKEDTMTCLFLSRTFHEEEGIDEVIVPLPTWNARTREPVTDNVEKFAIETELIYKYSPFRTEEEVMTQFMKIPGDSGTLVIIFNLKLMDNGEPELDIISNPRDIQMAETSPEGTKPERRSFRAYAAVLYIDPRMRIFIHGHKVQTKRLSCCLYKPRMYKYTSSRFKTRAEQEVKKAEHVARIAEEKAREAESKARTLEVRLGGDLTRDSRVMLRQVQNRAITLRREADVKKRIKEAKQRALKEPKELNFVFGVNIEHRDLDGMFIYNCSRLIKMYEKVGPQLEGGMACGGVVGVVDVPYLVLEPTHNKQDFADAKEYRHLLRAMGEHLAQYWKDIAIAQRGIIKFWDEFGYLSANWNQPPSSELRYKRRRAMEIPTTIQCDLCLKWRTLPFQLSSVEKDYPDTWVCSMNPDPEQDRCEASEQKQKVPLGTFRKDMKTQEEKQKQLTEKIRQQQEKLEALQKTTPIRSQADLKKLPLEVTTRPSTEEPVRRPQRPRSPPLPAVIRNAPSRPPSLPTPRPASQPRKAPVISSTPKLPALAAREEASTSRLLQPPEAPRKPANTLVKTASRPAPLVQQLSPSLLPNSKSPREVPSPKVIKTPVVKKTESPIKLSPATPSRKRSVAVSDEEEVEEEAERRKERCKRGRFVVKEEKKDSNELSDSAGEEDSADLKRAQKDKGLHVEVRVNREWYTGRVTAVEVGKHVVRWKVKFDYVPTDTTPRDRWVEKGSEDVRLMKPPSPEHQSLDTQQEGGEEEVGPVAQQAIAVAEPSTSECLRIEPDTTALSTNHETIDLLVQILRNCLRYFLPPSFPISKKQLSAMNSDELISFPLKEYFKQYEVGLQNLCNSYQSRADSRAKASEESLRTSERKLRETEEKLQKLRTNIVALLQKVQEDIDINTDDELDAYIEDLITKGD

SEQ ID NO: 892103 - protein, 485 aa, Homo sapiens
ACAAPEQAGKVTGLEALFRALEELAVREAMSAKTTPIRSQADLKKLPLEVTTRPSTEEPVRRPQRPRSPPLPAVIRNAPSRPPSLPTPRPASQPRKAPVISSTPKLPALAAREEASTSRLLQPPEAPRKPANTLVKTASRPAPLVQQLSPSLLPNSKSPREVPSPKVIKTPVVKKTESPIKLSPATPSRKRSVAVSDEEEVEEEAERRKERCKRGRFVVKEEKKDSNELSDSAGEEDSADLKRAQKDKGLHVEVRVNREWYTGRVTAVEVGKHVVRWKVKFDYVPTDTTPRDRWVEKGSEDVRLMKPPSPEHQSLDTQQEGGEEEVGPVAQQAIAVAEPSTSECLRIEPDTTALSTNHETIDLLVQILRNCLRYFLPPSFPISKKQLSAMNSDELISFPLKEYFKQYEVGLQNLCNSYQSRADSRAKASEESLRTSERKLRETEEKLQKLRTNIVALLQKVQEDIDINTDDELDAYIEDLITKGD

SEQ ID NO: 892104 - protein, 970 aa, Homo sapiens; identical to SEQ ID NO: 892099

SEQ ID NO: 892105 - protein, 972 aa, Homo sapiens
MDPSDAASVIQFGKSAKRTPESTQIGQYGNGLKSGSMRIGKDFILFTKKEDTMTCLFLSRTFHEEEGIDEVIVPLPTWNARTREPVTDNVEKFAIETELIYKYSPFRTEEEVMTQFMKIPGDSGTLVIIFNLKLMDNGEPELDIISNPRDIQMAETSPEGTKPERRSFRAYAAVLYIDPRMRIFIHGHKVQTKRLSCCLYKPRMYKYTSSRFKTRAEQEVKKAEHVARIAEEKAREAESKARTLEVRLGGDLTRDSRVMLRQVQNRAITLRREADVKKRIKEAKQRALKEPKELNFVFGVNIEHRDLDGMFIYNCSRLIKMYEKVGPQLEGGMACGGVVGVVDVPYLVLEPTHNKQDFADAKEYRHLLRAMGEHLAQYWKDIAIAQRGIIKFWDEFGYLSANWNQPPSSELRYKRRRAMEIPTTIQCDLCLKWRTLPFQLSSVEKDYPDTWVCSMNPDPEQDRCEASEQKQKVPLGTFRKDMKTQEEKQKQLTEKIRQQQEKLEALQKTTPIRSQADLKKLPLEVTTRPSTEEPVRRPQRPRSPPLPAVIRNAPSRPPSLPTPRPASQPRKAPVISSTPKLPALAAREEASTSRLLQPPEAPRKPANTLVKTASRPAPLVQQLSPSLLPNSKSPREVPSPKVIKTPVVKKTESPIKLSPATPSRKRSVAVSDEEEVEEEAERRKERCKRGRFVVKEEKKDSNELSDSAGEEDSADLKRAQKDKGLHVEVRVNREWYTGRVTAVEVGKHVVRWKVKFDYVPTDTTPRDRWVEKGSEDVRLMKPPSPEHQSLDTQQEGGEEEVGPVAQQAIAVAEPSTSECLRIEPDTTALSTNHETIDLLVQILRNCLRYFLPPSFPISKKQLSAMNSDELISFPLKEYFKQYEVGLQNLCNSYQSRADSRAKASEESLRTSERKLRETEEKLQKLRTNIVALLQKVQEVQEVSPAAFLLQLDHLVSQGGGPGPCSCSHKNLS

SEQ ID NO: 892106 - protein, 130 aa, Homo sapiens
TGPQLIICVDVYVLLHLFAGVPPSFPISKKQLSAMNSDELISFPLKEYFKQYEVGLQNLCNSYQSRADSRAKASEESLRTSERKLRETEEKLQKLRTNIVALLQKVQEDIDINTDDELDAYIEDLITKGD

SEQ ID NO: 892107 - protein, 57 aa, Homo sapiens
HVLFWVSAEEKAREAESKARTLEVRLGGDLTRDSRVRSRPRRLFSSVSGTRSPCPMS

SEQ ID NO: 892108 - protein, 322 aa, Homo sapiens
MPVTVTRTTITTTTTSSSGLGSPMIVGSPRALTQPLGLLRLLQLVSTCVAFSLVASVGAWTGSMGNWSMFTWCFCFSVTLIILIVELCGLQARFPLSWRNFPITFACYAALFCLSASIIYPTTYVQFLSHGRSRDHAIAATFFSCIACVAYATEVAWTRARPGEITGYMATVPGLLKVLETFVACIIFAFISDPNLYQHQPALEWCVAVYAICFILAAIAILLNLGECTNVLPIPFPSFLSGLALLSVLLYATALVLWPLYQFDEKYGGQPRRSRDVSCSRSHAYYVCAWDRRLAVAILTAINLLAYVADLVHSAHLVFVKV

SEQ ID NO: 892109 - protein, 322 aa, Homo sapiens; identical to SEQ ID NO: 892108

SEQ ID NO: 892110 - protein, 322 aa, Homo sapiens; identical to SEQ ID NO: 892108

SEQ ID NO: 892111 - protein, 322 aa, Homo sapiens; identical to SEQ ID NO: 892108

SEQ ID NO: 892112 - protein, 322 aa, Homo sapiens; identical to SEQ ID NO: 892108

SEQ ID NO: 892113 - protein, 322 aa, Homo sapiens; identical to SEQ ID NO: 892108

SEQ ID NO: 892114 - protein, 322 aa, Homo sapiens; identical to SEQ ID NO: 892108

SEQ ID NO: 892115 - protein, 322 aa, Homo sapiens; identical to SEQ ID NO: 892108

SEQ ID NO: 892116 - protein, 322 aa, Homo sapiens; identical to SEQ ID NO: 892108

SEQ ID NO: 892117 - protein, 322 aa, Homo sapiens; identical to SEQ ID NO: 892108

SEQ ID NO: 892118 - protein, 322 aa, Homo sapiens; identical to SEQ ID NO: 892108

SEQ ID NO: 892119 - protein, 322 aa, Homo sapiens; identical to SEQ ID NO: 892108

SEQ ID NO: 892120 - protein, 322 aa, Homo sapiens; identical to SEQ ID NO: 892108

SEQ ID NO: 892121 - protein, 322 aa, Homo sapiens; identical to SEQ ID NO: 892108

SEQ ID NO: 892122 - protein, 322 aa, Homo sapiens; identical to SEQ ID NO: 892108

SEQ ID NO: 892123 - protein, 322 aa, Homo sapiens; identical to SEQ ID NO: 892108

SEQ ID NO: 892124 - protein, 75 aa, Homo sapiens
ARYPDDAENPLIAGCCEISHITSRYQSFCKGPRSCHSSPVTSTVTSSSVSHSWALIIFFCCGKWPAPGILCLFHP

SEQ ID NO: 892125 - protein, 322 aa, Homo sapiens; identical to SEQ ID NO: 892108

SEQ ID NO: 892126 - protein, 93 aa, Homo sapiens
EFELRFPNRSAIRLTVSLANMVKACLYVNIPKLARAWWRAPVIPSSWEDRCELPHPACFSFSTLLFSHLFSGLPVGFLICLFCKHLLLCPWEP

SEQ ID NO: 892127 - protein, 106 aa, Homo sapiens
MHTDSKKSRGPRTHKKRQKGRSAERRTTGSTQTRRDGDTEGDSQETRAREQADAQHTSDHGEPKSRPTKPGRAGVADERRSNHKTEHNTSLSETTKTPLSIKRNAI

SEQ ID NO: 892128 - protein, 272 aa, Homo sapiens
MPVTVTRTTITTTTTSSSGLGSPMIVGSPRALTQPLGLLRLLQLVSTCVAFSLVASVGAWTGSMGNWSMFTWCFCFSVTLIILIVELCGLQARFPLSWRNFPITFACYAALFCLSASIIYPTTYVQFLSHGRSRDHAIAATFFSCIACVAYATEVAWTRARPGEITGYMATVPGLLKVLETFVACIIFAFISDPNLYQHQPALEWCVAVYAICFILAAIAILLNLGECTNVLPIPFPSFLSGLALLSVLLYATALVLWPLYQFDEKYGGPGI

SEQ ID NO: 892129 - protein, 311 aa, Homo sapiens
RFYCGGRLMLAGHGGVFALTLLLILTTTGLFFVFDCPYLARKLTLAIPIIAAILFFFVMSCLLQTSFTDPGILPRATVCEAAALEKQIDNTGSSTYRPPPRTREVLINGQMVKLKYCFTCKMFRPPRTSHCSVCDNCVERFDHHCPWVGNCVGRRNYRFFYAFILSLSFLTAFIFACVVTHLTLRAQGSNFLSTLKETPASVLELVICFFSIWSILGLSGFHTYLVASNLTTNEDIKGSWSSKRGGEASVNPYSHKSIITNCCAVLCGPLPPSLIDRRGFVQSDTVLPSPIRSDEPACRAKPDASMVGGHP

SEQ ID NO: 892130 - protein, 311 aa, Homo sapiens; identical to SEQ ID NO: 892129

SEQ ID NO: 892131 - protein, 311 aa, Homo sapiens; identical to SEQ ID NO: 892129

SEQ ID NO: 892132 - protein, 273 aa, Homo sapiens
RFYCGGRLMLAGHGGVFALTLLLILTTTGLFFVFDCPYLARKLTLAIPIIAAILFFFVMSCLLQTSFTDPGILPRATVCEAAALEKQIDNTGSSTYRPPPRTREVLINGQMVKLKYCFTCKMFRPPRTSHCSVCDNCVERFDHHCPWVGNCVGRRNYRFFYAFILSLSFLTAFIFACVVTHLTLRAQGSNFLSTLKETPASVLELVICFFSIWSILGLSGFHTYLVASNLTTNEDIKGSWSSKRGGEASVNPYSHKSIITNCCAVLCGPLPPR

SEQ ID NO: 892133 - protein, 311 aa, Homo sapiens; identical to SEQ ID NO: 892129

SEQ ID NO: 892134 - protein, 337 aa, Homo sapiens
RFYCGGRLMLAGHGGVFALTLLLILTTTGLFFVFDCPYLARKLTLAIPIIAAILFFFVMSCLLQTSFTDPGILPRATVCEAAALEKQIDNTGSSTYRPPPRTREVLINGQMVKLKYCFTCKMFRPPRTSHCSVCDNCVERFDHHCPWVGNCVGRRNYRFFYAFILSLSFLTAFIFACVVTHLTLRAQGSNFLSTLKETPASVLELVICFFSIWSILGLSGFHTYLVASNLTTNEDIKGSWSSKRGGEASVNPYSHKSIITNCCAVLCGPLPPSLIDRRGFVQSDTVLPSPIRSDEPACRAKPDASMEDTCQDFAISWHSLRGANRPLCRGLAVCAGA

SEQ ID NO: 892135 - protein, 291 aa, Homo sapiens
RFYCGGRLMLAGHGGVFALTLLLILTTTGLFFVFDCPYLARKLTLAIPIIAAILFFFVMSCLLQTSFTDPGILPRATVCEAAALEKQIDNTGSSTYRPPPRTREVLINGQMVKLKYCFTCKMFRPPRTSHCSVCDNCVERFDHHCPWVGNCVGRRNYRFFYAFILSLSFLTAFIFACVVTHLTLRAQGSNFLSTLKETPASVLELVICFFSIWSILGLSGFHTYLVASNLTTNEDIKGSWSSKRGGEASVNPYSHKSIITNCCAVLCGPLPPSLMPEGICAVRFRTPTRSR

SEQ ID NO: 892136 - protein, 605 aa, Homo sapiens
MLEALKALSTFFVENSLRTRRNLRGDIERKSLAINEEFVSIFKEVKEELESISEDVQAMSNCCQDMTSRLQAAKEQTQDLIVKTTKLQSESQKLEIRAQVADAFLSKFQLTSDEMSLLRGTREGPITEDFFKALGRVKQIHNDVKVLLRTNQQTAGLEIMEQMALLQETAYERLYRWAQSECRTLTQESCDVSPVLTQAMEALQDRPVLYKYTLDEFGTARRSTVVRGFIDALTRGGPGGTPRPIEMHSHDPLRYVGDMLAWLHQATASEKEHLEALLKHVTTQGVEENIQEVVGHITEGVCRPLKVRIEQVIVAEPGAVLLYKISNLLKFYHHTISGIVGNSATALLTTIEEMHLLSKKIFFNSLSLHASKLMDKVELPPPDLGPSSALNQTLMLLREVLASHDSSVVPLDARQADFVQVLSCVLDPLLQMCTVSASNLGTADMATFMVNSLYMMKTTLALFEFTDRRLEMLQFQIEAHLDTLINEQASYVLTRVGLSYIYNTVQQHKPEQGSLANMPNLDSVTLKAAMVQFDRYLSAPDNLLIPQLNFLLSATVKEQIVKQSTELVCRAYGEVYAAVMNPINEYKDPENILHRSPQQVQTLLS

SEQ ID NO: 892137 - protein, 638 aa, Homo sapiens
QYSRCLRGPCLAEVAAGGGTRSAMAEGSGEVVAVSATGAANGLNNGAGGTSATTCNPLSRKLHKILETRLDNDKEMLEALKALSTFFVENSLRTRRNLRGDIERKSLAINEEFVSIFKEVKEELESISEDVQAMSNCCQDMTSRLQAAKEQTQDLIVKTTKLQSESQKLEIRAQVADAFLSKFQLTSDEMSLLRGTREGPITEDFFKALGRVKQIHNDVKVLLRTNQQTAGLEIMEQMALLQETAYERLYRWAQSECRTLTQESCDVSPVLTQAMEALQDRPVLYKYTLDEFGTARRSTVVRGFIDALTRGGPGGTPRPIEMHSHDPLRYVGDMLAWLHQATASEKEHLEALLKHVTTQGVEENIQEVVGHITEGVCRPLKVRIEQVIVAEPGAVLLYKISNLLKFYHHTISGIVGNSATALLTTIEEMHLLSKKIFFNSLSLHASKLMDKVELPPPDLGPSSALNQTLMLLREVLASHDSSVVPLDARQADFVQVLSCVLDPLLQMCTVSASNLGTADMATFMVNSLYMMKTTLALFEFTDRRLEMLQFQIEAHLDTLINEQASYVLTRVGLSYIYNTVQQHKPEQGSLANMPNLDSVTLKAAMVQFDRYLSAPDNLLIPQLNFLLSATVKRPPNGP

SEQ ID NO: 892138 - protein, 680 aa, Homo sapiens
QYSRCLRGPCLAEVAAGGGTRSAMAEGSGEVVAVSATGAANGLNNGAGGTSATTCNPLSRKLHKILETRLDNDKEMLEALKALSTFFVENSLRTRRNLRGDIERKSLAINEEFVSIFKEVKEELESISEDVQAMSNCCQDMTSRLQAAKEQTQDLIVKTTKLQSESQKLEIRAQVADAFLSKFQLTSDEMSLLRGTREGPITEDFFKALGRVKQIHNDVKVLLRTNQQTAGLEIMEQMALLQETAYERLYRWAQSECRTLTQESCDVSPVLTQAMEALQDRPVLYKYTLDEFGTARRSTVVRGFIDALTRGGPGGTPRPIEMHSHDPLRYVGDMLAWLHQATASEKEHLEALLKHVTTQGVEENIQEVVGHITEGVCRPLKVRIEQVIVAEPGAVLLYKISNLLKFYHHTISGIVGNSATALLTTIEEMHLLSKKIFFNSLSLHASKLMDKVELPPPDLGPSSALNQTLMLLREVLASHDSSVVPLDARQADFVQVLSCVLDPLLQMCTVSASNLGTADMATFMVNSLYMMKTTLALFEFTDRRLEMLQFQIEAHLDTLINEQASYVLTRVGLSYIYNTVQQHKPEQGSLANMPNLDSVTLKAAMVQFDRYLSAPDNLLIPQLNFLLSATVKEQIVKQSTELVCRAYGEVYAAVMNPINEYKDPENILHRSPQQVQTLLS

SEQ ID NO: 892139 - protein, 705 aa, Homo sapiens
QYSRCLRGPCLAEVAAGGGTRSAMAEGSGEVVAVSATGAANGLNNGAGGTSATTCNPLSRKLHKILETRLDNDKEMLEALKALSTFFVENSLRTRRNLRGDIERKSLAINEEFVSIFKEVKEELESISEDVQAMSNCCQDMTSRLQAAKEQTQDLIVKTTKLQSESQKLEIRAQVADAFLSKFQLTSDEMSLLRGTREGPITEDFFKALGRVKQIHNDVKVLLRTNQQTAGLEIMEQMALLQETAYERLYRWAQSECRTLTQESCDVSPVLTQAMEALQDRPVLYKYTLDEFGTARRSTVVRGFIDALTRGGPGGTPRPIEMHSHDPLRYSNQTAEEELMFFQRKSSLTFIFIRYVGDMLAWLHQATASEKEHLEALLKHVTTQGVEENIQEVVGHITEGVCRPLKVRIEQVIVAEPGAVLLYKISNLLKFYHHTISGIVGNSATALLTTIEEMHLLSKKIFFNSLSLHASKLMDKVELPPPDLGPSSALNQTLMLLREVLASHDSSVVPLDARQADFVQVLSCVLDPLLQMCTVSASNLGTADMATFMVNSLYMMKTTLALFEFTDRRLEMLQFQIEAHLDTLINEQASYVLTRVGLSYIYNTVQQHKPEQGSLANMPNLDSVTLKAAMVQFDRYLSAPDNLLIPQLNFLLSATVKEQIVKQSTELVCRAYGEVYAAVMNPINEYKDPENILHRSPQQVQTLLS

SEQ ID NO: 892140 - protein, 707 aa, Homo sapiens
QYSRCLRGPCLAEVAAGGGTRSAMAEGSGEVVAVSATGAANGLNNGAGGTSATTCNPLSRKLHKILETRLDNDKEMLEALKALSTFFVENSLRTRRNLRGDIERKSLAINEEFVSIFKEVKEELESISEDVQAMSNCCQDMTSRLQAAKEQTQDLIVKTTKLQSESQKLEIRAQVADAFLSKFQLTSDEMSLLRGTREGPITEDFFKALGRVKQIHNDVKVLLRTNQQTAGLEIMEQMALLQETAYERLYRWAQSECRTLTQESCDVSPVLTQAMEALQDRPVLYKYTLDEFGTARRSTVVRGFIDALTRGGPGGTPRPIEMHSHDPLRYVGDMLAWLHQATASEKEHLEALLKHVTTQGVEENIQEVVGHITATRCCQQEALLKQGVRKLRRQSLSTLGFEPGAKFYFTKHFYISSNFITIQSVVLLDTYVQHSLELTIAQTMALALSHNITLISCQVRRLQASPIGLTDSQLGKQEVELPPPDLGPSSALNQTLMLLREVLASHDSSVVPLDARQADFVQVLSCVLDPLLQMCTVSASNLGTADMATFMVNSLYMMKTTLALFEFTDRRLEMLQFQIEAHLDTLINEQASYVLTRVGLSYIYNTVQQHKPEQGSLANMPNLDSVTLKAAMVQFDRYLSAPDNLLIPQLNFLLSATVKEQIVKQSTELVCRAYGEVYAAVMNPINEYKDPENILHRSPQQVQTLLS

SEQ ID NO: 892141 - protein, 213 aa, Homo sapiens
QYSRCLRGPCLAEVAAGGGTRSAMAEGSGEVVAVSATGAANGLNNGAGGTSATTCNPLSRKLHKILETRLDNDKEMLEALKALSTFFVENSLRTRRNLRGDIERELESISEDVQAMSNCCQDMTSRLQAAKEQTQDLIVKTTKLQSESQKLEIRAQVADAFLSKFQLTSDEMSLLRGTREGPITEDFFKALGRVKQIHNDVKVLLRTNQQTAG

SEQ ID NO: 892142 - protein, 680 aa, Homo sapiens; identical to SEQ ID NO: 892138

SEQ ID NO: 892143 - protein, 231 aa, Homo sapiens
QYSRCLRGPCLAEVAAGGGTRSAMAEGSGEVVAVSATGAANGLNNGAGGTSATTCNPLSRKLHKILETRLDNDKEMLEALKALSTFFVENSLRTRRNLRGDIERKSLAINEEFVSIFKEVKEELESISEDVQAMSNCCQDMTSRLQAAKEQTQDLIVKTTKLQSESQKLEIRAQVADAFLSKFQLTSDEMSLLRGTREGPITEDFFKALGRVKQIHNDVKVLLRTNQQTAG

SEQ ID NO: 892144 - protein, 680 aa, Homo sapiens; identical to SEQ ID NO: 892138

SEQ ID NO: 892145 - protein, 680 aa, Homo sapiens; identical to SEQ ID NO: 892138

SEQ ID NO: 892146 - protein, 265 aa, Homo sapiens
GEEVAPEMAVSERRGLGRGSPAEWGQRLLLVLLLGGCSGRIHRLALTGEKRADIQLNSFGFYTNGSLEVELSVLRLGLREAEEKSLLVGFSLSRVRSGRVRSYSTRDFQDCPLQKNSSSFLVLFLINTKDLQVQVRKYGEQKTLFIFPGLLPEAPSKPGLPKPQATVPRKVDGGGTSAASKPKSTPAVIQGPSGKDKDLVLGLSHLNNSYNFSFHVVIGSQAEEGQYSLNFHNCNNSVPGKEHPFDITVMIREKNPRVPLAGRCL

SEQ ID NO: 892147 - protein, 550 aa, Homo sapiens
GEEVAPEMAVSERRGLGRGSPAEWGQRLLLVLLLGGCSGRIHRLALTGEKRADIQLNSFGFYTNGSLEVELSVLRLGLREAEEKSLLVGFSLSRVRSGRVRSYSTRDFQDCPLQKNSSSFLVLFLINTKDLQVQVRKYGEQKTLFIFPGLLPEAPSKPGLPKPQATVPRKVDGGGTSAASKPKSTPAVIQGPSGKDKDLVLGLSHLNNSYNFSFHVVIGSQAEEGQYSLNFHNCNNSVPGKEHPFDITVMIREKNPDGFLSAAEMPLFKLYMVMSACFLAAGIFWVSILCRNTYSVFKIHWLMAALAFTKSISLLFHSINYYFINSQGHPIEGLAVMYYIAHLLKGALLFITIALIGSGWAFIKYVLSDKEKKVFGIVIPMQVLANVAYIIIESREEGASDYVLWKEILFLVDLICCGAILFPVVWSIRHLQDASGTDGKVAVNLAKLKLFRHYYVMVICYVYFTRIIAILLQVAVPFQWQWLYQLLVEGSTLAFFVLTGYKFQPTGNNPYLQLPQEDEEDVQMEQVMTDSGFREGLSKVNKTASGRELL

SEQ ID NO: 892148 - protein, 550 aa, Homo sapiens; identical to SEQ ID NO: 892147

SEQ ID NO: 892149 - protein, 682 aa, Homo sapiens
GEEVAPEMAVSERRGLGRGSPAEWGQRLLLVLLLGGCSGRIHRLALTGEKRADIQLNSFGFYTNGSLEVELSVLRLGLREAEEKSLLVGFSLSRVRSGRVRSYSTRDFQDCPLQKNSSSFLVLFLINTKDLQVQVRKYGEQKTLFIFPGLLPEAPSKPGLPKPQATVPRKVDGGGTSAASKPKSTPAVIQGPSGKDKDLVLGLSHLNNSYNFSFHVVIGSQAEEGQYSLNFHNCNNSVPGKEHPFDITVMIREKNPDGFLSAAEMPLFKLYMVMSACFLAAGIFWVSILCRNTYSVFKIHWLMAALAFTKSISLLFHSINYYFINSQGHPIEGLAVMYYIAHLLKGALLFITIALIGSGWAFIKYVLSDKEKKVFGIVIPMQVLANVAYIIIESREEGASDYVLWKEILFLVDLICCGAILFPVVCGSEPGQAEAVPALLCHGHLLRLLHPHHRHPAAGGCALSVAVAVPALGGGLHPGLLRAHGLQVPAHREQPVPAAAPGGRGGCSDGASNDGLWVPGRPLQSQQNSQRAGTVMITSTSQTKGSSSPSISHSCPSSTAYVGRWRGSMWTRRPAPRDPGSRTSPFGRRVPSSPQILGSPVLTPGPPLPSSYVYNNDQSVWLKKKNKKQKQNTREKQTEVCGQTGSNGPGIKWYRTHVLETGKFRGTHEESNIANPGTRIET

SEQ ID NO: 892150 - protein, 582 aa, Homo sapiens
GEEVAPEMAVSERRGLGRGSPAEWGQRLLLVLLLGGCSGRIHRLALTGEKRADIQLNSFGFYTNGSLEVELSVLRLGLREAEEKSLLVGFSLSRVRSGRVRSYSTRDFQDCPLQKNSSSFLVLFLINTKDLQVQVRKYGEQKTLFIFPGLLPEAPSKPGLPKPQATVPRKVDGGGTSAASKPKSTPAVIQGPSGKDKDLVLGLSHLNNSYNFSFHVVIGSQAEEGQYSLNFHNCNNSVPGKEHPFDITVMIREKNPDGFLSAAEMPLFKLYMVMSACFLAAGIFWVSILCRNTYSVFKIHWLMAALAFTKSISLLFHSINYYFINSQGHPIEGLAVMYYIAHLLKGALLFITIALIGSGWAFIKYVLSDKEKKVFGIVIPMQVLANVAYIIIESREEGASDYVLWKEILFLVDLICCGAILFPVVWSIRHLQDASGTDGKVAVNLAKLKLFRHYYVMVICYVYFTRIIAILLQVAVPFQWQWLYQLLVEGSTLAFFVLTGYKFQPTGNNPYLQLPQEDEEDVQMEQVVCGEVEGVHVDQAPSSPGPRFPDKPIWKKSPFLPPNIGQPCPYPGTTPPFQLCVQ

SEQ ID NO: 892151 - protein, 531 aa, Homo sapiens
GEEVAPEMAVSERRGLGRGSPAEWGQRLLLVLLLGGCSGRIHRLALTGEKRADIQLNSFGFYTNGSLEVELSVLRLGLREAEEKSLLVGFSLSRVRSGRVRSYSTRDFQDCPLQKNSSSFLVLFLINTKDLQVQVRKYGEQKTLFIFPGLLPEAPSKPGLPKPQATVPRKVDGGGTSAASKPKSTPAVIQGPSGKDKDLVLGLSHLNNSYNFSFHVVIGSQAEEGQYSLNFHNCNNSVPGKEHPFDITVMIREKNPDGFLSAAEMPLFKLYMVMSACFLAAGIFWVSILCRNTYSVFKIHWLMAALAFTKSISLLFHSINYYFINSQGHPIEGLAVMYYIAHLLKGALLFITIALIGSGWAFIKYVLSDKEKKVFGIVIPMQVLANVAYIIIESREEGASDYVLWKEILFLVDLICCGAILFPVVWSIRHLQDASGTDGKVAVNLAKLKLFRHYYVMVICYVYFTRIIAILLQVAVPFQWQWLYQPTGNNPYLQLPQEDEEDVQMEQVMTDSGFREGLSKVNKTASGRELL

SEQ ID NO: 892152 - protein, 534 aa, Homo sapiens
GEEVAPEMAVSERRGLGRGSPAEWGQRLLLVLLLGGCSGRIHRLALTGEKRADIQLNSFGFYTNGSLEVELSVLRLGLREAEEKSLLVGFSLSRVRSGRVRSYSTRDFQDCPLQKNSSSFLVLFLINTKDLQVQVRKYGEQKTLFIFPGLLPEAPSKPGLPKPQATVPRKVDGGGTSAASKPKSTPAVIQGPSGKDKDLVLGLSHLNNSYNFSFHVVIGSQAEEGQYSLNFHNCNNSVPGKEHPFDITVMIREKNPDGFLSAAEMPLFKLYMVMSACFLAAGIFWVSILCRNTYSVFKIHWLMAALAFTKSISLLFHSINYYFINSQGHPIEGLAVMYYIAHLLKGALLFITIALIGSGWAFIKYVLSDKEKKVFGIVIPMQVLANVAYIIIESREEGASDYVLWKEILFLVDLICCGAILFPVVWSIRHLQDASGTDGKVAVNLAKLKLFRHYYVMVAVPFQWQWLYQLLVEGSTLAFFVLTGYKFQPTGNNPYLQLPQEDEEDVQMEQVMTDSGFREGLSKVNKTASGRELL

SEQ ID NO: 892153 - protein, 527 aa, Homo sapiens
SCQTPGAGQAERGLNCLCLLGLRQGEKRADIQLNSFGFYTNGSLEVELSVLRLGLREAEEKSLLVGFSLSRVRSGRVRSYSTRDFQDCPLQKNSSSFLVLFLINTKDLQVQVRKYGEQKTLFIFPGLLPEAPSKPGLPKPQATVPRKVDGGGTSAASKPKSTPAVIQGPSGKDKDLVLGLSHLNNSYNFSFHVVIGSQAEEGQYSLNFHNCNNSVPGKEHPFDITVMIREKNPDGFLSAAEMPLFKLYMVMSACFLAAGIFWVSILCRNTYSVFKIHWLMAALAFTKSISLLFHSINYYFINSQGHPIEGLAVMYYIAHLLKGALLFITIALIGSGWAFIKYVLSDKEKKVFGIVIPMQVLANVAYIIIESREEGASDYVLWKEILFLVDLICCGAILFPVVWSIRHLQDASGTDGKVAVNLAKLKLFRHYYVMVICYVYFTRIIAILLQVAVPFQWQWLYQLLVEGSTLAFFVLTGYKFQPTGNNPYLQLPQEDEEDVQMEQVMTDSGFREGLSKVNKTASGRELL

SEQ ID NO: 892154 - protein, 306 aa, Homo sapiens
CPSLIVQLFTPSAVTVPSIFSAPITSFESHPPSSLFNFLTTHLMVTVRVPNPPPPPSASHPSVRLTVRLSIHPQINYYFINSQGHPIEGLAVMYYIAHLLKGALLFITIALIGSGWAFIKYVLSDKEKKVFGIVIPMQVLANVAYIIIESREEGASDYVLWKEILFLVDLICCGAILFPVVWSIRHLQDASGTDGKVAVNLAKLKLFRHYYVMVICYVYFTRIIAILLQVAVPFQWQWLYQLLVEGSTLAFFVLTGYKFQPTGNNPYLQLPQEDEEDVQMEQVMTDSGFREGLSKVNKTASGRELL

SEQ ID NO: 892155 - protein, 255 aa, Homo sapiens
GEEVAPEMAVSERRGLGRGSPAEWGQRLLLVLLLGGCSGRIHRLALTGEKRADIQLNSFGFYTNGSLEVELSVLRLGLREAEEKSLLVGFSLSRVRSGRVRSYSTRDFQDCPLQKNSSSFLVLFLINTKDLQVQVRKYGEQKTLFIFPGLLPEAPSKPGLPKPQATVPRKVDGGGTSAASKPKSTPAVIQGPSGKDKDLVLGLSHLNNSYNFSFHVVIGSQAEEGQYSLNFHNCNNSVPGKEHPFDITVSGVEGS

SEQ ID NO: 892156 - protein, 132 aa, Homo sapiens
GEEVAPEMAVSERRGLGRGSPAEWGQRLLLVLLLGGCSGRIHRLALTGEKRADIQLNSFGFYTNGSLEVELSVLRLGLREAEEKSLLVGFSLSRVRSGRVRSYSTRDFQDCPLQKNSSSFLVLFLINTKDLQ

SEQ ID NO: 892157 - protein, 135 aa, Homo sapiens
MITSTSQTKGSSSPSISHSCPSSTAYVGRWRGSMWTRRPAPRDPGSRTSPFGRRVPSSPQILGSPVLTPGPPLPSSYVYNNDQSVWLYAVVLPFWGLGSTRRLCLQCRNLFSLCVAGARAQGPCLCIFNKYSFSK

SEQ ID NO: 892158 - protein, 670 aa, Homo sapiens
GEEVAPEMAVSERRGLGRGSPAEWGQRLLLVLLLGGCSGRIHRLALTGEKRADIQLNSFGFYTNGSLEVELSVLRLGLREAEEKSLLVGFSLSRVRSGRVRSYSTRDFQDCPLQKNSSSFLVLFLINTKDLQVQVRKYGEQKTLFIFPGLLPEAPSKPGLPKPQATVPRKVDGGGTSAASKPKSTPAVIQGPSGKDKDLVLGLSHLNNSYNFSFHVVIGSQAEEGQYSLNFHNCNNSVPGKEHPFDITVMIREKNPDGFLSAAEMPLFKLYMVMSACFLAAGIFWVSILCRNTYSVFKIHWLMAALAFTKSISLLFHSINYYFINSQGHPIEGLAVMYYIAHLLKGALLFITIALIGSGWAFIKYVLSDKEKKVFGIVIPMQVLANVAYIIIESREEGASDYVLWKEILFLVDLICCGAILFPVVCGSEPGQAEAVPALLCHGHLLRLLHPHHRHPAAGGCALSVAVAVPALGGGLHPGLLRAHGLQVPAHREQPVPAAAPGGRGGCSDGASNDGLWVPGRPLQSQQNSQRAGTVMITSTSQTKGSSSPSISHSCPSSTAYVGRWRGSMWTRRPAPRDPGSRTSPFGRRVPSSPQILGSPVLTPGPPLPSSYVYNNDQSVWLYAVVLPFWGLGSTRRLCLQCRNLFSLCVAGARAQGPCLCIFNKYSFSK

SEQ ID NO: 892159 - protein, 531 aa, Homo sapiens; identical to SEQ ID NO: 892151

SEQ ID NO: 892160 - protein, 531 aa, Homo sapiens; identical to SEQ ID NO: 892151

SEQ ID NO: 892161 - protein, 525 aa, Homo sapiens
MLLGAQLECKSSSGKVKVRHAEGEKRADIQLNSFGFYTNGSLEVELSVLRLGLREAEEKSLLVGFSLSRVRSGRVRSYSTRDFQDCPLQKNSSSFLVLFLINTKDLQVQVRKYGEQKTLFIFPGLLPEAPSKPGLPKPQATVPRKVDGGGTSAASKPKSTPAVIQGPSGKDKDLVLGLSHLNNSYNFSFHVVIGSQAEEGQYSLNFHNCNNSVPGKEHPFDITVMIREKNPDGFLSAAEMPLFKLYMVMSACFLAAGIFWVSILCRNTYSVFKIHWLMAALAFTKSISLLFHSINYYFINSQGHPIEGLAVMYYIAHLLKGALLFITIALIGSGWAFIKYVLSDKEKKVFGIVIPMQVLANVAYIIIESREEGASDYVLWKEILFLVDLICCGAILFPVVWSIRHLQDASGTDGKVAVNLAKLKLFRHYYVMVICYVYFTRIIAILLQVAVPFQWQWLYQLLVEGSTLAFFVLTGYKFQPTGNNPYLQLPQEDEEDVQMEQVMTDSGFREGLSKVNKTASGRELL

SEQ ID NO: 892162 - protein, 301 aa, Homo sapiens
MIREKNPDGFLSAAEMPLFKLYMVMSACFLAAGIFWVSILCRNTYSVFKIHWLMAALAFTKSISLLFHSINYYFINSQGHPIEGLAVMYYIAHLLKGALLFITIALIGSGWAFIKYVLSDKEKKVFGIVIPMQVLANVAYIIIESREEGASDYVLWKEILFLVDLICCGAILFPVVWSIRHLQDASGTDGKVAVNLAKLKLFRHYYVMVICYVYFTRIIAILLQVAVPFQWQWLYQLLVEGSTLAFFVLTGYKFQPTGNNPYLQLPQEDEEDVQMEQVMTDSGFREGLSKVNKTASGRELL

SEQ ID NO: 892163 - protein, 214 aa, Homo sapiens [sequence omitted]

SEQ ID NO: 892164 - protein, 63 aa, Homo sapiens
MGDVRADRTLCPPLVPGPSGISRMRLAQTGRVRPCACRPSAHGPIPPPGPSFCPLDAPPGLSA

SEQ ID NO: 892165 - protein, 1499 aa, Homo sapiens
MKPLAIPANHGVMGQQEKHSLPADFTKLHLTDSLHPQVTHVSSSHSGCSITSDSGSSSLSDIYQATESEAGDMDLSGLPETAVDSEDDDDEEDIERASDPLMSRDIVRDCLEKDPIDRTDDDIEQLLEFMHQLPAFANMTMSVRRELCAVMVFAVVERAGTIVLNDGEELDSWSVILNGSVEVTYPDGKAEILCMGNSFGVSPTMDKEYMKGVMRTKVDDCQFVCIAQQDYCRILNQVEKNMQKVEEEGEIVMVKEHRELDRTGTRKGHIVIKGTSERLTMHLVEEHSVVDPTFIEDFLLTYRTFLSSPMEVGKKLLEWFNDPSLRDKVTRVVLLWVNNHFNDFEGDPAMTRFLEEFENNLEREKMGGHLRLLNIACAAKAKRRLMTLTKPSREAPLPFILLGGSEKGFGIFVDSVDSGSKATEAGLKRGDQILEVNGQNFENIQLSKAMEILRNNTHLSITVKTNLFVFKELLTRLSEEKRNGAPHLPKIGDIKKASRYSIPDLAVDVEQVIGLEKVNKKSKANTVGGRNKLKKILDKTRISILPQKPYNDIGIGQSQDDSIVGLRQTKHIPTALPVSGTLSSSNPDLLQSHHRILDFSATPDLPDQVLRVFKADQQSRYIMISKDTTAKEVVIQAIREFAVTATPDQYSLCEVSVTPEGVIKQRRLPDQLSKLADRIQLSGRYYLKNNMETETLCSDEDAQELLRESQISLLQLSTVEVATQLSMRNFELFRNIEPTEYIDDLFKLRSKTSCANLKRFEEVINQETFWVASEILRETNQLKRMKIIKHFIKIALHCRECKNFNSMFAIISGLNLAPVARLRTTWEKLPNKYEKLFQDLQDLFDPSRNMAKYRNVLNSQNLQPPIIPLFPVIKKDLTFLHEGNDSKVDGLVNFEKLRMIAKEIRHVGRMASVNMDPALMFRTRKKKWRSLGSLSQGSTNATVLDVAQTGGHKKRVRRSSFLNAKKLYEDAQMARKVKQYLSNLELEMDEESLQTLSLQCEPATNTLPKNPGDKKPVKSETSPVAPRAGSQQKAQSLPQPQQQPPPAHKINQGLQVPAVSLYPSRKKVPVKDLPPFGINSPQALKKILSLSEEGSLERHKKQAEDTISNASSQLSSPPTSPQSSPRKGYTLAPSGTVDNFSDSGHSEISSRSSIVSNSSFDSVPVSLHDERRQRHSVSIVETNLGMGRMERRTMIEPDQYSLGSYAPMSEGRGLYATATVISSPSTEELSQDQGDRASLDAADSGRGSWTSCSSGSHDNIQTIQHQRSWETLPFGHTHFDYSGDPAGLWASSSHMDQIMFSDHSTKYNRQNQSRESLEQAQSRASWASSTGYWGEDSEGDTGTIKRRGGKDVSIEAESSSLTSVTTEETKPVPMPAHIAVASSTTKGLIARKEGRYREPPPTPPGYIGIPITDFPEGHSHPARKPPDYNVALQRSRMVARSSDTAGPSSVQQPHGHPTSSRPVNKPQWHKPNESDPRLAPYQSQGFSTEEDEDEQVSAV

SEQ ID NO: 892166 - protein, 395 aa, Homo sapiens
SGNQLRSFGSGQLDLTSSSSSLGSYTLAPSGTVDNFSDSGHSEISSRSSIVSNSSFDSVPVSLHDERRQRHSVSIVETNLGMGRMERRTMIEPDQYSLGSYAPMSEGRGLYATATVISSPSTEELSQDQGDRASLDAADSGRGSWTSCSSGSHDNIQTIQHQRSWETLPFGHTHFDYSGDPAGLWASSSHMDQIMFSDHSTKYNRQNQSRESLEQAQSRASWASSTGYWGEDSEGDTGTIKRRGGKDVSIEAESSSLTSVTTEETKPVPMPAHIAVASSTTKGLIARKEGRYREPPPTPPGYIGIPITDFPEGHSHPARKPPDYNVALQRSRMVARSSDTAGPSSVQQPHGHPTSSRPVNKPQWHKPNESDPRLAPYQSQGFSTEEDEDEQVSAV

SEQ ID NO: 892167 - protein, 1499 aa, Homo sapiens; identical to SEQ ID NO: 892165

SEQ ID NO: 892168 - protein, 337 aa, Homo sapiens
MKPLAIPANHGVMGQQEKHSLPADFTKLHLTDSLHPQVTHVSSSHSGCSITSDSGSSSLSDIYQATESEAGDMDLSGLPETAVDSEDDDDEEDIERASDPLMSRDIVRDCLEKDPIDRTDDDIEQLLEFMHQLPAFANMTMSVRRELCAVMVFAVVERAGTIVLNDGEELDSWSVILNGSVEVTYPDGKAEILCMGNSFGVSPTMDKEYMKGVMRTKVDDCQFVCIAQQDYCRILNQVEKNMQKVEEEGEIVMVKEHRELDRTGTRKGHIVIKGTSERLTMHLVEEHSVVDPTFIEDFLLTYRTFLSSPMEVGKKLLEWFNDPSLRDKVGNIFYFVS

SEQ ID NO: 892169 - protein, 709 aa, Homo sapiens
MDLSGLPETAVDSEDDDDEEDIERASDPLMSRDIVRDCLEKDPIDRTDDDIGKLEQENESTKVNIKAEGFHLCLKKHRINAMGFPFPPLSISGNDSKVDGLVNFEKLRMIAKEIRHVGRMASVNMDPALMFRTRKKKWRSLGSLSQGSTNATVLDVAQTGGHKKRVRRSSFLNAKKLYEDAQMARKVKQYLSNLELEMDEESLQTLSLQCEPATNTLPKNPGDKKPVKSETSPVAPRAGSQQKAQSLPQPQQQPPPAHKINQGLQVPAVSLYPSRKKVPVKDLPPFGINSPQALKKILSLSEEGSLERHKKQAEDTISNASSQLSSPPTSPQSSPRKGYTLAPSGTVDNFSDSGHSEISSRSSIVSNSSFDSVPVSLHDERRQRHSVSIVETNLGMGRMERRTMIEPDQYSLGSYAPMSEGRGLYATATVISSPSTEELSQDQGDRASLDAADSGRGSWTSCSSGSHDNIQTIQHQRSWETLPFGHTHFDYSGDPAGLWASSSHMDQIMFSDHSTKYNRQNQSRESLEQAQSRASWASSTGYWGEDSEGDTGTIKRRGGKDVSIEAESSSLTSVTTEETKPVPMPAHIAVASSTTKGLIARKEGRYREPPPTPPGYIGIPITDFPEGHSHPARKPPDYNVALQRSRMVARSSDTAGPSSVQQPHGHPTSSRPVNKPQWHKPNESDPRLAPYQSQGFSTEEDEDEQVSAV

SEQ ID NO: 892170 - protein, 1499 aa, Homo sapiens; identical to SEQ ID NO: 892165

SEQ ID NO: 892171 - protein, 218 aa, Homo sapiens
MGSAALEILGLVLCLVGWGGLILACGLPMWQVTAFLDHNIVTAQTTWKGLWMSCVVQSTGHMQCKVYDSVLALSTEVQAARALTVSAVLLAFVALFVTLAGAQCTTCVAPGPAKARVALTGGVLYLFCGLLALVPLCWFANIVVREFYDPSVPVSQKYELGAALYIGWAATALLMVGGCLLCCGAWVCTGRPDLSFPVKYSAPRRPTATGDYDKKNYV

SEQ ID NO: 892172 - protein, 218 aa, Homo sapiens; identical to SEQ ID NO: 892171

SEQ ID NO: 892173 - protein, 217 aa, Homo sapiens
QSRLLGLGPPLPLGATPSVLGHWELPEVVSPELGPQGWGAGSTAGRGAAPVKIESCQRLCDWLRHDDPRTDWLLRAGGPGPGDRIRPRTFKEVPPGRSGADLGGATDPRGKRTGAKSRERGRKGTRARPGRRAARPWGFCGPSGARLASSHGVRSVGDPGPGAVPGGLGGSDPGVRAAHVAGDRLPGPQHRDGADHPTGRCVQLVFTPSAGPEPRDQ

SEQ ID NO: 892174 - protein, 90 aa, Homo sapiens
ARVLFCARRCFHRQSGCQTEDFASPPRRWGSWLLPYFPEAASHACEALDKPGEPRMDRGFRRVARRAGSSERPALRPDAAPGSAPACARS

SEQ ID NO: 892175 - protein, 218 aa, Homo sapiens; identical to SEQ ID NO: 892171

SEQ ID NO: 892176 - protein, 450 aa, Homo sapiens
MGETMSKRLKLHLGGEAEMEERAFVNPFPDYEAAAGALLASGAAEETGCVRPPATTDEPGLPFHQDGKIIHNFIRRIQTKIKDLLQQMEEGLKTADPHDCSAYTGWTGIALLYLQLYRVTCDQTYLLRSLDYVKRTLRNLNGRRVTFLCGDAGPLAVGAVIYHKLRSDCESQECVTKLLQLQRSVVCQESDLPDELLYGRAGYLYALLYLNTEIGPGTVCESAIKEVVNAIIESGKTLSREERKTERCPLLYQWHRKQYVGAAHGMAGIYYMLMQPAAKVDQETLTEMVKPSIDYVRHKKFRSGNYPSSLSNETDRLVHWCHGAPGVIHMLMQAYKVFKEEKYLKEAMECSDVIWQRGLLRKGYGICHGTAGNGYSFLSLYRLTQDKKYLYRACKFAEWCLDYGAHGCRIPDRPYSLFEGMAGAIHFLSDVLGPETSRFPAFELDSSKRD

SEQ ID NO: 892177 - protein, 185 aa, Homo sapiens [sequence omitted]

SEQ ID NO: 892178 - protein, 97 aa, Homo sapiens
VLSRAAPLRRGGTGCSQVSSEQPQRWPRMRVSPQVSLSTPLRKEKKECQFRRKASFLLVWLCVGLAPEMCDIQLLNDAWRVCLLQTPLLLSHYFLSC

SEQ ID NO: 892179 - protein, 450 aa, Homo sapiens; identical to SEQ ID NO: 892176

SEQ ID NO: 892180 - protein, 450 aa, Homo sapiens; identical to SEQ ID NO: 892176

SEQ ID NO: 892181 - protein, 232 aa, Homo sapiens
MGETMSKRLKLHLGGEAEMEERAFVNPFPDYEAAAGALLASGAAEETGCVRPPATTDEPGLPFHQDGKIIHNFIRRIQTKIKDLLQQMEEGLKTADPHDCSAYTGWTGIALLYLQLYRVTCDQTYLLRSLDYVKRTLRNLNGRRVTFLCGDAGPLAVGAVIYHKLRSDCESQECVTKLLQLQRSVVCQESDLPDELLYGRAGYLYALLYLNTEIGPGQRTNVEAAVNLVVVD

SEQ ID NO: 892182 - protein, 786 aa, Homo sapiens [sequence omitted]

SEQ ID NO: 892183 - protein, 786 aa, Homo sapiens [sequence omitted]

SEQ ID NO: 892184 - protein, 742 aa, Homo sapiens [sequence omitted]

SEQ ID NO: 892185 - protein, 711 aa, Homo sapiens
MPHPAGSRYPWGQEAFDKARKENKPIFLSVGYSTCHWCHMMEEESFQNEEIGRLLSEDFVSVKVDREERPDVDKVYMTFVQATSSGGGWPMNVWLTPNLQPFVGGTYFPPEDGLTRVGFRTVLLRIREQWKQNKNTLLENSQRVTTALLARSEISVGDRQLPPSAATVNNRCFQQLDEGYDEEYGGFAEAPKFPTPVILSFLFSYWLSHRLTQDGSRAQQMALHTLKMMANGGIRDHVGQGFHRYSTDRQWHVPHFEKMLYDQAQLAVAYSQAFQLSGDEFYSDVAKGILQYVARSLSHRSGGFYSAEDADSPPERGQRPKEGAYYVWTVKEVQQLLPEPVLGATEPLTSGQLLMKHYGLTEAGNISPSQDPKGELQGQNVLTVRYSLELTAARFGLDVEAVRTLLNSGLEKLFQARKHRPKPHLDSKMLAAWNGLMVSGYAVTGAVLGQDRLINYATNGAKFLKRHMFDVASGRLMRTCYTGPGGTVEHSNPPCWGFLEDYAFVVRGLLDLYEASQESAWLEWALRLQDTQDRLFWDSQGGGYFCSEAELGAGLPLRLKDDQDGAEPSANSVSAHNLLRLHGFTGHKDWMDKCVCLLTAFSERMRRVPVALPEMVRALSAQQQTLKQIVICGDRQAKDTKALVQCVHSVYIPNKVLILADGDPSSFLSRQLPFLSTLRRLEDQATAYVCENQACSVPITDPCELRKLLHP

SEQ ID NO: 892186 - protein, 909 aa, Homo sapiens
MLGARAWLGRVLLLPRAGAGLAASRRCPGVWPRTWPHRSPSRGSSSRDKDRSATVSSSVPMPAGGKGSHPSSTPQRVPNRLIHEKSPYLLQHAYNPVDWYPWGQEAFDKARKENKPIFLSVGYSTCHWCHMMEEESFQNEEIGRLLSEDFVSVKVDREERPDVDKVYMTFVQATSSGGGWPMNVWLTPNLQPFVGGTYFPPEDGLTRVGFRTVLLRIREQWKQNKNTLLENSQRVTTALLARSEISVGDRQLPPSAATVNNRCFQQLDEGYDEEYGGFAEAPKFPTPVILSFLFSYWLSHRLTQDGSRAQQMALHTLKMMANGGIRDHVGQGFHRYSTDRQWHVPHFEKMLYDQAQLAVAYSQAFQLSGDEFYSDVAKGILQYVARSLSHRSGGFYSAEDADSPPERGQRPKEGAYYVWTVKEVQQLLPEPVLGATEPLTSGQLLMKHYGLTEAGNISPSQDPKGELQGQNVLTVRYSLELTAARFGLDVEAVRTLLNSGLEKLFQARKHRPKPHLDSKMLAAWNVGQQHLRPSLSVGSPFTKPLSFRQRLNAHSPLISVIILSLQKRLKELEYPAQGHAQGLGTPPCLALEPKILGITHGSREVLGPKVIEVDMPGGSWPASYHYLSLLAPGLMVSGYAVTGAVLGQDRLINYATNGAKFLKRHMFDVASGRLMRTCYTGPGGTVEHSNPPCWGFLEDYAFVVRGLLDLYEASQESAWLEWALRLQDTQDRLFWDSQGGGYFCSEAELGAGLPLRLKDDQDGAEPSANSVSAHNLLRLHGFTGHKDWMDKCVCLLTAFSERMRRVPVALPEMVRALSAQQQTLKQIVICGDRQAKDTKALVQCVHSVYIPNKVLILADGDPSSFLSRQLPFLSTLRRLEDQATAYVCENQACSVPITDPCELRKLLHP

SEQ ID NO: 892187 - protein, 802 aa, Homo sapiens [sequence omitted]

SEQ ID NO: 892188 - protein, 530 aa, Homo sapiens
MLGARAWLGRVLLLPRAGAGLAASRRCPGVWPRTWPHRSPSRGSSSRDKDRSATVSSSVPMPAGGKGSHPSSTPQRVPNRLIHEKSPYLLQHAYNPVDWYPWGQEAFDKARKENKPIFLSVGYSTCHWCHMMEEESFQNEEIGRLLSEDFVSVKVDREERPDVDKVYMTFVQATSSGGGWPMNVWLTPNLQPFVGGTYFPPEDGLTRVGFRTVLLRIREQWKQNKNTLLENSQRVTTALLARSEISVGDRQLPPSAATVNNRCFQQLDEGYDEEYGGFAEAPKFPTPVILSFLFSYWLSHRLTQDGSRAQQMALHTLKMMANGGIRDHVGQGFHRYSTDRQWHVPHFEKMLYDQAQLAVAYSQAFQLSGDEFYSDVAKGILQYVARSLSHRSGGFYSAEDADSPPERGQRPKEGAYYVWTVKEVQQLLPEPVLGATEPLTSGQLLMKHYGLTEAGNISPSQDPKGELQGQNVLTVRYSLELTAARFGLDVEAVRTLLNSGLEKLFQARKHRPKPHLDSKMLAAWNVGQHT

SEQ ID NO: 892189 - protein, 605 aa, Homo sapiens
QRTVLGQRTVLGQRTVLLRIREQWKQNKNTLLENSQRVTTALLARSEISVGDRQLPPSAATVNNRCFQQLDEGYDEEYGGFAEAPKFPTPVILSFLFSYWLSHRLTQDGSRAQQMALHTLKMMANGGIRDHVGQGFHRYSTDRQWHVPHFEKMLYDQAQLAVAYSQAFQLSGDEFYSDVAKGILQYVARSLSHRSGGFYSAEDADSPPERGQRPKEGAYYVWTVKEVQQLLPEPVLGATEPLTSGQLLMKHYGLTEAGNISPSQDPKGELQGQNVLTVRYSLELTAARFGLDVEAVRTLLNSGLEKLFQARKHRPKPHLDSKMLAAWNGLMVSGYAVTGAVLGQDRLINYATNGAKFLKRHMFDVASGRLMRTCYTGPGGTVEHSNPPCWGFLEDYAFVVRGLLDLYEASQESAWLEWALRLQDTQDRLFWDSQGGGYFCSEAELGAGLPLRLKDDQDGAEPSANSVSAHNLLRLHGFTGHKDWMDKCVCLLTAFSERMRRVPVALPEMVRALSAQQQTLKQIVICGDRQAKDTKALVQCVHSVYIPNKVLILADGDPSSFLSRQLPFLSTLRRLEDQATAYVCENQACSVPITDPCELRKLLHP

SEQ ID NO: 892190 - protein, 674 aa, Homo sapiens
MLGARAWLGRVLLLPRAGAGLAASRRCPGVWPRTWPHRSPSRGSSSRDKDRSATVSSSVPMPAGGKGSHPSSTPQRVPNRLIHEKSPYLLQHAYNPVDWYPWGQEAFDKARKENKPIFLSVGYSTCHWCHMMEEESFQNEEIGRLLSEDFVSVKVDREERPDVDKVYMTFVQATSSGGGWPMNVWLTPNLQPFVGGTYFPPEDGLTRVGFRTVLLRIREQWKQNKNTLLENSQRVTTALLARSEISVGDRQLPPSAATVNNRCFQQLDEGYDEEYGGFAEAPKFPTPVILSFLFSYWLSHRLTQDGSRAQQMALHTLKMMANGGIRDHVGQGFHRYSTDRQWHVPHFEKMLYDQAQLAVAYSQAFQLSGDEFYSDVAKGILQYVARSLSHRSGGFYSAEDADSPPERGQRPKEGAYYVWTVKEVQQLLPEPVLGATEPLTSGQLLMKHYGLTEAGNISPSQDPKGELQGQNVLTVRYSLELTAARFGLDVEAVRTLLNSGLEKLFQARKHRPKPHLDSKMLAAWNGLMVSGYAVTGAVLGQDRLINYATNGAKFLKRHMFDVASGRLMRTCYTGPGGTVEHSNPPCWGFLEDYAFVVRGLLDLYEASQESAWLEWALRLQDTQDRLFWDSQGGGYFCSEAELGAGLPLRLKDDQDGAEPSANSVSAHNLLSAHH

SEQ ID NO: 892191 - protein, 406 aa, Homo sapiens
MLGARAWLGRVLLLPRAGAGLAASRRCPGVWPRTWPHRSPSRGSSSRDKDRSATVSSSVPMPAGGKGSHPSSTPQRVPNRLIHEKSPYLLQHAYNPVDWYPWGQEAFDKARKENKPIFLSVGYSTCHWCHMMEEESFQNEEIGRLLSEDFVSVKVDREERPDVDKVYMTFVQATSSGGGWPMNVWLTPNLQPFVGGTYFPPEDGLTRVGFRTVLLRIREQWKQNKNTLLENSQRVTTALLARSEISVGDRQLPPSAATVNNRCFQQLDEGYDEEYGGFAEAPKFPTPVILSFLFSYWLSHRLTQDGSRAQQMALHTLKMMANGGIRDHVGQGFHRYSTDRQWHVPHFEKMLYDQAQLAVAYSQAFQLSGDEFYSDVAKGILQYVARSLSHRVCVHGGRQAWLWEGL

SEQ ID NO: 892192 - protein, 80 aa, Homo sapiens
RAWLGRVLLLPRAGAGLAASRRYGRASGPLGHSLRLPAGPVEGLPDTGPQCQSGPPLHAWPFPHPHLRSAPETWLWLEGP

SEQ ID NO: 892193 - protein, 93 aa, Homo sapiens
THSPWNKLNSVPWGAVSMAKDTKALVQCVHSVYIPNKVLILADGDPSSFLSRQLPFLSTLRRLEDQATAYVCENQACSVPITDPCELRKLLHP

SEQ ID NO: 892194 - protein, 802 aa, Homo sapiens [sequence omitted]

SEQ ID NO: 892195 - protein, 786 aa, Homo sapiens [sequence omitted]

SEQ ID NO: 892196 - protein, 802 aa, Homo sapiens [sequence omitted]

SEQ ID NO: 892197 - protein, 899 aa, Homo sapiens
MLGARAWLGRVLLLPRAGAGLAASRRCPGVWPRTWPHRSPSRGSSSRDKDRSATVSSSVPMPAGGKGSHPSSTPQRVPNRLIHEKSPYLLQHAYNPVDWYPWGQEAFDKARKENKPIFLSVGYSTCHWCHMMEEESFQNEEIGRLLSEDFVSVKVDREERPDVDKVYMTFVQATSSGGGWPMNVWLTPNLQPFVGGTYFPPEDGLTRVGFRTVLLRIREQWKQNKNTLLENSQRVTTALLARSEISVGDRQLPPSAATVNNRCFQQLDEGYDEEYGGFAEAPKFPTPVILSFLFSYWLSHRLTQDGSRAQQMALHTLKMMANGGIRDHVGQGFHRYSTDRQWHVPHFEKMLYDQAQLAVAYSQAFQLSGDEFYSDVAKGILQYVARSLSHRSGGFYSAEDADSPPERGQRPKEGAYYVWTVKEVQQLLPEPVLGATEPLTSGQLLMKHYGLTEAGNISPSQDPKGELQGQNVLTVRYSLELTAARFGLDVEAVRTLLNSGLEKLFQARKHRPKPHLDSKMLAAWNGLMVSGYAVTGAVLGQDRLINYATNGAKFLKRHMFDVASGRLMRTCYTGPGGTVEHRSGGWVDREGPSPQRCPQPTSALLLPSMWTPVLALPGACCEFVASLGPFTHLGSGLMAPAQEGSSGGLSEQMRERASSGKGPLSWGSPQPLPYCLSPSNPPCWGFLEDYAFVVRGLLDLYEASQESAWLEWALRLQDTQDRLFWDSQGGGYFCSEAELGAGLPLRLKDDQDGAEPSANSVSAHNLLRLHGFTGHKDWMDKCVCLLTAFSERMRRVPVALPEMVRALSAQQQTLKQIVICGDRQAKDTKALVQCVHSVYIPNKVLILADGDPSSFLSRQLPFLSTLRRLEDQATAYVCENQACSVPITDPCELRKLLHP

SEQ ID NO: 892198 - protein, 802 aa, Homo sapiens [sequence omitted]

SEQ ID NO: 892199 - protein, 553 aa, Homo sapiens
MLGARAWLGRVLLLPRAGAGLAASRRCPGVWPRTWPHRSPSRGSSSRDKDRSATVSSSVPMPAGGKGSHPSSTPQRVPNRLIHEKSPYLLQHAYNPVDWYPWGQEAFDKARKENKPIFLSVGYSTCHWCHMMEEESFQNEEIGRLLSEDFVSVKVDREERPDVDKVYMTFVQATSSGGGWPMNVWLTPNLQPFVGGTYFPPEDGLTRVGFRTVLLRIREQWKQNKNTLLENSQRVTTALLARSEISVGDRQLPPSAATVNNRCFQQLDEGYDEEYGGFAEAPKFPTPVILSFLFSYWLSHRLTQDGSRAQQMALHTLKMMANGGIRDHVGQGFHRYSTDRQWHVPHFEKMLYDQAQLAVAYSQAFQLSGDEFYSDVAKGILQYVARSLSHRSGGFYSAEDADSPPERGQRPKEGAYYVWTVKEVQQLLPEPVLGATEPLTSGQLLMKHYGLTEAGNISPSQDPKGELQGQNVLTVRYSLELTAARFGLDVEAVRTLLNSGLEKLFQARKHRPKPHLDSKMLAAWNDRTGSFGTPRVAATSAVRLSWGLACPCV

SEQ ID NO: 892200 - protein, 404 aa, Homo sapiens
MLGARAWLGRVLLLPRAGAGLAASRRCPGVWPRTWPHRSPSRGSSSRDKDRSATVSSSVPMPAGGKGSHPSSTPQRVPNRLIHEKSPYLLQHAYNPVDWYPWGQEAFDKARKENKPIFLSVGYSTCHWCHMMEEESFQNEEIGRLLSEDFVSVKVDREERPDVDKVYMTFVQATSSGGGWPMNVWLTPNLQPFVGGTYFPPEDGLTRVGFRTVLLRIREQWKQNKNTLLENSQRVTTALLARSEISVGDRQLPPSAATVNNRCFQQLDEGYDEEYGGFAEAPKFPTPVILSFLFSYWLSHRLTQDGSRAQQMALHTLKMMANGGIRDHVGQGFHRYSTDRQWHVPHFEKMLYDQAQLAVAYSQAFQLSGDEFYSDVAKGILQYVARSLSHRSGGFYSAEDAEAL

SEQ ID NO: 892201 - protein, 97 aa, Homo sapiens
LPRDTVKFILGGVGAQGGAVSMAKDTKALVQCVHSVYIPNKVLILADGDPSSFLSRQLPFLSTLRRLEDQATAYVCENQACSVPITDPCELRKLLHP

SEQ ID NO: 892202 - protein, 600 aa, Homo sapiens
MAALAPVGSPASRGPRLAAGLRLLPMLGLLQLLAEPGLGRVHHLALKDDVRHKVHLNTFGFFKDGYMVVNVSSLSLNEPEDKDVTIGFSLDRTKNDGFSSYLDEDVNYCILKKQSVSVTLLILDISRSEVRVKSPPEAGTQLPKIIFSRDEKVLGQSQEPNVNPASAGNQTQKTQDGGKSKRSTVDSKAMGEKSFSVHNNGGAVSFQFFFNISTDDQEGLYSLYFHKCLGKELPSDKFTFSLDIEITEKNPDSYLSAGEIPLPKLYISMAFFFFLSGTIWIHILRKRRNDVFKIHWLMAALPFTKSLSLVFHAIDYHYISSQGFPIEGWAVVYYITHLLKGALLFITIALIGTGWAFIKHILSDKDKKIFMIVIPLQVLANVAYIIIESTEEGTTEYGLWKDSLFLVDLLCCGAILFPVVWSIRHLQEASATDGKGDSMGPLQQRANLRAGSRIESHHFAQADLELLASSCPPASVSQRAGITAAINLAKLKLFRHYYVLIVCYIYFTRIIAFLLKLAVPFQWKWLYQLLDETATLVFFVLTGYKFRPASDNPYLQLSQEEEDLEMESVVTTSGVMESMKKVKKVTNGSVEPQGEWEGAV

SEQ ID NO: 892203 - protein, 600 aa, Homo sapiens; identical to SEQ ID NO: 892202

SEQ ID NO: 892204 - protein, 552 aa, Homo sapiens
MAALAPVGSPASRGPRLAAGLRLLPMLGLLQLLAEPGLGRVHHLALKDDVRHKVHLNTFGFFKDGYMVVNVSSLSLNEPEDKDVTIGFSLDRTKNDGFSSYLDEDVNYCILKKQSVSVTLLILDISRSEVRVKSPPEAGTQLPKIIFSRDEKVLGQSQEPNVNPASAGNQTQKTQDGGKSKRSTVDSKAMGEKSFSVHNNGGAVSFQFFFNISTDDQEGLYSLYFHKCLGKELPSDKFTFSLDIEITEKNPDSYLSAGEIPLPKLYISMAFFFFLSGTIWIHILRKRRNDVFKIHWLMAALPFTKSLSLVFHAIDYHYISSQGFPIEGWAVVYYITHLLKGALLFITIALIGTGWAFIKHILSDKDKKIFMIVIPLQVLANVAYIIIESTEEGTTEYGLWKDSLFLVDLLCCGAILFPVVWSIRHLQEASATDGKAAINLAKLKLFRHYYVLIVCYIYFTRIIAFLLKLAVPFQWKWLYQLLDETATLVFFVLTGYKFRPASDNPYLQLSQEEEDLEMESVVTTSGVMESMKKVKKVTNGSVEPQGEWEGAV

SEQ ID NO: 892205 - protein, 571 aa, Homo sapiens
MAALAPVGSPASRGPRLAAGLRLLPMLGLLQLLAEPGLGRVHHLALKDDVRHKVHLNTFGFFKDGYMVVNVSSLSLNEPEDKDVTIGFSLDRTKNDGFSSYLDEDVNYCILKKQSVSVTLLILDISRSEVRVKSPPEAGTQLPKIIFSRDEKVLGQSQEPNVNPASAGNQTQKTQDGGKSKRSTVDSKAMGEKSFSVHNNGGAVSFQFFFNISTDDQEGLYSLYFHKCLGKELPSDKFTFSLDIEITEKNPDSYLSAGEIPLPKLYISMAFFFFLSGTIWIHILRKRRNDVFKIHWLMAALPFTKSLSLVFHAIDYHYISSQGFPIEGWAVVYYITHLLKGALLFITIALIGTGWAFIKHILSDKDKKIFMIVIPLQVLANVAYIIIESTEEGTTEYGLWKDSLFLVDLLCCGAILFPVVWSIRHLQEASATDGKGDSMGPLQQRANLRAGSRIAAINLAKLKLFRHYYVLIVCYIYFTRIIAFLLKLAVPFQWKWLYQLLDETATLVFFVLTGYKFRPASDNPYLQLSQEEEDLEMESVVTTSGVMESMKKVKKVTNGSVEPQGEWEGAV

SEQ ID NO: 892206 - protein, 463 aa, Homo sapiens
MNKMMYNWLFLSQDEDVNYCILKKQSVSVTLLILDISRSEVRVKSPPEAGTQLPKIIFSRDEKVLGQSQEPNVNPASAGNQTQKTQDGGKSKRSTVDSKAMGEKSFSVHNNGGAVSFQFFFNISTDDQEGLYSLYFHKCLGKELPSDKFTFSLDIEITEKNPDSYLSAGEIPLPKLYISMAFFFFLSGTIWIHILRKRRNDVFKIHWLMAALPFTKSLSLVFHAIDYHYISSQGFPIEGWAVVYYITHLLKGALLFITIALIGTGWAFIKHILSDKDKKIFMIVIPLQVLANVAYIIIESTEEGTTEYGLWKDSLFLVDLLCCGAILFPVVWSIRHLQEASATDGKAAINLAKLKLFRHYYVLIVCYIYFTRIIAFLLKLAVPFQWKWLYQLLDETATLVFFVLTGYKFRPASDNPYLQLSQEEEDLEMESVVTTSGVMESMKKVKKVTNGSVEPQGEWEGAV

SEQ ID NO: 892207 - protein, 453 aa, Homo sapiens
MSLAQGLHAACSVARSTALTFFPSVLFECRVRVKSPPEAGTQLPKIIFSRDEKVLGQSQEPNVNPASAGNQTQKTQDGGKSKRSTVDSKAMGEKSFSVHNNGGAVSFQFFFNISTDDQEGLYSLYFHKCLGKELPSDKFTFSLDIEITEKNPDSYLSAGEIPLPKLYISMAFFFFLSGTIWIHILRKRRNDVFKIHWLMAALPFTKSLSLVFHAIDYHYISSQGFPIEGWAVVYYITHLLKGALLFITIALIGTGWAFIKHILSDKDKKIFMIVIPLQVLANVAYIIIESTEEGTTEYGLWKDSLFLVDLLCCGAILFPVVWSIRHLQEASATDGKAAINLAKLKLFRHYYVLIVCYIYFTRIIAFLLKLAVPFQWKWLYQLLDETATLVFFVLTGYKFRPASDNPYLQLSQEEEDLEMESVVTTSGVMESMKKVKKVTNGSVEPQGEWEGAV

SEQ ID NO: 892208 - protein, 382 aa, Homo sapiens
MFLLLDGGKSKRSTVDSKAMGEKSFSVHNNGGAVSFQFFFNISTDDQEGLYSLYFHKCLGKELPSDKFTFSLDIEITEKNPDSYLSAGEIPLPKLYISMAFFFFLSGTIWIHILRKRRNDVFKIHWLMAALPFTKSLSLVFHAIDYHYISSQGFPIEGWAVVYYITHLLKGALLFITIALIGTGWAFIKHILSDKDKKIFMIVIPLQVLANVAYIIIESTEEGTTEYGLWKDSLFLVDLLCCGAILFPVVWSIRHLQEASATDGKAAINLAKLKLFRHYYVLIVCYIYFTRIIAFLLKLAVPFQWKWLYQLLDETATLVFFVLTGYKFRPASDNPYLQLSQEEEDLEMESVVTTSGVMESMKKVKKVTNGSVEPQGEWEGAV

SEQ ID NO: 892209 - protein, 275 aa, Homo sapiens
QRSPEVLSPSLLPWVHAIDYHYISSQGFPIEGWAVVYYITHLLKGALLFITIALIGTGWAFIKHILSDKDKKIFMIVIPLQVLANVAYIIIESTEEGTTEYGLWKDSLFLVDLLCCGAILFPVVWSIRHLQEASATDGKGDSMGPLQQRANLRAGSRIAAINLAKLKLFRHYYVLIVCYIYFTRIIAFLLKLAVPFQWKWLYQLLDETATLVFFVLTGYKFRPASDNPYLQLSQEEEDLEMESVVTTSGVMESMKKVKKVTNGSVEPQGEWEGAV

SEQ ID NO: 892210 - protein, 102 aa, Homo sapiens [sequence omitted]

SEQ ID NO: 892211 - protein, 138 aa, Homo sapiens [sequence omitted]

SEQ ID NO: 892212 - protein, 103 aa, Homo sapiens
MDLIVCYIYFTRIIAFLLKLAVPFQWKWLYQLLDETATLVFFVLTGYKFRPASDNPYLQLSQEEEDLEMESVVTTSGVMESMKKVKKVTNGSVEPQGEWEGAV

SEQ ID NO: 892213 - protein, 114 aa, Homo sapiens
TFHPGSWESHFHWKWNSECDNIWGDGKYEESQEGDQRLRGAPGRVGRRRVTEPTLRMALSKETVNLFIVLLDSRSSSYSELLAPPTVTPGHMAGAQCRGNLILYSLLWKRSVAV

SEQ ID NO: 892214 - protein, 165 aa, Homo sapiens
MGIFLTLCFPVQKHNTSFRRNVSQSVTTKALLSPSLRGTHLLFLPQADVVDEAIDSLARTKGVMKPPCSEGSPWRCPHFTCWVLQARKPGSGGTRERQACVWTSAGAAALRLARERQRWVFRFHAYVWAHSQHGRVSAVLVLTLPEQQWTDEIRLFQKQRWPQPS

SEQ ID NO: 892215 - protein, 552 aa, Homo sapiens; identical to SEQ ID NO: 892204

SEQ ID NO: 892216 - protein, 552 aa, Homo sapiens; identical to SEQ ID NO: 892204

SEQ ID NO: 892217 - protein, 552 aa, Homo sapiens; identical to SEQ ID NO: 892204

SEQ ID NO: 892218 - protein, 552 aa, Homo sapiens; identical to SEQ ID NO: 892204

SEQ ID NO: 892219 - protein, 296 aa, Homo sapiens
MAALAPVGSPASRGPRLAAGLRLLPMLGLLQLLAEPGLGRVHHLALKDDVRHKVHLNTFGFFKDGYMVVNVSSLSLNEPEDKDVTIGFSLDRTKNDGFSSYLDEDVNYCILKKQSVSVTLLILDISRSEVRVKSPPEAGTQLPKIIFSRDEKVLGQSQEPNVNPASAGNQTQKTQDGGKSKRSTVDSKAMGEKSFSVHNNGGAVSFQFFFNISTDDQEGLYSLYFHKCLGKELPSDKFTFSLDIEITEKNPDSYLSAGEIPLPKLYISMAFFFFLSGTIWIHILRKRRHWHWLGFH

SEQ ID NO: 892220 - protein, 450 aa, Homo sapiens
MAALAPVGSPASRGPRLAAGLRLLPMLGLLQLLAEPGLGRVHHLALKDDVRHKVHLNTFGFFKDGYMVVNVSSLSLNEPEDKDVTIGFSLDRTKNDGFSSYLDEDVNYCILKKQSVSVTLLILDISRSEVRVKSPPEAGTQLPKIIFSRDEKVLGQSQEPNVNPASAGNQTQKTQDGGKSKRSTVDSKAMGEKSFSVHNNGGAVSFQFFFNISTDDQEGLYSLYFHKCLGKELPSDKFTFSLDIEITEKNPDSYLSAGEIPLPKLYISMAFFFFLSGTIWIHILRKRRNDVFKIHWLMAALPFTKSLSLVFHAIDYHYISSQGFPIEGWAVVYYITHLLKGALLFITIALIGTGWAFIKHILSDKDKKIFMIVIPLQVLANVAYIIIESTEEGTTEYGLWKDSLFLVDLLCCGAILFPVVWSIRHLQEASATDGKEGKFSRAHFVLLSLL

SEQ ID NO: 892221 - protein, 552 aa, Homo sapiens; identical to SEQ ID NO: 892204

SEQ ID NO: 892222 - protein, 521 aa, Homo sapiens
MAALAPVGSPASRGPRLAAGLRLLPMLGLLQLLAEPGLGRVHHLALKDDVRHKVHLNTFGFFKDGYMVVNVSSLSLNEPEDKDVTIGFSLDRTKNDGFSSYLDEDVNYCILKKQSVSVTLLILDISRSEVRVKSPPEAGTQLPKIIFSRDEKVLGQSQEPNVNPASAGNQTQKTQDGGKSKRSTVDSKAMGEKSFSVHNNGGAVSFQFFFNISTDDQEGLYSLYFHKCLGKELPSDKFTFSLDIEITEKNPDSYLSAGEIPLPKLYISMAFFFFLSGTIWIHILRKRRNDVFKIHWLMAALPFTKSLSLVFHAIDYHYISSQGFPIEGWAVVYYITHLLKGALLFITIALIGTGWAFIKHILSDKDKKIFMIVIPLQVLANVAYIIIESTEEGTTEYGLWKDSLFLVDLLCCGAILFPVVWSIRHLQEASATDGKAAINLAKLKLFRHYYVLIVCYIYFTRIIAFLLKLAVPFQWKWLYQLLDETATLVFFVLTGYKFRPASDNPYLQLSQEEEDLEMESV

SEQ ID NO: 892223 - protein, 488 aa, Homo sapiens
MAALAPVGSPASRGPRLAAGLRLLPMLGLLQLLAEPGLGRVHHLALKDDVRHKVHLNTFGFFKDGYMVVNVSSLSLNEPEDKDVTIGFSLDRTKNDGFSSYLDEDVNYCILKKQSVSVTLLILDISRSEVRVKSPPEAGTQLPKIIFSRDEKVLGQSQEPNVNPASAGNQTQKTQDGGKSKRSTVDSKAMGEKSFSVHNNGGAVSFQFFFNISTDDQEGLYSLYFHKCLGKELPSDKFTFSLDIEITEKNPDSYLSAGEIPLPKLYISMAFFFFLSGTIWIHILRKRRNDVFKIHWLMAALPFTKSLSLVFHAIDYHYISSQGFPIEGWAVVYYITHLLKGALLFITIALIGTGWAFIKHILSDKDKKIFMIVIPLQVLANVAYIIIESTEEGTTEYGLWKDSLFLVDLLCCGAILFPVVWSIRHLQEASATDGKGDSMGPLQQRANLRAGSRIAAINLAKLKLFRHYYVLIVCYIYFTRIIAFLLKP

SEQ ID NO: 892224 - protein, 374 aa, Homo sapiens
MAALAPVGSPASRGPRLAAGLRLLPMLGLLQLLAEPGLGRVHHLALKDDVRHKVHLNTFGFFKDGYMVVNVSSLSLNEPEDKDVTIGFSLDRTKNDGFSSYLDEDVNYCILKKQSVSVTLLILDISRSEVRVKSPPEAGTQLPKIIFSRDEKVLGQSQEPNVNPASAGNQTQKTQDGGKSKRSTVDSKAMGEKSFSVHNNGGAVSFQFFFNISTDDQEGLYSLYFHKCLGKELPSDKFTFSLDIEITEKNPDSYLSAGEIPLPKLYISMAFFFFLSGTIWIHILRKRRNDVFKIHWLMAALPFTKSLSLVFHAIDYHYISSQGFPIEGWAVVYYITHLLKGALLFITIALIGTGWAFIKHILSDKDKKIQMLRG

SEQ ID NO: 892225 - protein, 98 aa, Homo sapiens
QRREPLGLLRYHGRRRGKRQQNHRGIGRLFRSGQVYSARGFGWRPDSFHLKPENIGPHKVLLMQTNFDMENMFDLLKKGDRSEGPSWSRALPLSEGPY

SEQ ID NO: 892226 - protein, 72 aa, Homo sapiens
MSSKTASTNNIAQARRTVQQLRLEASIERIKVSKASADLMSYCEEHARSDPLLIGIPTSENPFKDKKTCIIL

SEQ ID NO: 892227 - protein, 72 aa, Homo sapiens; identical to SEQ ID NO: 892226

SEQ ID NO: 892228 - protein, 82 aa, Homo sapiens
SFGYNRNGASLRQRAIDHLIFNVSLNIYNVAVFQNIFMKNYFYYTIMCMLLVAGIVYYLVLKHALLPNSKQVCFDIYLLICL

SEQ ID NO: 892229 - protein, 72 aa, Homo sapiens; identical to SEQ ID NO: 892226

SEQ ID NO: 892230 - protein, 72 aa, Homo sapiens; identical to SEQ ID NO: 892226

SEQ ID NO: 892231 - protein, 581 aa, Homo sapiens
LYDRRDCFVAVSFPRGLSLWLHFYLWWLCYGGAEMRQKRKGDLSPAELMMLTIGDVIKQLIEAHEQGKDIDLNKVKTKTAAKYGLSAQPRLVDIIAAVPPQYRKVLMPKLKAKPIRTASGIAVVAVMCKPHRCPHISFTGNICVYCPGGPDSDFEYSTQSYTGYEPTSMRAIRARYDPFLQTRHRIEQLKQLGHSVDKVEFIVMGGTFMALPEEYRDYFIRNLHDALSGHTSNNIYEAVKYSERSLTKCIGITIETRPDYCMKRHLSDMLTYGCTRLEIGVQSVYEDVARDTNRGHTVKAVCESFHLAKDSGFKVVAHMMPDLPNVGLERDIEQFTEFFENPAFRPDGLKLYPTLVIRGTGLYELWKSGRYKSYSPSDLVELVARILALVPPWTRVYRVQRDIPMPLVSSGVEHGNLRELALARMKDLGIQCRDVRTREVGIQEIHHKVRPYQVELVRRDYVANGGWETFLSYEDPDQDILIGLLRLRKCSEETFRFELGGGVSIVRELHVYGSVVPVSSRDPTKFQHQGFGMLLMEEAERIAREEHGSGKIAVISGVGTRNYYRKIGYRLQGPYMVKMLK

SEQ ID NO: 892232 - protein, 533 aa, Homo sapiens
LYDRRDCFVAVSFPRGLSLWLHFYLWWLCYGGAEMRQKRKGDLSPAELMMLTIGDVIKQLIEAHEQGKDIDLNKVKTKTAAKYGLSAQPRLVDIIAAVPPQYRKVLMPKLKAKPIRTASGIAVVAVMCKPHRCPHISFTGNICVYCPGGPDSDFEYSTQSYTGYEPTSMRAIRARYDPFLQTRHRIEQLKQLGHSVDKVEFIVMGGTFMALPEEYRDYFIRNLHDALSGHTSNNIYEAVKYSERSLTKCIGITIETRPDYCMKRHLSDMLTYGCTRLEIGVQSVYEDVARDTNRGHTVKAVCESFHLAKDSGFKVVAHMMPDLPNVGLERDIEQFTEFFENPAFRPDGLKLYPTLVIRGTGLYELWKSGRYKSYSPSDLVELVARILALVPPWTRVYRVQRDIPMPLVSSGVEHGNLRELALARMKDLGIQCRDVRTREVGIQEIHHKVRPYQVELVRRDYVANGGWETFLSYEDPDQDILIGLLRLRKCSERIAREEHGSGKIAVISGVGTRNYYRKIGYRLQGPYMVKMLK

SEQ ID NO: 892233 - protein, 581 aa, Homo sapiens; identical to SEQ ID NO: 892231

SEQ ID NO: 892234 - protein, 581 aa, Homo sapiens; identical to SEQ ID NO: 892231

SEQ ID NO: 892235 - protein, 532 aa, Homo sapiens [sequence omitted]

SEQ ID NO: 892236 - protein, 548 aa, Homo sapiens
TLRQAGLFCGCQLSPWSEFVAAFLSLVALLRRRRNEAEAERVKTKTAAKYGLSAQPRLVDIIAAVPPQYRKVLMPKLKAKPIRTASGIAVVAVMCKPHRCPHISFTGNICVYCPGGPDSDFEYSTQSYTGYEPTSMRAIRARYDPFLQTRHRIEQLKQLGHSVDKVEFIVMGGTFMALPEEYRDYFIRNLHDALSGHTSNNIYEAVKYSERSLTKCIGITIETRPDYCMKRHLSDMLTYGCTRLEIGVQSVYEDVARDTNRGHTVKAVCESFHLAKDSGFKVVAHMMPDLPNVGLERDIEQFTEFFENPAFRPDGLKLYPTLVIRGTGLYELWKSGRYKSYSPSDLVELVARILALVPPWTRVYRVQRDIPMPLVSSGVEHGNLRELALARMKDLGIQCRDVRTREVGIQEIHHKVRPYQVELVRRDYVANGGWETFLSYEDPDQDILIGLLRLRKCSEETFRFELGGGVSIVRELHVYGSVVPVSSRDPTKFQHQGFGMLLMEEAERIAREEHGSGKIAVISGVGTRNYYRKIGYRLQGPYMVKMLK

SEQ ID NO: 892237 - protein, 537 aa, Homo sapiens
DLSSSVQGGVANSGAQAVASWSGGESSIVWVKTKTAAKYGLSAQPRLVDIIAAVPPQYRKVLMPKLKAKPIRTASGIAVVAVMCKPHRCPHISFTGNICVYCPGGPDSDFEYSTQSYTGYEPTSMRAIRARYDPFLQTRHRIEQLKQLGHSVDKVEFIVMGGTFMALPEEYRDYFIRNLHDALSGHTSNNIYEAVKYSERSLTKCIGITIETRPDYCMKRHLSDMLTYGCTRLEIGVQSVYEDVARDTNRGHTVKAVCESFHLAKDSGFKVVAHMMPDLPNVGLERDIEQFTEFFENPAFRPDGLKLYPTLVIRGTGLYELWKSGRYKSYSPSDLVELVARILALVPPWTRVYRVQRDIPMPLVSSGVEHGNLRELALARMKDLGIQCRDVRTREVGIQEIHHKVRPYQVELVRRDYVANGGWETFLSYEDPDQDILIGLLRLRKCSEETFRFELGGGVSIVRELHVYGSVVPVSSRDPTKFQHQGFGMLLMEEAERIAREEHGSGKIAVISGVGTRNYYRKIGYRLQGPYMVKMLK

SEQ ID NO: 892238 - protein, 320 aa, Homo sapiens [sequence omitted]

SEQ ID NO: 892239 - protein, 320 aa, Homo sapiens [sequence omitted]

SEQ ID NO: 892240 - protein, 564 aa, Homo sapiens
LYDRRDCFVAVSFPRGLSLWLHFYLWWLCYGGAEMRQKRKGDLSPAELMMLTIGDVIKQLIEAHEQGKDIDLNKVKTKTAAKYGLSAQPRLVDIIAAVPPQYRKVLMPKLKAKPIRTASGIAVVAVMCKPHRCPHISFTGNICVYCPGGPDSDFEYSTQSYTGYEPTSMRAIRARYDPFLQTRHRIEQLKQLGHSVDKVEFIVMGGTFMALPEEYRDYFIRNLHDALSGHTSNNIYEAVKYSERSLTKCIGITIETRPDYCMKRHLSDMLTYGCTRLEIGVQSVYEDVARDTNRGHTVKAVCESFHLAKDSGFKVVAHMMPDLPNVGLERDIEQFTEFFENPAFRPDGLKLYPTLVIRGTGLYELWKSGRYKSYSPSDLVELVARILALVPPWTRVYRVQRDIPMPLVSSGVEHGNLRELALARMKDLGIQCRDVRTREVGIQEIHHKVRPYQVELVRRDYVANGGWETFLSYEDPDQDILIGLLRLRKCSEETFRFELGGGVSIVRELHVYGSVVPVSSRDPTKFQHQGFGMLLMEEAERIAREEHGSGKIAVISGVGTQEII

SEQ ID NO: 892241 - protein, 574 aa, Homo sapiens
LYDRRDCFVAVSFPRGLSLWLHFYLWWLCYGGAEMRQKRKGDLSPAELMMLTIGDVIKQLIEAHEQGKDIDLNKVKTKTAAKYGLSAQPRLVDIIAAVPPQYRKVLMPKLKAKPIRTASGIAVVAVMCKPHRCPHISFTGNICVYCPGGPDSDFEYSTQSYTGYEPTSMRAIRARYDPFLQTRHRIEQLKQLGHSVDKVEFIVMGGTFMALPEEYRDYFIRNLHDALSGHTSNNIYEAVKYSERSLTKCIGITIETRPDYCMKRHLSDMLTYGCTRLEIGVQSVYEDVARDTNRGHTVKAVCESFHLAKDSGFKVVAHMMPDLPNVGLERDIEQFTEFFENPAFRPDGLKLYPTLVIRGTGLYELWKSGRYKSYSPSDLVELVARILALVPPWTRVYRVQRDIPMPLVSSGVEHGNLRELALARMKDLGIQCRDVRTREVGIQEIHHKVRPYQVELVRRDYVANGGWETFLSYEDPDQDILIGLLRLRKCSEETFRFELGGGVSIVRELHVYGSVVPVSSRDPTKFQHQGFGMLLMEEAERIAREEHGSGKIAVISGVDVLGQRQRGGHHRSCS

SEQ ID NO: 892242 - protein, 556 aa, Homo sapiens
LYDRRDCFVAVSFPRGLSLWLHFYLWWLCYGGAEMRQKRKGDLSPAELMMLTIGDVIKQLIEAHEQGKDIDLNKVKTKTAAKYGLSAQPRLVDIIAAVPPQYRKVLMPKLKAKPIRTASGIAVVAVMCKPHRCPHISFTGNICVYCPGGPDSDFEYSTQSYTGYEPTSMRAIRARYDPFLQTRHRIEQLKQLGHSVDKVEFIVMGGTFMALPEEYRDYFIRNLHDALSGHTSNNIYEAVKYSERSLTKCIGITIETRPDYCMKRHLSDMLTYGCTRLEIGVQSVYEDVARDTNRGHTVKAVCESFHLAKDSGFKVVAHMMPDLPNVGLERDIEQFTEFFENPAFRPDGLKLYPTLVIRGTGLYELWKSGRYKSYSPSDLVELVARILALVPPWTRVYRVQRDIPMPLVSSGVEHGNLRELALARMKDLGIQCRDVRTREVGIQEIHHKVRPYQVELVRRDYVANGGWETFLSYEDPDQDILIGLLRLRKCSEETFRFELGGGVSIVRELHVYGSVVPVSSRDPTKFQHQGFGMLLIEEQKIVVKVLKAQAQSQKAK

SEQ ID NO: 892243 - protein, 208 aa, Homo sapiens
LYDRRDCFVAVSFPRGLSLWLHFYLWWLCYGGAEMRQKRKGDLSPAELMMLTIGDVIKQLIEAHEQGKDIDLNKVKTKTAAKYGLSAQPRLVDIIAAVPPQYRKVLMPKLKAKPIRTASGIAVVAVMCKPHRCPHISFTGNICVYCPGGPDSDFEYSTQSYTGYEPTSMRAIRARYDPFLQTRHRIEQKADLKCLLCLESSINFRLLS

SEQ ID NO: 892244 - protein, 734 aa, Homo sapiens
MSWESGAGPGLGSQGMDLVWSAWYGKCVKGKGSLPLSAHGIVVAWLSRAEWDQVTVYLFCDDHKLQRYALNRITVWRSRSGNELPLAVASTADLIRCKLLDVTGGLGTDELRLLYGMALVRFVNLISERKTKFAKVPLKCLAQEVNIPDWIVDLRHELTHKKMPHINDCRRGCYFVLDWLQKTYWCRQLENSLRETWELEEFREGIEEEDQEEDKNIVVDDITEQKPEPQDDGKSTESDVKADGDSKGSEEVDSHCKKALSHKELYERARELLVSYEEEQFTVLEKFRYLPKAIKAWNNPSPRVECVLAELKGVTCENREAVLDAFLDDGFLVPTFEQLAALQIEYEDGQTEVQRGEGTDPKSHKNVDLNDVLVPKPFSQFWQPLLRGLHSQNFTQALLERMLSELPALGISGIRPTYILRWTVELIVANTKTGRNARRFSAGQWEARRGWRLFNCSASLDWPRMVESCLGSPCWASPQLLRIIFKAMGQGLPDEEQEKLLRICSIYTQSGENSLVQEGSEASPIGKSPYTLDSLYWSVKPASSSFGSEAKAQQQEEQGSVNDVKEEEKEEKEVLPDQVEEEEENDDQEEEEEDEDDEDDEEEDRMEVGPFSTGQESPTAENARLLAQKRGALQGSAWQVSSEDVRWDTFPLGRMPGQTEDPAELMLENYDTMYLLDQPVLEQRLEPSTCKTDTLGLSCGVGSGNCSNSSSSNFEGLLWSQGQLHGLKTGLQLF

SEQ ID NO: 892245 - protein, 154 aa, Homo sapiens
PKQLCFNLVYLLGLCIKLHLKSSCLLPSLPQLRRGPSQPWGPHEVVSRICSSLFVKPGRRVGPSHRYTHVKHSWPLQSLKLPPSLTDLPLSPQHLGPELWCRQWQLQQQQQQQLRGPSLEPGAAAWAQNWPAALLMAIPGASVHPAVPGQQPTP

SEQ ID NO: 892246 - protein, 248 aa, Homo sapiens
TARYEAWCYKNIVVDDITEQKPEPQDDGKSTESDVKADGDSKGSEEVDSHCKKALSHKELYERARELLVSYEEEQFTVLEKFRYLPKAIKAWNNPSPRVECVLAELKGVTCENREAVLDAFLDDGFLVPTFEQLAALQIEYEDGQTEVQRGEGTDPKSHKNVDLNDVLVPKPFSQFWQPLLRGLHSQNFTQALLERMLSELPALGISGIRPTYILRWTVELIVANTKTGRNVAISEAVCARGVGLSLS

SEQ ID NO: 892247 - protein, 717 aa, Homo sapiens
MSWESGAGPGLGSQGMDLVWSAWYGKCVKGKGSLPLSAHGIVVAWLSRAEWDQVTVYLFCDDHKLQRYALNRITVWRSRSGNELPLAVASTADLIRCKLLDVTGGLGTDELRLLYGMALVRFVNLISERKTKFAKVPLKCLAQEVNIPDWIVDLRHELTHKKMPHINDCRRGCYFVLDWLQKTYWCRQLENSLRETWELEEFREGIEEEDQEEDKNIVVDDITEQKPEPQDDGKSTESDVKADGDSKGSEEVDSHCKKALSHKELYERARELLVSYEEEQFTVLEKFRYLPKAIKAWNNPSPRVECVLAELKGVTCENREAVLDAFLDDGFLVPTFEQLAALQIEYEENVDLNDVLVPKPFSQFWQPLLRGLHSQNFTQALLERMLSELPALGISGIRPTYILRWTVELIVANTKTGRNARRFSAGQWEARRGWRLFNCSASLDWPRMVESCLGSPCWASPQLLRIIFKAMGQGLPDEEQEKLLRICSIYTQSGENSLVQEGSEASPIGKSPYTLDSLYWSVKPASSSFGSEAKAQQQEEQGSVNDVKEEEKEEKEVLPDQVEEEEENDDQEEEEEDEDDEDDEEEDRMEVGPFSTGQESPTAENARLLAQKRGALQGSAWQVSSEDVRWDTFPLGRMPGQTEDPAELMLENYDTMYLLDQPVLEQRLEPSTCKTDTLGLSCGVGSGNCSNSSSSNFEGLLWSQGQLHGLKTGLQLF

SEQ ID NO: 892248 - protein, 415 aa, Homo sapiens
MKEPENCWYHTKRSSLREAVLDAFLDDGFLVPTFEQLAALQIEYEENVDLNDVLVPKPFSQFWQPLLRGLHSQNFTQALLERMLSELPALGISGIRPTYILRWTVELIVANTKTGRNARRFSAGQWEARRGWRLFNCSASLDWPRMVESCLGSPCWASPQLLRIIFKAMGQGLPDEEQEKLLRICSIYTQSGENSLVQEGSEASPIGKSPYTLDSLYWSVKPASSSFGSEAKAQQQEEQGSVNDVKEEEKEEKEVLPDQVEEEEENDDQEEEEEDEDDEDDEEEDRMEVGPFSTGQESPTAENARLLAQKRGALQGSAWQVSSEDVRWDTFPLGRMPGQTEDPAELMLENYDTMYLLDQPVLEQRLEPSTCKTDTLGLSCGVGSGNCSNSSSSNFEGLLWSQGQLHGLKTGLQLF

SEQ ID NO: 892249 - protein, 687 aa, Homo sapiens
MSWESGAGPGLGSQGMDLVWSAWYGKCVKGKGSLPLSAHGIVVAWLSRAEWDQVTVYLFCDDHKLQRYALNRITVWRSRSGNELPLAVASTADLIRCKLLDVTGGLGTDELRLLYGMALVRFVNLISERKTKFAKVPLKCLAQEVNIPDWIVDLRHELTHKKMPHINDCRRGCYFVLDWLQKTYWCRQLENSLRETWELEEFREGIEEEDQEEDKNIVVDDITEQKPEPQDDGKSTESDVKADGDSKGSEEVDSHCKKALSHKELYERARELLVSYEEEQFTVLEKFRYLPKAIKAWNNPSPRVECVLAELKGVTCENREAVLDAFLDDGFLVPTFEQLAALQIEYEENVDLNDVLVPKPFSQFWQPLLRGLHSQNFTQALLERMLSELPALGISGIRPTYILRWTVELIVANTKTGRNARRFSAGQWEARRGWRLFNCSASLDWPRMVESCLGSPCWASPQLLRIIFKAMGQGLPDEEQEKLLRICSIYTQSGENSLVQEGSEASPIGKSPYTLDSLYWSVKPASSSFGSEAKAQQQEEQGSVNDVKEEEKEEKEVLPDQVEEEEENDDQEEEEEDEDDEDDEEEDRMEVGPFSTGQESPTAENARLLAQKRGALQGSAWQVSSEDVRWDTFPLGRMPGQTEDPAELMLENYDTMYLLDQPVLEQRLEPSTCKTDHLILGPACWSA

SEQ ID NO: 892250 - protein, 699 aa, Homo sapiens
MSWESGAGPGLGSQGMDLVWSAWYGKCVKGKGSLPLSAHGIVVAWLSRAEWDQVTVYLFCDDHKLQRYALNRITVWRSRSGNELPLAVASTADLIRCKLLDVTGGLGTDELRLLYGMALVRFVNLISERKTKFAKVPLKCLAQEVNIPDWIVDLRHELTHKKMPHINDCRRGCYFVLDWLQKTYWCRQLENSLRETWELEEFREGIEEEDQEEDKNIVVDDITEQKPEPQDDGKSTESDVKADGDSKGSEEVDSHCKKALSHKELYERARELLVSYEEEQFTVLEKFRYLPKAIKAWNNPSPRVECVLAELKGVTCENREAVLDAFLDDGFLVPTFEQLAALQIEYEENVDLNDVLVPKPFSQFWQPLLRGLHSQNFTQALLERMLSELPALGISGIRPTYILRWTVELIVANTKTGRNARRFSAGQWEARRGWRLFNCSASLDWPRMVESCLGSPCWASPQLLRIIFKAMGQGLPDEEQEKLLRICSIYTQSGENSLVQEGSEASPIGKSPYTLDSLYWSVKPASSSFGSEAKAQQQEEQGSVNDVKEEEKEEKEVLPDQVEEEEENDDQEEEEEDEDDEDDEEEDRMEVGPFSTGQESPTAENARLLAQKRGALQGSAWQVSSEDVRWDTFPLGRMPGQDQPVLEQRLEPSTCKTDTLGLSCGVGSGNCSNSSSSNFEGLLWSQGQLHGLKTGLQLF

SEQ ID NO: 892251 - protein, 548 aa, Homo sapiens
ENGARTIYRANRKGQTVGTGENSLRETWELEEFREGIEEEDQEEDKNIVVDDITEQKPEPQDDGKSTESDVKADGDSKGSEEVDSHCKKALSHKELYERARELLVSYEEEQFTVLEKFRYLPKAIKAWNNPSPRVECVLAELKGVTCENREAVLDAFLDDGFLVPTFEQLAALQIEYEENVDLNDVLVPKPFSQFWQPLLRGLHSQNFTQALLERMLSELPALGISGIRPTYILRWTVELIVANTKTGRNARRFSAGQWEARRGWRLFNCSASLDWPRMVESCLGSPCWASPQLLRIIFKAMGQGLPDEEQEKLLRICSIYTQSGENSLVQEGSEASPIGKSPYTLDSLYWSVKPASSSFGSEAKAQQQEEQGSVNDVKEEEKEEKEVLPDQVEEEEENDDQEEEEEDEDDEDDEEEDRMEVGPFSTGQESPTAENARLLAQKRGALQGSAWQVSSEDVRWDTFPLGRMPGQTEDPAELMLENYDTMYLLDQPVLEQRLEPSTCKTDTLGLSCGVGSGNCSNSSSSNFEGLLWSQGQLHGLKTGLQLF

SEQ ID NO: 892252 - protein, 472 aa, Homo sapiens
MSWESGAGPGLGSQGMDLVWSAWYGKCVKGKGSLPLSAHGIVVAWLSRAEWDQVTVYLFCDDHKLQRYALNRITVWRSRSGNELPLAVASTADLIRCKLLDVTGGLGTDELRLLYGMALVRFVNLISERKTKFAKVPLKCLAQEVNIPDWIVDLRHELTHKKMPHINDCRRGCYFVLDWLQKTYWCRQLENSLRETWELEEFREGIEEEDQEEDKNIVVDDITEQKPEPQDDGKSTESDVKADGDSKGSEEVDSHCKKALSHKELYERARELLVSYEEEQFTVLEKFRYLPKAIKAWNNPSPRVECVLAELKGVTCENREAVLDAFLDDGFLVPTFEQLAALQIEYEENVDLNDVLVPKPFSQFWQPLLRGLHSQNFTQALLERMLSELPALGISGIRPTYILRWTVELIVANTKTGRNARRFSAGQWEARRGWRLFNCSASLDWPRMVESCLGSPCWASPQLLRIAVLGGS

SEQ ID NO: 892253 - protein, 529 aa, Homo sapiens
TARYEAWCYKNIVVDDITEQKPEPQDDGKSTESDVKADGDSKGSEEVDSHCKKALSHKELYERARELLVSYEEEQFTVLEKFRYLPKAIKAWNNPSPRVECVLAELKGVTCENREAVLDAFLDDGFLVPTFEQLAALQIEYEDGQTEVQRGEGTDPKSHKNVDLNDVLVPKPFSQFWQPLLRGLHSQNFTQALLERMLSELPALGISGIRPTYILRWTVELIVANTKTGRNARRFSAGQWEARRGWRLFNCSASLDWPRMVESCLGSPCWASPQLLRIIFKAMGQGLPDEEQEKLLRICSIYTQSGENSLVQEGSEASPIGKSPYTLDSLYWSVKPASSSFGSEAKAQQQEEQGSVNDVKEEEKEEKEVLPDQVEEEEENDDQEEEEEDEDDEDDEEEDRMEVGPFSTGQESPTAENARLLAQKRGALQGSAWQVSSEDVRWDTFPLGRMPGQTEDPAELMLENYDTMYLLDQPVLEQRLEPSTCKTDTLGLSCGVGSGNCSNSSSSNFEGLLWSQGQLHGLKTGLQLF

SEQ ID NO: 892254 - protein, 270 aa, Homo sapiens
MVESCLGSPCWASPQLLRIIFKAMGQGLPDEEQEKLLRICSIYTQSGENSLVQEGSEASPIGKSPYTLDSLYWSVKPASSSFGSEAKAQQQEEQGSVNDVKEEEKEEKEVLPDQVEEEEENDDQEEEEEDEDDEDDEEEDRMEVGPFSTGQESPTAENARLLAQKRGALQGSAWQVSSEDVRWDTFPLGRMPGQTEDPAELMLENYDTMYLLDQPVLEQRLEPSTCKTDTLGLSCGVGSGNCSNSSSSNFEGLLWSQGQLHGLKTGLQLF

SEQ ID NO: 892255 - protein, 308 aa, Homo sapiens
MSWESGAGPGLGSQGMDLVWSAWYGKCVKGKGSLPLSAHGIVVAWLSRAEWDQVTVYLFCDDHKLQRYALNRITVWRSRSGNELPLAVASTADLIRCKLLDVTGGLGTDELRLLYGMALVRFVNLISERKTKFAKVPLKCLAQEVNIPDWIVDLRHELTHKKMPHINDCRRGCYFVLDWLQKTYWCRQLENSLRETWELEEFREGIEEEDQEEDKNIVVDDITEQKPEPQDDGKSTESDVKADGDSKGSEEVDSHCKKALSHKELYERARELLVSYEEEQFTVLEKFRYLPKAIKAWNNPPPSTTDAP

SEQ ID NO: 892256 - protein, 305 aa, Homo sapiens
MSWESGAGPGLGSQGMDLVWSAWYGKCVKGKGSLPLSAHGIVVAWLSRAEWDQVTVYLFCDDHKLQRYALNRITVWRSRSGNELPLAVASTADLIRCKLLDVTGGLGTDELRLLYGMALVRFVNLISERKTKFAKVPLKCLAQEVNIPDWIVDLRHELTHKKMPHINDCRRGCYFVLDWLQKTYWCRQLENSLRETWELEEFREGIEEEDQEEDKNIVVDDITEQKPEPQDDGKSTESDVKADGDSKGSEEVDSHCKKALSHKELYERARELLVSYEEEQFTVRKCPGLGVLSSAPAISSLLPAT

SEQ ID NO: 892257 - protein, 717 aa, Homo sapiens; identical to SEQ ID NO: 892247

SEQ ID NO: 892258 - protein, 699 aa, Homo sapiens; identical to SEQ ID NO: 892250

SEQ ID NO: 892259 - protein, 719 aa, Homo sapiens
MSWESGAGPGLGSQGMDLVWSAWYGKCVKGKGSLPLSAHGIVVAWLSRAEWDQVTVYLFCDDHKLQRYALNRITVWRSRSGNELPLAVASTADLIRCKLLDVTGGLGTDELRLLYGMALVRFVNLISERKTKFAKVPLKCLAQEVNIPDWIVDLRHELTHKKMPHINDCRRGCYFVLDWLQKTYWCRQLENSLRETWELEEFREGIEEEDQEEDKNIVVDDITEQKPEPQDDGKSTESDVKADGDSKGSEEVDSHCKKALSHKELYERARELLVSYEEEQFTVLEKFRYLPKAIKAWNNPSPRVECVLAELKGVTCENREAVLDAFLDDGFLVPTFEQLAALQIEYEENVDLNDVLVPKPFSQFWQPLLRGLHSQNFTQALLERMLSELPALGISGIRPTYILRWTVELIVANTKTGRNARRFSAGQWEARRGWRLFNCSASLDWPRMVESCLGSPCWASPQLLRIIFKAMGQGLPDEEQEKLLRICSIYTQSGENSLVQEGSEASPIGKSPYTLDSLYWSVKPASSSFGSEAKAQQQEEQGSVNDVKEEEKEEKEVLPDQVEEEEENDDQEEEEEDEDDEDDEEEDRMEVGPFSTGQESPTAENARLLAQKRGALQGSAWQVSSEDVRWDTFPLGRMPGQTEDPAELMLENYDTMYLLDQPVLEQRLEPSTCKTDTLGLKGVLSNRQCQTQPQSPSLQAFMLETPGGCPIRCGRPARS

SEQ ID NO: 892260 - protein, 714 aa, Homo sapiens
SGVKYIQHYVEEEASRIDEDKTSIGYGQANVARVCRGVRTEVPLNLRDGSEATPSGMTGRRGQLASIKVHRFYETRIKTDHLSLGVDIIDLVNESDWEGLIPCQMAVMGMTVRDGSELDYGVIRVRKTKFAKVPLKCLAQEVNIPDWIVDLRHELTHKKMPHINDCRRGCYFVLDWLQKTYWCRQLENSLRETWELEEFREGIEEEDQEEDKNIVVDDITEQKPEPQDDGKSTESDVKADGDSKGSEEVDSHCKKALSHKELYERARELLVSYEEEQFTVLEKFRYLPKAIKAWNNPSPRVECVLAELKGVTCENREAVLDAFLDDGFLVPTFEQLAALQIEYEENVDLNDVLVPKPFSQFWQPLLRGLHSQNFTQALLERMLSELPALGISGIRPTYILRWTVELIVANTKTGRNARRFSAGQWEARRGWRLFNCSASLDWPRMVESCLGSPCWASPQLLRIIFKAMGQGLPDEEQEKLLRICSIYTQSGENSLVQEGSEASPIGKSPYTLDSLYWSVKPASSSFGSEAKAQQQEEQGSVNDVKEEEKEEKEVLPDQVEEEEENDDQEEEEEDEDDEDDEEEDRMEVGPFSTGQESPTAENARLLAQKRGALQGSAWQVSSEDVRWDTFPLGRMPGQTEDPAELMLENYDTMYLLDQPVLEQRLEPSTCKTDTLGLSCGVGSGNCSNSSSSNFEGLLWSQGQLHGLKTGLQLF

SEQ ID NO: 892261 - protein, 472 aa, Homo sapiens; identical to SEQ ID NO: 892252

SEQ ID NO: 892262 - protein, 415 aa, Homo sapiens
MVFCQHHFAKLVSSCSREAVLDAFLDDGFLVPTFEQLAALQIEYEENVDLNDVLVPKPFSQFWQPLLRGLHSQNFTQALLERMLSELPALGISGIRPTYILRWTVELIVANTKTGRNARRFSAGQWEARRGWRLFNCSASLDWPRMVESCLGSPCWASPQLLRIIFKAMGQGLPDEEQEKLLRICSIYTQSGENSLVQEGSEASPIGKSPYTLDSLYWSVKPASSSFGSEAKAQQQEEQGSVNDVKEEEKEEKEVLPDQVEEEEENDDQEEEEEDEDDEDDEEEDRMEVGPFSTGQESPTAENARLLAQKRGALQGSAWQVSSEDVRWDTFPLGRMPGQTEDPAELMLENYDTMYLLDQPVLEQRLEPSTCKTDTLGLSCGVGSGNCSNSSSSNFEGLLWSQGQLHGLKTGLQLF

SEQ ID NO: 892263 - protein, 359 aa, Homo sapiens
SYAQHQQVRQIRKKMMEIMTREVQTNDLKEVVNKLIPDSIGKDIEKACQSIYPLHDVFVRKVKMLKKPKFELGKLMELMVKAVVLDWPRMVESCLGSPCWASPQLLRIIFKAMGQGLPDEEQEKLLRICSIYTQSGENSLVQEGSEASPIGKSPYTLDSLYWSVKPASSSFGSEAKAQQQEEQGSVNDVKEEEKEEKEVLPDQVEEEEENDDQEEEEEDEDDEDDEEEDRMEVGPFSTGQESPTAENARLLAQKRGALQGSAWQVSSEDVRWDTFPLGRMPGQTEDPAELMLENYDTMYLLDQPVLEQRLEPSTCKTDTLGLSCGVGSGNCSNSSSSNFEGLLWSQGQLHGLKTGLQLF

SEQ ID NO: 892264 - protein, 243 aa, Homo sapiens
MSWESGAGPGLGSQGMDLVWSAWYGKCVKGKGSLPLSAHGIVVAWLSRAEWDQVTVYLFCDDHKLQRYALNRITVWRSRSGNELPLAVASTADLIRCKLLDVTGGLGTDELRLLYGMALVRFVNLISERKTKFAKVPLKCLAQEVNIPDWIVDLRHELTHKKMPHINDCRRGCYFVLDWLQKTYWCRQLENSLRETWELEEFREGIEEEDQEEDKNIVVDDITEQKPEPGSATSTQLSTTGEF

SEQ ID NO: 892265 - protein, 268 aa, Homo sapiens
MQQIRPPFIRGPPHHASNPNSPLSNPMLPGIGPPPGGPRNLGPTSSPMHRPMLSPHIHPPSTPTMPGNPPGLLPPPPPGAPLPSLPFPPVSMMPNGPMPVPQMMNFGLPSLAPLVPPPTLLVPYPVIVPLPVPIPIPIPIPHVSDSKPPKKLLSPEEPAVSELESVKENNCASNCHLDGEAAKKLMGEEALAGGDKSDPNLNNPADEDHAYALRMLPKTGCVIQPVPKPAEKAAMAPCIISSPMLSAGPEDLEPPLKRRCLRIRNQNK

SEQ ID NO: 892266 - protein, 268 aa, Homo sapiens; identical to SEQ ID NO: 892265

SEQ ID NO: 892267 - protein, 295 aa, Homo sapiens
GHSLSPRDSKQGSSKSADSPPGCSGQALSLAPTPAEHGRSEVVDLTRRAGSPPGPPGAGGQLGFPGVLQGPQDGVIDLTVGHRARLHNVIHRALHAHVKAEREPGAAERRTCGGCRDGHCSPPAAGDPGPGAPAGPEAAAACNVIVNGTRGAAAEGAKSAEPPPEQPPPPPPPAPPKKLLSPEEPAVSELESVKENNCASNCHLDGEAAKKLMGEEALAGGDKSDPNLNNPADEDHAYALRMLPKTGCVIQPVPKPAEKAAMAPCIISSPMLSAGPEDLEPPLKRRCLRIRNQNK

SEQ ID NO: 892268 - protein, 317 aa, Homo sapiens
MAEMEKEGRPPENKRSRKPAHPVKREINEEMKNFAENTMNELLGWYGYDKVELKDGEDIEFRSYPTDGESRQHISVLKENSLPKPKLPEDSVISPYNISTGYSGLATGNGLSDSPAGSKDHGSVPIIVPLIPPPFIKPPAEDDVSNVQIMCAWCQKVGIKRYSLSMGSEVKSFCSEKCFAACRRAYFKRNKARDEDGHAENFPQQHYAKETPRLAFKNNSNYLNVHSQGTLMERGRRANHVTPSNDTSWSAHHPLWLKLKQIKPLPVIKHLRGSSPPSMASSPEKPAHLGPTKQAQPSCCHHLCFSPEELRDFTPGF

SEQ ID NO: 892269 - protein, 207 aa, Homo sapiens
MAEMEKEGRPPENKRSRKPAHPVKREINEEMKNFAENTMNELLGWYGYDKVELKDGEDIEFRSYPTDGESRQHISVLKENSLPKPKLPEDSVISPYNISTGYSGLATGNGLSDSPAGSKDHGSVPIIVPLIPPPFIKPPAEDDVSNVQIMCAWCQKVGIKRYSLSMGSEVKSFCSEKCFAACRRAYFKRNKVILVCVIQLFPFYQGG

SEQ ID NO: 892270 - protein, 355 aa, Homo sapiens
MAEMEKEGRPPENKRSRKPAHPVKREINEEMKNFAENTMNELLGWYGYDKVELKDGEDIEFRSYPTDGESRQHISVLKENSLPKPKLPEDSVISPYNISTGYSGLATGNGLSDSPAGSKDHGSVPIIVPLIPPPFIKPPAEDDVSNVQIMCAWCQKVGIKRYSLSMGSEVKSFCSEKCFAACRRAYFKRNKARDEDGHAENFPQQHYAKETPRLAFKNNCELLVCDWCKHIRHTKEYLDFGDGERRLQFCSAKCLNQYKMDIFYKETQANLPAGLCSTLHPPMENKAEGTGVQLLTPDSWNIPLTDARRKAPSPVATAGQSQGPGPSASTTVSPSDTANCSVTKIPTPVPKSIPI

SEQ ID NO: 892271 - protein, 291 aa, Homo sapiens
VWVGESWGQTWGEYLGGARWLGWLDLRQSWALSISEEVVKKRDFLFHFLNFLCMLVEDMLLHKLRTLEFLATERTQPLILAQFLRVEVTNFSTSCSGSLRPIFWASSSESDSSAAARAAAASWEGEEAGEEPTSPVTQYLQPRSPEECKMFACAKLACTPSLIRAGSRVAYRPISASVLSRPEASRTGEGSTVFNGAQNGVSQLIQREFQTSAISRDIDTAAKFIGAGAATVGVAGSGAGIGTVFGSLIIGYARNPSLKQQLFSYAILGFALSEAMGLFCLMVAFLILFAM

SEQ ID NO: 892272 - protein, 142 aa, Homo sapiens
MFACAKLACTPSLIRAGSRVAYRPISASVLSRPEASRTGEGSTVFNGAQNGVSQLIQREFQTSAISRDIDTAAKFIGAGAATVGVAGSGAGIGTVFGSLIIGYARNPSLKQQLFSYAILGFALSEAMGLFCLMVAFLILFAM

SEQ ID NO: 892273 - protein, 203 aa, Homo sapiens
YPPGAISRDIDTTAIFHESPTPSTSAAARAAAASWEGEEAGEEPTSPVTQYLQPRSPEECKMFACAKLACTPSLIRAGSRVAYRPISASVLSRPEASRTGEGSTVFNGAQNGVSQLIQREFQTSAISRDIDTAAKFIGAGAATVGVAGSGAGIGTVFGSLIIGYARNPSLKQQLFSYAILGFALSEAMGLFCLMVAFLILFAM

SEQ ID NO: 892274 - protein, 142 aa, Homo sapiens; identical to SEQ ID NO: 892272

SEQ ID NO: 892275 - protein, 105 aa, Homo sapiens
MFACAKLACTPSLIRAGSRVAYRPISASVLSRPEASRTGEGSTVFNGAQNGVSQLIQREFQTSAISRDIDTAAKFIGAGAATVGVAGSGAGIGTVFGSLIIGYAR

SEQ ID NO: 892276 - protein, 163 aa, Homo sapiens
YPPGAISRDIDTTAIFHESPTPSTSAAARAAAASWEGEEAGEEPTSPVTQYLQPRSPEECKMFACAKLACTPSLIRAGSRVAYRPISASVLSRPEASRTGEGSTVFNGAQNGVSQLIQREFQTSAINPSLKQQLFSYAILGFALSEAMGLFCLMVAFLILFAM

SEQ ID NO: 892277 - protein, 142 aa, Homo sapiens; identical to SEQ ID NO: 892272

SEQ ID NO: 892278 - protein, 291 aa, Homo sapiens; identical to SEQ ID NO: 892271

SEQ ID NO: 892279 - protein, 263 aa, Homo sapiens
MTTPDDHTNTHEEANNETNDNAADTPKEEQGRRTVPTQSRERASAGTSRPRPRDARPATSARTHTDDAPTPPMTSNQLASTARRLPRQRHCIEEADQHRRHRKTRQAQLPSRSKQPQQKEPYCDQSADGARPTRREIDGTSSQPSETTSRLDRSSTGHGTCTPHTQAAGRKRETTPKAHGEHEQTANNARRANEQTADQNAPADTKRRRQKKKAPERRKRQAQPDPADSSAQNGARRAAPRDQGTRARTPQMDASRGEDNDVH

SEQ ID NO: 892280 - protein, 105 aa, Homo sapiens; identical to SEQ ID NO: 892275

SEQ ID NO: 892281 - protein, 177 aa, Homo sapiens
RSGAVRRQCGAGGRAGGARRSAGGRRNSKGGPRQGAIGLGLREPETAAAAAAAAAGGAQGTPPLPVLCLGPSLLPRAQCGLASVKCHTMSDRKAVIKNADMSEDMQQDAVDCATQAMEKYNIEKDIAAYIKKEFDKKYNPTWHCIVGRNFGSYVTHETKHFIYFYLGQVAILLFKSG

SEQ ID NO: 892282 - protein, 177 aa, Homo sapiens; identical to SEQ ID NO: 892281

SEQ ID NO: 892283 - protein, 111 aa, Homo sapiens
MFTAQSKELSALPLCSFCECHTMSDRKAVIKNADMSEDMQQDAVDCATQAMEKYNIEKDIAAYIKKEFDKKYNPTWHCIVGRNFGSYVTHETKHFIYFYLGQVAILLFKSG

SEQ ID NO: 892284 - protein, 177 aa, Homo sapiens; identical to SEQ ID NO: 892281

SEQ ID NO: 892285 - protein, 177 aa, Homo sapiens; identical to SEQ ID NO: 892281

SEQ ID NO: 892286 - protein, 177 aa, Homo sapiens; identical to SEQ ID NO: 892281

SEQ ID NO: 892287 - protein, 312 aa, Homo sapiens
MSAFSEAALEKKLSELSNSQQSVQTLSLWLIHHRKHSRPIVTVWERELRKAKPNRKLTFLYLANDVIQNSKRKGPEFTKDFAPVIVEAFKHVSSETDESCKKHLGRVLSIWEERSVYENDVLEQLKQALYGDKKPRKRTYEQIKVDENENCSSLGSPSEPPQTLDLVRALQDLENAASGDAAVHQRIASLPVEVQEVSLLDKITDKESGERLSKMVEDACMLLADYNGRLAAEIDDRKQLTRMLADFLRCQKEALAEKEHKLEEYKRKLARVSLVRKELRSRIQSLPDLSRLPNVTGSHMHLPFAGDIYSED

SEQ ID NO: 892288 - protein, 276 aa, Homo sapiens
MRNSNWRFCQTGIYSKPNRKLTFLYLANDVIQNSKRKGPEFTKDFAPVIVEAFKHVSSETDESCKKHLGRVLSIWEERSVYENDVLEQLKQALYGDKKPRKRTYEQIKVDENENCSSLGSPSEPPQTLDLVRALQDLENAASGDAAVHQRIASLPVEVQEVSLLDKITDKESGERLSKMVEDACMLLADYNGRLAAEIDDRKQLTRMLADFLRCQKEALAEKEHKLEEYKRKLARVSLVRKELRSRIQSLPDLSRLPNVTGSHMHLPFAGDIYSED

SEQ ID NO: 892289 - protein, 312 aa, Homo sapiens; identical to SEQ ID NO: 892287

SEQ ID NO: 892290 - protein, 276 aa, Homo sapiens; identical to SEQ ID NO: 892288

SEQ ID NO: 892291 - protein, 270 aa, Homo sapiens
MSAFSEAALEKKLSELSNSQQSVQTLSLWLIHHRKHSRPIVTVWERELRKAKPNRKLTFLYLANDVIQNSKRKGPEFTKDFAPVIVEAFKHVSSETDESCKKHLGRVLSIWEERSVYENDVLEQLKQALYGDKKPRKRTYEQIKVDENENCSSLGSPSEPPQTLDLVRALQDLENAASGDAAVHQRIASLPVEVQEVSLLDKITDKESGERLSKMVEDACMLLADYNGRLAAEIDDRKQLTRMLADFLRCQKEALAEKEHKLEVRNLFLL

SEQ ID NO: 892292 - protein, 312 aa, Homo sapiens; identical to SEQ ID NO: 892287

SEQ ID NO: 892293 - protein, 312 aa, Homo sapiens; identical to SEQ ID NO: 892287

SEQ ID NO: 892294 - protein, 68 aa, Homo sapiens
SSIRKSNTDRCYGSALRAQEYKRKLARVSLVRKELRSRIQSLPDLSRLPNVTGSHMHLPFAGDIYSED

SEQ ID NO: 892295 - protein, 312 aa, Homo sapiens; identical to SEQ ID NO: 892287

SEQ ID NO: 892296 - protein, 75 aa, Homo sapiens
TFQKEHKTLLRTSYTVIRYSQRRTGKQTGKVHLPMCYCHLRTDSCVDGWNNSWHPRVRKWKKKIQPSGEVTDAQL

SEQ ID NO: 892297 - protein, 289 aa, Homo sapiens
MSAFSEAALEKKLSELSNSQQSVQTLSLWLIHHRKHSRPIVTVWERELRKAKPNRKLTFLYLANDVIQNSKRKGPEFTKDFAPVIVEAFKHVSSETDESCKKHLGRVLSIWEERSVYENDVLEQLKQALYGDKKPRKRTYEQIKVDENENCSSLGSPSEPPQTLDLVRALQDLENAASGDAAVHQRIASLPVEVQEVSLLDKITDKESGERLSKMVEDACMLLADYNGRLAAEIDDRKQLTRMLADFLRCQKEALAEKEHKLEILDMGVSSNDVVTISIFFLLKINIKP

SEQ ID NO: 892298 - protein, 164 aa, Homo sapiens
MEASWGSFNAERGWYVSVQQPEEAEAEELSPLLSNELHRQRSPGVSFGLSVFNLMNAIMGSGILGLAYVMANTGVFGFSFLLLTVALLASYSVHLLLSMCIQTAVTSYEDLGLFAFGLPGKLVVAGTIIIQNIGAMSSYLLIIKTELPAAIAEFLTGDYSRHIK

SEQ ID NO: 892299 - protein, 183 aa, Homo sapiens
MSSYLLIIKTELPAAIAEFLTGDYSRYWYLDGQTLLIIICVGIVFPLALLPKIGFLGYTSSLSFFFMMFFALVVIIKKWSIPCPLTLNYVEKGFQISNVTDDCKPKLFHFSKESAYALPTMAFSFLCHTSILPIYCELQSPSKKRMQNVTNTAIALSFLIYFISALFGYLTFYDEQLKPREVK

SEQ ID NO: 892300 - protein, 456 aa, Homo sapiens
MEASWGSFNAERGWYVSVQQPEEAEAEELSPLLSNELHRQRSPGVSFGLSVFNLMNAIMGSGILGLAYVMANTGVFGFSFLLLTVALLASYSVHLLLSMCIQTAVTSYEDLGLFAFGLPGKLVVAGTIIIQNIGAMSSYLLIIKTELPAAIAEFLTGDYSRYWYLDGQTLLIIICVGIVFPLALLPKIGFLGYTSSLSFFFMMFFALVVIIKKWSIPCPLTLNYVEKGFQISNVTDDCKPKLFHFSKESAYALPTMAFSFLCHTSILPIYCELQSPSKKRMQNVTNTAIALSFLIYFISALFGYLTFYDKVESELLKGYSKYLSHDVVVMTVKLCILFAVLLTVPLIHFPARKAVTMMFFSNFPFSWIRHFLITLALNIIIVLLAIYVPDIRNVFGVVGASTSTCLIFIFPGLFYLKLSREDFLSWKKLGAFVLLIFGILVGNFSLALIIFDWINK

SEQ ID NO: 892301 - protein, 456 aa, Homo sapiens; identical to SEQ ID NO: 892300

SEQ ID NO: 892302 - protein, 459 aa, Homo sapiens
MEASWGSFNAERGWYVSVQQPEEAEAEELSPLLSNELHRQRSPGVSFGLSVFNLMNAIMGSGILGLAYVMANTGVFGFSFLLLTVALLASYSVHLLLSMCIQTAVTSYEDLGLFAFGLPGKLVVAGTIIIQNIGAMSSYLLIIKTELPAAIAEFLTGDYSRYWYLDGQTLLIIICVGIVFPLALLPKIGFLGYTSSLSFFFMMFFALVVIIKKWSIPCPLTLNYVEKGFQISNVTDDCKPKLFHFSKESAYALPTMAFSFLCHTSILPIYCELQSPSKKRMQNVTNTAIALSFLIYFISALFGYLTFYDKVESELLKGYSKYLSHDVVVMTVKLCILFAVLLTVPLIHFPARKAVTMMFFSNFPFSWIRHFLITLALNIIIVLLAIYVPDIRNVFGVVGASTSTCLIFIFPGLFYLKLSREDFLSWKKLGVGVQWCDLSSLQPLPPGLKQSSHLSLQSS

SEQ ID NO: 892303 - protein, 443 aa, Homo sapiens
MEASWGSFNAERGWYVSVQQPEEAEAEELSPLLSNELHRQRSPGVSFGLSVFNLMNAIMGSGILGLAYVMANTGVFGFSFLLLTVALLASYSVHLLLSMCIQTAVTSYEDLGLFAFGLPGKLVVAGTIIIQNIGAMSSYLLIIKTELPAAIAEFLTGDYSRYWYLDGQTLLIIICVGIVFPLALLPKIGFLGYTSSLSFFFMMFFALVVIIKKWSIPCPLTLNYVEKGFQISNVTDDCKPKLFHFSKESAYALPTMAFSFLCHTSILPIYCELQSPSKKRMQNVTNTAIALSFLIYFISALFGYLTFYDKVESELLKGYSKYLSHDVVVMTVKLCILFAVLLTVPLIHFPARKAVTMMFFSNFPFSWIRHFLITLALNIIIVLLAIYVPDIRNVFGVVGASTSTCLIFIFPGLFYLKLSREDFLSWKKLGVGCFCFFLSRLLF

SEQ ID NO: 892304 - protein, 314 aa, Homo sapiens [sequence omitted]

SEQ ID NO: 892305 - protein, 441 aa, Homo sapiens
MEASWGSFNAERGWYVSVQQPEEAEAEELSPLLSNELHRQRSPGVSFGLSVFNLMNAIMGSGILGLAYVMANTGVFGFSFLLLTVALLASYSVHLLLSMCIQTAVTSYEDLGLFAFGLPGKLVVAGTIIIQNIGAMSSYLLIIKTELPAAIAEFLTGDYSRYWYLDGQTLLIIICVGIVFPLALLPKIGFLGYTSSLSFFFMMFFALVVIIKKWSIPCPLTLNYVEKGFQSAYALPTMAFSFLCHTSILPIYCELQSPSKKRMQNVTNTAIALSFLIYFISALFGYLTFYDKVESELLKGYSKYLSHDVVVMTVKLCILFAVLLTVPLIHFPARKAVTMMFFSNFPFSWIRHFLITLALNIIIVLLAIYVPDIRNVFGVVGASTSTCLIFIFPGLFYLKLSREDFLSWKKLGVGVQWCDLSSLQPLPPGLKQSSHLSLQSS

SEQ ID NO: 892306 - protein, 348 aa, Homo sapiens
MEASWGSFNAERGWYVSVQQPEEAEAEELSPLLSNELHRQRSPGVSFGLSVFNLMNAIMGSGILGLAYVMANTGVFGFSFLLLTVALLASYSVHLLLSMCIQTAVTSYEDLGLFAFGLPGKLVVAGTIIIQNIGAMSSYLLIIKTELPAAIAEFLTGDYSRYWYLDGQTLLIIICVGIVFPLALLPKIGFLGYTSSLSFFFMMFFALVVIIKKWSIPCPLTLNYVEKGFQISNVTDDCKPKLFHFSKESAYALPTMAFSFLCHTSILPIYCELQRLACSGVISAHCNLCLPDSSNPPTSASRVAETTEKEEIPWRCAPRGKATQGHSKKATVYKPREEASGEPNVSTP

SEQ ID NO: 892307 - protein, 372 aa, Homo sapiens
MEASWGSFNAERGWYVSVQQPEEAEAEELSPLLSNELHRQRSPGVSFGLSVFNLMNAIMGSGILGLAYVMANTGVFGFSFLLLTVALLASYSVHLLLSMCIQTAVTSYEDLGLFAFGLPGKLVVAGTIIIQNIGAMSSYLLIIKTELPAAIAEFLTGDYSRYWYLDGQTLLIIICVGIVFPLALLPKIGFLGYTSSLSFFFMMFFALVVIIKKWSIPCPLTLNYVEKGFQISNVTDDCKPKLFHFSKEQWAGLIICLPTHGFFLPPQIFLPPPFFPPFFWGGPPPPPQNNPFFLNTNAPPPPPCVFFFSPPPATTRPNHTPPAVLLSPTTKPTVSSFARPLAGGGGAPPPTHPQPPPTRPSEPATHAAPLVY

SEQ ID NO: 892308 - protein, 125 aa, Homo sapiens [sequence omitted]

SEQ ID NO: 892309 - protein, 164 aa, Homo sapiens; identical to SEQ ID NO: 892298

SEQ ID NO: 892310 - protein, 402 aa, Homo sapiens
MNAIMGSGILGLAYVMANTGVFGFSFLLLTVALLASYSVHLLLSMCIQTAVTSYEDLGLFAFGLPGKLVVAGTIIIQNIGAMSSYLLIIKTELPAAIAEFLTGDYSRYWYLDGQTLLIIICVGIVFPLALLPKIGFLGYTSSLSFFFMMFFALVVIIKKWSIPCPLTLNYVEKGFQISNVTDDCKPKLFHFSKESAYALPTMAFSFLCHTSILPIYCELQSPSKKRMQNVTNTAIALSFLIYFISALFGYLTFYDKVESELLKGYSKYLSHDVVVMTVKLCILFAVLLTVPLIHFPARKAVTMMFFSNFPFSWIRHFLITLALNIIIVLLAIYVPDIRNVFGVVGASTSTCLIFIFPGLFYLKLSREDFLSWKKLGAFVLLIFGILVGNFSLALIIFDWINK

SEQ ID NO: 892311 - protein, 164 aa, Homo sapiens; identical to SEQ ID NO: 892298

SEQ ID NO: 892312 - protein, 227 aa, Homo sapiens
MNAIMGSGILGLAYVMANTGVFGFSFLLLTVALLASYSVHLLLSMCIQTDFWKESFLKKERKREKNQIDAIKNDKGVITTDPTEIQTTIREYYKHLYANKLENLEEMDKFLDTYTLPTLNQEEVESLNRPITGSEIVAIINSLPTKKNPGPDGFAAEFYQRYKEELVPFLLKLFQSIEKEGILPNSLYEASIILIPKPGRDTTKKENFRPISLMNMDAKILNKILAN

SEQ ID NO: 892313 - protein, 126 aa, Homo sapiens
MASASTQPAALSAEQAKVVLAEVIQAFSAPENAVRMDEARDNACNDMGKMLQFVLPVATQIQQEVIKAYGFSCDGEGVLKFARLVKSYEAQDPEIASLSGKLKALFLPPMTLPPHGPAAGGSVAAS

SEQ ID NO: 892314 - protein, 126 aa, Homo sapiens; identical to SEQ ID NO: 892313

SEQ ID NO: 892315 - protein, 141 aa, Homo sapiens
MASASTQPAALSAEQAKGENRPSQGIGCWPGVVKAWAAGLGRMRAEDVGDKPGYVRRENGVGDAGYRPSKWGACPQDLGSYWVTYSLNPLIPCALRWARCLFSDAYPGRLPGMLLARSGPRGGDPGVLRPGECSAHGRGSG

SEQ ID NO: 892316 - protein, 103 aa, Homo sapiens
MASASTQPAALSAEQAKVVLAEVIQAFSAPENAVRMDEARDNACNDMGKMLQFVLPVATQIQQEVIKAYGFSCDGEGGSDAGRRVRRGKAGVGSGEGAGSVGP

SEQ ID NO: 892317 - protein, 113 aa, Homo sapiens
MNDLMVLAEVIQAFSAPENAVRMDEARDNACNDMGKMLQFVLPVATQIQQEVIKAYGFSCDGEGVLKFARLVKSYEAQDPEIASLSGKLKALFLPPMTLPPHGPAAGGSVAAS

SEQ ID NO: 892318 - protein, 126 aa, Homo sapiens; identical to SEQ ID NO: 892313

SEQ ID NO: 892319 - protein, 126 aa, Homo sapiens; identical to SEQ ID NO: 892313

SEQ ID NO: 892320 - protein, 75 aa, Homo sapiens
MRENAGYPRSVVSDKPRDTQQRRHNQRDTQRKKATTRRYKEQHTSNNTGDTDSSHTTHNTKNTKPTHIETQHSED

SEQ ID NO: 892321 - protein, 133 aa, Homo sapiens
MASASTQPAALSAEQAKGENRPSQVVLAEVIQAFSAPENAVRMDEARDNACNDMGKMLQFVLPVATQIQQEVIKAYGFSCDGEGVLKFARLVKSYEAQDPEIASLSGKLKALFLPPMTLPPHGPAAGGSVAAS

SEQ ID NO: 892322 - protein, 79 aa, Homo sapiens
MHEVVRKHCMDYLMKNADYFSNYVTEDFTTYINRKRKNNCHGNHIEMQAMAEMYNRPVEVYQYSTEPINTFHGTRHRAL

SEQ ID NO: 892323 - protein, 566 aa, Homo sapiens
MTILPKKKPPPPDADPANEPPPPGPMPPAPRRGGGVGVGGGGTGVGGGDRDRDSGVVGARPRASPPPQGPLPGPPGALHRWALAVPPGAVAGPRPQQASPPPCGGPGGPGGGPGDALGAAAAGVGAAGVVVGVGGAVGVGGCCSGPGHSKRRRQAPGVGAVGGGSPEREEVGAGYNSEDEYEAAAARIEAMDPATVEQQEHWFEKALRDKKGFIIKQMKEDGACLFRAVADQVYGDQDMHEVVRKHCMDYLMKNADYFSNYVTEDFTTYINRKRKNNCHGNHIEMQAMAEMYNRPVEVYQYSTEPINTFHGIHQNEDEPIRVSYHRNIHYNSVVNPNKATIGVGLGLPSFKPGFAEQSLMKNAIKTSEESWIEQQMLEDKKRATDWEATNEAIEEQVARESYLQWLRDQEKQARQVRGPSQPRKASATCSSATAAASSGLEEWTSRSPRQRSSASSPEHPELHAELGMKPPSPGTVLALAKPPSPCAPGTSSQFSAGADRATSPLVSLYPALECRALIQQMSPSAFGLNDWDDDEILASVLAVSQQEYLDSMKKNKVHRDPPPDKS

SEQ ID NO: 892324 - protein, 542 aa, Homo sapiens
MTILPKKKPPPPDADPGGTGVGGGDRDRDSGVVGARPRASPPPQGPLPGPPGALHRWALAVPPGAVAGPRPQQASPPPCGGPGGPGGGPGDALGAAAAGVGAAGVVVGVGGAVGVGGCCSGPGHSKRRRQAPGVGAVGGGSPEREEVGAGYNSEDEYEAAAARIEAMDPATVEQQEHWFEKALRDKKGFIIKQMKEDGACLFRAVADQVYGDQDMHEVVRKHCMDYLMKNADYFSNYVTEDFTTYINRKRKNNCHGNHIEMQAMAEMYNRPVEVYQYSTEPINTFHGIHQNEDEPIRVSYHRNIHYNSVVNPNKATIGVGLGLPSFKPGFAEQSLMKNAIKTSEESWIEQQMLEDKKRATDWEATNEAIEEQVARESYLQWLRDQEKQARQVRGPSQPRKASATCSSATAAASSGLEEWTSRSPRQRSSASSPEHPELHAELGMKPPSPGTVLALAKPPSPCAPGTSSQFSAGADRATSPLVSLYPALECRALIQQMSPSAFGLNDWDDDEILASVLAVSQQEYLDSMKKNKVHRDPPPDKS

SEQ ID NO: 892325 - protein, 566 aa, Homo sapiens; identical to SEQ ID NO: 892323

SEQ ID NO: 892326 - protein, 566 aa, Homo sapiens; identical to SEQ ID NO: 892323

SEQ ID NO: 892327 - protein, 407 aa, Homo sapiens
DVFQSFRLTAFKLESWRGGVFPVVRGTGHAVRPQYRRLQQEHWFEKALRDKKGFIIKQMKEDGACLFRAVADQVYGDQDMHEVVRKHCMDYLMKNADYFSNYVTEDFTTYINRKRKNNCHGNHIEMQAMAEMYNRPVEVYQYSTEPINTFHGIHQNEDEPIRVSYHRNIHYNSVVNPNKATIGVGLGLPSFKPGFAEQSLMKNAIKTSEESWIEQQMLEDKKRATDWEATNEAIEEQVARESYLQWLRDQEKQARQVRGPSQPRKASATCSSATAAASSGLEEWTSRSPRQRSSASSPEHPELHAELGMKPPSPGTVLALAKPPSPCAPGTSSQFSAGADRATSPLVSLYPALECRALIQQMSPSAFGLNDWDDDEILASVLAVSQQEYLDSMKKNKVHRDPPPDKS

SEQ ID NO: 892328 - protein, 328 aa, Homo sapiens
MHEVVRKHCMDYLMKNADYFSNYVTEDFTTYINRKRKNNCHGNHIEMQAMAEMYNRPVEVYQYSTEPINTFHGIHQNEDEPIRVSYHRNIHYNSVVNPNKATIGVGLGLPSFKPGFAEQSLMKNAIKTSEESWIEQQMLEDKKRATDWEATNEAIEEQVARESYLQWLRDQEKQARQVRGPSQPRKASATCSSATAAASSGLEEWTSRSPRQRSSASSPEHPELHAELGMKPPSPGTVLALAKPPSPCAPGTSSQFSAGADRATSPLVSLYPALECRALIQQMSPSAFGLNDWDDDEILASVLAVSQQEYLDSMKKNKVHRDPPPDKS

SEQ ID NO: 892329 - protein, 328 aa, Homo sapiens; identical to SEQ ID NO: 892328

SEQ ID NO: 892330 - protein, 566 aa, Homo sapiens; identical to SEQ ID NO: 892323

SEQ ID NO: 892331 - protein, 566 aa, Homo sapiens; identical to SEQ ID NO: 892323

SEQ ID NO: 892332 - protein, 566 aa, Homo sapiens; identical to SEQ ID NO: 892323

SEQ ID NO: 892333 - protein, 566 aa, Homo sapiens; identical to SEQ ID NO: 892323

SEQ ID NO: 892334 - protein, 566 aa, Homo sapiens; identical to SEQ ID NO: 892323

SEQ ID NO: 892335 - protein, 566 aa, Homo sapiens; identical to SEQ ID NO: 892323

SEQ ID NO: 892336 - protein, 566 aa, Homo sapiens; identical to SEQ ID NO: 892323

SEQ ID NO: 892337 - protein, 602 aa, Homo sapiens
MTILPKKKPPPPDADPANEPPPPGPMPPAPRRGGGVGVGGGGTGVGGGDRDRDSGVVGARPRASPPPQGPLPGPPGALHRWALAVPPGAVAGPRPQQASPPPCGGPGGPGGGPGDALGAAAAGVGAAGVVVGVGGAVGVGGCCSGPGHSKRRRQAPGVGAVGGGSPEREEVGAGYNSEDEYEAAAARIEAMDPATVEQQEHWFEKALRDKKGFIIKQMKEDGACLFRAVADQVYGDQDMHEVVRKHCMDYLMKNADYFSNYVTEDFTTYINRKRKNNCHGNHIEMQAMAEMYNRPVEVYQYSTEPINTFHGIHQNEDEPIRVSYHRNIHYNSVVNPNKATIGVGLGLPSFKPGFAEQSLMKNAIKTSEESWIEQQMLEDKKRATDWEATNEAIEEQVARESYLQWLRDQEKQARQVRGPSQPRKASATCSSATAAASSGLEEWTSRSPRQRSSASSPEHPELHAELGMKPPSPGTVLALAKPPSPCAPGTSSQFSAGADRATSPLVSLYPALECRALIQQMSPSAFGKPPLSGGMEAARSWERLEEVASPERGFLEPLAISPRKEGRGTGGDFSDPRNLPQKGLGSKWGFTGLADPSVLRKE

SEQ ID NO: 892338 - protein, 566 aa, Homo sapiens; identical to SEQ ID NO: 892323

SEQ ID NO: 892339 - protein, 588 aa, Homo sapiens
MTILPKKKPPPPDADPANEPPPPGPMPPAPRRGGGVGVGGGGTGVGGGDRDRDSGVVGARPRASPPPQGPLPGPPGALHRWALAVPPGAVAGPRPQQASPPPCGGPGGPGGGPGDALGAAAAGVGAAGVVVGVGGAVGVGGCCSGPGHSKRRRQAPGVGAVGGGSPEREEVGAGYNSEDEYEAAAARIEAMDPATVEQQEHWFEKALRDKKGFIIKQMKEDGACLFRAVADQVYGDQDMHEVVRKHCMDYLMKNADYFSNYVTEDFTTYINRKRKNNCHGNHIEMQAMAEMYNRPVEVYQYSTEPINTFHGIHQNEDEPIRVSYHRNIHYNSVVNPNKATIGVGLGLPSFKPGFAEQSLMKNAIKTSEESWIEQQMLEDKKRATDWEATNEAIEEQVARESYLQWLRDQEKQARQVRGPSQPRKASATCSSATAAASSGLEEWTSRSPRQRSSASSPEHPELHAELGMKPPSPGTVLALAKPPSPCAPGTSSQFSAGADRATSPLVSLYPALECRALIQQMSPSAFGLNDWDDDEILASVLAVSQQEYLDSMKKNKVHRDPPPERVWDPVGLPPYLFRGHFGSPALFG

SEQ ID NO: 892340 - protein, 401 aa, Homo sapiens
MTILPKKKPPPPDADPANEPPPPGPMPPAPRRGGGVGVGGGGTGVGGGDRDRDSGVVGARPRASPPPQGPLPGPPGALHRWALAVPPGAVAGPRPQQASPPPCGGPGGPGGGPGDALGAAAAGVGAAGVVVGVGGAVGVGGCCSGPGHSKRRRQAPGVGAVGGGSPEREEVGAGYNSEDEYEAAAARIEAMDPATVEQQEHWFEKALRDKKGFIIKQMKEDGACLFRAVADQVYGDQDMHEVVRKHCMDYLMKNADYFSNYVTEDFTTYINRKRKNNCHGNHIEMQAMAEMYNRPVEVYQYSTEPINTFHGIHQNEDEPIRVSYHRNIHYNSVVNPNKATIGVGLGLPSFKPGFAEQSLMKNVQAVSSRQGPTGQLPPLCPSTLLWSAGPSFSRCPPLPLV

SEQ ID NO: 892341 - protein, 605 aa, Homo sapiens
MTILPKKKPPPPDADPANEPPPPGPMPPAPRRGGGVGVGGGGTGVGGGDRDRDSGVVGARPRASPPPQGPLPGPPGALHRWALAVPPGAVAGPRPQQASPPPCGGPGGPGGGPGDALGAAAAGVGAAGVVVGVGGAVGVGGCCSGPGHSKRRRQAPGVGAVGGGSPEREEVGAGYNSEDEYEAAAARIEAMDPATVEQQEHWFEKALRDKKGFIIKQMKEDGACLFRAVADQVYGDQDMHEVVRKHCMDYLMKNADYFSNYVTEDFTTYINRKRKNNCHGNHIEMQAMAEMYNRPVEVYQYSTEPINTFHGIHQNEDEPIRVSYHRNIHYNSVVNPNKATIGVGLGLPSFKPGFAEQSLMKNAIKTSEESWIEQQMLEDKKRATDWEATNEAIEEQVARESYLQWLRDQEKQARQVRGPSQPRKASATCSSATAAASSGLEEWTSRSPRQRSSASSPEHPELHAELGMKPPSPGTVLALAKPPSPCAPGTSSQFSAGADRATSPLVSLYPALECRALIQQMSPSAFGTRARVPKIDKRHTETDQLAARQPQRRETFRQRKVSLPLIPSKMRKTCRHPPTLMPGRWEEEVGNFPSQYPQERLSLQC

SEQ ID NO: 892342 - protein, 721 aa, Homo sapiens
MTILPKKKPPPPDADPANEPPPPGPMPPAPRRGGGVGVGGGGTGVGGGDRDRDSGVVGARPRASPPPQGPLPGPPGALHRWALAVPPGAVAGPRPQQASPPPCGGPGGPGGGPGDALGAAAAGVGAAGVVVGVGGAVGVGGCCSGPGHSKRRRQAPGVGAVGGGSPEREEVGAGYNSEDEYEAAAARIEAMDPATVEQQEHWFEKALRDKKGFIIKQMKEDGACLFRAVADQVYGDQDMHEVVRKHCMDYLMKNADYFSNYVTEDFTTYINRKRKNNCHGNHIEMQAMAEMYNRPVEVYQYSTEPINTFHGIHQNEDEPIRVSYHRNIHYNSVVNPNKATIGVGLGLPSFKPGFAEQSLMKNAIKTSEESWIEQQMLEDKKRATDWEATNEAIEEQVARESYLQWLRDQEKQARQVRGPSQPRKASATCSSATAAASSGLEEWTSRSPRQRSSASSPEHPELHAELGMKPPSPGTVLALAKPPSPCAPGTSSQFSAGADRATSPLVSLYPALECRALIQQMSPSAFGKPPLSGGMEAARSWERLEEVASPERGFLEPLAISPRKEGRGTGGDFSDPRNLPQKGLGSKWGFTGLADPSVLRKEEKGPMGFLQSPRCRHRVRRRQAESAPSSFSSSSRPAGLNDWDDDEILASVLAVSQQEYLDSMKKNKISFHSPMSIYLRPITFYIPKQYPIRLPIKNYFITLHINKVIKFPKRESAVRPT

SEQ ID NO: 892343 - protein, 182 aa, Homo sapiens
LLFGSTCFPVSFFFWGLWAYLAEPVLALGQVQCVIAHPCSSPSLQFAEQSLMKNAIKTSEESWIEQQMLEDKKRATDWEATNEAIEEQVARESYLQWLRDQEKQARQVRGPSQPRKASATCSSATAAASSGLEEWTSRSPRQRSSASSPEHPELHAELGMKPPSPGTVLALAKPPSPCAPGQ

SEQ ID NO: 892344 - protein, 167 aa, Homo sapiens [sequence omitted]

SEQ ID NO: 892345 - protein, 308 aa, Homo sapiens
MTILPKKKPPPPDADPANEPPPPGPMPPAPRRGGGVGVGGGGTGVGGGDRDRDSGVVGARPRASPPPQGPLPGPPGALHRWALAVPPGAVAGPRPQQASPPPCGGPGGPGGGPGDALGAAAAGVGAAGVVVGVGGAVGVGGCCSGPGHSKRRRQAPGVGAVGGGSPEREEVGAGYNSEDEYEAAAARIEAMDPATVEQQEHWFEKALRDKKGFIIKQMKEDGACLFRAVADQVYGDQDMHEVVRKHCMDYLMKNADYFSNYVTEDFTTYINRKRKNNCHGNHIEMQAMAEMYNRPVEVYQYSTDFCSG

SEQ ID NO: 892346 - protein, 1237 aa, Homo sapiens
MQKSVRYNEGHALYLAFLARKEGTKRGFLSKKTAEASRWHEKWFALYQNVLFYFEGEQSCRPAGMYLLEGCSCERTPAPPRAGAGQGGVRDALDKQYYFTVLFGHEGQKPLELRCEEEQDGKEWMEAIHQASYADILIEREVLMQKYIHLVQIVETEKIAANQLRHQLEDQDTEIERLKSEIIALNKTKERMRPYQSNQEDEDPDIKKIKKVQSFMRGWLCRRKWKTIVQDYICSPHAESMRKRNQIVFTMVEAESEYVHQLYILVNGFLRPLRMAASSKKPPISHDDVSSIFLNSETIMFLHEIFHQGLKARIANWPTLILADLFDILLPMLNIYQEFVRNHQYSLQVLANCKQNRDFDKLLKQYEANPACEGRMLETFLTYPMFQIPRYIITLHELLAHTPHEHVERKSLEFAKSKLEELSRVMHDEVSDTENIRKNLAIERMIVEGCDILLDTSQTFIRQGSLIQVPSVERGKLSKVRLGSLSLKKEGERQCFLFTKHFLICTRSSGGKLHLLKTGGVLSLIDCTLIEEPDASDDDSKGSGQVFGHLDFKIVVEPPDAAAFTVVLLAPSRQEKAAWMSDISQCVDNIRCNGLMTIVFEENSKVTVPHMIKSDARLHKDDTDICFSKTLNSCKVPQIRYASVERLLERLTDLRFLSIDFLNTFLHTYRIFTTAAVVLGKLSDIYKRPFTSIPVRSLELFFATSQNNRGEHLVDGKSPRLCRKFSSPPPLAVSRTSSPVRARKLSLTSPLNSKIGALDLTTSSSPTTTTQSPAASPPPHTGQIPLDLSRGLSSPEQSPGTVEENVDNPRVDLCNKLKRSIQKAVLESAPADRAGVESSPAADTTELSPCRSPSTPRHLRYRQPGGQTADNAHCSVSPASAFAIATAAAGHGSPPGFNNTERTCDKEFIIRRTATNRVLNVLRHWVSKHAQDFELNNELKMNVLNLLEEVLRDPDLLPQERKAAANILRALSQDDQDDIHLKLEDIIQMTDCMKAECFESLSAMELAEQITLLDHVIFRSIPYEEFLGQGWMKLDKNERTPYIMKTSQHFNDMSNLVASQIMNYADVSSRANAIEKWVAVADICRCLHNYNGVLEITSALNRSAIYRLKKTWAKVSKQTKALMDKLQKTVSSEGRFKNLRETLKNCNPPAVPYLGMYLTDLAFIEEGTPNFTEEGLVNFSKMRMISHIIREIRQFQQTSYRIDHQPKVAQYLLDKDLIIDEDTLYELSLKIEPRLPA

SEQ ID NO: 892347 - protein, 1151 aa, Homo sapiens
MQKSVRYNEGHALYLAFLARKEGTKRGFLSKKTAEASRWHEKWFALYQNVLFYFEGEQSCRPAGMYLLEGCSCERTPAPPRAGAGQGGVRDALDKQYYFTVLFGHEGQKPLELRCEEEQDGKEWMEAIHQASYADILIEREVLMQKYIHLVQIVETEKIAANQLRHQLEDQDTEIERLKSEIIALNKTKERMRPYQSNQEDEDPDIKKIKKVQSFMRGWLCRRKWKTIVQDYICSPHAESMRKRNQIVFTMVEAESEYVHQLYILVNGFLRPLRMAASSKKPPISHDDVSSIFLNSETIMFLHEIFHQGLKARIANWPTLILADLFDILLPMLNIYQEFVRNHQYSLQVLANCKQNRDFDKLLKQYEANPACEGRMLETFLTYPMFQIPRYIITLHELLAHTPHEHVERKSLEFAKSKLEELSRVMHDEVSDTENIRKNLAIERMIVEGCDILLDTSQTFIRQGSLIQVPSVERGKLSKVRLGSLSLKKEGERQCFLFTKHFLICTRSSGGKLHLLKTGGVLSLIDCTLIEEPDASDDDSKGSGQVFGHLDFKIVVEPPDAAAFTVVLLAPSRQEKAAWMSDISQCVDNIRCNGLMTIVFEENSKVTVPHMIKSDARLHKDDTDICFSKTLNSCKVPQIRYASVERLLERLTDLRFLSIDFLNTFLHTYRIFTTAAVVLGKLSDIYKRPFTSIPVRSLELFFATSQNNRGEHLVDGKSPRLCRKFSSPPPLAVSRTSSPVRARKLSLTSPLNSKIGALDLTTSSSPTTTTQSPAASPPPHTGQIPLDLSRGLSSPEQSPGTVEENVDNPRVDLCNKLKRSIQKAVLESAPADRAGVESSPAADTTELSPCRSPSTPRHLRYRQPGGQTADNAHCSVSPASAFAIATAAAGHGSPPGFNNTERTCDKEFIIRRTATNRVLNVLRHWVSKHAQDFELNNELKMNVLNLLEEVLRDPDLLPQERKAAANILRALSQDDQDDIHLKLEDIIQMTDCMKAECFESLSAMELAEQITLLDHVIFRSIPYEEFLGQGWMKLDKNERTPYIMKTSQHFNDMSNLVASQIMNYADVSSRANAIEKWVAVADICRCLHNYNGVLEITSALNRSAIYRLKKTWAKVSKQTKALMDKLQKTVSSEGRFKNLRETLKKYVYLNY

SEQ ID NO: 892348 - protein, 564 aa, Homo sapiens
MQKSVRYNEGHALYLAFLARKEGTKRGFLSKKTAEASRWHEKWFALYQNVLFYFEGEQSCRPAGMYLLEGCSCERTPAPPRAGAGQGGVRDALDKQYYFTVLFGHEGQKPLELRCEEEQDGKEWMEAIHQASYADILIEREVLMQKYIHLVQIVETEKIAANQLRHQLEDQDTEIERLKSEIIALNKTKERMRPYQSNQEDEDPDIKKIKKVQSFMRGWLCRRKWKTIVQDYICSPHAESMRKRNQIVFTMVEAESEYVHQLYILVNGFLRPLRMAASSKKPPISHDDVSSIFLNSETIMFLHEIFHQGLKARIANWPTLILADLFDILLPMLNIYQEFVRNHQYSLQVLANCKQNRDFDKLLKQYEANPACEGRMLETFLTYPMFQIPRYIITLHELLAHTPHEHVERKSLEFAKSKLEELSRVMHDEVSDTENIRKNLAIERMIVEGCDILLDTSQTFIRQGTMKNSNTIIVKHEWGRQLHSDWTLLLSGPDILCSSKEDRSAWPTAVAVPSADDTQAKAQEKLALLKALSHKTGDHVRSENSCLLFPFFISTSGSAPHDII

SEQ ID NO: 892349 - protein, 610 aa, Homo sapiens
MQKSVRYNEGHALYLAFLARKEGTKRGFLSKKTAEASRWHEKWFALYQNVLFYFEGEQSCRPAGMYLLEGCSCERTPAPPRAGAGQGGVRDALDKQYYFTVLFGHEGQKPLELRCEEEQDGKEWMEAIHQASYADILIEREVLMQKYIHLVQIVETEKIAANQLRHQLEDQDTEIERLKSEIIALNKTKERMRPYQSNQEDEDPDIKKIKKVQSFMRGWLCRRKWKTIVQDYICSPHAESMRKRNQIVFTMVEAESEYVHQLYILVNGFLRPLRMAASSKKPPISHDDVSSIFLNSETIMFLHEIFHQGLKARIANWPTLILADLFDILLPMLNIYQEFVRNHQYSLQVLANCKQNRDFDKLLKQYEANPACEGRMLETFLTYPMFQIPRYIITLHELLAHTPHEHVERKSLEFAKSKLEELSRVMHDEVSDTENIRKNLAIERMIVEGCDILLDTSQTFIRQGSLIQVPSVERGKLSKVRLGSLSLKKEGERQCFLFTKHFLICTRSSGGKLHLLKTGGVLSLIDCTLIEEPDASDDDSKGSGQVFGHLDFKIVVEPPDAAAFTVVLLAPSRQEKAAWMSDISQRSKHPLQECLMLDFYLYTLRMASMA

SEQ ID NO: 892350 - protein, 249 aa, Homo sapiens [sequence omitted]

SEQ ID NO: 892351 - protein, 186 aa, Homo sapiens
MQKSVRYNEGHALYLAFLARKEGTKRGFLSKKTAEASRWHEKWFALYQNVLFYFEGEQSCRPAGMYLLEGCSCERTPAPPRAGAGQGGVRDALDKQYYFTVLFGHEGQKPLELRCEEEQDGKEWMEAIHQASYADILIEREVLMQKYIHLVQIVETEKIAANQLRHQLEDQDTEIERLKSEVFPSQ

SEQ ID NO: 892352 - protein, 184 aa, Homo sapiens
MQVPQDGEDLAGQPWYHGLLSRQKAEALLQQNGDFLVRASGSRGGNPVISCRWRGSALHFEVFRVALRPRPGRPTALFQLEDEQFPSIPALVHSYMTGRRPLSQATGAVVSRPVTWQGPLRRSFSEDTLMDGPARIEPLRARKWSNSQPADLAHMGRSREDPAGMGKCLLEWPVAQGLALPLTT

SEQ ID NO: 892353 - protein, 592 aa, Homo sapiens
MQVPQDGEDLAGQPWYHGLLSRQKAEALLQQNGDFLVRASGSRGGNPVISCRWRGSALHFEVFRVALRPRPGRPTALFQLEDEQFPSIPALVHSYMTGRRPLSQATGAVVSRPVTWQGPLRRSFSEDTLMDGPARIEPLRARKWSNSQPADLAHMGRSREDPAGMEASTMPISALPRTSSDPVLLKAPAPLGTVADSLRASDGQLQAKAPTKPPRTPSFELPDASERPPTYCELVPRVPSVQGTSPSQSCPEPEAPWWEAEEDEEEENRCFTRPQAEISFCPHDAPSCLLGPQNRPLEPQVLHTLRGLFLEHHPGSTALHLLLVDCQATGLLGVTRDQRGNMGVSSGLELLTLPHGHHLRLELLERHQTLALAGALAVLGCSGPLEERAAALRGLVELALALRPGAAGDLPGLAAVMGALLMPQVSRLEHTWRQLRRSHTEAALAFEQELKPLMRALDEGAGPCDPGEVALPHVAPMVRLLEGEEVAGPLDESCERLLRTLHGARHMVRDAPKFRKVAAQRLRGERSLCAGLQTSEHPAGFRPNPELREALTTGFVRRLLWGSRGAGAPRAERFEKFQRVLGVLSQRLEPDR
